United States Patent 11,913,074 (METHODS FOR ASSESSING RISK OF DEVELOPING A VIRAL DISEASE USING A GENETIC TEST) - sequence listing, part 3

SEQ ID NO: 93 - DNA, 2526685 bp, Homo sapiens
  source 1..2526685: mol_type = genomic DNA
aacagatcgcatgacctttagttcatggactttgaaaaccaatttgatataagagactcctctatttttttctaaatgatgtccaaggggatcgaggttgctagatagataaattccagagaaaggctgttagctaacaataacacactaaaactagccagctacatttatttcccttagtcatttcaaatttgtcaccaacttccaaaaaacacaatttacttaagatttaaaacaatatattcaatacttccagagtttggttatctgtaatcctttctcatatccactgcaactaagaacttaccttaactggaacttaaggtactcctgttgtaccaagtatccttttagttaaaagaaaaagccctggccgggcgcagttgttcacgcccataatcccagcactttgggaggccaaggcaggccgatgacttgaggccaggagttctagactaccctagccaacatggtgaaaccccatctctacttaaaaaaaaaaaaaaatacaaaaaattagctgggcatgctgatgcacccttgtagtcccagctactcgggaggctgaggcagaactgtttgaacctgggaggtggaggttgcagtgagccaaaattgcaccactgcactccagcctgggtgacacagtgagattctgcctcaaaaaaaaaaaaaaaaaaaaaaaaaaaaaaaaaaaaggaaagcccttattttaagtgcagagtaggtgagattattacttttgattttggctagtccatcaagaagaaaagttgacccacaaggtccagaaggataacatgtgataaaatgctaaccagattttcaagaatcttttatgcctccagctttgcttgcactgcttcagccagtttaactggtatcatcctacatgcacccattttctccaccacagttaaaatctctggtttaactgtcctcctataaagtttttcctgagttcctcttatgctgaattagccactgcactttttgcaaataatacctatcatagaaacctcctggggtagagattgtaccttattcacctattatctccctcacctgccaaaatatctgccacataaaaggtactccattaatgtgtcaaataactaaatgttgttaagaatcctttcttatatacataattacctcatagaaaaaagtaatttttggtctttctggtgcaaaaggttgcattattttataagatttataaaatattttttaaaagctatgtttcctttgtttttggaataccatagtgattttcaaagaaaacacattatcaggatcatctgagaaattcttttcagcctgaaaatgggcagcgcttcccctaacttgctcccctcctcagcctttgttacgtgcagcctcagatactgggaaatactgagaaatattttcggactgatccactgttacttatgagagtatgtcattctgtcaccttcctcaagtctaggggtgttaaaacaaaaattgagacagtctgagattcaagttctaacgctgtatattttcctgaatagggacaataactgtttatatgcaaagtctttttccttttttttttttggcggtggtggggcagggacgggacagagtctcactctgttgcccaggctggagtgcacaggcatgatctcggctcactacaacccctgcctcccatgttcaagcgattcttgtgcctcagccttccctgtagctagaattacaggcacatgccaccacacccagctagtttttgtatttttagtagagacagggtttcaccatgttggccaggctggtctcaaactcctgacctcagtggtcaggctggtctcaaactcctgacctcaagtgatctgcccacctcagcctcccaaagtgctaggattacaggcgtgagccacagtgcccagcctcaaagtcctttttctaagtaagagcaaagtattttatactaaagcattttaatacatccattaatgaaacattaacaaaataataaaaatataacttaccaatgttggaataatattcacttaatattttgatttcatggcaaaattgatacaaaatattaacttaaatttctgtatttatttacaaattcacaaaaagacagctgcaaacaggaagagaaaccacgcagacttcccaagagcctcttttccttattgaaacttcctttaagcatgcataattaaagcaatccatattcccttgtagcataaaaagttaagcaacaccgaggcaaggaaaaaccagctattttgagcaacccaaaaccaagctgctaaaacaaaatatacaggacccacagtaacactggagtcattaagaagttcctgtcctcttgtttcattttcatcgtgcactttctggtaatgctccaataaatcaatagcagttatacatcttttcatacataaggggcagatgaaaccctgtgaaataacaacttttagaaaaatatacagaaaaatatttttataaaacaagacaatgcaaatagaaataacaagaaaataactagtgtatctcttctggtatacgtaaggaaaattttcaagtggtaactgtacaaaaggtgaaaatctatccaaagtaggacttctaaaattagttcccatccttatgctataaatttgcattggttcaattccttttcattatggtatccagttgcttcagttagaatattattttgtttatgacacttttaaaaaattctttctgcttatgatactttgtccttacctatgtaagacctattatcggcaagttagcttttattttatttatttatttatgagacagtttcactctgttgcccaagctgtagtgcaatggtgccatctcagctcactgccatctccgcctccggggttcaaggggttcttgtgcctcagcctcccgagtagctgggactacaggcgcgtaccaccaggcccagctaatttttttttttttttttttgagacggagtctcactctgtcgcccaggctggagtgcagtggcacgatcttggctcactgcaacctcctcctcccaggttcaagcaattctcctgcctcggcctcctgagtagctgagactacaggcatgtgccaccacacctggccaatttttgtatttttagtagaaatggggtttcaccatgttggccaggctggtctccaactcctaacctgagaagatctgtctgcctcggcctcccaaggtactgggattacaggcgtgggccaccacgcccagccgagatcaagaaattactggcaagtataacaaatacttttatgtcatataatgtgttcaacaaagaagttctctttgaaagtaatttaatgaaagtaatttttagtctttactatattccactaggttgagatcccattcttccccacacccataattcccagcagatgattcttccttgtaattttctgagccaaataaaaccatcttcaaacagtattttaaattacatatacctaacaatatctatattttaaaatatgggctgttatactgatgtatgtatggcttgaggttttgtcaaataagaataataggatgaggggctgggcatggtggctcatgcctgcatccccagcactttgggaggccaaggcaggcagatcacttgaggtcaggagttcgagaccagtctggccaacatggtgaaaccccatctctcctaaaaatacaaaaattagccaggcatggtggtgtgcacctgtaatcccagctactagggaggctcaggccagagaatggcttgaacccgggaggggggaggttgcagtgagccaagatcacaccactgcactccagcctgggtgacagagtcagactctgtctcaaacaaaaaaaagaataataggatgagagactagaattgaaagcatcagggagaaagtaaataaaatgaagacagcaataagcatgaaatgttataacatcatgagtgtcagtgtcaaaaatagatgtggacttgggtcttgggtctcaaccaatgcctgattatatgaccttaaggaaatcactttgctttgcttaaatgtccttatctataaaatggggctaatactagcacctattcttctagagtttttgtgtatataaaatactaaatacagtgcttgagatattgtaagtgctcaacgaatatgaattgtcattagatgtacgcttaaagatgaaagggaaagactgagagactagatgaaaagatagcaattaaaaacctagattactcagcaaggccaaggaaatgaagtaatgagaatatgaagaagaaagtttgtgaaaggatagacaattatagtaaagaatggggagatatgactttaatatttcaggtgaaactattgtgcctgatgatacagtagaaggtactgccatggaattaagtagcaagaaaagagatacgaaagatcattgacattgacaacattaaggaactgggaggttaaaatgttccttgagttatcaaagtcacttagaatagcaaggagagagaggaagactgaaaacagatgccagatgggaagcaagacagggtagcaattaagagctaggcttgggcttgaatcctggattcatatcactcttagtagctatgagaccttcaattgcctcatctgttaagtggaataacaataacacctacttcatatgaatctcatgacaattaaataagataatacatgcaatgcatttatcattgtacctggtacaaagaaaacattcagtaaatgttagctatcattactttaattattccttttgttaataacctttaaaggagattatccaggggatgaaaatgaggaatatgagttcatctttttttttaactgatgaaagagttgtcttccagatgaccacagtctcaagtgctagaactacagaacaattcttctttaaaagatgcttcagcccagcacagtggctcacacctgtaatgccagcactttgggaggctaaagcaggcagatcgcttgagcctaggaatttgagacctgccttggcaacatggcaaattcccatctctacaaaaaatacaaaaaaaaaaaatttagccaggcatggtggcatgcacctatagtcccaggtacttaggaggttgaggcgggaggatcacttgagcccaggaggtccgggctgcggtagccatgttcacaccactgcactccagcccaggcaatagagtgagaccctgtctcaaaaaagaaagagaaaaaagaaaaaaagaaaaagaaaatatgcttcatttgttttgtattgtttgagacagagtctcgctctgtcacccaggctggagtgcagtggcacaatctcggctcactgcaacctctgcctcccaggttcaagcgattctcctgcctcagcctcccgagtagctgggattacaggcgcttgccgccaggcctggctaatttttgtatttttagtagagacggggtttcaccatgttggccaagctggtctcgaactcctgacctcaggtgatccgcctgcctcagcctcccaaagtgctgggattacaggcgtgagccacagtgcccagctgttttgttattgccaccatagctttaggctgcctttcactttactcttgtttttcactgttaagtttccatatacagtcattcattcaaaaagtatttacttgctggtattctaccatgcagtagggtaactgtggttaacagtgaaatattgtatatcacaaaatagctaaaagacagccttttgaatgctctcaccacaaagaaatgatacatgaataaggtgatggatacactacactgatcggattattatacaacatacatatgtattgaacatcaaaatgtaacccacaaataggtgtaattaaaatgtgtcaatttaaaaagtaaataaatttttttaagtaatatacgattttttaaaaatcacatgggcatgtgattactatgttctagctgttgtggtatggtgctaagaatacaatgataaataagacaaggtcttcaccctcaagaagcttacagcctctctgaaaaagttacccaaaaaaatgacattttaggccagacacagtggctcatgcctataatcctagcactttgagaggctgaggcaggcggatcacaaggtcaagagatcaagactatcctggccaatggtctattaaaaatacaaaaattagctgggcatggtggcacgcgcctgtggtctcagctactcgggaggctaaggcaggagaatctcttgaacccaggaggcagagattgcagtgagctgagattgcaccactgcactccagactgggcgacagagtgatactctgtctcaaaaaagaaaaacttacattttatgccccactaatcagaaaatcctattaaatccacattgaaaatgcatccagaatctcagcacctctactgttaccactctgctccaagtcaccatcacattgtacacagatcattacaacagcctcctaacactctttgctcctaccctcaccccactaacacacagcagctagagtgtatcccataaaaatgcaaatcaaatcttgtcgtttccttgcttaaaattatccgatagctttctacgacagtaacagttaaaaactaaagtctgtataatagtctataaggccctacaagaggcagacccgatcgctgacccaatctcccccttgctcactatgctacagctacaatagcctcctggttgctttttcaacatgacaggcatattcccaccttagagacctgctgttccacagacctggaaaaatacttgccccagaaatccacgtgactcatttcctcacctccttcagttctttttgtgttatcccctcctcagagaagtcttccctgataactatttaaaattgcagccaccaagaacactttatatgcctcctttcctgctttatttttttcaataacaccaactgtctaacttgatacattttttatttatttatttttgagacagggtctcactctatcatcccagctggaatgcagtggcagaatcatgattaacttgcggcctcgaactgctgggctcaagcgatcctcccaccttagcctcccgagtagctgagaatacaggtgcatgccaccactcctggctaattttcttttttattttttgtagagatggcatctccctatgttgtccaggctggtcttaggcgatcctcccaccacagcctcccaaagtgctgagattacaggcgtgagccaccatgcctggccaatacatgtttagtatgtttttatttttgcctatttccacccacttgaatgtaagctccaccaggataaatactttttagtttatcctaacaaatgggtaaaagggagctctttaacccatcccaccacgtgaggacacagggataagaccctatctatgaaccgggaaatgggccctcatcagacatcaaatctgccagcaccttgatcttggacttctcatactctagaactatgagaaataaatttctgcagtttataagctaccaagtctgtggtattttataatagcagtctgaacttactaagataagcaggtgaggtacagagattagcttatggaaaagcccaagaaaagaaaaaacttggcacactataaaaacagagaattcgatatgcccggatcagagtatcaagaagactatgagaagaaatgaagctatagaggtaaaaagaaagctgatcaccaaaaaaaaaaaaaaaagataaataaacaacaacaaaaaaacttctagaacaagctaaagaatttagactttattctaaggacaattaattgaaagccattaacctgggtgttgttttttttttttgtttttgagacagagtcttgctttatcacctagactggtgtgcagtggcacgaactcagctcactgcaacctctgcctcccaggcacaagaaattctcgtgcctcagcctcccgagtagctgggattacaggcatgtgctgtcatgtccagctaaattttttttcttttttcttttttcttttttttttttttttgtatttttagtagagacagggtttctccatgttggccaggctggtctcaaactcctggcctcaactgatccgccagcctgggcatccaagtgctgagatttcaggcatgagccaccattcctggcctaacctgggttttaaccaggaaaatggcatcataaaatcctagcgatattttaaaagaatagattcaattggaagagagaggagataggaggtgggtaacatcagataaaaggaggacagttacaataatatgtgagggttaatgattgatggtagtctgtgttaaggcagtaacagaatggattaaaattattgcttaagcaatttcaatagaaaaggttttctgagaaggtgataattgaactaaaattaaaataattttttttttttgagacaaagtcttgctctgtcacccaggcgggagtgcagtggtgcgatcttggctcactgcaacctccaccttctgggttcaagtgattctcctgcttcagcctcctgagtagctgggactacaggtgcgtgccaccacaccctttagtagagatggggtttcaccatgttggtcaggctggtctcgaactcctgatctcgtgatcttggcctcccaaagtgtttggattatagccatgagccaccacgcctggcctaagaaatgagatttgataggtaggtggaggccacaaatgcagggccttatagaccatgataagatataatggaatttattttgcataataggaagccaatgaattttcttttttcttttcttgctgggaagcatagcctccagcagaagctggaagcaggcatttcctaaagccaatgaagattttaattcagggaatggcctgatctgattccagtccttgtggttgctctttggagaagtgacctaaaatgataaggataatacacccttatgatcatctaggtgaccagcagaaacagaaagaagaagataagaccaggcacagtggctcacacttgtaatcctaacacttcaggaggccaaggtgggaggattgcttgaagccaggagcttgagaccagctggggcaacatagcaagacccctcgctacaagaaaattaaaaattaaatttccatacagctacctttggaaaaaacaaaaacaaaaaacaaaaaaggtgggggaacggactgaagatatatctgggggctaaaatgaataggacttatcatgtactgaatatggtggatgaggaaaaggaagaatcaagtttactctgaaatcctgagcttcaatatctgagattttctacaattttcagctttctgagacagctaaaagaatagcaagttgaatgttggggtaggaaagactggagggcaagaatttagcttaaacaataaatttaggacaaatattaaatttaaaatgcatattaaagtcctaagcttccaccttaagaatctagaaaaaagatgagcaaactaaatccaaagtaagtagatggaggaaattaaatataaaagcagaaaccaataaaagaggaaagcaaaacacagagaaaattaacaaagtcaaaagttggctaccttaaaaattaataaatggataaactaataggaataattaggaaagaaagaaaaggataaaatattttatctcttaccaaaatcatgggatatcactacagatgctatagacatttatgccaataaattcaacacattagatgaaacaacagattccttaaaaacacaattcaccaaaactgactcaaaaagaaacagagaatctgagtaataatcaatacacttcccaaaaagaaagctccaagcccagatggttttactagtgaattctagcaaacattcaaggtatacctccctaatttatgaggccaggaaaacccagataccaaaacctgatacaaacatttcaaaaaagaaaattacagactgatatccctcatgaccaaatgaaaaggtcccccaaaaatacataaacaaatgaaatctagcagtatacaggctgagcacccattatctgaaatgcttgagacacttttggattctggattttttttttttttttgtattttggaatatttacatgatacttaccagttggacatcctaatccaaaaaaatccaaaatctgaaatgaacatcatttcggcactcaagtttggaattttgcagcatttcggattttgaattttcagattagggatgctccacctgtattaaaatagtaacaacacagcaagaccaagtggagcttatcctagaaacaagagtagatcaacattcaaaaatcaatgtaaatcttcacagtaacggaaagagaaaatcatattatcatctcaatagatgtgggaaaagcatttggcaatattcaaaattcattcaaagggaagggggaggggaaaagaagggagagagggagggagggaaggggaaaagctctcagaaaactagaaagcatccttaagctgatcagaaaaaaacccatggctaccatcattctcagtggtaaaaaccttaaatgctattccctaagttcacaaagtaaaatacttactctccccaattctatttaatatttgacccaaattaaggcccaatattgtgtgctgccttgacatctggtgaaagtgggagggcctcaaatggcctaaccagaagtttgcctccccattctcctcccacagataaggctgcctactcaaacagcccttctgatcacagggaccaggcacagtccctgcttatccctacgtagtgggtttcccatgtcctggtcccctgccagcccacagacttatccaaacaatccaatcatatccttctttaggaaccagaaggcaccccagactcttgatactaccaagcctgcctcctacagcccctggttgttcattttgttcccaaatgtaatctacatgtagccatgcatggcatgtagtgtcctactcccctaggctgtaaacataaaacaaactgctgttgatctcaactgtccagtgtcacgtgttacatgttcagccattcccataacctggggcaaaatccctccttcactacacagtaaataggaggcaatgaaaacactggcaaatgcaaatgacttgcacccagtataaaggagtctcacaattcaataataaaaagacaatccaatgtttttgtttttttttgagttgtggtctcactctgtcactctaactggagtgcagtagtgcaatctcggctcaccgcagcctccacctcacaggagcaagcgattctcctgcctcaacctttcaagtagctgggattacacgcacacgccacagtgcctggctaattttttttgttgttgttggagggggcggagtctcactctgtcgcccaagctggagtatagtcatgcaatctcggctcactgtaagctccacctcccaagttctcaccactctcctgcctcagcctcgcgagtagctgggactacaggcacccaccaccatgctcggctaatttttttgtatttttagtagagacggggtttcacagtgttagccaggatggtctcgatctcctgacctcgtgatcagcccgcctcggcctcccaaagtgctgggattacaagcgtgagctaccacacctggcttaatttttaaaataggcatttccaattccagaaaaaatggcatagatgcacttttccttattccttctgccaagtacagctaaaattcatggacattacatataaaacaaatgtaagaagactctgaaagatacagaggggaaggcagaccagttagtgatctcaggagacaaggaatgacagactgatgagttctttgcctcatatattctgaaatgaatactagagaagccagcaatctggaaacaccagactatgctaacaagaaaagcctgctctctctaggcacatgatcagggatgaggtagtcctcccactgctaaatctgactggctttttagaaaacgggctcagtgtagtagatcatgcctgtaatcccagcactttgggaagccgaggcgggtggactgtttgagcccaggaattcaagactggcctgggcaacatggcaagaccccatctctatgaaaaaaaaagaacaaaaattatcagggccatggtgatgtgtgcctatggtccccagctacctactctactcgggaggcagtggtaggaagatcacttgagcccgggagatcgagcagtgatcacaccaccacaatcagcctgggcaacagagtgagatggagaggaggaggggagggaaagaaggaacggagggaaggaaaggaaaaggaagaaagggaaagaaaggcgatgcagtactgagatactacaacatctggaggtcagttgaagaggtaggaaaaacaccagaagagaggtatcagagaagcacaagaaagactgcgttattagacagcaagagtcgactggactaaatgcgtctaagaagtaaagtaagatgaggacaaagaagtacagatgagaattagtaaaagacaggccattagtgagtagtttcagtggaaaaactgaggatggaagccagcttggaataggataaacaataaacaaagacatttacttctagcaatatggtgtactaaacagtctgaactgtcctgatgaaaacaatgaaatgatataaaatatcacttattacattatgtattacatatattatatatgttattacagctgaccctcgaacaccgcaagtttgaacagtgtgggtccacttacacgtggattttcttccacctctgcctcctctgagacagcaagaccaactccatttcttcctcctcctcctcctcatcctactcaacataaagacaaaaatgaagacctttatgaccttccacttaaagaatagtaaatatattttctctttgttatgacgattttccttttcttttttggctctatggaatctttctagtcatatgatttttcttttttttttgttgagacaaagtctcactctgttgcccaggctggagtgcagtggagtgatctcagctcactgcaacctctgcctcctgagttcaagtgattctcctgcctcagcctcctgagtagctgggattacagtcacgtgccaccatgactggctaatttttgtatttttagtagaaacatggtttcatcacgttggccaggctggtctcaaactcctgacctcaggtgatctgcccgcctcggcctcccaaagtgcaggattacaggcatgagtcaccgtacctggcatctttttttttttttccacttttattttagattcagagggtgtatgtgcaggtttgttacctgggtatattgcatgatgctgagctttggggtacaaatgatcttgtcacccaggtactaagtatagtacccaacagtcggattttcaaccactgcccacccccttcccttctcattctagtagtctccagtttctgttgttgccatctttatgtccatgagtacccaatgtttagctcccatttataagtgagaacaagcagtatctggttttctgttcctgtgttaatttgcttgggataatagcctctagctgcatcagtattcctacaaagaatatgattttgttatttttatgcctgtgtggtattctgtggtatatatgtaccatttcttttttttatccaatccaccattgatgggcacatagtccgattccatttatttgctattgtgaatagtgctgtaatgaacatacaaatgcgcatgtctttttggtagaacagtttgttttgttcagatatatactcagtaatggattactgggttgaatggtagtcctgttttaagttctttaaatctcgaaactgctttccacagtggctgaactaatttacattcccaccagcaatgtataagcattctcttttctctgcagcctcaccaacatttgttttttaatattttaataacagccattctaactggtgtgagatggtatctcattgcggttttgatttgcatttctctgatgattagagatatggaccattttgtcacgtttcttggccatttgtatgtcttctgagaagtgtctgttcgtgtcttttgaccattttttaatggggctttttgcttgttcaattgtttaagtttcttacagattctggatattagacctttgatatctgcaaacttggctgcacagtttgcaaatattttctcccattctgcaggctatctcttaactctgtcgatagtttctttcactgtgcagaggctctttaattagtccggcttgtcaatttttgattttgttgcaattgcttttgaggacttagttataaattctctcccgacactaatgtccagaatgatgtttcctaggttttcttctaaaattcttatagtttaaggtcttacatttaaatctttaatctattttgagctaaattttttatatggtgaaaggtagggaatccagtttcatttttctgcataagccacatgattttcttaataatattttcttttctctatcttactttatcgtaagaatacagtgagacacgttcatcagcttgttcttttctgcccgcggacgccactgaagaagcatcgttaaagtctctcttctcccttccgtcatgtctaagtcagagtctcctaaagagcccgaacagctgaggaagctcttcattggagggttgagctttaaaacaaccgatgagagcctgaggagccattttgagcaatggggaacgctcacggactgtgtggtaatgagagatccaaacacagagcactccaggggctttgggttcatcacacatgccactgtggaggaggtggatgcagccatgaatgcaaggccacataaggtggatggaagagttgtggaaccaaagagagctgtctcaagagaagattctcaaagaccaggtgcccacttaactatgaaaaagatatttgttggtggcattaaacaatgaagaacaacacctaagagattattttgaacagtatggaaaaattgaagtgactcaaatcatgactcactgaggcagtgccaagaaaaggggctttgcctttgtaacctttgacgaccatgactccgtggataagactgtcattcagaaataccatactgtgaatggccacaactgtgaagttaggaaagccctgtcaaagcaagagatggctagggctttatccagccaaagaggctgaagtggttctagaaactttggcggtggtcgtggaggtggttttggcaggaatgacaacactggtagtggaggaaacttcagtggtggtggtggatatggtggcagtggggatggctataatggatttggtaatgatggaagcaattttggaggtggtggaagctacaatgattttggcaattacaacaatcagtcttcaaattttggacccatgaagggaggaaactttggaggcagaagccctggcccctatggtggtggaggccaatactttgccaaaccatgaaaccaaggtggctatggtggttccagtagcagcagtagctatggcaatggcagaagattttaattaggaaacaaagcttagcaggagaggagagccagagaagtgacagggaagctacaggttacaacagattgtgaactcagccaagcacagtggtggcagggcctagctgctacaaagaagacctgttttagacaaatactcatgggtatgggcaaaaaactcgaggactgtatttgtgactaattgtataacaagtcattttagtttctgttctgtggaaagtgtaaagcattccaacaaagggtttcaatgtagatttttttttttttttgcaaacatgctgttgattgctaaatgtaagtctgatcatgatgcagaataaatgtctttttttaatgtgcaaagaaaaaagaatactgtatataatatatatataacatgcaaaatatgtgtgaatcaactgtttatattataggtaaggcttctggtcaacaataggctattagtagttaaatttttggggagtcaaaagttatacatgaatttcagctgcacaggaggttggcactcaaattgttcaagggtcaactacacgctataaaatataaaatattatataaatagaaccaaagttagctttcaccctgaatatttctttaatgtcctggagaccatgatatttccaatttaacttagaagctgttaaaggcacaatgttaaaacctacagcttgtccaaagtaggaagccaaagtcaatgtaaaggtaaaaaggaaacaaacctcagagagacagagacagagaccaaccaagaccttgtctgtaccttagtattggtggcatatggaaaaaacaatttcccctgagaatccataaccactaatagccctcaattagattagcagtcagaatgtatgctattgtataatctgaagaatttcaagctcagaacttaatttacggcagtccccagttaacagcacctctctaatgttccccagttaacggcacctctctaatgttcccatccactaagtggaagtggatcatgacaaagtttttcatccttgttgtctctgagtaggctgaaaagcaagagaaagaagtggaatgggtcttgctgtctcagaggtggcagaggtggaagaaaattcacatataagtggacctgcgcagttcaaacctgtgttgttcaagtgtcggctgtaataacatatatgtaatacataatgctgagcaaatcctcgctgcaagaacatcgacatagcccacaaagagtttccactagaaaagttccaaggaacataaattcacaatcgaaaaaaattcacaaaatacacaagagaaaaagccacaagccattacgagtgacatccaacagaaagaactggcaacagagtcaaacctataaagtttcaaatactataatgctataaacattaccagacagaaaatatagaataatcatatttgaatgttttaataaataaaagggaagcttgaaaattaaagcaaagaacaaggaactaagaaaaagaaagatcaaatttgaaaaaaaaaaaaaacaatcagaactagctggacatggtggcacatgcctataatctcagctactcaagaggctgaggtgggaggaatgcttgagcccagaagttcaaggctgcagtaaaagctatgattgcaccactgcactccagtctgggtgacagagcaagatcctgtggaaaaaaagaagaggcgaggagaggggaggggaggggaggggaggggtggagagaggagaagggaagagaaaggaacgccaggaggggactggaggggagaggaggggaaaggaggggaggagaggggaggggaggggaagggaagagaaaggaagggatgggaggggagggagaggaggggagggaaggggaagggaggggagagaagggaggggaggggagagaagggaagggaggggaggaaagggaaagagagaggaggggagggggaagggggaaggggagaagggggaaagggaggaagaaaggaaggaaggaaagaaggaaggaaggaaaaaagaaaaagaaaagccagtcacggtggctcacgcctgtaatcccaacactttgggaggccgaagcgggcggatcacaaggtcaggagatcgagaccatcctggctaacatggtgaaaccctgtctctactaaaaatacaaaaaattagccgggtgtggtggcaggcgcctgtagtcccagctactcgggaggctgagacaggagaatggcatgagcctgggaggaggagtttgcagtgagccgagatccgcaccactgcactccagcctgggcaacagagcgggactccatctcaacaaacaaacaaacaaacaaacaaacaaaaacaaagaaaaaaagaaagaacttctaggaatgaaaaaaagacatttaaaatgaaaattaatggcatattaaacagcaggtattctccatagctgaggaaagatttaattaattggataattcattttttaatccaaaatgaaaaacaaaaaaaaaggatataaaatataaaacaggccaggcacagtggctcatggctgtaatcccaacattttgggaggccaaggcaggaggatcacttgaggtcaggaagtcaagaccagcctgcaaccagagtcacagatggagaccccatctcaaaaactaaaacttaaaaatttaaaaaataaaacagggaggggtgcagtggctcacatctataattccagcactttgggaagctgaggcaggaagactgtttaaagccaggagttcaagatcagcctaagctacataatgagagcccatctctaccaaaaacaacaacaacaacaacaacaaaaagccaggcatggtgatgtgcacctatagtcccactactggagacgtcagattgggagaattgcttgagcccaggagtttgaggtgcagtgaactatgaccacgctccagcccaggcaatagagcaagaccttgtctcaaaaaataaaaataaaaaaaatacctatgatagaataaatgataaagggagaaattttaacatacaggaagcccccaacttagaatagtttgacttaaaatttttgactttatgactgatttatcaagatgtaaccccatcataaatcgaagagcatctgtatatctaatctaggtttcagatggcaatatcagaaaaaaattgaggcaatagtcaaagataatcaccgagaattttccaaaacacttcaaatacacattggtgtgtacagaaagcccaatgagtctcaagcaggattaaacacacacacacataacaggaaatgaaagaaagagactagaacagattaatttattggctgattaattataaaaaacaaccacaggagtagagaaaaggatcccttcaatagaaccaaatagactaaaagcagtcttctcaacagtaacaatgtgacccagaaaaaagacagagatggaagttttcaatgtgctgacaaaaaaaaaggtctgtatgtagaattttatgctcagcaaaatcgtgtttcaagaacgagcatgaaataacattttagactgaaactgagagtctagcaaatcagtcctcattttaaaaaaatcctaaatgatgttctataaaacgaataaaataggccgggcgcagtggcttacgcctgtaatgccagcactttgggaggccgaagcaagtggaccacaaggtcaggagatcaagaccatcctggctaacatgaaaccccatctctactaaaaatacaaaaaattagccgggtgtggtggcgggtgcctgtagtcccagctactcgggaggctgaggcaggagaatggcgtgaacccgggaggcagagcttacagtgagccgagatcgcgccactgcacttcagcctgggcgacagagccagactccatctaaaaaaacaaacaaacaaacaaaaaaaaaaacccaagaaaacaattgtaagtggaaggctgaagatgcaataaggaatggtaaacaactacactggtaaatacatggataaatctaaaaataataataacctctaatttgtgaagataaaagaaaataagataaatctaaactaatgaaccacaatataagttaggaagtagtgatccatatcaaagcattcaaaaatcctcgaaacggaaggaaagaaaagtatgttagacattatgtatgttacaaaagaaacaaaaatgggccaggcatggtgactcacacctataatcccggcactttgggaggccaaggcagatggatcacttgaggtcagaagttcgagactagcctggtcaacatggtgaaaccctgtctctactaaaaatacaaaaaaattcgcagggtgtggtggcacgtgcctgtaatcccaactacttaggaggctgaggtgggagaatcatttgatcctgggaggtggagattgcagtgacccaagatcatgtcactgcactccaaggcaacaaagcaagactctgtctcaaaaacattaaaaaaaaaaaaaacactaaatgaacagaatatagtgcataatatccaaactagtagcagtacccaggactaaacccagcaatgtactccaccaccatgtgaaggttgcttaccaaagggccagcaaataaggagaatgaacagctagagaggtaagaaaaaaaccagaagtgtgtggtattacagaagcacagaaaagggtgtgtagtaaggaagttaaatccaaactaaggcaaaaagagaaaaagaaacagaagagcaggacaaagagaaagtacataaagagtaataaaaataaatcaaaatataaccaaaataattcaaaggggtttagcggttttcccagttaaaagacaagtgttaacgctctttgcaaaaaaaaaaaaaagaacaaaccaaaaaaaaacccccacctaaaacaaaaggaacaagaaaatacgaaaatgaaaagaaagataaagtccgggagcagtgactcatgcctctaatcccaacactttgggaagctgaggcaggcagatcacccgaggtcaggtgtttgagaccaggctggccaacatggcaaaaccccgtctctactaaaaacaaaacaaaacaaaacaaaaaaattagccaggtgtggtagcatgcacctgtaatcccagttactcaggaggctgaggcaggagaatcattcgaacctgggaggcagaggttacagtgagccaagattgtgccactgcactccagtctgggcaatagagtgagactctgtctcaaaaaaaagaaagaaagaagaagatacacaaaatactaatcaaaacaaagctggggttattccactactattaaacaccaattcatcaaaaagatataacagatctaagtagataaaatatgaagccagtgactgtaaacagcatattagagaagtttggctctgaaggaaagcaaataacacatggtacctgaagacgggatttcaagtcaaagaaagagtttttggtcttggttttattcatttttgattttttggtgttcttttcttatttgttttcatatgaatcatattgaacaaatttgtatgttattgggaattatatgaagtagaggtaaaaagtgaagtagcaggagggagagaggataaattaaaaatgaaaaagaatggaatccacagaacaagagaaaggactgaaattttataaaaaggactttttttcagtgtaataaagtaagaggaaacaggtatggtataggtatgataaaataagaacatttatctaatggttcctattttctcagttatatatacggtgactgagagaaggttaaaaagagacagatttcaaaacaaagaaggtacaaaataactatctcagaaagtaggaagttaatcctactaatatgatattaacagtattgccaggcactgctcaataccaatacccattggaattgttttttggtgttgttctgattgaggtcaactaaattattactagattcctttcagttcatcatattatgaacacagtttagaacatttttcttaaagacatttactgaaacttgttcttaataaagtccagctgatagttttcctcccctctcgcaaatctgtaaaatcttactatggttaaaatacatacacatggagacaaaaaataaacacatggtcagagagagacaaaacagaatgatgaatggacagaaagaggacatatccagaaacgtatgcacaatacacagactcatcaaccaagaggtggagaagaggatagcagagaaaaaaagactgggtaaggactacagctaggccttcaaaggggcaactgacaaaaactatcagagcaaaatttgagcatcttcatctcttcgtggcagtattatgggtgagtgttatgttcttcacattccttatctcctttttctataatcatccaatattacttatttattaaaaataatattaatgcaactaaagctgacttttcaaatttttggaatttttttacttatttacaataatttcttcatttttaatataatgtatttatatttaatataatgtctttaatatcaaagacaaaagtccttacaaagtcatacatgaagacagtaaataatatgtaaattttatagataacccaatttttccttagtccaataacagttcatgacagtacacacacataaatagatactaattaacctgtaattctttataaacagacgttttaaaatcttcagtgagatgacattagcattaaagacaaattggcaatattatttttcagagtcttaatgtacactttctcagtctcacaactaggcacaggcatatagctacaagtatgtttcaaaagtcacattccaacttttacaagaaaaacttgtgagaacttttcctatacaaatcaccaatcgttacaccaaatatttgctcattttcccttaatattgaattttattgccaagttattattttcatacctctgaagagctttcattattgacgtccactgtgtttataggagttgctgatgaatctaaatcagaaccttgagagccaactctcccaggagtctggaacacaaacagtagggaggaaaaaaaaacaaagcagacattaacaatatattcatcggccatttaataatctaaaccttttcacataagaaaagtagatgtctttacaataataacagtactaacagtatcatttatggaagagtgtacctaatgctgtatcaaaatctctatatatgcatttctctcattttaagtcactttaaacaaaatgtatacaacactttacaaagtcttcaagtcaccttcacaaaacatcatatttaatcaaaatgacatctcttaagacaggtaagatggatgttatctctgtagagaagaaaacagatttaaagcaggaagtgacttgttcaccattgtactcttttgttttggttgttttttgagttggggtcttgctctgtcacccaggctggagtgcagtggtacaatcttggctcactgcaacctccacctcccaggctcaagcgatcctcctatctcagctacccaagtagctgggaccacaggtgcacaccaccacacccagctaatttgttgtatttttggtagagacgaagtttcaccatgttgcccaagatggtctcaaactcctgagctcaaacgatctgcccacctccgcctcccaaagtgctggggttacaggtgtgagccataacgctcagtccaccattgtactgtcagcaaaaatcagaaagtcctcaagatgcaagttcaaggaagaagaaaaaaaatcagaaagttctcaagatccaagttaaagcaaaaaaaatcagaagatgcagaactaaaatgcagatcttctgattcctttgacaatgctttctcttttctttttttttttgaaacaagagtcttgctctgtcatccaggctggtctcactctgtcatccaggctggagcatagtggcacgatcttggctcattgcaatctccacctcctgggttcaagcaattctcctgcctcagactcctgagtagctgggactacaggcacatgccaccatgtccagctaatttttttttgagtagctgggactacaggcacatgccaccatgtgcagctaaattttttttgtatttttagtggaaacggggtttcaccatgttggccaggctgttctcgaactcctgacctcaagtgatccccccaccttggcctcccaaagtgctgtgattacaggcatgagccacagcgcccagccggcaatagtctcttttctacacaaactaaaactacagtgattcaagtggtgcaaaaaagaccaatgcagcccaagttatcaagtccccatcacctaccactcaaaccaatcattaccatccagctccaatacttgatatgacaccatcagagacacattttggagggttaaaggtcttttccccctgtaccatttatcacttagcattatcattcattaaaatctaggtgttacttttatatcaaattgctttttggatgaatctgaaacctagtaaaacactgggtaaaaagagatttagagcacaaaaactgactcaataatactcatcaaaaatatatatggtatatgctagcattatccacactttacaaatgagggaaccaaggcatagagactaagtaaattgcccaaggtcagatgggtaataaatgaaagaagggattttaattagagcagtgtggctcttaatcactaaccaatactgcttctctgttagacatctccactgaaatgcccctcaatcacccaagattcaaaacacctcactacatatttgcctcaacatgtgaacatcctgtacatcactactaaatgttcaacctaaatccaaataaggatgaattcataatgctatattcatcaaaatgattataaaaactatatacaatggaaaaatatacacagtatgatttaaattatatataaaaactactgatataagaaaaaagattaaaaagaaatattccaaaattcaaataatgatttctgtagcaagacaggaatcttcatttttatttttttcagttttcattttgctactttttttttcagaattttagatccatacttgaattgcttttatcttgaaaaaaatgttttatgttaaagataagcaaacctccagtttaatagccagcattcctttttttttcctcatgcagatactttgcacatttatttacaggcatatctcattttattgtgtgtctctttattgcactttgcagatgtggcgctttttagatattgaaagtttgtgtcaactctgccatcaagcaagtctattcctgccatttcttcaaaagcatgtgctcactttgtatctctgtgtcacattttggtaattatcataatatttcaagcttttttattattatcatatctgttatggtgacctgtgatcaatgatctttgaagttactactgcaattgttttgaggcactacaacccatacccatataagatggccaacttaattgataaatgttgtgtgtgttctgactgctccactcactggccatttcccagtctctctcccttctccttgagcctccctattccttgagacacaaccatattaaaattaggccaattaataaccctataatggcctctaagtgttcaagtgaaaagaagagctgctcatttctcactttaaatcaaaagctagaaatgattaagcttaatgaggaaggcatgtggaaagctgaaacagactaaaagctaggcctttgtgccaaacagccaaatgtgaatgcaaagaaaaagttcctggggaaattaaaagtgctactccagtgaacacacaaatgataagagcacaaattgctgagaatgttttagtgacatggatataagttcaaaccagccattaacgttcccttaaaccaaagcctaattcagagaaaggcccttcaattgtacgaaggctgacagagatgaggaagctgcagaagaaatgtttgaaggtagcagaggttggttcatgggatttaaggaaagaagctgtctccataacataataatgcaaagtgaagcagcaagtgatcatggagaagctgcagcaagttatccagaagatctagctaagataattgatgaagatatctatattaagtaacagattttcaattcagaaaaaaacagccttctattggaagatgtcatctgtaactactatagctagagaagagaaatcaatactgggcttccaagcttcgaattccaagcttcaaagaacagggtaattcttgttaggggttaatgcagctgatgacttttaagttcaagccaatgatcatttataccgttctgaaattcctaggacccttaagaattacgctaatgctactctgcgctctatacatagaacaagaaagcctaattaatagcacatctgtttaccacatggatcactgaattttttttttttttttttttttttttttttttttttttttgagacggagtctcactctgtcgcccaggctggagtgcagtggcccgatctcagctcactgcaagctccgcctcccaagtacatgccattctcccgcctcagtctcctgcctcagagtagctgggactacaggtgcctgccaccaaggccgcctaattgtttttttgtatttttagtagagacagggtttcaccgtgttagccaggatggtctcgatctcctgacctcatgatccacccgcctcagcctcccaaagtgcagggattacaggtgtgagccactgtgcctggctggatgactgaatattttaagcccactattaagagctgccactggaaaaaaaaaaaaaaatcctttcaaaaatatcactgttcattgacaattcacctggtcacccaagagctctcctggaggcatacaaggagtttaatgttgttttcatgcctattaatataacatccattccgcagcctatggatcaaggagtaattttgactttcaagtcttattatttaagaaatatattttgtaaggctataactaccatagatagtgactcctctgacagatctgggcagagtgtgtggaaaaccttctaaaaaggtcaccattctagatgtgattaagaacatttgtgattcatgggaggaagtcaaaatatcaacactaacaagagtttagaagttgattccaaccttcataatgactgtgaggggttcaagactccagtagaacagatacggtggaatcagcaagacaactagaattaaaagtggagcctgaagatgcgactgataattttcttttttttttttttcttgagacggacttttgctctgtcaccaggctggagtgcagtggtgtgatctcagctcactgcaacctccacctcccaggttcaagcgattctcctgcctcagcctcccgagtagctgggactacaggtacgtgccaccacgcccagctaatttttgtatttttagtagagacagggtttcaccatgttggccaggatggtctcgatctcttcacctcgtgatccacccacttcggcctcccaaagtgccgggattacaggtgtgagccatcgcgcctggcatgactgataattttcacaataaaactttaatggaggaggaatggcttcttagggatgagcaaagaaggtggttccttgagatgaaatctgctactggagaagatgctgtgaacactgttgaaatgacaacaaagaatttagaatattccataaatttagttgataaagcatcagcagcttttcggaggattgactcaagttttgaaggaagttctactgtgggtaagatgctatcaaacagcatgctacagggaaatctttcatgaaaagaagagttaatcaaagcaaaacagcaaacttcattgttgttttattttaagaaatgccacaactccagcctgaccaacatggtgaaactccgtcactactaaaaatacaaaaattagccaggcgtggtggtgcgtgcctgtaatcccagctactcaggagggaggcaggagaatcgcttgaatccgggaggtggaggttgcagtgagccaagatcgcaccactgaaagaaaagaaaaaaagaaaaaaaaagaaattgacacagctatcccaaccttcagaaacctccaccctggtcagtcagcagctatcagtatagaggcaaaaccttccacaagcaaaaagattatgactagctgggcaagatggcccacatttgtaatcctagtgctttgggaggccaaagaaggaggatcgcttgaggctaggcatttgagaccactctgggcaacataatgagaccccatctctaccaaaaaaatacaaaaatcagcaaggcgtggtggcgttcacctgtagtcccagctaccagtgaggcaggagaatagggtctggaggcaaggaaactaaggctgtttcatggcaacttcctagaactaaattgaaaggaaaaccctaactttccacacctaagtaacaaaaggaccacaggctactccctttgacctttcctttgaccttttctgcacagatgggaaattggctatccacaacaaatcagactgattgtgggcaagtcttcatttgcatagaagtataactgtgtagctttaccctaggctctgattggttgccttttgcaaccaatcagatgtttgcacaggagtgtgacctttgtaactttacttcagcctctggttggctgttttctgcaaccaatcagactgaatgtgggttaccacttcatttacatgaggtgagcgtgaagtggctaatcagaaacgtctagggggtatttggacccaagaagatgctgtatccaggcccttgagctgctgctcaggcccactcccacactgtggagtgtactttcgtttccaataaatctctgctttcgttcttttgttgcttcattctttctttgctttgctgggcgttttgtccaattctttattcaaaacgccaagaatctggacaacttgcagtcacgaccctctaccagtgacaataggaaggctgaggcaggaggatcacttaagcccaggaattcaaaaatgcagcgagctatgatcacaccattgcattatagaccggatgacagagcgagactctgtctcatcaaagaaaaaagattacaaatcactgaaggctcaaacgattgttggcattttacagcaataaaatattttttaattaaagtatctattagacataatgctattgcacacttaatagactacagtatgccgtgaatataatttttatatgcactgtgaaaccaaagaatttatgtgactcgttttattgcgatacttgttttattgcagtgatctagaaccaagcccgcaatatctccaagatatgcctatatacaagtatgcctatatacttgtataatttttatataaatcaggaaactagaacaagtacaaaataacaaccagtaattaaagctacagagaaattcccaaactcttctcaaacatacttcctcaaagaagggtataagattaaacttttattttatattctggatagagtattaacctagcatgccatgacaaaggggaaataaaatgatcttgaaccttttttaaagtacttatgttctttaggattctcagaagaactcagggttctgtgaggttctgtcaactaaagaatgacaaagaaggaacattatggctgggtgaaatggctcacgcctgtaatctcagcactttgggaggctgaggtgggtggatcacttcaggttaggagtttgagaccagcctggccaatatggtgaaacctcatctctactaaaaatacaaaaattagctgggcatggtggtgcacacctgtaatcccagctattcgggaggctgaggcaggagaattgcttggacctgggagacagaagttgcagtgagccgagatcgtgccaccgcactccagcctgggtgacagagcgagactccatctcaaaaaaaaaaaagaagaaggaacattacttgtgtaactatgtcttcttttttttttcctttttttcccttttttttttttttttttttttttttttagagacaggggtctcagaatgttgcccaggctggtcttgaactcctaggctcaagtgatccttctcccacttcatcctcccaaagtgctgagattacaggcatgagccactgcatccagcctatgtttcaataaagatggctagagaacatcagaggcacacttcagaaagagacaggtatcttactcatgagtgaaaaaaaaaaaaaaaaccacaaacattgtttagagatggaggaggcaataactgtatcctgtccaagaatagtagcaaccaccacaccaaggcttatccaaaacaggtagaaagtggcagaatttcaataaagtactaaagatgaagaatgcaaaatgaatctctggccaaaggcaaaaaaaaaaaaaaaatgagaggagctggatatgaggggtctccatttggttgtcgataccaggagacagtacccactacccgaaatgatgaaattgtaaggctttcatcctcagagaagtcagagaaggttaagccaactgaatacatgagtgaaataaacatgaattttagataccaccaatctagatcaaatctcacttcagcctaacttcaatttgctacaggctttagagaggctgcactttattgccaggtcttggagcctgagcactacctcctgcctcagcgtggtcgctgacccttcttctgggaggtttccactttctagacaagcagacaaagcttgtgaaataatcaaagcagtgatgccaaggatgtcatggcagaaggcctgggttcctgagtcactgagagctcagagggctggatttgacattcctgatgcattacacaggcacattcatcctgctgacactgtaatctgtcctcattgggaaagttaggatcatcttcctgggcactgaatagggtcagcttttaatctggtctcttcactttgtagtgggacaaaaggtgttggaagaattaggggagagggtgcagtgggcctctactttctccttcctcttgctcgttctcattttctttgtccttacaatcttcctaaaatgcctatgcttttttggaagttgatctagctttcttttctggactggaggcacagcaggatattgtgaaacctcagccacatgactcttgggtgtctcctccaatggctctgataatgattccaaacttctcttcagagggtgaacttccattctcccttgggtggaatttatcttccacatcttgagtatttggtgatgaacgttcaagtctttagtgacatgtttgggagactggagattcctaaagtctgtcactgaggactttttttttaaaacctactatgctgatcctagccagctttgcagaaacaaggaatcacaacaaaagggaccaaaagtcaaatgatatttttaaaatggtagttagcaccctgactgtttccaatgacgtatccttagctatcactgatacaggagatatactcatttcagatttctcccctcgacttatctaaaggcattcaatggccttcagaaataaagtcctcaagttgttcttagcctagggaatctcagatttcctagtatagtatggaagagcaggcctcagtctctacagtccctttaaactttcccaaaatctaacattctaaaactgtctaaatttatccagagtatgtctttactgtgtgtttttttttttacatttaatgcccacaaaattttcttgttttaatatcagctacagttctgcaaacaccaaagcaaaattctttcccaaaataatataattgagacatgaatttataaataaataaaagccagctctggatttaatgatacactcatggatgtggcaaaaagtaaatggcgaaaatgttttaaaagagcatttaaatttttttttgtagttgttttttttttttgtcttgttttatttttttgaggcacagtctcactctgtcacccaggctggggtacaatggtgtgatcttggctcactgcaacctctgcctcccaggttcaagtgattatcctgcctcagcctccccagtagctggaattacaggtgcccgccaccacgtccagctaatttttgtatttttagtagagacagggtttcaccatgttggccaggctggtctctaaatcctgacctcaactgatccgcccacctcagcctcccaaagtgctgggattacaggcgcgagccaacacgtccagcctaaactggatatttaatataaagaaccgttctataaaactagaaattcatttttgattcattaacatttcaataacttcacactacgatggtattaagaacaatgaaagacactggaaacaggaagttatacttccaaagaactgtattttcctcatttctgtttcctttatttttccagatgccagatggcttttcaccaaggttttccttgactgagccgaagtaagcaattcaaagaaatattgtacttttttttatttttgtaaagatgaggtctctgtatgttgcctaggctcatctcaaacctatgggctccagtgattctcctgcctcaccctcccaaagtgctgggattacaggtgtgagccaccatggccacctgaaataaggtacttctacataaacctattatcatcaccaaaaataccctttctcaaatttgcctacaataatcctagtaaatatacctaagtaaagcccaagaggcatggggagtaaacagagaaaaaaacaaggaaaccctcacaagtcaggggtttttgatgtccatattttaaatatactcctcatgattgctgttaaattatctaagaacttcttgtttttttttttttgagacggagtttcactcttgttgcccaagcgggagtgcaatggcattatcttggctcactgcaacctctgcctcccaggttcaggcgattctcctgcctcagcctcccaagtagctgggactacaggtgcacgccaccatgcccagctaattttttgtatttttagtagaaacggggtttttccatgttggtcaatctggtcacaaactcctgacatcagatgatccgcccacctcagcctcctaaggtgctgggattacaggcatgagccaccgcacccagccttcattcttattctatttttaagccactaaaattcctttatttcaaggagaagcccaaaaacaataacactaaccctaaataaagcatataaagcattctaactttttcacttataaaagttttattttgcaaaaagaatgggattggaatgatttatgctaaaaatttaaagtgataggctgggcacaatggttcacatctgtaatcccaccactttgggaggtccaggtgggaggatcacttgagcccaggaagtcaacgctgcagtgaactgtgattatgccactttactccaccctgggcaacagagtaagaccttgtctccacaaaaaaaagaatttcaaatattattaagatggaaccaatcttaaaaacaaggtacacaatggaccaaaaataaaatggaaacatagagtatccaggattctggaacctaaaacaggtagaggcagctaagttcagtaataagaaccaaaaacgccctggatgcgcaaggtaacaagaagccaggcccactgtgagaacttagtaagcggggcaaggcaactatcccttgcaatgaatagaaactctttaaaaagctgtaaatccggccgggtgcgatggctcacgcctgtaatcccagaagtttgggaggccaaagtgggcataacacgaggtcaggagttcgagaccagcctggccaacagggtgaaaccccgtctctactaaaaacacaaaaattagctgggtgtggtggcgggcgcttgtaatccaagctactcaggacgctgaggcagtagaatcatttgaacctgggaggcagaggttgtagtgagtcaagattgtgccactgcactccagcctgggcaacagggcgaaattctgtcttaaaaaaaaaaaaaaaaaaggctgtaaatcctgccacacactgtttaggcccaaagtttgagcagagcttttccaggtagagatgagagggcattccaaccaaagcattatttgtaacagcttataaatcataagcaacctatatgttcaaaatgaagaaactgttaactaaactacgacgtaactgttcaacagtcttttttttttttttttgagacggagtctcgctctgtcacccaggctggagtgcagcggcgcgatcttgacttactgcaagctccgcctcccgggttcacaccattctcctgcctcagcctcccaagtagctggggttacaggcacccgccaccacacccggctaattttttttgtattttttagtagagacagggtttcaccgtgttagccaggatggtctcaatctcctgacctcgtgatccgcccacctcggcctcccaaagtgctgggattacaggcatgagccaccgcgcccggcctgttcaacagtcttgacaattaatgggataagtgtgtaggttataaaagcatgaaggttatgtagaaaaatgagaatgcagtcggaagcggtagctcacgcctgtaatcccagcactttgggaggctgaggcaggcagatcacctgaggtcgggagtttgagaccagcctgaccaacaaggagaaaccccatctccactaaaaatataaaaattagccaggcgtggtggcacgtgcctgtagtcccagctactcgagaggctgaggcaggagaatcacttgaacccaggaggcgaaggttgtggtgagctgagatagcaccattacactccagcctgggcaacaaaagcaaaactccatctcaaaaaaaaaagaaaaatgagaatgcatatgatatatgatacatctattgtgagaaattaaaaaaagaaaaaacaaaaagaaagaaaagaatgtatatgatataaatcctgaatttgtcaaagaggtaaatacaacatttgtatatattatgacttcaattacataaaaatacatacacataaagagattaaaaggtaatcatataagaccaatgagttttatgttaggatgatttttttgttgctacttttccccctcatattactgaatagatgagatttgtgttaagatgattttattaaccacccacctacttccacccataattttttgttagtgttgtcatattactttttaaagttttctgatttttttttttttgagacggagtttctctcttgctgcccagactggagtgcaatggtgcaatctcagctcaccacaacccccgcctcccgggttcaagcgattctcctgcctcagcctcctgagtagctgggattacaggcatgcaccaccaccccggctaattttgtatttttagtagagacggggtttctccatgttggtcaggctggtcttgaactcctgacctcaggtgatctgccagcctcagcctcccaaagtgctgggattacaggcgtgagccaccatgcctggccaaaagttttccgatttttaaaaaaccatttggccttgacaaaaagatccagagaattctaattatcaaacactcaccattaatgtttaagtagctacaaccaaacagaccaactaaaggaaaaccagctacaacaaaactatttctctattcactatacttctgaacaaatgtttgagttttccacaccaattctctgcagccaccaactgtatgtcccacaatttaattgaattctgacactatctggaattagcacagacctcacagactaagggatcagtcccttaagactgccctccccttctaacaccaatagcaaataaaaggtccccaggttacccacacttttgtctactttggctacatgtcgggaaccctcacaactcccctcctcaggtttgataatttgctatagcagctcaaagaactcagggaaacattttacttatgtttactctaaaagatatcttaaaggatacaaataaacagccagatgaaacagtatgtaagggaaggtctgcagggctcccaagcacaggagcttctgtccccatgaatttagagatacatcaccctcccagcacatgaatgcattcgacaaccaggaagatctccaaaatcactgtttaaagtttttacagaggttccattatgtaagcatgattgactaagtcattggccattggtgattaactcaatctctagcccctctctatgcctgaaggtcagagggtagggtcgaaagttccatagccttaatcttgtggctagtgtctatggcaacaagtccccaacctgaagctatctaggggcccatcaatatcaccttattagcataaactcaggtattgccaaaaggtacttattatgaatgacaaatgacattcctttcacctccatcactcaaggaattccaagttttaggagctccatgccagaaacaagaaaaaagaccaaatatatatttcttattataacaatattacatcaatatttgaaattatgaaaaaaatacatagtattccaagtatttacttcaaataagaacagatgttggctgggtgtggtagctcacacctgtaatcccaacaatgggaggccaaggcgtgcggatcatttgaggtcaggagttaaagaccagcctggccaacatggtgaaaccccatctctactaaaaatacacacacacacacacacacaaagctgagcgtggtggcacacacctgtaatcccctggggagcccagggcaggagaatcgcttgaacccgggagaccgaggttgcagtgagccgacatcacgccactgcactccagcttaggtgacagagagactctgtctcaaaaaaaaaagaacagatgtctgcaataaacaggatatcctagactgctggtaataaaaacaaattcatactacaagatcagtataaaaccgcattaatctctgcaaaaaactatcaaagaagcaaacacaaatttgagaaagaacagcactttactgggagaaaaaatgttattgtttacttatgcaatatcttaaaaagaaatatcactgtcacagaagttttaacaacctaaaacttttttgaaataaatgatttatctattgcagactagttgtttactgagtataatttagacatatatatatatatatttttaataggcaaaatctcactctgtgacccaggctgaagtgcagtggcacaatcatggctcatcgtagcctcaaatttcctgggctcaagccatcctcccgcctcagcctactgagtagctaggactacagatgagtgccaccacacctggctaattttcttttcttttcttttcttttttttttttttctgagacagggtcttactctgtcacctaggctggagtgcagtggtgtaatctcggctcattgcaacctctgcctcctgggttcaagatatcctcccacctcagcatcctgagtagctgggactataggcacatgccaccacacctgactaatttttgtattttttttatagagacggggttttgccatgttgcccaggctggtctcaaattcttaggcgcaagcaatccacctgcctcagcctctcaaagggctgagattacaggcatgagtcatcatgcctggccctggctaattttctttaagcaaaattctttctaaaactggaaaggatacaagtattagaaattaaataatatacaactcaaaaccttggggatttataagctatctataaggatttcttataaaatgtaactttaggggccgggtgcagtggctcacgcctgtaattccagcactctgggaggccgaggcgggcggatcacgaggtcaggagatcgagaccatcctggctaacacggtgaaaccccgtctctactaaaaacacaaaaaaggttagccgggcatagtggcgggcgcctgtagtcccagctactggggaggctgaggcaggagaatggcatgaacccaggaggtggagcttgcagtgagccaagattgcgccactgcactccagcctgggtgacagagctagactctgtctcaaaataaaaaaaaaattaaataaaatgtaactttcaacactgattttgttactctatttcatctgcatcccaccataaaaacaaattagaaagattttcacaaaaagtttgaaaagccatttactatatgcagaccttaagaacaatgctttaaatacattatgcaagccttatactaaatggatagacaaagggctctcactaacccttttctactattaagagctaaaaacgtaacatatagataaagcgagaagttatctttgcaaataacaaatactatttcatgaaaaaaaattcatgtaaagtaattgaggggttcccagggagttttcatacttgacctcttagcttatcacatactctttaggtaaattcatttactcccttaattttcattaacaccattgctgaaaataataaaacactaactttaatccagacctttgctgagtttccaattcatattttcctgtcctgccaaatatatctaattgaatgccttgagagcaccacaaagtcagcttattcaaaaccaaattcatttatctttgctcaaagctttcacccatctacattctccatctcagattatagaaccatcacacactcattttgcctaaatccaaggcatcactcttacttgtctctattccttaaccttcacatccaatcaccaagttaattcaactgcccacttaaattttgaatctatccccctttctccatctccttggccactaccttaattcatgttgcaatcatctctcacctggacgataaaagagacctaatatagcactctatacctctacatccacatttgtagttgtttactaagaaatcaagcaatggatttctcaaagcattgtaaccaaaccaaactcttcattcatctcaacactttaccatcctaggaaaaagtttactttcctcactatgttctccagcttagtcaataatatcctcatttatcaagaacttcagttaaaacctaaatgaactattaaccaggcatggtgatgggcacctgttatcccagctacttgggaggctgaggcaggagaatcacttgaacccaggaggcggaagttgcagtgcactgagatcacaccactgcgctccagcctgggtgacagagtgagactgtctccaaacaaacaaacaaacaaaaattaaaacctaaatgaactaaaacagatatttgcacaccaatgttcatagcagcattattcacaatagctaaaacatgtaaataatccaatgtctgtcaacggatgaatggataaacaaaaggtagtatatacatccacaatgaaatattattcagcctttaaaaggaagaaaattctgataacatgctgcaacatgaagctagaaataattatgctaagtgaaataaaccagacacaaaaggatcactatcgtataattccacttatatgaggtacctagaacagttaaattcatagtgacaggaagtggaattgtggttacagtgggttcaggggaggggaggaatgaagagttattgttttatgagtatggagtttagttgtaatgattgtacaacaacgtgaatacatttcatgccactggattatacacttaaaaatggtaaaaattgtatcttttaaattacgtatattttgtcataatttaaaaaaaatttttttaaaacctaaataagtattatattgcaggcattaccatacagacaaaataattattttaagtatttaagaatgcagagtttctactacatatccttttgggatatagcacaaagccaaaaaaaattgctaaaaaaagaaacagtaaaattaattcaataatcttagccataatattcatattgttaattttaaagctatttatgtatattttagcaaaaaacatttgctaatgttaagaaccaagatattcagtataagaaaaaatgatataaatacagaatcaaataagtaaaaaaccattttatatcttaaatttgaattatcatttgggtttttgtttcatttttttcctgagacagagtctggctctctcacccaagctggagtgcagtggtacaatctcagttcactgcaacctccgcctcccaagttctagcaattctcctgcctcagcctcctgagtagctaggattacaggcgtgcaccaccacacccagctaattagtaaagatggggtttcgccgtgttagccaggatggtcttgaactcctgacttgtgatctgcctgcctcggcctcccaaagtgctgggattacaggcatgagccaccgcgcccagccctgtttcttaacaataattcttatcattcaaaagcttaaaagcaaagacaacccaaaagcaaagcgcaccctacgtgcttatactatggtctctaaccatcactccccactcaaaggaaccagaattttctagagaaatggctgattccagacatgggagagggaatttacaagataaatctgaaacatattattgtgccaaaaagcaaggaagctttttgaacacaaataaggtcctgtcaaaatgacaaacgtcaccttgaaggtactcccagtagctaaagctgagatcattttcacatcagcaaaacacattgactgtaattgactgaaacatgctaaacatatgtaaatccgtgagttcataatataaaaatccatgagttagtcaactaatctttgacaatggaacaaaggcaataaaatgagaaaagatagctgttatcgcttgaatgtccccaccaaaactcatgttgaaatttaattgcaaatgtaatggtattgagaagtgaggcctttaaaaggtgactaggtcatgggagttccaccctcatgaatggattgccattattgtgaacatggatcagttatcatgggaatggctttgttataaagacaagcttgtggccgagcatggtggctgacacctgtaatcccagcactttgggaggccgaggtaggaggatcacttgagctcaggagcccaagaccagcctgggcaacatggtgagaccccgccttaataaatttaggttgggcacagtggctcacgcctgtaatcccagcactttgggagaccgagaagggtagatcaccggaggtcaggagtttgagaccagcctggtcaatgtggagaaaccttgtctctgctaaaaatacaaaaattagccaggtgtggtagcagccacctgtaatcccagctacttgagaggctgaggcagaagaatcacttgaacccaaaaggtggaggttgcagtgagccaagatcacgccactgcactccagcctcggcaacagagcaagattccatctcaaaaataaataaattaattaaattttaattttaaaaaattaactcaaggtcaggcgcggtggctcacacctataatcccagcactttgggaggccgagatgggcagatcacgaggtcaggagttcaagaccagcctgaccgacatggtgaaacccatctctactaaaaatacaaaaattagccgggcatggtggtgcgcacctgtaatcccagctacccaggaagctgaggcaggagaatcgcttgaactcgggaggcggaggttgcagtgagccaagatcatgccactgcactacagcctgggcgacagagcaagactccatctcaaaaaaaaataaataaataaactcaaaatggatcacaaacctaaatgtaaaacacaaaactataaaccctagaagataacataggagaaattactgtggtttgtccattatttttttaggtagaacaccaaaggcgcaatccatgaaagaaagaattaataagctggacttcattaaaatttaaaatgtcagctcttcaaaagacattgtcaagagtaaaaagacaagtcacagactggagaaaaatatttacaaaagacaaacctgataatggactattatccaaaatatacaaacaactctttaaattcaacagtaaaaaaataaacaatctaatttaaaaataaggcaaagaccttaatagacaggcatcttacaaaagaagatatacagatggcaaatatgcatatgaaaagttgctccacagcatacaccatcagggtaatgcaaattaaaacaatgggataccacaacacagctagtagaatggccaaaatccagaacactaccaccatcaaatgctgacaaggatgtggagaaataggaacaggaattcattgctggtggaaatacaaaatgttacagctactttggaagacagtttggtagttccttacaaaactaaacatactcttactatacaattcagtaatcacactccttggtatttacccaaatgagctaaaaacttctgtccacaccaaaacgtggacatagaagtttaaagtagctttattcataatagctaaagcttgtaattgaccaagatgtcccccagcgggtgaatcaataacttactagtacacccagacaatattctccagcgttaaaaagaaatgagctattaagccatgaagacaatgaagaaacttaaacatatattactaagtgaaatacaaagtgaaaggagccaatctgaaaatgctacatactgtaagattccaattatatggatttctggaaaaggcaaaactatgaaaaaagtgaaaagatcaatgtttgccaagagttaaggggaagggaaggatgaataggcaaaacacagtggatttgtacagaagtgaaagtactctgtatggtattataacggtagatactaaaaatttgtcccaaaatctacagaatgtacaacaccaagagtgaaccctactgtaaactgcagactctaaatgataatgatatgtcaacataggttcacgaatcataacaaatgtaccactctagtggggaatgttgataatgggggagtctatgcatgtgtaggggcaggaagtacatgggaaatctctgtaaccttcactcaattttattgtaaacctacaactgctctaaaaagtaacttgtttttcaaatctatgaatttccttttctcaagaaagagaaaatcaaaagaaaactaagaaaacctcagtgatcactgctggagtagctagtgtaccaactcttattctaacacttagtaatcaatgaaaaacaattaagtctttatcctgccttccaagtatgcactgaaatttgggataaccaaatagccctggttgatatcgaaaagttctttacagaaaaaatttcagttaatatatgtagaagcaatgaaagatttagaagatcattttgcaaatactgctgaaatctaacccaaatgacatcataaaatcttctttgaatgttcttactcaaataagaagtctttccatcctttaaactcgactacgtcccttatttatatttcctcttgcagcacttactcataatacaaggaagaacaaagtggtgtcagtggtagtttgttatggtaattaccatcaatgaatcaggcctatgttttcatgcccttgtaattctcttatgtaatcctcccctacataaactctgggctggccatgagacttgccttgactaatggtagtagcaaatgagacacaagcagagacttgaaaggcgtctgtctgcacaatgggatttgttctcttgttgctggaaactcctctgccaccacataaacccagactagccttagacacatgtggcccaatggataaaaccagcaatatgactgaaggtaccttagatcatccattctgttttccaccttattttctttttatagatttagtgggtacaagtgcagttttgttagatgggcatattgtatagtggtgaagtctcggcttttagtgtacccaccaccctaataatgtcactgtacagaataggtaatttttcatccctcactctcctcccaccctcaccctttccccatttccatctttacgtctatctgtatccattgtctagctcccacttataagtgagaacatgcagtatttcactttgtttctgagtgatttcacttaggataacggcctccagttccatccctgttgctacaaaagacatgatctcattcttttttatggctgagcagtattccatggtatacagaaaccacattttctttatccaatcatctgttgatggacacttaggttgattccaagactttgctgtggtgcaaagtgccatgataaatagccatgtgcagctgtcttttttatacagtgatttgttttcctttggatatatacccagtactgggactgctggattgaactgtagttctgtttttagctctttgagaaatctccatactgttttccacagaggctgtactaatttacattcccatcaacaatgtatgggcattcccttttctccacatcctcaccaacatgttgttggttttgttttttaattttttgtaacagccattctgactggtgtaagatggtatctcaatgcatttttaatttgcatttctctgattagcaatgttgagcattttctcatgtttgttggtcacttgtatgtcctcttttgagaaatatctgctaatgtcctttgcttactttctgatggacttgtttttttcttgttgcgttccatgtagattccggatgttagtcctttgtcagatgaatagtttgcaagcattttctcccattctgtaggttgtctgttgattatttctttggctgtacagacaatttttactttaattcccattttttttctatttttgtttgtgtatttgcttttgaggtctcagtcataaattcttcgcccaggctaatgtccagagagattttcctaggttttcttccagggtttttacttccaggttttttgtttgtttgttagtttgtttttgaggcagagtcttgctctgtcacccgggctggagtgcagtggcgcgatgtcagctcactgcaacctccacctcccaggctaaagcaattctcctgcctcagcctcccaagtagctgggattacaggcatgtgccaccacatctgactaatttttgtctttttagtagagacatggtttcactatgttggccaggctggtcttcaactcatgacctcaggtgatccgcccgcctaggcctcccaaagtgctgggagccatcacacttggcctagtttgaggtcttacatctaagtctttaatccttcagttaatttgagttatctttcgtatatggtgaacaatatgggtccagcttcattcttctgcatatggctaattttctatttattgaataaagtatcctttttctatttattgaataaagtatcctttccccgctgcatttccctacccccaccacaccctcaggtctccccttaccactcacccaccagcccatgcccccatggcctctgcccctgcctttgcttgcctctagccctgcactcagatcccaggcccataatcagaaaccacagtgcatatttttgtcaacttcatcgaatatcaattagtataagtatgtggctttatttctgggttctctcttctgttccattgacctgtgactatttttataccagtaccatgtttactgtagccttgtagcataacgtgaagtcaggtaatctgatgcctcccactttgttctgcttaggattgctttggttattcgctctcttttttggttccacacgaattttagaattgttttttctaattctatgaaaaacaatgttggtaatctgacagaaattgcattgaggctgggtacactggctcacacctgtaatcccagcactttggaggctgatgtgagagaatcacttgaggccaagagtttaagaccatcccctgggcaacataacaagaccttgtctctacaattttttttttttttttgagaaggagtctcgctctgtaacccaggctggagtgcagtgatgtgagctcagctcactgcaacctccacctccagagttcgagcaactctcccacttcagcctcccaagtaactggaagaaaaggcgtgcatccccacgaccaactaatttttgtcttttcagtacagatggggttttgccacattggccaggctggtcttgaactcttgacctcaggtgatccacctgcctcggcttcccaaagtgctgggattataggtgtgagccaccgcacctggccaagctttgtaaatttacttaacttctctaagcatgaaattcccatttgtaaagtgaaactaataatgtcagcctcacagaattgttgcaaagattaaataataaatataaaatgtttaaattagtgtctggcattatggtagatacactataaatagacacatattattattaagtacatctctctacacaaaaaagacctagaatcaaaatttaaaagctgtccaggcacagtggtttgtgcatgtaatcccagcactttgggatgccaaggtgagagcatcacttgagccaaggagttcaagactagcctggataacaaagtgagaccccgtctctacaaaaaatacaaaaaagtagccaggtgtgctggtgtgggcctgtaatcccagctactagggaggctaagccaggaggactgcttaagcctggaaaggctgaggttgcagtgagccgtgatcatgctacttgcactctagcctggacaacagggcaagaacctgtcttaaaaacaaaacaaaacaaaacaaaaacaaaaaaagctggaaggtactcagaaatcatttggtccaattgcagtgacttcatacatgaagaaactaaaagaaagaatagctggcttgcctgacaacgctctgctatctaatggtagagttgcaattaacacttaggtttctgggatctcaactgatattttccctacaatctcaaaatgtttcttgttcatctctctgataacaattaagcctaacttttctaatctcaatttcttcattgataaactctaaggacaggatgaattcacaggatcttccaactccaaaattctcattctatgattgatttggagccataaattggctgacctaaaaggatgtcaaacatatttccagtatctgtatatgcttagttttcttatggtcatatttaaaattctaaaacttaagttattagttacatgaaaataatttgtctctcacaagcagccaagtcagtaagagactgagactatcagaactcattatagataagttcctagtacctaaattgagtttacatatatcatacaattaacttaatattaagtgaaatattaagtgaatataagtattattaagtgaaataataaaagttttaaaaatacccaccatatgattaaaattgacctacatatgttaggcaagtttaaagtatagggtgttttgattcatcaaatatgaatagacagctacaaaaacataccaaaataagggttaacagtctgctttaaagaagaagccacttttcattttatttaagtcttaaactcacttaagggaacagggaaaggtactgacaataaaatttcttgaacagagatctgtggatcatgctcaaaatcatggactgtgaaacaaacttaaaaatctgggccgggcgcggtggctcatgcctgtaatcccagcactttgggtggctgaggtgggcagatcatgaggtcaggagttcaagaccagcctgatcgaaatagtgaaaccccgtctctactaaaaatacaaaaattagctgggcgcagtaccacacacctgtaatcccagctactggggaggctgaggcagaataatcgcttgaacctgggaggcggaggttgcagtgagccatcatcaaagaccaaaagtagataaaaccacaaagatggggaaaaaacagaacagaaaaactggaagctctaaaaatcagagcgcctctcctcctccaaaggaacgcagctcctcaccagcaacagaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaacgcagaagcctcaggagccgacgcgatcaactggaagaaagggtgtcagcaatggaagatgaaatgaatgaaatgaagtgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaaggtcagccagagagaaaggtcgggttatcctcaaagggaagcccatcagactaacagcggatctctcggcagaaaccctacaagccagaagagagtgggggccaatattcaacattcttaaagaaaagaattttcaacccaaaatttcatatccagccaagctaagcttcataagtgaaggagaaataaaatactttacagacaagcaaatgctgagagattttgtcaccaccagacctgccctaaaagagctcctgaaggaagcgctaaacatggaaaggaacaaccagtaccagccattgcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatgaaactagaactcaggattaagaatctcactcaaagccgctcaactacatggaaactgaacaacctgctcctgaatgactactgggtacataacgaaatgaaggcagaaataaacatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaagacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaatgaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagggtccaggaccagatggattcacagccaaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaagcctttgacaaaattcaacaacccttcatgctaaaaactctcaataaattagctattgatgggacgtatttcaaaataataagagctatatatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaacaaaagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactatctgacttcaaactttactacaaggctacagtaaccaaaacagcatggtactggtaccaaaacagagatatagataaatggaacagaacagagccctcagaaataacgccgcatacctacaactgtctgatctttgacaaacctgagaaaaacaagaaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatatccaaaacaccaaaagcaatggcaacaaaagacaaaattgacaaatgggatctaattaaactcaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacaaacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacgagaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggttgggggaggggggagggatagcattgggagatatacctaatgctagatgacgagttagtgggtgcagcgcaccagcatggcacatgtatacatatgtaactaacctgcacattttgcacatgtaccctaaaacttaaagtataataaaaaaaaagaaaaaaaaaaaaaaaaaagaatcgcttgaatccaggaggcagaggttgcagtgagccgagatcacaccactgtactccagcctggcgacagagcaagactctgtctcaaaaaaaaaaaaaaaaaaaagaaaaaaagaaaagaaagctattagaagatggtcagagaatgacagattacattaatgcatttaatatttcaataatttccatgtagtctgtactccctgtttctattcccttacttcctagtcattcatttccccctgtgactctcttgaaactgaaataggtatgacccaattgtcacattcagcggccacttctcagtccttatttgactcaacttctcttcaacatttacacatacccaacacctggcctctacttgtcttctgagtgctggacctgtattttctcctgcctactgaacatctccacttgggaagtccagacctctagttcacatttatcttcttccccaacattttcttcctcctctacccttaatcttacatctattccaccaccctcacagctacccaaactactcacaagtcaacaagttctagcaattctatccctcttattgaaaatcaatttattctttctccatccccaaaactgctgcctgaattcaaactttcgttatccctagactgagggccagaggtccagaaattctgattcaattgagaaactcaaaaatctggtttgtttttaagaattccaaatgactccaatatgcaacgattttaagaacgacaacaactttctagctgatctctccctaatgaagtcatcctctctacagggccaacaagtagtcaatatatactactgaaaaaccaccaggcatcaagcaccacgttagacctaaacataacaaagaaagacaacaaaatctctaccctggcggggtgcggtggctcacgcctgtaatcccagcactttgggaagccgaggcgggcggatcgcctgaggtcaggagtttgagaccagcctggccaacatagtgaaaccccatctctactaaaaatacaaaaaaaaaattagctgggagtggtggcgggcacctgtaatcccagctactcaggaggctgaggcaggagaattgcttgaacccgggaggcagaggttgcagtgagctgagattgcaccattacacttcagcctggccaacaagagcaaaactccacctcaaaaataaaataaaataaaataaaataaaataaaataaagattacctgggagaaatatttttggagggtttttccttattacagatttgataactttaaaattctctggccgggcgcggtggctcacgcctgtaatcccagcactttgggaggctgaggcaggcagatcacgaggtcaggagatcgagaccatcctggctaacacagtgaaaccctgtctctactaaaaatacaaaaaaattagccaggcacggtggtgggcgcctgtagtcccagctactcgggaggctgaggcaggagaatggcgtgaacccgggaggcggagcttgtagtgagccgagattgcgccactgcactccagcctgggcgacagagcgagactccgtctcaaaacaaaaaaaaaaattttctgtggctccttactgtctacagtataaggtccaaaacccttcaagctacctgttgcaaacatcccatccacatccagaaatacgcacaatccccctactctatactaaactatatcatgctcttggatttgtctggttcctatctctaaaatgcccttctgtcctttttccctccttgcctgagtcactgccatcctctgcaaagacttccacaatctctattccttgccctcccctaccacaccccctctccaccacatagttactttttcttttgtgcttacaaacttttcctctgtgtatctattacacttatcacattgttttgtaattatttatctgtctcctccattaaaactcagcaggttttttttttactctcaagagtgttttgcacagtagttagcacaaaataaatattcggtagtacataaaatgaatgtacctatgttctaagtcctcatctacctcatctacaaaaaaaaaaaaaaaaaatggagattagaaaaataaaggaagtgataagaaaagtgttccttaaagaaatttggagtttataattataataacactgaaacaccattttaaaaaaatcagccaggtgtggtagttcacacctataatcccagctattcctgaggctgaggcaggagggccacttgagcccaggaggcaggggctgcagtgaacgtgacggtgtcactgtgtcactgcactccatcctggctgacagagcaagaccctgtttcaaaaaagaaaaaaataagaaaagaaagttaaacaccaaaaacaacaacaaaacaccaacattagcagcagctaacatttaagactttttttttttttttttttttttgggatggagttttgcttgttgcccaggctggagagtgcaatggcacaatctcggctcactgcaatctcagcctcccaggttcaagcagttcccctgcctcagcttccctaatagctgggattacaggtgcccgccaccacgcccagctaattttttctatttttagtagagacggggtttcactatgttggccaggctggtctcaaactcctgacctcaggtgatccacccacctcagcctcccaaagtgctgggattacaggcatgagccaccgcgcctggctgagacttttatacatattagttatctagttctcaactttataaggaggctagtattattacaactattttactgagacacagagaagtaacttctccaaaactacacagatagtaaatgaaacaggatacaaacccaggtagtctggcatcagagttcatgttcttaactactaaattacattatttctttagctcaagcaaaaggccactggaattagagaagaaaattgagtactagccctggttcttttcatttcttaacgtcttctttattcttagttctagtcctggttctttaatatcttaatctcttctttattcctaacatgctaaaaaaaaaaaaaaaaaaaaaaaaaactactcaaaaagaaaatcattccattagctgtcactttttaaaattcacttcaataaattagcaatactttcatcaaacttagatgggcaactaatctgggaagccttcccaacatctaaaaccagggccctcttgctgggtgttcttggggcatcctgagtttgtccttcctagaactcattcaagagtatagttgtatgaatctctgaacaattcctctctcttccactggacgctaaactccacaaaaaattcatgactactttacccatcattgtctgcacagcacacagttggcccacaaaagatgtctcaaaaaaaaaaaaaaaaacactaatcacagtttttttgttttgttttgttttgtttttaacacagggtctcactctgttgctggagtgcagtggcacgatcttggctcactgcaacctctgcctcccaggttcaagcaattctcccacctcagtctcccaagtagttgggactacaggcgtgcaccacgatgcccggctaatttttgtattttttggtagtgacggggtttcaccacattgaccaagctggtctcgaactcctgatctcagtgatctgcacgcctcggcttcccaaagtgatggaattacaggcatgagccactaagccagcccacagtaagttataatacttaagaaagaaatggcaacaaggtttacaagctgcctaaggtactaaacgttgattaaatttctaaccatcaagtactttaaattcatgtttttctttgaaggactattaagtaaaatattcaatacatacatattggagctacttcactttggttttgttttgaggtttttttgtttttgttttccagcttctttcaagcctcagagaaacaccttagtaagctaatgaaaaaggaggagcaggaggagggacaaaagcaggagaaccagaaaccaaatttccgtaaagtatcctgagacttattgatgatgttcaaacactttgagttctaattgatggtaagcagtttgtctgtttcttcttttaaaaaatgctatttaaaggaaactattcagaagaaaataagaatagttaaaatgaaaagttcatctaaaaacaaaatgctaaaggaatgccacataattttttttttttttttagacggagttccggtcttgttgctcaggctggagtgcaatggagcaatctcagctcactgcaatctccacctcccgggttcaagtgattctcctacctcagcctcctgagtcgctgggattataggcatgcaccaccactcccggctaattttgtatttttagtagagtcagggtttctccatgttggtcaggctggtctcgaactcccgacctcaggtgatccgcccgtctcggcctcccaaagtgctgggattacaggaatgagccactgcacccagccaaggaatgccacataatttcaaagcacagagtccatttcaaataaatctctaaattaacaatagctttaatcttatagcttaatatctgtgctgagaaataagattagcagggaggggtaaaataggttgccatgttacacaatttaaagattcaagttatacttgttggtaaataccacttgtagagttaataaaatatatattctaccttctaaactagtaaatcaccagatttaagacatttatcaaaatgtccctattaaatactcagcattaacactgacccaactacaagataaaagctgaactccttcaaagggactcttacgtcctctcacaatttggtctctagccaccacggtagcttcatctcttactaattgctacagaccatctcacttcctaagcttcattgttcacactcctcacagtactacctgcgccttttatgactccatctctttgcatttgctgttccctctgcctgacatgcccttccctcttctgagctgtgaatatgcccccgtccctgaagcttttcctaattgccctcacctcccacagagtgcctcctgggtcctctgtcctcttcattattctattacatagcactgtcattacttttaaatgttcacctcccaaacagcctgtgagttctaaagggaggacccacagcttaatcaactgtttcctaccccttagcatgaagcctggcatttactgaaactcaatataaatacactgaataaaagaaaattaagtacttaactgtgagaaacacttcaaactttcctactaaagagttaatgcatttaacacagtgattctcaaccagaggcaattttgcccctaggggacatttggtaaaatctggagctatttttggttgtcacaagggggaagggatataggggaatgctactggcatctagtgggggtagatgccagggatgctgctaacatcttacaaggcacagggcagcctcccacaacgcagaattatccagtcacaaatgccaatagcgccgacgttaagaaactcagttgtcaactgacttattcagaagtgatgattcaatatcacatctctgcaataaccacaatcaatttcacttttgtagtttcaacagaagcttctttaacagttgataggtatgcaccaacattaaaaatgatcttcatataatctcgatgtttaactttaaaccaagattactagaaagcatcccatatttctgaaaaccaatctataactacagctgagctacccttaaaccagtaaacacttttatttgtaaacttcaaagcaaaccacaggcaaactaattttcacttgcagaactatgacagaaacacaatctgaaacatgaggtaatcagttcctccaggtctgataaaagaaaaatctcctaaagcctgaaagtaaatcatgcacagatgtctttactgctgaactaaggaagtgatggggaaagtaaaggacatgcccttgttactgccaaaatcatcgcttaccgggatttcaaaattcacaaaacactgcaaaatacaattaaatgtcaacacaggttgtcagataaagaagttaactatttctccctctaataactgaccaagtttcacatgacttcattctttcaggagaaagctaggcagaagcaagagcactcccttcctatctactggatgactcaactctcttccgcacattcctcggctgaatcctacaaattcactaatttcttttgtcctttgaactagttatcctactccctcggtaaagaactaataggctcggcacctacttttcaatcatttacattttgttacaccctatcagcctcaaaaagaaaagaaaaaagctataccaaaaaaaaaaaacaaatttaagttgacaggtacaataactcttacaggaaaagagatgtgaattatgttattctagtaactgattcttaaatgatacacctacagttttctaatgctctaatctttctatcctcaaggttttccagatttcagagacagcacaggcagaaactaagtgtatataccacttgatcaagcttactgcggatttattcttggatagctaaaataaggtagtggggcttgcacagaaaacatatttttaattaaaaaaaaagtttccaacagtgagtaacatcttccttctcggctgactgtgccagtgtcagtcccacgcctgggcccaggctaggccggggctcaccacaccaccctccactgtggtccaaaggagaaagcagggccgtgtgtggcaggtgcgcatcgtgtcaaattggggggcacggggagtgcggcgggtggggaaaggcgaagcaagccgcccgaatctcccatggggcgttctccagcccggcaggcggcggctggcccgtcccacgggcaccaactctccattttcactcccactcagggttcccgggaggaacgcgccggcaccacaccctccagctcgcagcccgctcgcacacacggagccccgcgccggagcgggcgccaggcctggacgcgcggggccaccagggctctgcctgccgccccgccgcgccggccccacccgccctccccgcccccgggccgggcgaccgaggcctaagcgcctgccgggctgtggggcctagggaaggaaggagcccgcgctgaggaggggcgcccgcgccgcggccccgagctccggctgtcccgctcacgtgctgccagaaagacggtttcactctcttaccctctgtaaaatcctccttaacatggtttaaccaccacccggcgccgccgcggtgactctccagaccctgcgcggggccactcactactcggggtgcgcgggcgggagggactgggccgggaggggaccgggaaggaggtcggggcgaggcggtggcgacggccgctcgggcggccccgacttccccacaggcggcgagagggagcacgcgagagagagcgagcgaacgactaggcagcctgcgagcgcctccagcccgcccgccgggcagcccccgtaactgacagatgggcgggcccgcccgcggccgccggggggcggggcggtggcgggcccgcccctcgcctgtccattcgcgggaggcggggctgaagggggccggtccaggccagcgaccaatcggaagcggtggcaacgtgggcggctgcgtgacagacaggcggcaggacgctgtcgccgcagcttcttccggctagctgggggacgccgaggctgcggagtgcacgcctgggctccgtcagagggccgcgcccgcgcgacgaccgcgtgcccgctagtgggaggcgggcgaggacccctgggggtgtccctccctgacccaggcgggaggaggggacgccttaggctgttttgtaaaatgtgtcggtgtgacccttccggcgatggctcctgactcgacgtggtattgagcctgagctatatgctagtttctgctggaaacgctgactctgcctcttagcccctgggttgaagccgactagagaatctcagacgtgcttaaccggtctgttgggcttccctgcccttttccagtcccaggtttcctttccctgctcccttcctgcttctaatttcagccaaagagaaagcaaagatttagaaaagaagggtaggaagaagctggaatttgaattggcaagagaagtttgaggttgtcttttctagatcaaaacaatttttaataggctgatgttcacatgttgcactttctaaagcccgtgcttgacctcctaaggaattttaagtcctattctgataatcgatttatgaagtaaattgtcattaacgcctctgttttatagattaagaagaaaatgaggtcacagataaatatcgtgccaaaacgacgtggtctttgaactgacctccaggcacgatgtcattatttaactcgagaaatcacagcttctgcgtcctaccattctgccaatattcacagccaagaggctcaacttaacaccctggtagaaaaagagaagcctttaatattgcttgaatagggaaggagagggaataatggaactaaccttgctgggagggaaaaaaaaaaaaaaagaaaaaaccaacagaccactgaatgaagcctatgaagcaatgaatggagtgctttttggaaagcacttccagatcttttgaaaagcagcacaaaattaaatattatttgcaaatcagttaatgaataggaaaatgttttgtaaagtataatgcattatataatgtaatatgatatttctatcccaaatatatttggttttttattatgtgtgtgtgtgtctctcgatggtgcagcagcacggtcatgcctacagctaatatatgagtaatcactagtgataatgcacttacaaagaacatacttttccatctttctaaacatgaggtgctttattttcagacaatatgggaaacattctcagcgacatggggtgataaaagtgactttttttctcttttttgtttgtttttcaaaaattagtttagggtcaggcacactgattttatgcctgtaatcccagcacttcgggagacggaagcagacagattgcttgagctcaggagtttcagaccaacctggacaacatggcaacaactcgtctaaaaaaatattagctgggtgtggtggcatgcgcctgtgttcctagctactcaggaggctgaggtgagaggatcacctgagcccagggaggttgagaatgcagtgagctatgatctcaccactgtactccatcctgggtgacaaaatgagaccctgtctttaaaaaaaaaaaaaaaagtttaaaactgcttattaatgttacatgctaagaccttctttactggaattctcatgtagaatcctttgaataatataataggctctcatctacagctgagctagatggattattggaaaatctgtgtactcccctgcacagttcatgataactccatcactgggataatacactggagaacttaattactccaaaagaaaataagcagtgggtgagagctaaccatgtaagaatacccttcactaatctagcagcttcctatacatagcagttctgcttaccctgtctgaccactaattcccatccgttcagctcttgtgcattaatattcccccaccatctatttactttgatccccagcaagacctcaaatccattggcccttcttactttcttaatatcagtcatttccctagcctactcgtttccatcaaaacccaacctaaagcccatggtccaactttacaatcttccctttgcaaatatgcttaacttcttcacctttctttttttttttttttttttttttttttttagatgtagtctgtcgcccaggctggagtgcagtgtgcaatctcactgcaatctgtgcctcctgggttcaagcaattctcctgcctcagcctcccaagtagctgggactacaggcacccaccaccatgcccagctaattttttgtattttagtggagatggggtttcaccatgttgcccaggctggtctcaaactcctgagctcgggtaatccacccacctctgcctcccaaaatgctaggattacaaacatgagacaccatacccggccacttcttcacctttctcttcctccattgcttttgtctagcagaggccaaaccctggttaagttcaattaaccacctactctctgctgcacaggatccataggaatagaaggctgggcacagtggctcacacctgtaatcccagcactttgggaggtgaggggcgtggatcacctgaggtcaggagttcaagaccagtctggtgaacatggtgaaaccctgtctctactgaaaatacaaaaattagccggacgtggtggcgcacgtctgtagtcccagctactggggaggctgaggcacgagaatcacttgaaggcaggaggtggatggaggttgcagtgagctgagatcacgccattgcactccagcctgggcaacagagtgagacttcatctaatacgtatatatatatgaataggaaagtgtctaaatatcactagagatacacatatataactggggttgttgggctcattctgcattaataaccacagatctcaggcatatgtctccacaacaagaatatcaattttctgagcacaaggatcttgtcccccattcagtgctgtgaccccaaaactaaaacattgctcaattcatggtaagcactaaataaatatttgttgaacgaatgaaggaaggattgaaggaatgaaaggtatgtaattactcctttaacagttgcccagcagcattcctgttacactttatttctgtcttctttctcaagatcttcaagatggcctacacatctatagttgctgcactttcttactgtatattttcttctcgacccattccaatcaagcctctgtagcctgtgtcccactgactccaataaggctgttcttatgatcactaatgacctgcatgtttcctattccagtgactactttgttgtttcgacttcgactgtttcctatatagaaaacagttggccactctctccttgagttactttattctcttggcttccttgacactatactttctggtttttctcctcattgcccattccctctatgtctgatggcttctctactgcgtatcttaatgttggagtgcccctactctgttctggggcccttgcttttatctgtcatactcagcctagaagtaatctcaactagtcccctgacttttaatttcatttatcaggccagctacggtggctcacacctgtaatcccagcactttgggaggccgaggtgggtggatcacgaggtcaggagttcaaaaccagcttagccaacatggtgaaaccctgtctgtactcaaaatacaaaaattagcccggcatggtggtgcacatctgtaatcccagctactggggaagctgaggcaggagaatggcttgaccccaggagacggagattgtggtgagccgagatcgtgccactgcacaccagcctgggcaatagagcgagattccatctcaaaaaaaaaaaaaaatcatctacttcatatttcttcttggatgtctagtgagcatatcaaacgtaacatggcccaaacaaaactgtttcatttttatcctcaaaacatcgtcaccagttttcctgtctccatatgtatcactacaagatacttagttgattcaaaccaaaaatctctttatctcaccacttctcctccttccagcgaatccatcaggatatcctgacaaatccacctccaaaatatatcccaaatctgacacttcttgccactttcaccctagtttatagccccttcatctcctgtcaagactactagaatagtcttctagttggtctcccgccttttactttggcttctctgtaatccattcattacacagaagccagggacgactttttaaaatgcaaatcaaaaatgtcactgccctcctagattgtagcttccattatcatcacaatgaaatccaaataccttatcctggcttacacgccctgctgatctgggcctgcctgcttctctgctttccacttagaatatcctccccttgacccactatgccccagctgctctggacttttctcagttgcacaaaacctgttcctgcctgtacaccaaccagttcctatttagggaatgctttctcctgaaatctcatagttaattttgtgtcattcagattattcccttaaggtcacctccttagagaggccttcaaggaccacctcatccaaagtgcttcgaatctctggtcacccattctaattctctacatggtagagaaactaccatttctgacttctcttgtttgtctgcatatgtcttcccaacaagaatgtcaattttctgagcacaaggatcttgtcccctcttcagtgctgtgacttcaaaaccaaaacattgctctattaatggtaaatactaaataaatatttgttgaatgaatgaaggaaggattgaaggaatgaaaggtatagaattactcctataacaattaacttccaaggttcctcaagctaacatcttcctatttatgaagaagtgatccaaatgcaacaatcctgaaagcaacccaacaatcttttgatcctatctgacaatcttttttctttttacataatgtgtatgtatgtttcttgactcttcaaaatttcccaatatttatgggaaacaacctatttcttactttccataaattagaacattgggccaggcataatggctcacacctgtaatcccagcacttgggaggctgaggcgggcaggtcacctgaggtcaggagttcaagatcagcctggccaacatggtgaaaccctgtctttacaaaaatactaaaattagctgagcatgatgacaggtgcctataaccccagctactcaggaggctgaggcaggagaatcccttgaatccgggaagcagaggttgcagtgagccaagatggggccattgcactccagcctgggtgacagagtgagactctgtctcaaaaaacaaaacaaaacaaacaaacaaacaaaacattgttaaggcacctttcttgtcaatttcctgtgctataaccaaataattcatttccaaccagaagcaagtccatgaaaaaaatcacaatatcacttgaacccgcaaggcagaggttgcaatgaaccaaggtcgcgccactgcattccagcctgggcaatagagcaagaaaccatctcaaaaaaaaaaaaaaaaaaatcacaacaaaaataagcaaagtgtagatgatggctctgtataagtaaggccaaaacagtttatggattctttagaatccagacatgaccactaacccaactaaaatagctttttctttcttttttcttttctttttttttttggttttaaattaactgaattgttcacaaattatgttagcatcattgaactaacttgttgaagcctagcatcaagcctatgcttctttcagcccttgagggcagggtagggagggcagtaaagatgaggagctcagaggagttgggagatacatgaattctctagtacttcctgctggttttctccaggccctaggtgacttgcataacctcaaaaaaagtatctggtctccattgaatttatttgaaggcaggattagggaaaattcagaataatagtgaggactaagttctgatttttttatcttgcccaaattcctacctaagggtcctagggagtcatgtcctacaaaccgtaaattctcatcagatgggttttatttgatcctatatatagtgacttacttttcttttttctttttcttttttttttttttttttttgttgctgctgttgagactgagtctcgctctgtcgcccaggctggagtgcagtggcgcaatctcggctcactgcaagctccacctcccgggttcacgccattctcctgcctcagcctccggagtagctgggactaccggtgcctgccaccatgcccggctaattttgttttgtatttttagtagagacggggtttcaccatgttagccaggatggtctccatctcctgacctcgtgatctgcccacctcggcttcccaaagtgctgggattacaggcatgagccaccaatcccggcctatagtgacttacttttcagtcttactctggcataacattatgacacaaggagaaaatattaaaccgcaaaatatattttcttgccataccttgaaaatgtcctgcaaagtctcttgtgggaaaaatccacatcctgtagagaatcccctttcccctttggtttccttctttcctttccagatccaggagataatcaactaagagccaggcacccttttaggtccaataagaaacattttacaacctactctctctctctgtctctttttttttttttttttttttttttttgagatggagtttcaatctttcgcccaggctggagtgaggtggcgcgatctcagctctctgcaacctctgccccccgggctcaagtgattctcctgcctcagcctcccaagtagctgggattacaggtgcgtatcactacacctggctgatttttgtatttttagtagagatgaggtttcaccatgttggccaggctggttcacctgccttgggctcccaaagtgctaggattaccggtatgagccaccatgcctgaccacaacctgttgtctctctgaagtctgctgagagattcttctgcacaataaaacttggtctccacaatcctttatctcaacctgaacattcctttccattaatcccaggtcttcagataaactcaaccagttgtcaatcagaaaatttaaatttacctatagcctgctttaagttgtcccgcctttctaaaccaaaccaatgtatttcttaaatgtatatgattgatgtctcatgctttcctaaaatatataaaaccacgctgtaccccaaccaccttgggcacatgttctgaggacttcctgaggtctgtgtcatgggccatggtcactcatatttggctcagaataaatctcttaaaatattttacagtttgactctttttgtcgacaataattacattttaagatatattataaataatgcccttccagcctaggcaacatagcaagaccctgtctctataaaaatttaaaaatcagccaggcatggtggcacacacctgtagtcctagctacttgggaagttgaagcaggaggattgcttgcatgcaggagtttgaggctatagtgagctacgacagcaccagtgcattgtagcctgagtgacagagtgagacattgtctctaaataaataaatacatgttttaaaataaatgaaaagaaaaatgatgttcttggctgggcgtggtggcccacgcccttaatcccaacactttgggagaccgaggcaggtggatcacttaaggtcaggagttcaagaccagcctggccaacatagaaaccctgtctctactaaaaattcaaaagttagctgggcatggtggtgcacacttgtaatcccagctactcaggagactgaggcactagaatcacttgaacctgggaggtggaggttgcagtgaactgagatcacaccactgtactctagcctgggtgacagagtgagactgtgtctcaaaataaaaataaaataaaataaatattttaaaaatgatgcttttaatatatgaaaagcaatagccaagtctatcacatttaaacttcaagtttgtagagtacaaaatagacaatgtaaaggtggcacaacaaaaattcccatctatgataacagggtgactcttgaatgccagtgtctcctaagcaagacctgcctgtgggccccaagctgagcagcaacaaaatgtaatacaacatataaagtattacaaaagtggtgtgggtacattttagaaacagaactaatatctgaagctatttcctgaaatatgtctgtgggattgtggaagctaaagcaactccatcttagatgctaatccaccatgttgacatctgattaatctgtgttcccggaaggcctctaagatttctactttttccattgttacagtgaatccttcccttaggtcaaaacaaccttgaccataaatcctaccttagccagactcacacagcattcttgccttccccttggaagtcaacttcaattgtgctacacattttttccctgtgatatttaagccctgggtctgaagggtaatggaacgggagtccaccatctcccttttggacatctgagactgtgccttctttttgtaaatccctgttaaatgtttctttctgagaattggttgtatcagcctctttcttcagcctctcagcttcctcagacgttggggtaggtttgcatagacctactcaccacagaacagtggtcaggtgaagttatttagagtgcagtatagagatgtcatcccagcattagtcagagcttagatttctttaaatttgtggagtgtagtgtttttgaaagtgtgttccttgaagccctagagtcctcagaagccacctcagtggatggagaaaatcgagcaattgaggccctgtgctattcacctttgcattagctggtatagctttacttttatctttatgtgttttacataatagggtgatgaagaagaattctttctttctttgttttcctttcttttttctttttcttttttttttttttttttttttttttttggttgtagataggatctcactctgtcgcccaggctggagtacagtgctgcgatctcagctcattgcagcctcaacctcttggcctcaaatgattctcccaccttggcctcccacagtgctgggattacagatgtgaaccactgtgcccagcctgacattattttctttacactgtacacttcaggcatgctgaactattacacatttctgggctcatcatagtctctcccttacttctgaaccattatatatgctatttcatatgcctggaatgttccctacacccatcctactgttacttgtctaattcctactcatctgcaagtctcaccttgcctcccaaacgaaactacatggcctacgtatacctacatttttgtactcaaccctgtaactacagggaagaagagaccttgggtcaaaaactcaaaacactccgggccacatgacaaatttgacaaaaatgtaaggtacgtcttccaactaccttctcttgttctgaatacacacccccaaactgtcaattataattggattcccatgtagttttgtctttaaagagtaaatgcactggtcccattggtacagcacaactcacataaaaaatttgttgccctttgtaaattaataccatttcagcctctgtacgtttgaatattatgagtctgctaagagaagaatttactttcaacatgctgacaaaaattcaagttttgaagctgctgagcaaagattcagagcctggaccacagtgaatttaccaatttaaatgagcatcctgaggtctcttgacagctagccagctggcctccctacatgatataattaggatgatgggctgcatacaatttagacctacagcacttctatctccccttagaatttgatagaaactcaatgatagatgattccagaggctaattctaacaataccattgattaaactcatagattacttagaatggtctgaacatttaaagtaatgcagtaaggactcaaataaatggtttttgtgaaatactaatctgaaaatgtcttgctagcatatagatggcagcataagtaaagaatagagatggtaaagtactctaaagtattattactagtgacattattattttgtaaaaatatattctagtggccgagcacggtggcttatgcctgtaatcccaccactttgggaggccgaggcgggtggatcacgaggtcaggagatcgagaccatcctggctaacacggcaaaacctcatctctactaaaaatacaaaaaattagccaggcgtggtggtaggcgcctgtagtcccagctactcgggaggctgaggcaggagaatggcgtgaacccgggaggcagagcttgcagtgagccaagatcgcgccactgcactccagcatgggcgacagagtgagacactgtatcaaaaaaaaaaaaaaaaaaaaaaaaaatatatatatatatatgtatatatatattctagtgaaagaggtacatacacacattccctctctcatttacatcattgtttctaagtgatatcaaatgaaatttaatattaaaatttgtaagataacataaacaacacaatacactttttttttgttttagatgaagtctcaccctgtagcccaggctggagtgcaacggctcaatcttggctcactgcaatgtcttcctcctgggttcaagcaattctcctgcctcagcctcccgagtagctgggattacaggcgtgcaccaccacgcccagctaatttcttcgtatttttggtagatacagggtttcaccatgttggccaggatggtctcgaactcctgacctcctgatctgcccacctcggcttcccaaagtgctaggatcacaggtgtgagtcaccgcgcccggcccaatatgcctttttaaaactttttcaggacaatgcttgttatgagttaattggctaaaaatgggacccaaaaatatattctattgacatattttggttaatataaaaaatagacatttagatgatgaaaaaaagcaacaaacaaattaacctgaaaagaaaattaaagaacaacttgggaaacatacagtactcctcctcttccttttccctaatgcctctttcctcaggttgtagagcattgtgtggccttcaggaaaaaatatcaatttgctcaattaaattaaaatccagtttgtaatgttgttctgttgacctaaagggaaaaactgaggcaaacggaatgtaagtagagagtttatttgggccaagtttgaagactgcaacctaaaacatagactcaaagttccctgaatatgtactccaactagcagcaattacaagtagctggggttttgttttattttattttatttatgagaaagggtctttctctgtcacccaggctgagtgcagtggcacaaccatggctcactgcagcctgtgcctcgtgggctcgagtgatcctcttgacttttttcttttttttttttttggtagagagagggtctcactgtgttgctcaggctggttttgaactcctgggctcaagcaatcttcctgcctctgcctcccaaagtactgggattacaggcacaaaccaccacacccagccacaagtaggtttttaagggacaagaagaggtgatcttacactgtttactgatatggtttgtctctgtgtccccacccaaatctcatgttgaattgtaatccctacatgtcagagaagtggcctggcaggagtgactggatcatggggggcggatttcctccttacttttctcataaaagtgagtgagttctcacgagatctgatggtttaaaagtgtggcacttcccctttcactctctctctcttcctgctctgctacggtaagacgtgctttgctttccctttgccttccgccatgattctaagtttcctgaggcctccccagccatgcagaactgtgagtcaatctaacctctttttaaaataaattacccagtcttaggtagttttttttttttttttttttttttttttgagatggagtctcgcttcatcacccaggctgcagtgcagtggcacaatctcggctcactgcaacctccacctccagggttcgagtgattctcctgcctcagcctccccagcagcttggattacaggcatctgccaccaccctgggctaatttttgtatttttagtagagacggggtttcaccatgttggccagtcttgtctcaaactcctgacctcaagtgattcgcccacctcggcctcccaaagtgctgggattataggcatgagccaccatgccctgcctcaggtagttctttatagcagtgtgataatggactaatatatgtaccaataatttacatttaaataatataatttattgattggctgtaccatgttctttgtatcacaaatttcaggaacatgaagataatgggcagttcagctagtcagaaacaaaatggctttttttttcttcaaaataggtgtatttaaacagagacagggtttctctatattgccgaggttgatctcaaactcctggcttcaactgattctcttgtctttccaaaatgctgagattacaggatgaaccagcatgccagccaaaatgcctttaaacaattgtccctgactgggcacggtggctcacacctgtaatcccaacaccttgggaggccaaggcaggaggatccctcgagcccaggagttaaagaccagccggggcaacaaaagccatgatcatgccactgaacttcagcctgggcaacagagtgagaccctgtctgaaaaaacaaaaaacctgataaagggcacgttggctcatgcctataatgcgagaactttgggagaccaagaaaggaagattgcttgagcacagcctgggcaacatggtgagaccacatcttcacactcacacaaaaattagccagacatggtggcatgcacctgtagtcccagctactcttgaagctgagtggggagaatcacttgagccagggaggtcgaggctgcagtgagttgagatcatgccattgtattccagcctgggaaacagagcaggaccctgtgtcaaaacaaaaacccaaacaaaaaacaattacccctgggcatagatgcaagatggtggggggttgtaggatgtgactaaagtcacatactcatgtctctctgggcctggcacctcttgcagacctcacatagctcagattgctctgagctatatttctttcctcaattcactcaagaaactgcgctatatatgttgttactgcataacatgatgggaagaaatgtaaaactaataaataatttagtttttttatgagaagtgacaaaaatctttaaaccctttcatatactgaagaaaaagtctgaaatagcatatatcgtaattttaagtagaaaagttaggggtattgaaaccaccttcgcaaaaataaacactgagaaaattatgaaagaggtctgacctgactgactccagcttgcttacactctccaagctgcccttcttcattcctgggtgcaggccaaactaactttgggaggaatttaatttatagtctaactttgaaacaaagatgataacagcagtttcctgaaacaaacctccttcttgccagggggaccagactgcctttgtaagactaacatattaaccacaagattagaaatgatggcttaggagccatgcagccagaagccacaggatttcaaccctccccagttgctcctagggataatattactattgtaaaacctgagattggtgctcaagatattttttagaccctgcattatggtgcatcagctggcacctcctgatcaatcagcactctccactccctggccctctacccaccaaactatccttaaaaaaatgcagtctctaaattttgggggggactgatttcagtaataaaactctagtcttccattcagctcgctctgtgtgaattaaactctttctgtattccaattcccctgtcttaataaatcatctctgtttggacagtgggcaaggagaacccactgggcagttacagtattattaggttaataaatatatttgtccaggagttcgagtccagcctggacaacatgatgaaactctgcctgtacaacaaatgccaaaaaaattagctcagcatattggcccatgcctatagtcctggctactcggaaggctgaggtgggaggattgcttgagcccaggaggctgaggttgcagtgagccgtgatggagcaattgcattccagcctggacgacagagtgagtctctgtctctagaaacaaaaacaatatatatttgtccctccatattgacaatcttgctaaattttaaatactgtgaggtagagtagattaaagggatctattgtaccttttgctctgagttaaaaagttgaaaacacttggaaagagcaagccatttttaaaagctgaaggcattcggaaacaccaagtcatttttcaagcttgcatagtagcttctgacctctagtgggaacttggcttgaataactatgcctacagtgtagagggagccatatctactcttgttttgtttcattctgttgaatttttattttcgtgtcttgtttctgtggtttgaagaataactactaaaatttggtttaagtgtaaatcctctaaagaaattcttgccagagcttttctttatattttaacttgcttactcaagcaacttaagcaacagttaacttaggaagttttttgttgaggtttttttttttttttttttttttttttttccccatgcaaaagaggtatcgtttgtgttgaaacctgggtttcactggacaacacaatttacctgtggttgacctgagtttcactggacaacacagtttacctgtggttggttgtaaaatgttctgtaattcaataaaataaagataaaatacaagactcttttggtggataaaaattaatcaatattttgactttaaagaagctttgtgtttctttttaaaatcaatgttttgactttaaagaagctttggtaagaatgtttcaacactgagtaacattctgttgaactttgcaaacattgtatatgattttaaaagtaatttatgataataggaagttgcattggttatttacttgctctgtattactttatatattgtaacttttcattgcaaagataaaaataactaaacagaaagtttgtaactaagcatttggtagcaccgtctaagcttcttacttatttcatttattcctcacaacaatcctgtgaggtaaaaagtaatgaggtgttttgttgttgtgattgtttgtttgagacggagtttcgctcttgttgcccaggctggagtgcaatggcgtgatcttggctcaccacaacctctgcctcccaggttcaagcgattctcttgcctcagcttcctgagtagctgggattacaggtatgcgccaccacacctggctaattttgtatttttattagagacagggtttctccatgttggtcaggctggtctcgaactcccgacctcaggtgatctgcctgcctcagcctcccaaagtgatgggattacaggcttaagccactgtgcctggctagtcatgaggtttaaaaagattaaataacttgcccaaattaagaagtgattgagcaaagatttaaaaccagacaacctgactcgagagcctgcagtgtcaatgatttctaatacttaaatacctagtatgctggttacactagtaaagaggcaatattattctaggagtttaaatgttttatttacttttttatctatatattttttaaaaaacattctcataagctttcatcacatataactctatggtcttcataattttaatttctaatgcctaacagtctatcaacattagaatgtagaaaatcaatccacaaggaagtttgtttttttatctctattgtttcatttttagtatatatattttaggtttttgttcgctcattaaaaaatgtataacaaatcagaagcatataaagtgcattccatgtgtcattgtataatttttaaaaagctaaaaccatggctctcatctagtacgtatataaagagttgtctgagcatgctggctcacatctgtaatcccaacactttgggaggccgagacaggaggattgcttgagcccaggagtttgagaccagcctgggcaacatagtgagaccttgtctctactaaaaataaaaagaacttagccacctgtggtggcatgtgcctgtggtcccagctactcaggaggctgaagcagaaggattgcttgagcccaggagggcaaagttgcagtgagccatgattgcaccactacattccagcagcctggctgacagagcaagaccctgtctcaaaaaaaaaaaaaatccaaaaacaaaatcaaagagctcatagataagagagtcaacaacaggagaaagccaattcaaaggggcataggacaggtagtcactgaaagaaaaaacaaatgctagactatactagaacaaacaaaaatgctagactacgattactaaattacataaaaactggttagtgccgcatagggtaataaaactaactgttgggttgtagtctgtttaccagcctcacaacatctgcatctctatgggacaaaggttatttgcacttatattacacaatgattatttgcatcactatctggttttctacaatttactttctgctcttacatctttaccaattatcactatctattatattgcatatcttatatatttactttgtttgctgtcttctccattagaacattttcccacttctgtacactgctatatccccaatgcctagaacactgcctagcacatagaatgtacttaaaagtatgtgtggaataaataaataagaaaaaatttttccatgctggctaacacggtgaaatcccgtctctattaaaaatacaaaaaattagctgggcatgatggtgggtgcctgtagtcccagctactcgggaggctgaggcaggagaatggtgtgaacccgggaggtggaggttgcagtgagctgagaccgcgccactgcactccagcctgggtgacagagcaagactgcatcaaaaaaaaaaaaaaaaaagaaagaaagaaaaaaattttttaaatgcagatcaatttgcctttaaaaccacaagctattttttttttaactttttacctttttctctttttttttttgagactgggtcccactctgttgcccaggctggagtgcagtggcatgatcttggctcactgctgccttgacctcctgggctcaagcgatcctcctgcctcagccccctgcgtagctggaactacaggtgcatgccaccatgccctgctaatttttgtatttttggtagaggcagggttttgacatgttgcccaggctggtcttgacgttctgggctcaactgattcacctgtgtcagcctcccaaagtgctgggattataggtgtgagcctctgcacctggccccacagttattttaaaaggaaaaatgggggaaatgtaaagtaaacaaaccccaagtacatttaaatgtaagttaaatcagctgtgtaaaggacacccaagccctcatattggtgattgaacagagaaaagcttgtttctacctatttgtggagagatgaatagaaacgacgtgtgatgaggaaataaaacatggagaaactggagaaaatctactaacccctcgttcttttttttttttcttttaagatggagtctagctttgtcgccaggctggagtgcagtggcgtgatctcagctcactgcaacctccgcctctcgggttcaagcgatcctgcctcagcctcccaagtagctaggatttcaggttcatgcctccgtgcctggctaattttagtatttttaggagagagatttcaccatattggccaggatgatctcaatctcctgacctcaagtgatccacccacctcagcctcccaaagtgctaggactacaggcgtgagccaccgcgcccagccttactaacccctcattctaaaggtaaatggaaggatacaacttgagaatgtaggagagaaaaaaaatttcttttcctctattctttttcattgtgtgggtccctgcaagttagcctgacaaaagatagattaacagaagaaaaggcatacaaattttatttaatgttaatttttagcaaacagaggtgctttttgttttttgaagagatgggatctcactgtgttgcccaggctggtcttgaaaccctgggctcaagcaatcctcccacctcagcctcccaaagttctgggatgacaggcatgagccaccatgcccagcccacaggggcttttctaaaaaatgaagtgaagactcagtaaagcagataggcctaagagcttaagtaccactttaaacaaagaatgataaattgtggagatggaacaaggcaacagaaaagtgttttaggtttccaagggcaaatggtgggaaggtaaatatatgggaggagaaactaatggagtaaggttgatttgtgcaggtccactttggtattgacaatctacagaataggagaaaatttttgcattccatccatctgacaaaggcctaatatccagagtctacaaagaacttaaacaaatttacaagaaaaaaaacaaccccattaaaaagtgggcaaaggacatgaacagacacttctcaaaagaagacattcatggagccaacaaacatacagaaaaaaagctcaacatcactggtggttagataaatgcaaatcaaaaccacaatgagataccacctcacaccagtcagaatggcaattattaaaaagtcaagaaacatggcaaggtccacatcggtggaagaaagcaagcaagctagggtggtagattattacctgtaaaattatctggccctggtgggttttctttgtatgtatgagaaaatttttaaatactaatttaatttttatgataattgtgatttctcctaaattcattcattatattctcttcttttaatttctgtttatcattattgaccttttccctctgtcttttaaaaattattattattttctttttgagtcagagtttcactcttgttgtccaggctggagtgcaatgatgtgatctcggctcactgcaacctctgcctcccaggttcaagcgattctcctgcctcccgcatagctgggattacaggtgctcaccaccatgcccagctaattttttgtatttttagtagagacggggtttcaccatgttggccaggctggtctcgaactcctgacctcaagtgatccacccacctcagccccaaaagtgctgtgattacaggcatgagctaccacgcccaactcttattttttattatttgagacagagtctcactctggtcacccaggctggagtgcagtggcaagatcacagctcaccacagcctccatcttcccatctcaggtgatcctcccatctcagcctcctgagtagctgggactacaggcaggtatcaccaaacccagctaattactgtattttttgtagagacagagttttgccatgttgcccaagctggtctctaactcctgggctcaagcaatcctcctgccttagcctcccaaaatgctcagattacagacatgagccattcttcatttttctggcctattcttcatttttagtttcccattctggccgacttgaccattatcttttgcctagatgactatagaatcttcctctctaaatgattgtttggctgggtgcactggctcatgcctgtaatccaagcactttgggaggccaaggagggaggattatttgagcccaggagttcaaaaccagcctggcaacaaagtgagacactgtaagaaagaaaagaaaagaaaagaaaaggaaagagaagagaagagaaaaagaaagaaagagaaaaaggaaggaagaaaggaaggaaggaaagagggagagagggaggaaggaagggaggaggaaggaagagagggagggaggaagagagggagggagagagaaagcaataggagggcaggggaggggagggcaggggagggaagggaagggcagggcagggaagggaagagaagggaagggaagggattagccaggtgtggtggtagacgctggctgaagaagtaggaggatcactcccaggaggtcaaggctgcagtgagccatgatcacaccattgcactccagcctgggcaacaaagcaagaccctggctcaaaaataaaaataaaaaagtcattgtttatatcacagccagaatggtcatatttaaacataaactagatttcttttcctaaacataacctagcctataaatcattaaccagtttatacacataattctgctccttgttctattctcacttaacaatatattggacctcactatgttcaaatatgacatgggacatacatttttttttcttaaagtattctttgtttatatgaaattcaaatgtaactgggtgttctgtatttttagttgctaaatctggcagccctacttctaccattggtccaacacaaggtggctgttccagttctagcctccactcagccatgggaagagcttaagtaggcttgaggagcacaagtccagttctctttagggcaaaacctggacatgtcacatattacttctgtgcatataccatgggtcaaaacatttccacatttagcttctaaggaagctgggaaatgtagtctttagctaggcaggcatgtagccaactaaaaccctattgccaagaaagaaaagaagaatgggtacgggaaaacaactagtagtcccacattgacaataatcttggccaggtgcgtcggctcacgcctataatcccagcactttgggaggccaaggcagggggaatcacctgaggtcaggcattcaagaccagcctgaccaacatagagaaaccccgtctctactaaaaacacaaaattagccaggtgtggtggcccatacctataatcccagccactcgggaggccgaggcatgagaattgcttgaacccaggtggcggaggttgtggtgagccaagattgcatcattgcactccagtctgggcaacaagagccaggaaggaaggaagaaggaaggaagggagggaggaagagagggagagaagagggaggaagggagggagggagggagaaagcaataggatgggaggggaggggagggaagggaagggaagggaagggaaaggaagggaacggaacggaagggaagggaatcccagcactttgggcagctgcggcaggaggatcacctgaggccaggagttcaagaccagcctggccaacatggagaaaccctgtctctattaaaaataaaaattagcaaggcatggtggctggtacctgtaatcccagctactcgggaggctgaggcagcagaataacttgaacccaggaggggaagtttacagtgagccgagatcatgccaatgcactccaacttgggcaatagagcaagactccatctcaaaaaacaaagaaactaaatgagaacatagtgagaaatgaaaattaaatctgattaggctaatacttaggtttactctgccaggtgctttgcgaaaccttttacacacattatttcattaaatctttttctttgagacagaatctctgtcgcctaggctggaatgcagtggtgcaatctcagcttgctgcaatttccgcctgctaggttcaagagattctcctgcctcagcctctcaagtagctgggattacaggcatgtgtcaccacactgcctaagttttgtatttttagtagagacggggcttcaccatgttggccaagctgatcttgaactcctgacctcaaatgatttgcccacctcagcctctcaaagtgttgggattacagatgtgagtcaccatgccctgcttcattaaatctttattgcaacaagaggaattattattattattattatttgagacacagttttactctgtcacccaggctggagtgcagtggcaccatctggctcactgcaacctctgctcccgggttcaagtcattctcctgcttcagcctcccgggtagctgggattacaggcatgcaccaccatgcccagctaattttgtatttttagtagaaatggggtttcaccatgttggccagtctgctctcaaactcctgatctgaagcgatctgcccacctcggcctcccaaagtgctgggattacaggcatgagcgaccatgcccggccaagaggaatcataattcttatttggcaatagggaaaatggaggttgtaagggttaagtgactttcctaagtcatatagctgataaaagatgtagccagtattcaaaactgaggttaacttcattatgccatattacattcacaccttaaaaaaataaaatcaaggtatctgatatctagacagagtcttactctcttgcccaggctggagtacagtgctgtgatcatggctctctgcagcctcaccctcctgggctcaagaaatcctgccacctcaacctcccaagtagttgggactacaggcatgtgccaccacacctgtctaatttttgtattttttgtagagatggggtttcaccatgttgcccgggctggtcttgaaactcttgagttccagcaatctgtccacctcagcctcccaaatttctgggattacaggcatgagccatggttcctggcctttaaacctttcattatggaaaatttcacatgtgaaaatagaaagaaaaatgtaacaaagccatatgtacctattgcccagcttcaataattatttacaccctgccattctttttttatgaatcttcccttaccccctaaattctcacaattttttcttttatcatggagtattttaaaacaaatcccagtcatcaaatttctctacgtgtaaatatttcagtatgcttccctaatgcctaagaacttgaaaaaagaaacataacaataacattgtcatgcctccaaagaatcatatttaacatccagtccaagtttaacttttcttgattgtctcaagagtatttttatggctgttcaaataaaaattcaaacacagtgcagacattacatattttacatattctcttaagtccgttttttgcttgcgtcagcagcacatataccaaaattggaacgatacagagaagattagcatggcccctgctcaaggatgacatgcaaattcgtgaagcgttccaaaataaataaattcattaattaaaattaaaaaaaattttttttagtctacgcttggtggctcacgccagtaatcccagcactttgggaggccgaggtgggcagatcacaaggtcaggagattgagaccagcctggttcacacggtgaaaccccatctctactaaaaaaaaaaagtacaaaaaattagccgggtgtggcggcgtgtgcttgaagttccagctactcgggaggctgaggcaggagaatagcgtgaacccgggaggcggagcttgtagttagctgagatcgcaccactgcactccagactgggcgacagagcgagactctgtctcaaaaaaaaaacaaactttttttaaagtctcttttaatgtatgacagttccccttcccttgtgtttcctcgcttttctaatgcttttaactctgggatcatgaattaactttgtaacctgctatgtgttcattgaagaagtaaggctgtttgtcctgttgaatttcttacattcagaattgggctgacagttttctcctggtgtcattaatgggtttttccatcacctatacttccagtaagctggtagtttgttgaagaggctagtctaaattcaggttcaagttttttttttaatttgtttttattttttctttgtgggttttatatatatatgcaaggttagaccataggtggtacagtagcttacttttaaaataaactgtgtaactaatttattgaatgtgctgaattggttattataatcagtaaactactttttcttatctactgctaccttcaagcaagcagatctcccttctttgccccagatgacatttcagggagatctcttagctttggggccattctcagatgtgagaagagtctcattttcagctatggaaaattctagttcagtctatattaaactttaatttctcatccaatttaaatctcctgtcctctcttctcatccctattcctcccctgtcttctatgacagctgacaggcaggaccagcattgaggaaatggtacatgatctgtccttttactccatctggtgaacagtctccacagtgtccccgtggttcatggataaccttatgcattcttgcccagtcaaacaatggtggtgtaattgctgccacagcaaccctgtgtacttgccctgtcactagaggtcactctagttcctctataccccctcaaactccaggagacctgatgcaggatttttgctccttagctcagctaagtctgggttcttgtctcacgaccaggaagaattaggcacacaaacatcaaacagtgagtggagtagaatttattaagtgaaaggaaagctttcagcaaaaagaggggacacggcaggaggtgggggtagttctcctacccgaagacaggaaagttccccgatatggctgagcctggggctttttatgggctcagaatagggagtgtgtgctgattggtttgtgagtatccaaaaatggtcatagcaaagacaccactcaaaggtgggcacaacagtgtagaaaaccaattaggaaaaggtaggtatatgtaaaataggtgaagagtggggatcaatcaaaggaaagtgcaccaaacaggaaggtgggttctcaatcccatctgagtatttacccaggacagtttctgtcttgaaggttgggtttcaccagggacctgcccctatctgcctaggcatttgcctgcctcctgcctctatcagacccttgtcaggttctccccaaaacttaattgcctttcagtcctgtagtagcactgggcaggcctacacactcctccagcccagcaggcatctggccaaggagtaaaagtccctcacctgtttctggctagcccctcgattctctaaggggtgctcttactgtcccccttcacttggctccatcccatgtggaacagggaataaatgccagtgtgttctctctttttgtgaagtccccccaaagatgcacctgtcttaatgaaacaccagccttctccgctataggattttgggagtgacaattcctggacgagaaagaatgactgtgtcatagtaaggcctgtgcacatgtgtgcagatacccttttcaaaatgggggctacttcccacccattgtcagcaccactgaggattatcctaaaaataaacaggaaagtcctaatctatattcagacaagtttgttaagatttaccccttgacttcattttataaagtagcttagctaaacatacagaattttctagtttattttaaaatgaatgacttaaagaaactataattttttttttttttttgagacagggtcttgttctgtcacccaggctggagtgcagtggcatgatcactgctcactgaagcctcaacctcccaggctcaagaaatcctcccacctcagtcttccaaggagctggactacagatggacaccaccatgcccagctaatttttgtatttttactagagatggagatttcaccatgttgcccaggctggtctcgaactcctgagctcaagtgatcctcctgcctcagcctcccaaagtgctgggattatagttgtgagccactgcacccagccaagagaaactcaaatataaatgatacccttcaggacatgttttcatgtgtcattgggatgttaataaacatcatatacaagagctaacaaattcttatcttttgtccgtattttagaagacctgggcggcctaccaaatattaacaacaacaaaagcaacaaaagaaaataatttctggcagagcgtggtggctcatgcctgtaatcccagcactttgggaggccgaggcaggcagatcacctgaggtcgagagtttgagaccagcctgaccaacatgaaggaactccatctctactaaaaatacaaaattagctgggcgtggtggcatgcacctgtaatcccagctactcgagaggctaaggcaggagaatcacttgaacctgggagacataggttgcagggagtcatgattgtgccattgcactccagcctgggcaacaagagtgaaactccatctcaaaaaaagaaaaagaaaaagaaaaaaaaatcatttctaaaaacagcagaagacatggaagcaggtccacagtgatagatcagctatgttaaacatactcagtcttgttttctattttagcctttgtacatagaaatatttacttgtttgattcacatctttgttagacacaacctataccattttaattgatgtgttaaggtctatgtgtatttttttaattaatgggtttaattacaattgctgtgtagataattgcttattcaatcctgaagtagaactggaattaggaaatgaaaagagggtccactgactcactacagtcagctgagcacactcttattttgctctcagagtagaggtgaacaataatctaatcaagaactgcatggtggtgagtcagtattcaaagatgaatgggccaaaataagagtttaaaaacatgtgagacgtgtggatggatattacaataggtcaattgcatcacattaaacttattctggacatggctggttaagtatgcttgaatctaagtattatatcttccaaatgtgtgcacttagaaaagcttcaggctcataaaaggatgaatgtttgtggaagaaaggaaggaggaataaaagaggaaaaggggggaaaggaaaggagggagaaagaaagggagagagggaggaaaagcaaaatggttttcactacttcatttcaaccactgagtgagtataaattgctaatgattttttcatggtgtggttaaaatgttgattttaggcctagtcacataaatgaaataaaagtaagagtttaattaaaattatgttatggtaataatcgaaaggatgacagcacagcttgtgtttgaaaaaggaatgttaagagtttatatgtttttgggtttttttttttttttttttcttttgagacagagtcttgccctatcacccagactggagtgcagtggtgcgatcttggctcactgcaacctccatcttctgggttcaagtgattctcctgcctcaccctcctgagtagctgggattacaggaacccaccaccacgcccagctaatttttgtatttttagtagagatggggtttcaccatgttagccaggctggactcgaactcctgacctcaggcaatctgcctgcctcggcctcccaaagtgctgggattacaggcgtgagccaccaagccccgtcatgtttttgtttttaactctggcatcatgaatttactttgtaacatatttaacattccagaatatcaatgtcatgcccctctgtgtgaagagagtccactaacaggctttgtgtgagcaacaaggctgtttatttcacttggatgcaagtgggctgagtccaaaaagagtcagcaaagggagataggggtggggcagttttataggatttgggtaggtagtggaaaattacagttaaagggggttgttctcttgcaggcaggggtgggggtcacaaggtgctcggtggagagctccggagacttaatgtccaggagaaggaatgtcacaaggctaactgatcagtcagggtggggcaggaacaaatcacaatgtcatcagttaaggcaggaactggctattttcattattttgtggtttttcagttgcttcaggccatctggatttataagtgcaggtcacaggggatatgatgggggctcagaggcctgacaatcaagtcattgctttgttctcttggaaactccatttaccaagtcgcttgaatatagttacaaatgtatttaaacacaaagacatggtaattaatagaaaggaaatgttccattaagaaatacaacgtagaatgcatgtttaaagcaaacttgtagaaatagaatttcagggcaagacagtacttcagtcattctcaattctgtgtcacatgcagcagagttaatctttgtgtaagtcttgagtcttggatacagatgctgcagagagggtcacagccatggtcttgtggggctcacatagaggctgcatcccttgaattgccctcccccttctccctccattgcatgggaatatcgttcaacctgctgtgaatttgccatgtggtgctgtcacccttccttcatttcagtcccttgaagtaatctacaaggacatggaaggagatgagaaattgcctcatggccaaagtaacccttctcttcagggtgttcctatggtattttattttgttttatattttttttatttatttattgtttgtttgtttattcttttgagacagtctcactctgctgcccaggctggagtgcaatggcatgatctctgcccactgcaacctccgcctcctgggttcaagcaattctcctgtctcagcttccagagtagctgggattacaggtgcctgccaccacacctgtctaatttttgtatttttaatagagacagggtttcaccatgctggccaggctggtctcgaactcccgacctcaggtgatctgcccgcctcagcctcccagagtgctgggattacaggcatgagccactgcacccggcctattttattttttgagacagagtcttactctgtcacccaggctagagtgcaatgcatgatctcggctcactgcaacctctgcctcccgggttcaagcgattttcctgcctcagcctcccaagtagctgggattacaagtgtgtgccaccatacttggctaattttgtatttttagtacagatggggtttcaccatgttggtcaagctggtctcgaactcccgacctctggtgatccacccgccttggcctgccaaactgctgggattacagatgtgagccaccgtgcctggtcccctctggtattttatatgactatattgcactgatcacattgatcattttaatttcttgcccctaaaatattcactccatataaattgagttcatattcattttggaatcctcattgaacaggctttcttgtatgcccatactgatcaaggtctgtgttagatattacatttaaaattgaacaaagtaggtgtggtccttaaattttggaagggttgctggcatctgaggaagacagtcattatctaaatcaacaggaaaaatagaagattgcaagttgtattatgaaggaagagaccagggttccaggggctagaacaataggagaggcagaatcaaactgaggatttagcaaagcttctttgaggaaccaacatttaacttgaggcccacaactaggagctattccggttattcaggctttgagtgaaaagaggaatgtgcctgccatatggggcaccacatgggaagctgggggcaactggacctggaatacattgggcaaggagtgagtgatgggggagggtcagggcccaggggctgtggggccttagaggccacattagggattttgtattttatcccaagtgcaaactatttaaagtttgaagcaggtaagttgcagtggctcatacctgtaatctcagcactttgggaggctgaggcaggaagatcgattgaggccagaagttcaagatcagtctgggcaatatggtgagacccccccgtcatcgctacaaaaaatttgtttttcaaaacattagcaggcctggtgccacatgctatagtaacagctacttgggaggttaaagcaggaggatcacctgagcccagaagtttgaggctgcaatgatccatgactgtgcctctgcactccagccttggtgacatagcgagactgcatctcaaaaacaaataagtaaataaaaaataaagttcaaagttggcaattgatgtgatttgcataccctgccttgtgttcactggccagtattgaatatttagaaataaactaaacatgaacaatgaatcaatgatacagttcatctatgccattccctagttttaccaaccacaggcaattagattaatgcaatatagtttgttcttagaaaatatgtagtagaggccgggcacggtggctcacgccttaatcccagcactttgggaggccgaggcaggcagattacctgaggtcaggaattcgagaccaatctggccaacatgatgaaaccctgtctctaccaaaaatacaaaaattagtcaggctgtggtagtgggtgcctgtaatcccagctactcgggcggctgaggcaggagaatcacttggacatgagaggtggaggttgcagtgagccaagaccgtgccattgcactccagcctgggcaacagggccagactcagtctcaggaaaaaaaaaaaaaaaaaaaaaacctgggcgtgatggctcacgcctgtaatcccagcacattgggaggctgaggcgagtggatcacctgagatcagcagtttgagaccagcctggtcaacatggtgaaatcctgtctctactaaaagtacaaaaattaactgggtgtggtggtggcaggtgcctgtagtcccagctactcaggaggctgaagcaggagaatcacttgaatatgagaggcggaggttgcagtgagccaaaattgcaccattgcactccagcctgggcaatagagagagactccagctcaaaaaaaaaaaaaaaaaaaaaaaaagagagaaaagaaaagagaaagaaagaaaagaaaaaaaagaaaacatgtagtagaaatttgttttttttttgagatggagtttcgctcttgttgcccaggctggaatgcatgacgcgatctcggctcactgcaacctcctcctcctctcctacctcagcctcccgagtagctgggattacacgcatgcaccaccacgcccagctactttttttgtacttttagtagagatggggtttctccatgttagtcaggctggtctccaacttccgacctcaggtgatccaccaaccctcggcctcccaaaatgctgggtttacaggcgtgagccaccgcacctggctgttgacttttagtcactcaccattccctttccttttctactaatccctcattttattttggataagtacactgtgatggttaattatatgagtcaactcgactgagctaacagatactaggatagccagtaaaacatcatttttggatgtgtctgtgagagtggtaccatttgaatcagtaacggagtgaagaagatctgccttcaccagtgtgactgttcagagcacaaacgaaacaaaaaggcagaggaggggtgacatcactttctcttcttgagccaggacatctatcttctcttgtccttggacatcagaattcctcgttctcaggcctttggactctaggacttgcaccagggttcccaccaccccgtcccagttctcagtccatcagtcttggactgggatttgcaccactggcttctctgcttctcaagcctttggcctcgactgaattatatcactggctttccaggttctccagcttgcatcgttcatttgtttcttggccatttgggagtctatacatttttttacacttcctttccaagaaatcaaatacagggctgccagttgggcacaccctcaatgagtatggctgatgctacttgccatgacaacgttgcctggtttcctaatgttaacgttagctcctaccttctaagttgggtcactgaagtccacctttataagtgggtgtgttctggaaatagctgtttttctgtagacacagtatctgtgatccctgtattggatccactgagttataatactctcctaaatctcactatgggaggctagtctatgtaattgaactattgaacttctgcctcaagagctaaaacccagctctacccaactagagccctgtgaagtcttagcattccccttcctgggggcctagagactctctactaatccccaattgctgtctagggctctactctaaaaagatgaacaggccaggagtggtggctcacccttgtaatcccagcactttgggaggccgaggcgggtggatcacttgaggttaggagttcaagaccagcctgaccaacattgtgaaaccccgtctgtactaaaaatacaaaaactagcatggcctgggggcgcacagctgtaatcccagctacttgggaggctgcgggaagagaattgcttaaacccgggaggcggaggttgcaaagggccaagatcacaccactgcactccagcctgaatgacagagagagacttagcctcaaaataaaataaaataaaataataaaaagatgaagattcataagcaagttccatgctaatttgaggcattacctcttcatggaggcctttactgacatgcttcaactgtaaactggactctcttagatattagcattggatacatttatgtcaagtctgccacttccctttgaacaccaaattggaccacctgctagcatccttgcgggtctgagtcatagtcatgtcatgtgccccatcctggctccaaccactactttctccccaccagccaggcaccaggtccctgcatgccttgaggctgacctactagataatgacatctgtcctttttcctcggttattaatgtctcgattaaatataatttttattgatttgaacttttaagcaaataaaaaaattgttttgcttcattgaaatctccttctttgaggtcaaaaaatgataatgcacaaatctttttcttttttttgagacggagtctcattctgtctgtcacccaggctggagtgcagtggcatgatctcggcacattgcaacccccacctcctgggttcaagcaattctcctacctcagcctcccaagtagctgggattacaggcatgtgccaccacacctggctaatttttgtatttttagtagagacggggtctcactatgttggccaggctggtctcaaactcctgaccacaggtgatctgcccacttcagcctcccaaagtgctgggattagaggcataagccaccgtgcccggctgacttactttttttaaaaaaaaaactttaaaaaattttaatatagatgggatctcactatgtttgcccaggctgatcagaaacccctggcctcaagtgattctcctgcctcagcttcccaaattgctgggattccagatgtgagccaccatgcctatttttttttgttgtttgtttgtttttgttttgttttgttttggtaactctcatagcttttattgttttcctgcccaggattcaaacatttcaatccaagttacatactgaattaaaatcattttggcaaggataagcaagtatcccttaaaatttaaacaagaaaaaattttgtctgatatttcaatggattttcatactttaggtcagcatatttctttgaatttagatatgtggaaatactgtggcatttggtttacaaaataggccattcagtaagaccgtaatgtggacagaaagttctgtagaacacagcagcatggggaagcaagtgattttttgccaagcttactccaggtacttaaacatggcccaattctgcagtgaaggagaaaagcataattaaaatttctaaccttgtaccttcttcttctgttcttatgcacaaaatttcactcccaactatgccctttacacctcttttccaacctctgctcttccagggtatgactatgctgtttggtttcatttgtccagaaatatatcaggcagattccagaattctgagagaggaaaccattgtttttttaggaaattatattctctcttttttttttttttttttgagatggagttttgctcttgttgcccaggctggagtgcagtggcgtgatctgggcttactgcaacctccgccttccggtttcaagcgattctcctacctcagcctcccaagtagctgggattacaggtgtctgccactacgcccagctaatttttgtatttttagtagagacggggtttcaccatgttggccaaactggtctcgaactcctgacctcgtgatccacaggcctcagcctcccaaagtgctgggattacaggcgagagccaccgcacccggtcggaaatgctattctctattggcacttggaacaaatcatttacaagctcaaaatgtttccataatatattttagaaaagaaaagaaaaaaaaaagatcaagttgcacatcaggaagtttttcagagaaaatattatcactgccaatcactagtcatgttttattgcctcggcaaaacaaatgaataagaaatatttgttcccataaaagcacaactgtgattgcaagaattctgaaatttgatttggttgctagtggaatgagtctgaccattaatctctgaactatgacccttttcatacgttaggatttgacgtcaacccgaaaatgggaggattagccacatttttgaattctagaagtttggctagttcataagcgctatccaagtgcttttggtgaggactaacctctaatttttttaatcttgcccaaattcctatctaagaggtctggggagtcatgccctacaaatcataaattctcatcagatgggttttattcaaccctatatatcatgatttactttccaacctgactctggcataacattaggagacaaagaagaaaatcaaaatattttacccccaaaacatgtttcttgtcatattttgaaatggccctgcaaagctgttctttgtggggggaaatttgcatctgtaaagaatctctattaatatagctagatctttttcttccagaccctcccaatcctaaagagattaactaaaatctgaatagaaaacatttgtcacctattgtctctaaatgcagccactataagacttcaaaagaactttggtctccacagtctgttatcttaacctgaacatcccctttctgtttatcccaggtctttagacaaactcaaccaattgttaaccagaaaatgtttaaattcacctacagctcccactttgagttgttccacctttctggaccaaaccaacgtatttcttaaatatatttgattgatgtctcatgcctctctaaaatgtataaaaccaagctgtgccctgacctccttgggcacatgttctcgcatgttctgagggctgtgtcacgggccatggtcactcatatttggctcagaataaatctcttcaaatattttacagagttcgactctttttgtctacaggtgaatggtggtttttagatagcaagttttagaaaattgaaaactgtttgaccactcacttggtcgttctttattgtatcagcctttgagtgtagattgccctgactagtgttccagttcactgttcccatagaaaggtgatatttcttttctttctttttttttttctcttaaataatatgttatttatttttgctggtttgggagttgctttttgttttgctttctgttttttttttttttttttaatttgactttaacttctgggatacatgtgtagaatgtgcagttttgttacacaggtatacatgtgccatggtgttttgctgctcttatcaacccatcatctaggtttaagccctgcatgcattaggtatttgtcctaatgctccccctccccttaacccccacaccccaaaaggccccggtgtgtgatgctcccctccctgtgtccatgtgttctcattgttcaactcccacttatgagtgagaacaggcagtgtttggttttctgttcctgtgttagtttgctgagaatgatggcttccagcttcatccatgtccctccaaaggacatgaactcattcttttttatggctgcatggtattccatggtgtatgtgtgccacattttccttatccagtctatcattgatgggcatttgggttggttccaagtctttactattgtaaacagtgctgtaataaatatacgtgtgcatgtgtctttatagtagaatgacatataatcctttggatatatacccagtaatggaattgctgggtcaaattgtatttctggttctagatccttgaggaattgccacactgtcttccacaatgggtgaactaatttacactcccaccaacagtgtaaaagtattcctatttctccacagcctcgccaacatctgtggtttcctgactttttaataattgccattctaactggcgtgagatgatatctcactgtggttttgatttgcatttctctaatgaccagtgacaatgagctttttttcatatgtttgttggccacataaatgtcttcttttgagaagtgtctgttcatatcctttgcccactttttgatggggttgttttttcttgtgaatttgtttaagttccttgtagattctggatattagacctttgtcagaaggaaagattgcaaaaattttctcccattctgtaggttgcctgtttactctgataatagtttcttttgctgtgcagaagctttttagtttaattagatcccatttgtcaattttggtttctgttgccattgtttttggtgttttagtcataaagtctttacccatgcctacatcctgaatggtattgcctaggttttcttctagggtttttatggttttaggttttacatttaagttaatttttgtataaggtataaggaaggggtccagttcctgttttctgcatagggctagcctgttttcccagcaccatttacttaatagggaatccttctccattgcttgtttttgtcaggtttgtcaaagatcagatggttgtagatgtgtggtgtttttctgaggtctctgttctgttccattgttctatatatctgttttggtaccggtatcatgctgttttggttactgtagccttgtagtacagtttgaagtcaggtatcatgatgcctccagctttgttgtttttgcttaagattgtcttggctatacgggctctttttggttccatatgaaatttaaagtagtttagaaaggtgatatttcttaaggatggtgtgacggttaatactgagtgtcaacttgattggattgaaggatgcaaagtattgttcctgggtgcctctgtgagggtgttgccaaaggagattaatatttgagtcagtggactgggagagacagacccgccatcaatctgggtgggcaccatctaatcagctgacagcatggctaggataaagcaagtagaagggctgggcacagtggctcttgcctgtaatcccagcactttgggaggccaaggtgggcagatcacctgaggtcagttaaagaccagcctgaccaacatgctgaaaccccgtctgtagtaaatatacaaaaattagccaggcatggtggtgggcacttgtaatcccagctactcgtaaggctgaggcaggagaatcacttgaatccgggggacggaggttgaagtgagccgagatcgcaccactgcactccagtctgggcaatagagtgagactcagtctccaaaaaaaaaaaaaaaaaggcaggcagaagaacatggaatggctagactggcctccatctttctcccatgctggatgcttcctgccctcgaacatcagactctaacttctttggcttttggactcttggacttacaccagtggtttgccaggggctctcaggctttcggctacaaactgaagacttcattgtcagcttccctacttttgaggttttgggacttggactggcttccttgctcttcagcttgcagacagtctattgtgggactcaccttgtgatcgtgtgagtcaatactccttcataaactccgtttcatttatacatttatcctattagtcctgtccccctagagaaccctgactaataaggatggagagtgggatacacttttcccaactcactctatagagccttctgtcacacatacataaaaatgtgtatcctcagctggaagggggatgtcaaatttatatactgattaaaatttgtcaacacaccataaaaattcatggaatagtactgtgccatgcattcaggtacagaactattgtcttaggtctggtttgaaaaagcagcttactctggctaagaaggaagctttccttgacaaataaaaaatccatctttgtggctgagggtcttggctggttagtgtaggccagtgttttcaaagtgcctcacaaatgagatgagttttagtagtatatagacacagcaatagctaaaatagttatcctgtgatttctttccaaattctctttaatccttctgattacatcaagaagaaaattttgatttggtactgctacttttttttttcttttaaccacttctctttttttgtttgtttgttttttgttttttattggtgctgcacaaattaaaccacttctcttctaaagaatgacagagagagaaggtgcaaggaagccttaggctcagagctttcagtagacaatcctgtcttattaggatttaataacactgttttgctttcgttgtgattagttttacaattaccttccctttctgacaaatgacaccagtcgtgtaacatattggtggagcacatggcagcttgcttcccccagagcaagcgctggggagtggggacccatgatggaagtgagtctttttattacctaatctcaaaatgacatcctatcactctaccatattctatttgttaatagcaagtcataagttgagtcaacactcaggagagggggatcacacaaggacatgaataccaggaagcagtgatcatttgggccatttcagaagtgtttgccacagggatatattgcaattgctgttttccttcttttctccaagaaataatatgctccatgggaacagagatagtgtcttgttcattgggagcattcctagcactggacatagtgcctgagacttaaactgctcataaatgtttctttgaaggaaacgaaaaaggaagggagggaggaaaggagggagggaggcaggaaggaagggaggaaatgaatcagcatgagaagatcagggcactttgctaatccatagaaaacaggagatggttctttggggaaggaaaactcaaccataaaaaggattgtgaagaacagagtcagtacttttatttatttcctagtcttgagcataaatgagcttctaggaaagtggaagcactctgtgaagagacaacgcccaccatcttgctcccagggtagcttctgtggatggtggagagctgagctataaaatagcacaatgtgttacccatggaagggcagtcctggttgaggttcttaattgtgaatgtacagattctgttgaatgaattgtgataacctccaattatcaggaaagaatcaattagggagaactccttggtgctttttttcacttgcacttgcagagtgcagcaagaagttacactgaatgcacatagactgctagactgctttggcatttaaaattatagaataaacatatcactttgttagcataattctttttgtgtgtgttgtgggggtgacagcatcttactctgttgctgtggctggagtgcagtggcacgatctcggctcactgcctcaagggtttcttgaggcacctcgacctctgttcaagggtttctcctgcttcagccttccgactcgacctctgttcaagggtttctcctgcttcagccttccgagtagctgggattacaggtgcctgccaccatgcactaatttttgtatttttagtagaaatgaggtttcaccatcttggccaggctggtcttgaactcctgacctcaagtgagtgatctgctcacctcggcctcccaaactgctgggattacaggtgtaagccaccatgctcagcctttgctagcataattttaatggctccataatatttaatctaacagatatggcacaagctgtttggtcattactctactgttgcatttatgggttgtatccattttcttctttttttttttttttttgagacagagtctcactgtcgcccaggctggagtgcagtggcgtgatctcagctcactgcaacctctgcctcctgggttcaagcgactctcctgcctcaggctcccaagtagctgggattacaggcatgcgccatcacacctggctaatttttctatttttagtagagatgaggtttcaccatgttggccaggctggtctcgaactcctgaccttaggtgattcacccacctcggccttccaaagtgctgagattacaggcatgagccaccgcgcccggctgggttgtatccattttcaactgttatataaaatgcttcaataaatgcttttgtaaacttatctttccacaattgtataaatatctccttaggttgaattcctagaaatggaattgcagggtaaagagtatgcactctgtgtgtgtgtgtgtgcatatgcatttgtgtatactgtcaaattgcccccagaaattacgtataaactttcattcccaatttatagatgtttatacacatttgatgagacaagattttagctgggctgggtgcagtggcttacatctataatcccaacactttgggaggctgaggtgggaggatcccttgagtccaggagtttcagatcagcctaggcaacatacggagaccccatctctctctctcattccatatatatatatatatatatatatttttttttttttttttttttttttttttgagacagagtttttgctcttgttgcccaggctggagtgcaatggcgtgatctccgctcactgcaacgtccgccacccaggttcaagcgattctcctgcctcagcctcctgagtagctgggattacaggcgcctgccactgcacccagctaatttttgtagttttagtagagatggggtttcaccatcttggccaggctggtcttgaactcataacctcatgatccacctgcctcggcctcccaaagtgctgggattacaggcgtgaaccaccgcgcccggcccccgtctctatattttaacttttttgtttaaaaaacgttttagctatttttttaaagttgccaatctggtagctgaaaaataataacttattgttttgattgtatgttatagtcattaatgctccccccaagcacatgataagatttaattttatgagctgggcatggtggctcatacttgtaatcctagcactttgggaggctaaagcaggcagattgcctgagctcaggagtttgagaccagcctgggcaacatggcaaaaccccctttctactaaaaatacaaaaaaaattagctgggcgtggtggcacatgcttgtagtcccagctactagggaggctgaggcacgagaatcgcttgaacctgggtggctgagtttgcagtgagccgagatcacaccactgcactccagcctgggcaacagagcgagactctgtctcagaaacaaaaacaaacaaaaaagagatttaattttatggcccttgaggttaagcggggccatgtgacctggtctggtcattgagttgtgaatagcaatggtatgtgtcacttctgggttgagcaagacctttcagagttctctttcacttctgcaattgattaccaacaatgtttcagaaaatggcctgggtcccataattgattaacataaacatactctgttcagtttgatagaacaacatggaataaagactctaagtaaggcatgatgagtatgaacaaaaaatatgacttctttgttgtaagccactgagacttagggttgagcgttatggcagcattatctacaccatcctgactaatacattaaacatctttgctcactactgagactaaacatattttcctgtatttattgaccatttatttggacttccctttttgtgaattttctgctcatgtccttgcatgttaattttttaaacatatgacgctcagctacacatttgttaaacctggacctgatcatcactgaggtatcagggagaaagatgaagtctgtgaactaagaaaaatagatgtatcacaatagtctctaatacccagggcaagatttctccaatctacctttaaggatctgaaaatcctttgccacaaattgtttttttttaaagccatgtgctttcattcaatgataatgtcaaaattaatagaagcatattttggatcatttgaatggtcactttataactgaaggatgttatttacttttatgatcaaaatggtttcttatgggcatcaataccactacttttatccacacagactcataagaaaaaaacaaatgtgaacataatacataatgtaatgtttttgcaccaagtgagggacaagtggtatttcagcatattgtacacagtaagatcagaggttgcacagcagaattactaaagaaaattgtgggagcattgggtcatcccacagtctgcaagcaggctcagctcaaaagaatctggcccagaacacagcaccactttcacattgtcacttatctcagttatggtcctttgcttgcaaacaacagacatagattctgactaatttaagcaataaagaactgattggaataatacaagaaaacacagtattcaagcaacaaaaagaacaaatcaggctcaaaaagaaccagactaggggatctccaggggcttcagtaccagaaattcctgaatcagtacattttggatgctgccaagaaaatgactcaatgactcaatccagtcttcttttttttttgagacaggctcttgctctgttgcccagacaggagtgcagtaaccctatcatgcctcactgcatccctgaactcctgggctcaagaaaatctcttgcctcagcttcttgagcaactaggactataggtgcatgccaccacgcctggctagttttttaaaatttattttttgtagagacaggatttcgctaaattgcccagcaatcctcctgcctcaaccttccaaagtattgggattacaggcatgagccacagtgctgtgtccatcaaccccagtcttctatctgtgtgtctttatgttctagattcaaatttctggcttcatttgggtcatatgctcttcatatgagtggggtagggggaggatgtttgagacttcaaaatactcaagacatctggatgcttaatgaagaaaaaaagttgttacagtggggcacagtgagttcacacctgtaatcccagcacttagggaggccaacacaaaaggattccttgagttcaggagttcaagatcagcctgggcaacatggcaaaaccccatctctacaaaaatacaaaaactggccatgcatggtggtgtgcacctgtagtcccagatactcgggggactgagatggaaagattgcttgagcctgggaggtcgaggctccaatgaggtgagatagcaccattgtactccagcctgggctgagatcccgtctcaaaaaaaaaaaaaaaaagtttatatatctcaaagaatgtgtgagatattaagggtcactcctagaaggtatatgggatttaatccttcctgaacagaagagtggatgggacctttttcttataaagaccttttcttttcttgctttttttttttttttttttttttttgagagatggagtcttgctctgtcacccaggctggagtgcagtggcgcaatctcggctcagtgcaacctccacctcccagattcaagtgattctcctgcctcggcccctaccagtagcaggtacaggcgtgcgccaccatgcccagctaatttttgtatttttagtagagacggggttttgccatgttggccaggctgctctcaaactcctgacctcaggtgatccacccagatcggcctcccaaagtgttggaattacaggtgtaagccactgcgcccagcccatgttattttatttatttatttatttatttaagacaggctctcactctgttgcccaggctggagtgcagtggcatggccatagctcattgcagcctcgaaatcctggtctcaagctttcctcctgtgttggcttcccaaagtgctaagattggggaactgtgagccactgttcccacctgctatgaacatctatgtccatatttgtacatgtagacataagttgtcaattgcgaaatatggttaggtaatggttggactgcaattttcttaactgactggaacttgtaagtctctcagtctttgctaaggagctctatgtgcatgttggaacttgcctttaacactcagccaggcagttttcaactctgacttagcattcacttcctgctaatatagtttcaagatcagccagaggtgagagttcagggccttctcaattctttcctgaacttgtacacagccctgggcatgcatatagttctactcatttgtattgctttctttttttttttttttttttttttgagaccgagtttcgctcttgttgcccaggctggagtgcagtggcacaatctcagctcacctcaatcctcaatctctgcctctcagactcaagtgattctcctgcctcagccttcctgagtagctgggattacaggcatgcaccaccacgcccggctaattttgtatttttagtagagatgggtttctccatgttggtcaggctggtcacgaattcccaacctcagatgatctgcccaccttggcctcccaaagtgctggggattacaagcatgagccaccgtgcccggctttattggtattgctttctagactcccaggaatctatcacagcatgtcaaagccccctgtggacatctcattccccttcttttccttttttaaagttttttcattattctattattttgccctcatgtttatctactacctcagtgtaatcacctaatgggttcctcttgcctgctgtccagaaaagcgaatgcactcagaacagcagatttataaagcaaagaaggaatttaataattgcaggtctggccaagtagaagctacaaatcttgtgacatctggccacatgactcttgagcagtaatgcattatagaaaagcaagctagggaacaaatggctggttatcatttaactgtacctacattttagcagaaatcagctctgcccctcaccataatcctaatcttgtggcctttcattagtcttaaaaaggtggtttcagttttaaggaggaggtcagttttagggaggtactattatcatccttgatgcaaagttaaactataaactaaatgtctcccatggttagcttgacccacacctaggaataagtgaggacagccagcctgtgaggcttgaaacaagatggagtcagctatgctagacttcttttgctgtcataatctttacaaaggtgattgcatccggcagccatgatgttaaacaattgcctctaattgtttttaataaacccccatagagaaaaggctcttttcactgcatgagctccaactcaagtcaaacaatgacaaccttgcaattggggtcttccagggacctatgagacaggttaaataatgaccattccctggggatggggttttgaaggagccccagtaacattctacctttccagtggctgacaggctgctggtttccactgtgatcattacaaatttgttgcagcttgttggttttgtggcttgtggctgccttgttgctttttaaggctttcttcgagctgcaaaaagtgggaatggaaatagaaaaagttaaaatgacacaaactctccctttctgagtttcagtcacttttcttgaataaatattctccagattgctgaaagcttttgattttccagaattctgaaaaagttgattgcataaatgtttgaatcattctcattgtttttatggaagagagaatattgggaaggtccttactccaccacttcactgacatgaccttataaaaaccttttgatctaagaataatcaaccattttatagattagtagtattgtagtgcatctcatccattatctagtttccaagctgtataaattatgctaatttttctgcccttttttttctctaagtccattgtatttctctttgatgttaagtaaagtacttactgattccacctgatgatcagattgcctcagaggacatcaagccattctagccaagagattagctgtttcacaagcattaaaattaaaggatgcttgaagattgtaaactaagtagttttaaggtagggttgccagattagcaaatataaatacgggacccccagttagattttaatttcaaggctgggtgaggtggttcacatctgtaatcctggcactttgcaaggctgaggttggaggatcggttgagcccaggagttcaagatgagcctgagcaacataatgagactccatctatacaaaaagtttttttaaaaattagctgggcatggcagtgaacacctgtagtaccaactacttaggaagttgacatgggaggattacttgagcccaggatttcaaagctgcagtgagccttgatcatgccactgtgctccagcctgggccacaaagcaagaccttgtctcaataaataaataaataaaatgaaatgtgaatttcagataaacaatgacaaaatatttgggacacatttacactaatcattttcttgttgttgttgtcgcttatccgaaattcaaatttaactgggcattgtatatttgatctgaaagccctgttttcggtgaaaaataaacaaaacaatacctgtaaagtcattctcagatgacttgatggtgatcctttcttctgttttcttttaaaccactgttgaagctcttttctagtctataagagataactagttttgattaatgtaggtttagttcttttatggaaaaatatgttaatttggcatggtgacaatcctgtccatatttcttatacattcaacaagtatatttaagatggtctacttatatatactaatcaagatttgtagtctgtacaaccagaattttaagttcagctcagctcctaggaaaatacatgtatagaacaaatatgcttatgaaagacctctagagagccagaacactcaaatcaggaaaacaagccaaatcagtaaagtcaaggacttgcaggtagatagataaatatgtagggagagaaaaagagaaacagagagagagagagagacataaatttaagcaattaaatacaatggcacagtttattccataatatggaatttattattcattaatagcaatcatttacaaatcatacaaagcatcagtaatttggaatctagttgtcactaaggaagacaggaactcaagaaaactcagataaaaaaaaaaccctcaaaatatgtgttgtgaactaagaaaaaaaatcaaaacaccctccagacatagataaggctttgaagaacctctttgggactcagaggcagcttttaacccccggtaacacatactttcaatccactgtagtcctcttacttaatcattcaaaaataatttcaaaatacccttaagaaattgaaacccagacatgacagaatttatatactatttccaactctaattgcttttcatatctcttcattaaccatgtattaatcaactagtctgtgtcaagcactgtgctatcactctatcttttcagaatcaatttctctttggtcatcagtcaatcattttgccttataacgacactgggcagctctaaacatggaagcaagccctggaagagaccaatttgatcaccaaatgttttctttctcactattctcaccacatcccaggtgcccccgtgactgccttatttccgtttggcttctctttgagacactgctttgttccactgtctcgagactagcaacatcatgagggaatctggtgtggagaggcagagaggagtgtgtatgcgacactgcccagcccagttgctgtccaggggtgtcaagttgccctcaaaatatcactttgtgcaagactcagccaggaggaaatgacattctcagcctcctacgtaaagactcaatcacaatacttcctttgattaaaaatctaaccagaattctctacagctgcttgatgtcctgagtgtaagctctacatggagaagaaagcatcaaacattcataaaatggaactcatttctttgcttccacctgctgctctgagcagcagtagccactctgcacaggcagataaattgtgagttctgagaagctaaaaagatcacccattcaaaactgcaaatatccttacccaagctaccaactgtctaccccatcaccaccactgtggtgatctgttgaccagattttctgatactgccacttccaaggtgattaagtctgggcagtggcaacagttcaatttttttttattttattaaagttatttctgaagatggccaactagacgcagccaggaagagcatctcccgccgaaagaccagaccatcagggaaactgggtacactctgagcagatctttggagataaggcattgagagtgaatgcagggaggacgtagaccccgggctgaaggcagaggaagctgagaaccatgcacagggctgccaagcaccaggacttgttcctggcccccagtggttccttgggaaggggtgagttaaacaggtggggagcagcttactctcaccacggacctacagacttctagtgcagcagaccccatgacccccatttgagctggcaaggagagctgttcagagaggtggcaggggcagaactctagcttgtgtggagtccagagggtttggcatgagaatggctacagtggagcatggccagggaggcccatccttcagggcttgccatgctcctctgggtggctttgcctcttggtgactgccagacctagacgagcagggcagtcttccctgtgggatggggccaatctaatctgagtgctccactgtcaaccagcttcttctggggccccagccttgctgtgcttgcttgcagcatagccttggatgcccaatcagggtgcttcctgagggccttcattttagctctttcactggcagagcactcttaaccattggagaattccagcagactgacctatgctaaatgcacccacctgaagcctccctgaaccacagcctccccctgccactttacctgtgtacacttgcccatgcctgccctcatgccaacacatacacacactgctttgcatgtgtgtctgcatgggtggaacctacttctcttttcccacggatatgtgtgcgtgcattccaccaccccactgccagtgtgagcatgtgcctggatgccaccaccctgcccccaccccacccccactagtgccccacctgtgccactgctgctgctgaaatacacatgagcacaaatcctgtcattaccaccacaacaaagcactttggccagcactctccatcagagttttgttgccacctagccaggaatacttcgaccccctaccagcgcagcaagttcttaatctcaaggggccaaagaacaaagctggagccctagtaccagccccacagggttagaacacacagctcaggagtgctgagctgagccttgggcccctaaaatcttccagaaacaaagccagtcagctgaacccaccttatatcacaatcaaaccctcaaggatgtcaaagaatataaaagcaaaaaactccatccaaaggactgcagcttcaaaggttaaggaaacatcagcccacacagatgagaaagaaccaatgcaagaagtctggcaactaaaaaagcaccttcttacctccaaacgactgcactagttccccagcaacggttcttaactggctgaaatggcagaaatgacagacatagaattaagaatctgaataggaaagaagatcattgagattcaggaggaagtagaaatccaatccaatgaatattaaaaatccaataagtcaccaggcactgtggctcccacctgtaatcccagcactttgggaggccgaggcgggcagatcatgaggtcaggagctcgagaccatcctggctaacatagtgaaaccctgtctctactaaaaataaaaaaaaattagccgggtgtggtggcaggtgcctgtagtcccagctactcgggaggctaaggcaggagaatggtgtgaacttgggaggcagtgcttgcagtgagctgagaccacaccactgcactccagcctgtgtgacaaagcgagactccatctcaaaaaaaaaaaaaattccaataaaactatacaagagatgaaaagtgaaacagccattttaacaaagaaccaaactgagttgatagagctgaaaaacactacaagaatttcataatataattgcaagtattaacagcagaatagaccaagctgagaaacaaatctcagagctcaaaaaccagttctgaaatcaactgaataagacacagatttaaaaaaaattaaaaaattaaaaaatgaacaaaacctttgagaaatttgagattatgtagaaagatcaaatctgtgactcattagcatccctgaaagagagacagagaaggcaagcaacttggaaaatatatttgagaatattgttcatgaaaatttccctaacctcactagagaggccaacattcaaattcaggaaatgcagagagcccctgtaagatactatacaagataactatctccaagacacataggcattagattctccaaggtcaacatgaaagaaaaaatattaaaggcaactaaagagaagaggaaggtcactcacaaagggaaccttcatcaggctaacagcaaacctttcggcaggaaccctacaagccagaagagattagggcctatattcaacaatcttaaaggaaagaaattccaaccaagaattttatataagtttcataagtgaaggagaaatccatttcagataagcaaatgctaaagaattctttaccaccagacctgcttttcaagaggtcctcaaaggagtgataaatatgggaaaaagagatcattaccagccaccacaaaagcacaaatacatagaccattgacactataaagcaactacacaatcaagtctgcataataaccagctaacatcatgatgacaggaaaaaagtctgcacatatcattaaccttgaatgtaaatgggctaaatgtcccacttaaaaggcacagaggctgggcacagtggctcacgcctgtaatctgtaatcccatcctggcactttgggaggccaaggcagttggatcatttgaggtcaggagtttgagaccagcctggccaacatggtgaaaccccatctctactgaaaatacaaaaattagccaggcatggtggtgcacatctgtaattccagctacttgggaggctgaggcaggagaatcaattgagcccaggaggtggaggttgcagtgagccaagagtacaccactgcactccagcctgggtgacagggagaaactctgtctcaaaaaaaaaaaaaaaaaaaaaaaaggcacagaatggcaagttggacaaagaagcaagacccaactgtatgctgccttcaagagatctacctcacatgcaatgacatggataggatcaaagtaaagagatgaaaaaaaatctaccaggcaaacagaaaacagaaaaaaagcagggattgctattctaatttcaggcaaaacaaactttaaaccaacaatgatcaaggaacaccaagggcactacataatggtaatggataatggtaatgggttcaatccaagaagaagacttaaccatcctaaatatatatgcacccaacagtggagtacacagattcacaaaacaagttcttaaagatctacaaagagacttaaccccataataatagtgggaggcttcaaaatcccaatgatagtgttagacagatcaatcgaggcagaataataacaaagatatttgtgagctaagctcaacacttgaccaaatggacctaacagacatctacagaactcttcacccaaaacaacagaatatacattcttctcatctgcatatggcactaccttaaaattgaccacacaattggtcataaacaattctcagcaaattcaaagaaacgagaatcataccaactacactcttggaccacaggatgataaaaatagaaatcaatactaaggagattgttcaaaaccatataattatatggaaattaaacaatctgctcctggatgactttttgcgttaacaatgaatttaaggcagaaatcaggaaattatttgaaactaatgaaaacaaagatatagcatatctttagatataacatatctctgggacacagctaaagcagtgacaagaggaaagtttatggcactaaacacccacatcaaaaagttagaaagatgtcaaattaacaacctaatatcacacccaggagaaaaaaaaaaaagagcaaaccaaccttaaagctagcagtagaaaataaataaccaaaatagagctgaactgagtgaaattgagacatgaaaaaccataaagaagatcaacaaaaccagaagttaactctttgaaagaataaataatattgatagaccactagctagactgtgatggttaatattgagtgtcaacttgcttggattaaaagatgcaaagtattgttcctgggtgtgtctgtgagagtgttgccaaaggagtttaacatttgagtcagtggactgggaaaggcagacctaccctcaatccgggtgggtactatctaatcagcttccagctcaaccagaataaaagcaggcggaagaacatggaaagactagactggctaaatcttctggcctccatctttttcctgtgctggatgcttcctgtcctcaaacatcagactccaagttcttcagcttttggactcttggacctacaccagtggtttgccagagactctcgggccttcagccacagagtgagggcagcactgtcagcttccctacttttgaggttttgggactcagactggcttcaattgctcctcagcttgcagacagcctattgtgggacttcaccttgtgatgatgtaagtcaatactccttaattaaatgccctttaatacatacatctatcctattagtgctgtctctctagagaaccctgaataatacctagactaataaagaaaaaagagagattcatataaatacgagcagaaatgtcaaaggggacactaccacctaatccaaagaaatagaaaaacccctcagtttttgttcatagaggtgttcacaatagtcagaactattatgaaataaaaggcatccaaataggtagggaggaagtcaaactatctctcttcataggcaatgtgattctttatctagaaaaccccatagcctctgcccaaaggctaccagaactgataaacaacttcaataaagtttcaggatacagaatcaatgtacaaaaatcattagtatttctatgcaacaataacatccaagctgagatccaaatcaaaaacataatcccattcacaatagacacagacacacagacacacacacacacacagagacacacgtataaccaatacccaggaataccatagctaactaggaaggtgaagaatctctacaacaagaattacaaaacactgtgaaagaaatcggagatgacataaacaaatggaaaaacattccatgctcatggataagaagattcaatgttcttaaaatggccatattgcccaaagcaatttatagattaaatgctattcaatatataaatgtttatatattcattgttatttttcacagaattagaaaaaaaacattctaaaagccatatgcaaccaaagaagaagctgaatagccaaagcaatcgtaagcaaaaaaaaaaacaaaaaaaaaacaaagctggaggaatcacattactcgacttcaaactatactacaaggctacaataatcaaaatagcatggtaatggtacaaaaccagacacatagaccaatggaacaaattagagaacctagaaatatagccatatcccttcaaccatctgatctgcaacaaagtctacaaaaacaagcaatgaagaaaagtctccttattcaataagtggtgctaggataactggctagccatatgcagaagattgaaactggacccctttttttcaccatatacaaaaatcaactcaagatgtattaaagacttaaatgtaaaacctaaagctataaaagccctagaagaaaacctaggaaataccattctagacataggtcctggtaaagttttcatgatgaagacatcaaaaacatttgcaacaaaacgaaaaactgacaaacaggacctaataagttagagagcttctgcacagcaaaacaaacaaacaatggagtaaacagaaaacctacagaatgggagaaaatatttgcaaacgatgcctgtgacaaaggtctaatatgcgaatctataggaaacactatacacatattaagcaaaaaaatcaacaatcccattaaaaagtgggcaaaggacatgaacagacacttttcaaaagaagatatccaacaaacatatgaaaagatgctcaacatcacgaatcattacataaatgcaaatcaaaataaaaatgagatactgtctcacaccagtcagaacgggtattaaaatagtcaaaaaataggctgggtgtggtggctcaagtctgtaatcttagcactttgggaggttgaggagggcagatcgcttgagctcaggagttcaagaccagcctgggcaacagggcaaaaccccgtctctacaaaaaatatttaaaaattagccaggcatggtcatgcctgcctgtagccccagctacaggcacgtaaggtgggaggccaaggtgggagtatcacttgagcctcagaggtgaaggctgcagtgagctgagattgcaccactgcactccagcctgggtgagagtgagcccctgtctcaaaaaaaaaaaacaaaaaaacaaaaaaacaaaaaaaaacaaaaaaacaaaaacaaaacaaaaaacagctgggtgcagaggctcatgcctgtaatcctagcactttgggaggccaaggcaggtggatcacctgaggttaagagtttgagacaagcctggccaacatggtgaaaccctgtctctactaaaaatacaaaaattagctggacgtggtagagcacacctgtagtcccagctactcaggaggctgaagtaggagaattgcttgaatctgggaggcagacgttgcagtgagcggagatcatgccactgcactccagcctgggcgacacagcaagactccgtctcaaaaataataataataataataataacatgctggtgaggctgtggagaaaagggaatgcttacacagtgctgttaggactataaattagttcagccactgtggaaacctgtttggtgatttctcaaataatttaaaacagaactacccttcaacttaacaattgcattattgggtatatacccaaagaaaataaatcattctatcataaagacacacacatgcatatgttcattgcagcactattcacaatagcaaagacatggaatcaacctaaatgcccatcaatggtagactagataaagaggtggtacatatacagcatgaaatactttgcagccataaaaaataatgagagcatgttctttgtagaagctgtaggtcgttatcctaaatgagctaatgtaggaacagaaaaccaaataccacatgttctcacttacaagtgggagctaaacactgagtacacatggacacaaagaagaaaacaataggcactggagtctacttgagggtgcagggtgggaggagggtgaagatagaaaaactaaccatcaggtactatgcttatcacccgagtgacgaaatcatatatacaacaaaaccccgtgacatgtatttacctatataataaatctgcgcatgtagctctgaacttaaaagtttaaaaacacaaaacagccgggcacggtggctcatgcctgtaatcctagcactttgttaggccaacgcaggcagatctcttgaggtcaggagttcaagaccagcctggccaacatggtgaaaccctgtctctactagaaatacaaaaagtagccaggcatggttgtggatgcctgtaatcccagctactcgggaggctgaggcaggagaattgcttgaactcgagaggcaaaggttgcagtgatccaagatggcaccattgcactccaacctgggcgacagagcaagactccatctcaaaaaaaaaaaaaaaacaaaaaccaaaaaccaaaaataacaacaacaacaaaaaaacatctgatgtatctctcagaaagcaatattccatttatgtttcaggactggatttctctatgggcttattggtgtatatgggagacagagcacgttctaataaatattgtcaatatttgcttacaacaaatttctttcttcttttttaaaattttctttattttagtttgaaaaaaaatagagatggggtctcactaggttgtccaggctgagcttgaacttctgagctcaagtgatcctcttgccttggtttcccaaagtgctaggattataggcatgagtcattgtacctagtatctctctctctctcttttttttttttttaaataaaatagagacagaggctaggtgcggtggctcatgcctgtaatcccagcactttgggaggctgaggcaggcagatgacgaggtcagaagttcaagaccagcctggacgacatgacaaaaccctgtctctactgaaaatacaaaaattagctgggcatggtggcacatgcctgtagtcccagctactcaggaggctgaggcaggagaaccgcttgaactcgggaagcagaggttgcagtgagccgagatcacaccattgcactctagcctgggtgacagagcgagactctatctcaaaaaataaataaataaataatagagacagagtatgactatgttgcctaggctgttctttaactcctggtcttaagcaatcctcctgccttgcccctgctaaaatgttgggatcacaggtgaagccaccatgtccagccttttttttttttttttttttttttgctttctctctctctctctctttcataaattagagatggagtctcactatattgcccaggctagtctcaaattcctggccttaagtgatcctcccacctcgtaatctactttttggggactaatgaggtgtagccaaaatacaacatgtgggaggcagtaaatgtagagattaggagtagatttggcaagccagactgctgtggtcacaccccagcacagaatttatgaatccggctcctctccattcaaatctctgccaaaaatcacctccttctggaggcccaccatgactattctatttaatacagcttaccccactgccctatcactctctacaccattctcattttattatgctcagagtatctattattctccgaagaagcatttcttgaaatctagctggtaatcttctttccttattagaatgtaagctccatgagagcagggatctctctgtatcagaatctgtattgtgcttggtaggtagttgactcaataaacatttctgagtgaatgaatatattatatggaaattgaagaatacaagcttctccacataagcacgtggcagaaaagacaaaaagagaggtagagaaaaagactctctttttatttaagcttccctcccctgttgaaatccactactccaaaaaagggagacactgaccaaaacagaaacaaaagaaactaattcttggtttttatgcttcctgataatttaagggattttcatagataggtttgacaaatgcaatttttttgccttaggcactggcactagaaactattaataaacaagattggcctacagagggtgctagttctcttcaaaaaagtaaaagaagtgcatgcgcttttccactgggtctgggaaagagtttacaaaacaagcagagacacagcttagtaacaactaatgaaacgtctaaattgccacattttgcttcataaaaaaaaaaaaaggaggaatctgtgaaagtgccagaggcattcaaagacgtcccctgaggaaaagaattggcatcatttttcaaatgcaaagagaagctaagctaagagaagcatccatttaaaaagtttttttagttcttatttttgatagagaaggggtatcactatgttgactggcctgattttgaactcggaggctcaaaggatcctctgcccctcagagtgcttggattgcaggtgtgagctaccaagagaggcatccagaagttgaaaagactgaatctgttgtgaaacagaagacccaggtcgggggaagttgttgccagccctggagggaggagaggtgacaggcctctgccacattccacccccacttcatgctgggacatggggacctggagacctagtgtgagatgcctgtagactctgtaactggaggagtgttctgacagctgtgtttcctgaaactgagtcttggtttcagagttcagcaagggatatgcatggtggtggtagcgttgggacagaagcggggcactacttgagagttttgaaatatgtaatttgtcacagcaaggacaagggcaagtgagcctggcaggagggaggagcctcttcaaagtctggatctgcaaaaaaaatcttcagaagaggaaatgaaacaaataagcgagttcttaaaaaagcttttgagctctctaaatgagcaatagttgaggcagctttgatagtccaaagctaacctcaaggctgggattcttttatttatttatttatttatttatttatttatttatttatttatttattattttgtagagatgggaaggggaggggtctcactatgttgcccagcctggtcttaaactccaggcctcaagcagtcctccagccttggcctcccaaagtgttggaattacaggcatgagccactgtgccaggaaaaggttaagagtcctttttttttttttttttttaacttcaaggctgagattcttaatcctagtactctagacgtcatattccagtgatcagatgcagaatccataagtgctctgacaggtcttatcattatgtgtggtgttttcacttagtgagtgcccttgttttgtcagttcaaggtggcttgcttagttactttattgtaatgttcaatggctaaactttaaacaaaaatcaataaagggcaaggaatgagtttgcaaaaactatcagccacttccctcaatttaattgtaaaatcaatcaaatctgttttttggcacagtgcaaggaaaacatctatttgtccaataaactgtctcattgattaaatggttcatttggaagagataacaaaagtctaagattttaatctcaaggaaaaatgtatcttgcaaacatgttttcaagatcctgagatcatattattttcctttaaggatttgcttcatcccaggtgttcatctaatcctacttttgctatttttaatcattattcatctatgtaaaatggaaaatctatttagatgcttaaaagtcaacgtaagctcacaaacctgaatttcagcaactaaaaagggagaagtaataatgattcagttcttactgggagctactttatacactattttatttggacctcataacaactatatgagagagaactgtgcactctctgccaggggttagggttaacataaagccaaaacccaggcaggtcacgaaaatgagcaaagcaggccagttatgagtgctgtcaccttacaaggaggtggaaacaatgtttccggatcctgtttcttaagagaagccaaaagatttacgtaaagtctcctgattttttttcaatggtggtaattgattaaaataaatatttccaatactgtatgtactgaataaagaaaatttggggctgaccctggcccagcaactgccacttagcaatgtctggtattgaagtgaaaataaggctcagggctgggcacggtggctcatgcctgtaatcctagcactttaggaggccatggtgggcagattgcttgaacccaggagttccagactagcctgggcaacatgatgaaatcctgtctctacaaaaagtaccaaaaaaaatcagccaagcatggtggcaggcacctgtagtctcagctacttgggaggctgaggtgggaggattgcttgagtccaggaggccgaggttgcagtgagctgagattacactactacacttctgcctgggcaacagagcaagactctgtctcaaaaagaaaaggctcaggaaggtgacatcactatgctaattcaaggaggaatgaaagagtgacctcatgggacagtagatcagagaatgttctacctggtggccagcctatttgtggggaggggtccctaagaagaggctgtatgctggcttgggttatggagggccaaagctcaggggcctgggggaaggagagaagcttaaccaaagtttggctaacaggcattttgttctgattgatcagtggtgacaagcagttcagctagtcatttaggaggtcaaaaacagaagactggaagatccctatctagttttgtcatcagtagacaaaggggcactcatgaaacttgtctaagtcatacggggaagggtggccccttgcagtaagtcattttccagaacgtaaaagggcaatgggctttcttaaccttcaggtaaaattccactttgtcaaaacataagcatgatgtagacaaaggttgagagtgagatcaggcttattgcccagtcttaagccatttaaacccaaggtggactttcccctcaggaaagaagggaaggaaagaagctaggaaggccctggctaggttctgtgtgggttggggaatgtgaatcctgatggagcagcctaaagaagtcaagcagtcctgtagcagcagccgtgggggaggttcctcctgggagtggaggagggcgagtgctgcaggtccatcagtggaaatgggaatggaccattaggcggagaagacttatcgaagctgcgaagtccaagatcaaggtgccagcagattctgttcctggtgaaggctatcttcctgttttgcaggtggctaccttctcgctgtgtcctcatatggtggagagtgagacttcatctaaaaagaaaaaaaaaaacccactccggacatagtgactgtagctgggtcttggactgcaagaagaccatcctggtgagaagatcttgaccacaggtgatattcaccttggataaaaaacattctgataattcagaatgtttgtgcaaataagatttctaacccagttctatggaggtataatttatatatggtaaaattcacctctttaggtattcagtttatgaattttgagaaatgcaatcaccagccactacagtgaagattcagaacatttccatcaccccagaaagcctcctagtgaccctttggagtcagtcccctcccctcagcctgagctcctggtgaccagtgatctgatttctatccatgtacttctcccttttccagagcatcacctgagtggaaccgcacagtattccaccacagtattttgcatccgacttcttttccttggcatgtgcttttgagattcatcctttgctgttatattatcagtggtttgttcctttttgtggagagtattttattgtttggatataccacagtgtgtttattagtttatcgccagtagatggacatttgtattgtttcctgtttctggctgttaggaataaagttaatataaatataaaaaaaaaaaaacccaataaaacaagaagctagaaagttgctagttttcagtagagggggacaggctgctgtagaagctcaggactgctctgcttttggcacccaaaggtgagagtgttttgctgaaggcagcagctgtgaggagtgacaactccaccaaagtcaaggaagcaggtgtagaacaggcaggtcataggtggcaatctgtggtcctaaaataccctggaaaagaccgggagcccttacaggattgagaaaccaagagaaaatgtggggcaaaaaaattcctcaggtttcattcacagtcatccccacagccatcttaagtcatcaagaaagattcggaaaagctccgagaatcagcagatgggggctagtgcaaaataatactttttgtcttaattattagtaatctcaatccctcactcaattcttaggttgatgcctgggaggtaatatttactaccttgcatttccataaatggtgaccttttttatatggatgttggacaccagggaatgctcttaagttaactgcatttcatcagatccccctactatttaaattgatcttatttctatcatttcacctcaagatttattgttcttatcttacattctaaagaactgagggctgtctttgaagtggatatgaaaagtttcacctcagtctaccaatatatcattgaaagtttaaaataacaaatacaagaacaaaaatactctccacttgtccaagcatcccaggaggtctctgtattgtttaaattacttctgagtttaaattgcaattgctctagtaaattagctaacatctgctgtctgcctgatgatgaagaccaccctactagaaaccaaatacactctttgcttgagtcatttatttactatccaggacaacactgactcacagcagtataatatgagccacattttattttaaatgttgtaatagtaaccacattttaaaaagtgggaacagataaaattaatttaataatacatatttagctcagtttatcaaaagtataatttcaatacataatcaatataaaaattattattattattttgagatgggatcttgctctggcacccaggctggagtgcagtggagctcactgtaacctcaacctcctgggctcaaatgatccttctgtctcagcctcctgaatagctgggaccacaggcacacatcacaatcctggctaattttttaattcaacttttcttttcttttttgaaatggaatttcactcttgttgcctaggctggagtgcaatagcacaatctcagctcaccgcaacctccaccccccgggttcaagcaattctcctgcctcagcctcctgagtagctgggattacaggcatgagccaccactcctggctaattttgtatttttagtagagacggggtttctccatgttgatcaggctggtctcgaactcccaacctcaggtgatccgcccaccttggcctcacaaagtgctgggattacaggtgtgagccaccgtgcctggccttatttaactttttaatttaattttttattaattatttttttatttaattattttatttagaaatttttatgtagagatgaggtctcactatgttgcccagactggtctctaactcctgacctcaagtgatccttctgcctcaaccttccaaagtgctgggatcataggtatgagccaccacactcagccaatacaaaaattattaatgagatattttatattcttttgtcttcatactaagtcttcaaaattatgtgtgtattataatcttatagcacatctcaatttggacctgctactgaaggagattagccaccccaaaatatgccactttggcaaaacgattattttgagctgaaagcaattatgaattaacagacgctggaaggaggtctctgccctctccttatctgcctaaaatcagagcataaacttcccttggtgcaggtcccctctccaaccctcccctgccaggaaaggaagaatgactattatcattggagaggaggagtcaacactgagatgagtttgcacaaacagaacttactaaaataacctttaccttccattggttctctcatcattttgtagttacttccctatgatttaccatcctttgaagcccaaactcttttctctttgttaaaatggtatataagccctcaagtctaactgcttctttgagtttcacttctattatgtgaactcccatgcacataactattaataaacattgtgtgccttttctcttattaatctgtcttttgttagtttaatttatttaacttaagaagatggaggaaaagtttttcttccccatcactacatttcaagtgcttaatagccacataaagctagtggctatatattagacaatgcaggtctaggagaatatgtagcataaatcatttctaatctacactttatttttttttcttatgcaaaacctatttttgtcagtactttttccatggttgcagaaaatcagcataaacagtgttacattttagcagctaccagcaattagtaacgtaatggagtctgtaatactttagttttatattcttgaaggtttcagagcatgagaaaaagaccagtcctttcccaaatttcttcgtactttggtcctgaaaaagctattactaatagttctgcaaagtgaaaaaaagtaaatctcaatttaaaaattacacgtggttttaaaaacaaataaatacaaaacgagactatatcaaaaagccaggcacggtggctcaaacctgtaatcccagcactttgggaggctgaggtgggtggatcatgaggtcagttgttcaagaccagcctggccaacatggtgaaaccccatctctactaaagatacaaaaattagctgggtgtggtcataggcacctgtaatcccagctactcaggaggctgaggcagagaattgcttgaacgtgggaggcagagactgcagtgagccgggttgtgtcactgcactccagcctgggcgacagagcgacagagtgagactccttctcaaaaaaagaaagactaaatcaaagtaagaattcactttgtactttgctggaattttctattctgtagtcaatggtggtttctagtagtgcagggtagggaaactccagagcccaactaaaataaccacatgttctgaagttaattaaaagtataaattagtgttataaatagcaagatgtcccattcaatggttttaattattttacttctttgaaacaacaaatggatttgattaaagaataatttgatctattaaaatgtaattaaaggcatgtgtttgagcacttccattatttctccaaaaatataaagatgtgccctttatccctttgtatatatattttggctgcatttaaaatttacacaagtgttcaatacctaaaatctaaaagtaggattagatgtaaaattcccacatgattgttattttatttttcccaccaccatatcagacatgaaagatgaattgcgaatcttcttcctacttttctttcatgctctgctctgctctgaatgaagactcatgctgtagcagttaaatgaaaataagatcttttttcctttggcttatcgttactaacaaaggattttttttggggggggggtggtaataattcctggtaaaggagaagaaaaaaactcatcattaacaggcccagcagactttatggtgatatcaattaaatttttgataaatgaatgactctctgagtaaatgaatggatatggccatgacataggatgtaacaaatactcaggaacctggtattagaatcaatgcccagttctgagaaggctctgagtgtcatccatagtccttatgcagtcttccacgtgtgattactccatgatgactattctctggaagcttatataaaaataaatctgcagaaggttagggatgtttggggctgttagtacaattcttcaaaggagctgaaggtctgatcagatctgtacaactttgcacatcttgcatcctgccacttccccaaatctctgctgtttagttcagctattactgcaactattcacttaaaaaacgaactgtcaagaaaacaagttgtggctctactgaagcctaaagccaaccacactgtgttgcttctagccttgttttgtgttctgattctatgccaggggtttaacttacagttcacggactcctacttggatcatggctttgggaagtctatgaacttccggaaatagcatgagtcttctttttttctttttcatttttataccaagggctttcagtggattcttgcagaaccaagaaccactgcgcaaagcacacgtgcacactgggaactgagaagcaacactgtcataatcagtcaactgagaagagcccactgatgcctgactgccaaggaccctgctaagctgctttgcgtcaagagaacagacaatcctggcttggcacattacatttcagcaatggggtgtcctttggactagcggcttccattcagtccacacacaactgtaaaccacactgggctttacggatcagaatttttaactatagagaaaagatcgtgcacgggggtagtatatcaaattgctgtgcccgggtcttctacaccacacctatacaggggtggtgattgaagttaagagcatcacttttttttttcttttttgagacagaatgttcctctgtcgaccaggctggagtgcaacggcgcgatgtcggctcactgcaacatctacctccctagttcaagcgatttttgtgcctcagcctcccgagtagctgggattataggtacctgccaccatggctggctaatttttgtatttttagtagagacagagttttgccatgtcggccaggctggtttcgaactcctaacctccagtgatccgcctgcttcggcctcccaaagtgctgggattactggtgtgagccaccgcacctggtcgagagcatcaggttttgatacaataaacaaaagtagaacttgaccgtgaggtaattgccatgtcataccatggaaatagctgcatgagggatggctgaggatattcatctctacaaatcattttcaaagtttatctaggttattgaaccaaaaaaccatgggaaaaaaacaatggtatgtattctttcacacttgatcttagaagccatggtatgtattcttttattccaaatacttatcaagctcatctaataagagcaatttatctccctgagaaactttgtgcttctgccttggcccatgttaatgagccatgtttggctcatggtggctcattcccataattccagcccaccttaatgtactaaaggacaaaatcacacgattttctcttatatatgagaatcaattgtgaacttttgaaaaaggtgtttacaaagccagtaatagataaaaagttttttaagttgccaaaaatcagcagcaaatttaacatttcttgggtaaatattagaagcatttcctttaaggttgagaatgagctaggatgcctcttgtttttttgttctgtcttaaaaattgttttgagacagtcctgcttcagccccacaaagtattttgggattacaggcatgagccagcatgcccggcctctatgaggccttttaaattaccttttcttccatgtaatattgggaattttgatcaagagacataagtaagcaaaaagatcagaagaaagagagtcaggagactcagctgtcattatttacagatgatataaatattcacagaaaactcacaagagaattggcagaatctgtttagaattgtgaatagagttcagcagagttccagaggcctttctgagctctattaacctaggaattaacctaacaaaaatgcccagcttctcttgaagaaatctttaaaattctacgaaagctgtatttttccaactttaacgtacctccagataacctggggatgtttaaaaagcagattctgattcggtagctcgggggtggggcggagcctgcgttgacatttcaaagcctgtcaggtgatgcagcaggccctgtacaacactttgggttgatggtcctgatgcacttaaagaatacatgcagacagaaggcatgctcatgtggggactctttaccattgcaaagactctcattctctccaaactagtctatgatttttaataccattctcaccaaaatcccagtaaaatttgggggtcagaggtacttacttaatttacatgaaaaaggtcaactttcagaaaaaaaagtggggaaaatggagaatttggctaccatatattaagacatgtaacaaaaccagggtaattaaaaaacaccaccaccaatttgataatgcccaggaacagacaataaaacaatggaacagaatatagaaacaacccagaaacagaccacatgatattgatttatgaaagagatggcatcaaaactttgtggctcatgcctgtaaccccagcattttgagaggccaaggagggaggattgcttgaggccagaagttcgagacaagcctgtgcaatatagtgagaccccatctccattattaataataaaaaaaaaaaccttggtgaaacaaaaaatacattgataaatggtatgcacaaaactggcttactagatggagaggataaaaaattctctctctgacacacacacacacacacacacacacacacacacacacacacacagtctaagctaaatacctgaagttgtttatgcttctggtagagattggtcttgggcttctgattcagaggcagaaagcagaggcgaaagacacactctttctttttttttttcctttttttttttgagacagagtctcgctccactggcaggctggagtgcagtggggtgatcttggctcactgcaacctccacctcctggattcaagcaattctcctgcctcagcctcccgagtagctgggactacagatgcgtgccaccacaccggctaatttttgtattttcagtagagacggggtttcaccccattggccaggatggtctcgatctcttgacctcgtgatccacccgcctcggcctcccaaagtgctgggattacaggggtgagccaccacacccggccaagacacactctttcaagcaagcttcctgcatcagcacatgggatccactacttaactccttcagttagtcactcttggccttgccattcatggaaattcctctgagattctcacaacaagccagttctcatacattgtctcagtatatggtattgtgaattgagttttatgatttcttttttttggtcttcattagtattttattgcaaacttggaaaaaggcacgtgaggagctgataatcttatccaggtttaactacactcaactttttgattattgaagccaatgcattaaaggttttctctaactctgtgttgttcacaaattttattttcatatccttgttttcattcaagttcataatgactatttgaataggtcagagtcatagacaaagctctcagacaaataattaagagctttcccacaaagctggtatagacctactggttgaccctacgtggggataaggcacttcctgattctttccctttgtatccctcctctctatagcttaggccacctgacttctctctatgggcgtggtctcccccatttgtctagggataatactcagaatttgaaggtctccagaccaaaaatctagaactcagcacaggattgtgattcctccttgtacagtgctggcccttagggctaacagccgagcttctgccatgcatgtgaccctttcttttttctttttctttttcttttttttgacagggtctaactgtggcccaggctggaatgctgcggcatcattacagctcactgcagcttcgacctccccagctcaagtgatcctcctgcctcagcctcccgactagctgggaccacaggcatgtgcgacaccaaccagctaatgttttttttttttgttttttttttgttgttgttgttgtttgtttgtttgtttttagtagagatgatgtcacattatgttgcccaaactcatagctggtcttgaactcctgcccccaagtgatcctcctgccttggcctcccaaagtgctaggattataggcatgagccattgcacctggccaatgctttctgaaattaccgtttcaataaactgctttttatccccattattctctaactggagtacctttatatttttttaaaaacatgtttaaacttgggatcttttcatccattttgcatatatcctcatgcagagacttctccccacccataccccaatactaaaattacaagcctgtggcctgtccatctttctgtggtgcccattcttgcctgccgaggactaccatttgctcctgactcaagtacactgcccacttattagtgtgcccaccattcccattagacacttgccaacctcccccatcctctttgtttgcctgaaccatgtatctgtttgttacctgtcacagtatctttattttttaaaatttattttaattgtaaattgacagattatagttgtatatatttatgagattgttgtggctcagaaaacaatatcccaaagtgaaggcctcagaggtagcctcagaagcaagttctctctgaccttctccttccctcctgtctctggcccatcagtctcccccgaggctagccataaaaactataatccttcttccccaaggtgtgttatagaaactagaactcctgttcctcaaagccagccataaaacctaaaaacattactctaacctcctgccactccccgaccttcctgtgtaagacctggccataaagaaatctctgacttacattgtttaacgataggtcataagacactcattccaaaaagggttctgcctcatacctggaaggaagacagctgcacagagaggccaggaagaaccttaacagacaggccttgctgggattccccactcggtctatttccataagattataccttttctgtccaaacacagttctacactgcggtccattcttcatggaacctaagtataaaaatggatggttttacctgtatctttgggtcttcattctaaaggctcccatgtcatataaaactatgattaaataaatttgtatgcttttctcttgttaacctgtccttttttataggagtgtcagcttggaccctcaggatggggagaaaagggatcaccccctttctatccctatgaggtacaaagtgatgttatggttctctttttctttttttttttttgagacaggatctggctttgtcacccaggctagagtgcagtggcacaatctcggctcagtgcaacctctgtctcccgtgctgaagcaatcctcccacctctgcctcccgagtagctgagactacaggtgcacgccaccaagcccagctagcttttgtaattttggtagagacagggttttgccatgttgcccaggctggtcttgaactcctgggctcaaagcgatctaccgccttgacctcccaaagtgctgggattatagacgtgagccaccaggcccagcccatgatgttatgacttatgaatacaatgcggagtaattaaatcaagctaaataacatatacatcacctcaaatactttttttttgtggtgaagacattggaaatttactgtcttagcaattttgaaaagtactatacacgattattaactaccttcaccacgcagtgcaatttatctcaaaaccaaaccaaaacacaaccttgctcctcctgtctaactgaggctgtatactttgaccatcaactcctcattcccccagcccccagcctctggtaaccaccattctactctctgtttctatgagtttgattgttttagattccaaatataagtgaagacatacagtatttgtctttctgtgcctggcttattgcacttagcataatgttccctaagtccatctctgttttgcaaatgacagaatttctttctttttcaaggctgtcactgtacctttaaaatgccatgatctgttaaccagtcttgtcttcctcagcatcttgtctttcttcagcactacatcatctcctcaatatttttccatccaatattggccaaaatattataagcaattttatcaaatgcttgctgaaatccaatatgtgatggtggtgacttcctccggcatgtaatctactaatcctatcaaaaaaggaatgtttagcttggcacgcttggtctcagtgaatccgaagtagttaccactgtttacctctcctttctttaaatgcttgcatgtcaaatattgttccattctctggaatgacttttacctgtgaatggaatcttgaatgtcattctacagtaaaattctcaaccaaaaaaaaaaaacaaaaaaagccactgatttctagtcatcaatctataaacactaaagacattttactagttcacatagcaaaaaaattctgaggtagggtggtttcaggttggttgattcagcgtctcaataatattatcaaagactcagattctggccaggcacaatggctcatgcctataatcccagagctttgggaggcctaggtggatagatcatttgagcccaggaagttgagaccagcctgggcaacatagtgaaaccctgtctgtataaaaaatacaaaaattagccgggcatggtggcatgagcctgtagtcccagctattcaggaggccaaggtgggaggatcacttgggcctggcaggcagaggttgcaatgagtggagattgtggcactgtactccagcctgggtgacagagggagaccctgtctcaaaaaaaaaaaaaaaaagacccatattttttccatatctgtgctctgccaccatcattatgatggccttatctttggctggttctcttcatggaggcaagggagctatggcagctatgacctgcttttctacaggtcttcttttaggagcaagaaaagcatctaggagctccccttgcctgacctgccacggttttatttcacagaactgggtcactttccccctccaaaccagtcactggcaagctgagacagatcagaatttaatcccgagacatacagggaagagatgggtaaacccttgaaattggctgtttaccaacaagagaaagtcgacaaatgctctgggctaggaaaccctactgtctggtccagactggaggaattactgtctaatttggagagtggtcatatttgaagacggttactgatgaagacctattaaaataacatggactttttatctattcaaaacagcttaaaacaggactgtgtccagaacaaaggggtagattaagttatctctaaaattcccggccaactgtttaatgctgtgattctgttctcattgttttcactgtggaaactgcttgcaatttggaagagtgcgtgtcagcaatgtttgtgctgccagcaaaagtgaatagttgctgatctgtgtgcatttccccaaatagcacatttgtggaaaactgagtcatggggattctaggtactgtgaatccatcatctgcacaattttctgaatgccttacatcttagacactggcggcttccctgtaaataaacaaattgtaatgagacagttgacacataacatgggattggccaaagcaaagcaggtttagctaactggttttcctctggcaaattgttccttttttttttttttttttttttttttttgagacagaatcttgctctgtcacccaggctagagtgcagcggcatgatcttggctcactgcaacctccgcctcctgggttcaagcgattcttctgcctcagtctcccaagtagctgggactacaggcgcgtgccactgtgcctggctaacttttgtatttgtagtagagacagggtttcaccatgttagccaggctggtcttgaactcctgaccttgtgatccaccctcctcagcctcccaaagtgctgggattacagatatgagccaccttggccggccattgttcctttttatttattttgccctgaaagcagatgatggtgttaaataaagcaacaaattaaatgtggatgttagtgctgcaatggaggaaaacttgcagaaaaattgacctgacttatttaatcaagtgcagagacattactgtgctacctggggagctattcaaatacaatacaatctatatgccttccacctgagcaaccaagttcttacagcgctaactagagaaggtgcaggggagggggggaggactggataaagttatttttgtggcagttaagcttcgattacttgtagatccataaatcatcagccaaggttctcttttctccagcagtgagcacagggaggaggaggtgcatgcaagcgatactgcagggccagaatcagaatcatcagcacgtagcaactgattggatttctggagcaagaaagaagagttgaagataatgttgaactttctcattgggagattttactaacattattgagcaattactgcatgatggatgttacgctaagagcattctacaattattatacctcttacgtctcccagtagttctgttaagtaagtactattgtttttgttttagagacagagtcggctctgccactcaggctgtagtccagtggtgcaatctcagcttaccatagcctcgggctcaagcgatcctcccacctcagctccccaagtagctgtggtcccagctggctccatatgaaaagcctcttgcttccttaattactaaccaatggtaatagtttttttcttttttgtttttttcaagagacaaggtcttgctctgtcacccaggctggagtgcagtggtggtaacatagctcactgcagccttgaactcctgggctcaagggatcctcccacctccgcctcctgagtagctgggactacaggcatatgccaccatgcccagctaattttcaaatattttgtagagaccagggtcttgctaattgcccaggctggtcttgaactcttacctcaagcaatactcctgcctcagcctcccaaagtgctagtacttcaggtgtgagccaccacccccggtgaccaacagtaattctacacttcaatctcttgcatccttacccttatcttgtgtccttatgatcatcataaatagctcatttggccgggcacagtggctcatcctgggcagcacatgaaacctcatctgtacaaaaaaatataaaaattagccaggtgtggtggcacatgactgtgggcccagctacttgggaggctgaggcaggagaattgcttgaggctgggaggtcaaggctgcagtgagccgagatcatgcttctgtactccagcctgggtgagagagcgagaccctgtctccaaaataaaataaaataaaataaaagctaatttgtctcaggctttgaattaatctgcattagctcatgtaattgttgcaataactctatgtggtaggtactctcagccctgttatacaatgggtttgaaatgactactgatatacagaggtttgaaatgatgttacttgcccaagtctcatggtgaatggaggagcaaggaatggaactcagctcatttaacaccaaaggtctgaccaccacacagcactgccctctttagccaaactaatgtttttgtctttcttacttttgacccattttattccacctttctgaggtattttcagcattttcattaagctaatgaatacaacaattatttaagcagctaatccttaaatatgcttctataaaatgtccttttagtttcattttctccttatcactccccaaacccaccagacctacacttcatattttcccaaacgtgtatacacaaggcattcacctgcttttatatgatgtcctttcctgttcatctcaacctggtaaggttaagaaggaaaatgattttacatatcagaggggagagtgctacaaaagaatatgagacacagacaattttgtaaaaaaaaaaaaaaacaactttgtatgagataccttatgtacatacacagaacagttaaatcctgggcaacatgaaaaaacctcgtctctacaaaaaaatacaaaaattagctgggcatggtggcacaggcctgtagtcccagctacttgggaggctgaggcgggaggattgattgagtcctggaggtcgaggctgcagtgagccatgattgacagagtgagaccctgtatcagaataaataaataaataaataaataagaatataataagccaaaagtgaagtacagtgaatgactaagtgttctaaagaaaaataaaagcaacagtccatggaagaggtagaccttaaggatgagtgggatttgatgggaaaagggtggaagctagagtgaagacagaaatcaacatctcattactgacagctatttatcaagcacctccatgtgtttggccattaaattaaagttttgaggatagagatggaaaagctgcttgctgtctttctcccaaatactctgtgtttgggaaaggcttaaacagatagcaaaatacacagtgacacaaagaggcacacaatacaccgagcaagagtttcaggcattctgaaaatgcaggggacatatcccagtaagaatggtaagccctgggacagagggtgagcggtttacatggatcaaagggctcgctcatgataacaacagccttctctaagccaggcactgaatactgtggatacaaagagcccagagtcatcaagaggaaccaggaactctaacatgatgtgtggagcaggctatgcaaagaggggtacctctcccagtcagaggcatcagagaaggcttcctggtggaggtgagtaggaatcacgtgcaatcgtgcaggcgaggcggggagaggacacttctgagcaaagaaactggttagaaaatgtactggtgtgtagggagaaagagggcctccaggtcactcagggttgctatgagagcacgaagtttaaggccaggagcagtgagatgacatggaagagagaggtggtgactggctgccttagggagcctgggcttgatattgagccaggaaaatgttttaagcatcctttaggttagggagctgtatgaattagattcaggttgagccaaggttttagcaagcttcaaatgccaaactgagcaaatcttccctcactgtgagtttgctgtgatcactgttcttatggttcagagaataactgtgctgtagatattaggctcaattcaaagtggagctgctgaaaaatttattagtgctggagtgcataggatgctgttcatgcatgactagcatttcaaagggctgtagattaaaagtgagaggtctctgaagtccaatttcaaaacccagagcctctccgccacttatctcctacttcgcaccaatcctggaatgagtctatagaccactgtaacttctccttctcaacttccacatcttttcttctctttctattagcaacctttatattccctttgggtgttttctttttctttcttttaccacttatgatgcccacatggtcatactatgggaaatgcagagctgaatcccattagagtccattgagagcctgctgtgctccaggcattgtttggggcattttaaaacattatctcatttaattatcctagcaacagtaaaaggcgggtgtcattttacatgaagaattcgtggcacagacaggataaattacttgcccaaattcacacaactagtaatggacagaggtttttcacataagctttttggatgtgaattggaacacactcgtctctgtgaattcccaaagctcttgggataacaatacaaaactttgtcatgacctacaagggtttggatggcgatttctccgctctctcaccctacaaccaaacccagacaattggcatccagggcccaaggtcctggccactctggcatactgtctctgggtttcgaaacagttcatttaggatcctttatatacaacgagttacaaatcatattctgtgagtttctgatctaagttaacagttctttcttaccaaggagacgatgaacacacacacagacaagaaagagctgcagggaagtaacaataacctccaacaggttcttagttggaacggacccatcacaacagacaaacaggagaaaaacagaagtttattaatatggatattttatacacgcatgggggacatccagagaatgagttttcaaagaggtggctttaagttccagtttatatatagcatcttcaacaaagaacaatagatttttagacaagtggcaagacaacaagaaaggactttttgagtttctgtgagcaggctggcaactcaaggaaaagcaaacaaacagcagataaacgctagttaggaaagcctgccaatgcaaattcctctggttccgactctaggctgatgagggtctaaagctgtcttcagtggttaaacttttcttgagggaaaaggcgggggttggtggccaggatattttttgcctttgtaaatctatgtcctccttttggacaaattgaggcagagacctctcctgtacctgtttcttcttgagcatcttcagctcaacaatccttcatattttggggaagatattctggtctcccacagagcctttcaaagaaggttcagctctggtctgggttcctcgtctctcactattatctgagtttgtgtctcccaccctcctctgagtccatactggtctgtggaagaaggctgcttccctgaataaaggccctaatgttctatttgcacaaagctcagtctttctctatgctgaacttggctttattactaagtggctgtgagattttcatgttgtcaactctcctatctcagtttcagtttcctcatctgtgcaaaatcagtcatccccaaagtgttgcccagatcaaaaattttagaattctatgaagagctttacccactagtagaagagagaattaatacattcatcaacgaggaccccatttgcactattgtccagtataattatttaaactttctatctttgtggcatttatgattacttattgtaaatgaaactggtgtgaaggacacacatttttaatgcctttaattgtcatccaaaggcgctttccagctgaaaaattccatgattctaaatgtgtatcatcaatttcatgtcaggcaggatcagaggcttggtcaatattattttttccacagtgaaattgtgtaaggcaggagatcctacttaagctaacatatgtgtatccttcacaatggaagaataaataaaagtataagttgtggatttgctaatagtttcttcctgctaaaaatattaacctcttctattccttaacaataacttaacacatgtagttttagcttaaaattttggggaacttttggtgtcttgaagtattttctgcaaatttatttctcatctccaaattctatgtcccttttctgaatgttcttgatgctacattttcatgtattcatcaacttgagatgtttggctccttttttttgtttgtttgtttttgagacaaggtctcactctgtcacccaggctggaatgcagtggcatgatcatagctcaccacagcctcgacttccctaccttaggtgatcctcccacctcagcctcctaagtagctggaactacaggcacgggccacaatgcccagctaatttttgtattttttgtacaggcggtgttttggcatgttgcccaggctggtcttgaactcctgggctcaagtgatcctcctgcctcggcctcccaaagagctgggattacaggcgtgagcgaccacacgtgaccttttctactgttctctgagctccccaacattttcatatttgccaaatcactgttatgtacagagaaatctccatcaactatttcattatttgaaagaagcgacgccaataaagaatttactctctgtttacttggacataaagagctactccaaattaagacctgacattttctcatctccttctttgcaataaaaataaaattgaaattaaactgggataagtgcaacacattgtatctaagcagccattgtcaaactgtttctaaatatcaacagtaaaagctctaatctgagtcaattttggaatgcacatatattccaaagggaaatgaattttcaaaatggtataggactcaacatcgcatattttagtcttcaggccaagcaggaaaatactaacaagctacttcttccaattttgctattaatgcaaattgatgtaaaactacctgctatgggcgaaacactcagcctctgcaaatggtctcattctgaaactgtcagtgtcagagaaatggtgtttcccttccgcagctcattgaaatggagatggcatggaatggagtaaagggatggggatctgctttctaatcaggcaaaattagattcatttgaattggtgcatggactgaaatgaagggaaaatccaaccagtgcctatttttacctccttagacagcctttgagcagctaggcatagtaaaaccatacatgctaaaatttcccacattgatacagaattcatgaggaaattattttcacactttaatggaatgggtctattgcttacattatacaatgtaagggaaaaaattactaaactcagaagcacatttccatatttctcatcaacttagtttctttgatacaaacataagaagctaccccaactattacagagcacattttgcaaatttcactaatgcatcgtactcatgtgacatcaaaagcaaaaatatcaaagcaaacacacagacaacaaatgaaagcaaacctttatagtgtatcattcagtgaaaaatacatgttctaaagagttgtgatatatgatactacggaactataatatattccagtttctacaatttcagttcttttcagatttggtgtttataaaataacctagtaaagaagtggtaggagaaagtgaaattttacacagtggattatgtgaaacacaaactaatgaaaccagccaaagtttctgagttctttttttttcccagccttcccccagccaaatgagtttttaattcatataggatttttaaaaatcatttatttaattctcctatattttagaataatagcgttcctaggttagtagttttcagactttaagttttcaggacagcaaaatttcccaaggcagtagaaagagctaacatagagttgccaaactgttaattttgccaataacaacaataacaaaaagctaccattgccatcatttcagacaggaaaggatatttccacaccaaaaatgtaggaagttcataatgtcagaatacaaaagagctcttcccaagaaatacaatttgttaaccgtagataattttaaaggatatacttatagttttatatacatttagaaacatttataacattaaaatttattttatactacaacaaatattatgttcccttggtacaatttttttttaatttgatagcactatatgtatttcatactctggtatttgatagcacccatgatgaagggctctaaggtgtcatttgttttggtgttatatttttatcagtgccatcatgaaaaattctgttttacagatatgagcaaaaataaaaacaatagtcttaatagtgttttgttttttgtttttgagatggagtttcactcttgttgcccagtctggagtgatggtacgatttggactcactgcaaactctgcctcctgggttcaagcgattctcctgcctcagcctccagagtaggtggattacaggtgcccgccaccatgcccagctaattttttgtatttttagtagaggcggggttccgctatgttggtcaggctggtgtcaacctctttagcttgggtgactcatccacctcggcctcccaaatatgctgggattacaagcatgagccaccatgcccggcctaatgccgtttcaattattctgacatagtctaggcaaatcaatatgctcaggaacagtagctcccacattctcaagtccttccttttaccttgcttacaatgggcaggtagaaaggccggttgagccaggccaggtgggtggctgggactccgcaggaagtaagctcaggactctcctcagttattgcccctcactttcagggcagaaccatatggtctccttgccttacagagagaagctgggaatttttacaataggtgttctgtgggccagtaaaaactctggcccttcccggcatttgggaaccattgaaatgggtcctttagtctttgaattcctgaattttgtgtaatccagaggagcctgagactctgcgtggctatgggttgaatccacagccatcaaaaagcaccttcccactggtaagttaaacacagtacaaaaagcactggttctagggacagaaaagttgtgttcaagtctctatttaacatagacagttgactcttgaacaatgtggaagttaggggtgttgacccttccaggagttgaaaatccaagtataacttttgactccccaccaaaacttaattattgatagcctgctgttaaccagaagccttactgttaacataaatagtcaattaacacatattttgtatatgtattatatattgtattcttacaaataaagtaagctagagaaaagaaaatgttattaagaaaatcataaggatgagaaaatatatttactactcattaagtggataatcacaaaggtctcatcctcatcatcttcacattgaataggatgaagaagaggaggaagagaaggggttggtcttgctgtttcaggggcagcagaggtggaagaaaatctgagtttaagtagactcacacagttcaaacccatattgtttaagagttaactgtacttgatttcataatgttttctaatgtttttctcatgttcagatgggggttgtggggaggaagaccacacagataaagtgcagtcaagaattcttgatagaatttgggaggccgaggcgggtggatcacgaggtcaggagattgagaccatcctggcaaacacagtgaaacaccgtctctactaaaaatacaaaaaattagccagatgcagtggtgggagcctgtagtcccagctactcaggaggctgagacaggggaatggcatgaacctgggaggcggaggttgcaatgagcggagatcgctccactgtactccagcctgggcgacagagcgagactccatctcaaaaagaaataaaaaataaaaaagaattcttgatagaattctcatcatattctatcaaggttacatagtatcaatagaacatcactattgatatcaaccttgctcaactggttgaaatagtgtttgtcacatttcttcattgtgaagttacttttccctctttccacactactcttcagaaggaagtcacttaaagaatgggaagctatgttccacctccttcagggtacagtaccctcataaattgtttgaaattcatttacatggaagatttgtctattctcctccatctatttatttatttgacaatttatttatatcaatatgttgtcattagttttcatttcaactgttctaatatgtgtatagtaatggtcttaatttgcatttcccttaatggctagtgatattgaacatatcttcaaatgcttgtttgccatctttgtatcctctctggtgaactctctggatgtcttttgccaactttcaactagattctttttaatgttgaggttcagagttctttatatattccagatactagtcctttgtcagatgtgtgatttgcaaatatttctcccagtctttagcttgtctttttatcttcaacagggtcttttgcagagtaaaacttttaaatttttgataaagtccaatttattatttttctaacggtttgtgcttttggtatcacattcaagaacactttaccaagcccaaggtcccaaagactcttctatgttatcttccaaaagcttcatagttttgcattttacatttacctctataattcataatcagttaatttttgtataaggtatgagatttagatgaagatttatttttgtctatgaatatctaatgagccaagaataattttaaggaagtgatatcaatggaaatgaactctaaaccagatgggaagaaaatgaagatggggccaggtgtaatggctcatgcttgtaatcctagcactttgggaggccaagtcggggggatccctcaagcccagaagttcaagaccaacctgggcatcaaagtgagaccccatctatacaaaacaaaaaattagcctagtgtgatggtgcagagtactgtggtcccagctactctggaggctgaggtgggaggatccgaggcagaggctgcagtgagctgtgatcatgccaccacattccagcctaggcaacagagggagaccctgcctccaaaaaataaataataagtaaagatagaaggctaacagataattcttaagtgtcagagtccatgcttaaggtaaaataaatgtagctacgggctgggcttggtggctcatgcctgtaatcccagcactttgggaggccaaggtgggtggatcacctgaggtcaggagttcgagaccagcctggccaacatgggaaaaccccatctctactgaaaatacaaaaactagccaggcatggtggtgcgcacctgtaatcccagctactaaggaggctgaggcaggagaatcgcttgaaccagggaggcggaggttgcagtgagccgagattgcaccactgcactccagcctgggtgacagagcgagactccatctcaaaaaaaaaaaaaaaaaaaaaagtaactacaaagccagtcagccaaagactaagaaatagatagtagttggaaatttcagaaagaaagcaggtactggtggtgtaaataaaaagcccagtagtggccaagggggtgactggctgagatgaggtggagtggggtaaagaagttaaggaactgagatatcagggtgtagagaggcagcctgtgaaagctgaggtcagagaatgatgcaggagtgggtggagagaaagcacattggtcaggggctcaagtgtttttgaatgagcaggaatgagcggaggtcaaggagatgactggtccaagatggggggaaaggagcaagaggagacagtgtcaggagggagggagagaaatgctttgcagtcaacagtgaggagccagggggatgctttttctacttcttggccttagggtgcaagggggatgagaaagaaaaaacaaaacaaaacaaaaaactatcctgtccttgaagaggcagtggggaaggaaatggcctcagaagtcttccaatgtccgttagagcaaacaggtgaaaggaatatttggagaaaatgctgcatgagatgatcccaggacaagaggcaggagggcagtttcaggaactcagaaataccaggaataggaagaaggctttgagtcacactggagagcagagcccaagtgacagagctgcccttggttatcatgaaattctgagggatacgtcgttgttagactgggcctgaaagtcaagagtggaagttctaagagtcctcagagaaaaagagggtgagctgatgttcaggcctctaactgagataattatgtgaaagcactttgcttatttatttatttgtttatttgttttgagacagggtctcgctctgttgcccaggctggattgcagtggcatgatctcggctcactgcagcctccggctccccagttccagtgattatcctgcctcagcctcccaagcagctgggattacaggcatgcgccaccacacagctaattttttgtatttttagtagagattgggtttcactacgttggccaggctggcctcaaactcctgacctcaggcgatctgcctatctcaacctcccaaagtgctaggattataggcctgagccactccactgcctaagcacttcatttataaagctgtgtcttaaaaagctggaaatcactagctattgttaggtggtgaaaggcattacacaaagcaaattaatatgtttgatacttgttgtccagaaattatatatttatgattatatctacacacacgataatattaaaaaatatccattgttgctgggagcagtggctcactgctatagtcccagctattctggaggctgaggatggagaattgcttgagtcccggagttggaggttacagtgagctatgatcatgtcactgcactccagttggggtgacagaacaagaccctgtctctaaaaaataaaaataaaaaaatccattggcctagacataacaatttcatggttagttatatagacaaatatataaatacacacatacacgttagccaaaaatggtaagttcaagcagctgtaaaataaaatgcaatcggacattttacagcttgtattttaaggtcctggctcagttcaatctgtcttctcactggttcctgcttctctcttctttgttctacttctatttctcaccatgttttgacaggtgaggttgttcatgcaaagggatccaacaaaaatacaggaatgccacctttgcctcctcaaccaggacagagcaaccctccctttcctccttgcaacaaagcaggcaaaacacacattctcctaccgccccaccatgaagctgaggcacgaatggcagtgatgctattgttttgcttgcagggagggaattttcatgcaatcaataagtcacctgccctctttgcccaggatcagctctccacccaaacccctgtgagcttcagtggtagaatacttcaagcttcagccagcacaaacatgtcacagcaagagggacagcgattgtatttgcacacacaatttgtttaagtacaggctttatttgatccttaaaaaaaaagaacagctttggtattacattacaaccaaaggaatttagcctttaacctgcagtttccctattctcagtgatataaaacctttttctgataagaggtgaggcccagtgaaattttattcttttccctctttcccggaggtgaggtaatgaactaacaacttaattagaccctgttttataccaactaaaataatagaagggagtctttggtaacatggcaaaaaaaaaaaaaaacaaaaaaaaaaccccaggaacatcaggcatcataatacagagaatatatgattagaattaatcaggatatggaaagatatgtttatcctgtagatacttcaccctgaagccataccatttttatttcccctccattgggcataatggaagggacttgaaccctctgcaatggactgaatatgcattcccctgaaattcatatgttggagttctaattcccaaggtgatgatattaggaatggggcctctgggaggtcgttagagttagatgaagtccggagggtggaaccttcatcatgggattagtgccccatataacaggcctcagagagatcccctgcttcttctagcatgtgaggttacagtgagaaaacgactggctatgaggaagcaggccctcaccagacactaaatctgtcaataccttaattttggacttcccagcctccagaactgtgagaaataaatttctgtgtttataatctacccagtctatggcattttgtgataacagcctgaagggactatgacattattccccactgcccagctccactgagagcttgagagctaggactctagaggacacccgagagagagaggctggctggagaacaaagggagataggcttttttttttttttttttttttttttaacaaaggccttcttgttgctcacaaaggaggaggattctcatagactaatttccaccaatggaaaaaaataagagcagctttgccccatcctctgaacccagtgtctctccaatcatcacacagcaaggttttttgtttttgtttttgtttttcaggtaatggtctgtgtatttgttttctatgctgtgtgacaaactaccacacgcttaacagcttaaagcaacacatgcttattatctcacatgctctttgagtcaggagcctgaacacagctctgctgggttctgtccttagggtctcacctggtggcaatcaaggtgttggtcaaggttgggttctcatcagaggcttgaccaggtaaagatctctgtgcatactccctcaggttgttgaatttatttctttgccattgtagggttcatggcaactcaattcttcaaagtcagcaacagagagagaaagagagagagagagagagactctacctgggtctactaagaaaacagagttctacatgaacaaacatgatcttgggaatgacaccccattacctttgccatattccactggttacaggcaagtcacaggtcctgcctacactcaagagggcagaaacttcaggagatagagatcctgggtaccaccataaagtccatctgtgtctctctagtctagaaatttaagggtatagccaaggagttctagaagcaacatttgtagaagaatcataaaacgagggtagatattttaagtctacacacatattcacacaccctaacctacaaataaaataaaggtaggagtttttcttggtggtcaatggcatgagatattgtagtcatgcagtgtggctttgcatctctgatctataatttattggttgcttaactttactaagcctcagttcccatctttaaaatgggaatcatggtacttatctttgaagctgttatgaaaattaaattagataaagtagacaaaacacttagcacaatgtctggcataaaagtgctcaaaaaatgattgctattgtatccgggtaagatcctgaggtgcctcaaacaaagtagaattttatttttttagttttatatacttaattaactaactaatttttggagacaagatctccaaaagtcactcaagctggagagcagtagtgcgattatggctcactgcagcctgtagctcctgggctcaagctatcttcccacctcagcctcctgcatagctgagactacaggcatgtaccaccatgctaacttttttttttttagtagagctggggtctcaatatgttgcccaggctggtctcaaactcctcggctcaacccatactctcaccttggcctcccaaagtgctgagattacaggggtgagttactgcacccagcccaaggtatgatgttctctagacacagataacttaatcttcaaggttgggttccttctgagatctaagaggtttgacaccattttggctccatgcttccctcaaaaccatggtctttttaacctcctgagtggctctaccaggatctcagcctaccttttcctgtatcttcatcaatggaaccggtaaacttttgcaatgctgagttcaaagtccctgcagaccttcacacttcataactggaatgccctggaggaggctggcctctttcctacccacctatgcctccacccatcctgtccttaggcagacacctacgggtcctagctgactgtcttagcacaagcttcctatatgctagacctgcttagaccttggaacctggctcctgagatggattcactcaattattcactcactaaacacctaggtgacacttaccaagtgccagacacagagctagtttgaaagagagagaagagtgatgaagacagaaccctctcttcaagcaggccattggccaatggagaggcagacacacaccaacagagtaaagccaacacttgactttggacaggaatatatcggacatcttacaccaatccctcagcctgtgaaaatgcaatgatcagccgggccccttgctttctcccatgtctcagttccatcaagattcatgctttctgtacggtctcacaccacttgtgcatttccaacttctactacagttttatgcctcacgtgataagcagtttttgtgctagctgtttagtaaatgtttagtacttactaaaacatttcatacaccatgttttcctttctccgcagaacgtgtgtgatggacttatggactcattcactgcatcgatcttgggcactgcccagcttcatgttccactctcccgtttatcccaaattgctgaggatttcctaagaaccatcactttccagagctcattattttctgttatttgcctcagcagcacaagctgttttcacaaagaaataaagggtcttctattccagaagagttcttctatgcatgtaggtgagcagacagtgcagagccatgctgaggtgtgtgtgccttgctgtcactgtctctcctccgggaggaacactaggctcctgtacaccaggcttcccacagcccaggaggaacacatccacgccttgccagtcatttgcatcttagtaagactaaaactaataaaactaacaataaaacttaaaatagattgaaggattacagtatgccaagcatatatgtattgtgttatttggccctcacagtcaccttttgagctaggcaccagtaccagctttaagagctcaggaagctgaggtgtcaagattttaagtcatttgctcaaggtcacacagctaggaagtgtagtgggagagtcagtcccccatttgtccaatgcagtgctgtcgcccaagtgtgaagagggatgtgcgggtctgagaacaaagttagcctgcttagtactttgtccaaggtcagccctggctccaagcccaagaaacaaggcaggatcagcagccacaaagtccaacagtcagccaggctcccatactgcaggggtctctatcacagcccagctctggatatgggcaaatgaaagctagcagcagagtacccaggctacctctgcacagggagtgactgcggaacttcaagaacaaaagagaggcaaaagatgtggggtggcctgtctgggagggactagggaacagggacaccttgcagataactctcaggactgaggagtaaatatcttttattaaacaaagcttataattctgactctaagcctggcgttcctaacaatggcagggactgatggctgtgaaaggcactaatcagacacagtagattcgtgtttacactgggaagggccgctgatcccgcataggcctttgaagccacccgtgctcacacagattgtaatgcactatgaagtcatgtcttcaaataaaagggaggagttgaaatagacctgtctagccagttatttctctaaggcacttcaaagaaacattttctttgatcgttttgactttccatctataagaaatgtgaacatattactcatagaaattgctgagagacctcaggctgatgggggcttcagtttgacccatcgccagtgaaatgggaaggataaggtagggaagggcacactggttcttaaaacttccaccaggaagtgacacacatcccccactccctcacatttcactggccaaagcaagtcacctggcttatctaacttcaaggggagcagagaaacaccatcccaccacatgctgagagggagggtgggcagatactcatgacccccagtaaacagcactgatgactaacacaaaggccaagtgataaggaggttgtttttaggaggtcaaatgaaggagtatattcttcaagaaaataaggcactgatgagctttgttacatctccacagtaatttctaaaatggaatttccccatgaaggcctttaatatgagcattacaattgtttaagaaaacaaagtgtcctgatttgactaaattatcaaggaaaaatgtggaaattacaaaactgggaccaaagcaattttcccatgtgtaactggaggatgaaacaatccgtctctcattctggattgttggtgggaaaatccactataggactctacaaaggaaaactaccaaaacttggatggcaccttaaaccttttctccctggaacttgcctattatctcgctttttctctcagcagtttcaacgcattttacatgtatcaccacgtctggagtttcagataacctgacgatgactatttatatttcactcacgtgttccttcattcaacaaacatttattttgaggatctactacacgcagcattcttctctagacactagggatacaaagataagacatggttctacctgtaaggtacttattaacaaatttagttgagggaagaaagaacatgaatcagaaaattatagaatattgcaaaagtacaggctggtctcaaggtagtgagatatcttaattgatttttcagtcagctgcagatcgaattattcgtcctactcttcccttctcattaccgtacttgactagactttaagaaaaaaaaaagtaggccaggctcggtggctcacacctgtaatccctgcactttgggtggctgaggtgggcggatcacctgaggtcaggagttcgagaccagccgggccaacatggtgaaaccccgtctctactaaaaatacacacacacaaaaaaaaattagctgggcatggtggtgggtgcctgtaatctcagctactcaggaggctggggcaggagaattgcttgaatctgggaggtggaggttgcagtaagcccagattgcacctctgcactccagcctgggtgacagagtgagactctgtctcaaaaaaaaaaaaaaaaaaaaaaaaaaaaggtgccagctattatgggagagctgaaatgatatttataaggacatcaccttccttgcaagggagtagtgtccgtgtaggggtcactcagtacacagggacatggcttgaggcagtgcaggtgtgcattgcacaatatcaaggcacactcatccccttacaggcttcttagatttatgcagatgtcacttaggtgtcttgaaccacgagtactcctatctgtgccaccatttgaactgcgaacaggacagccagcaacgaaccaacccttagttctctgaaatatgttcatcatatgcttactcttatttttattagtatgatataatgataatctctaacttgctgaacaattttttttaataatcatcgattatacatccagtctgactaagactgttctaaccacattggaagtccgagataaagatatgccacagtccttgacctcaaaaagctttaaaactagatggggaagagagacaaaagcacataaatcagttcgaggataattaaatgctaacttgtgtaacactaagtttaaatacaatctgagttatgaagaccaagacatcagccttagatgggacttcatctggagcttaaaggacatggaatatttgggtaggccaggggaaagaaaatgatgagaatgtatgactctatcgatctttggccattacttcctgggcaaaacacctcaaagctcacgccttgctgatggagagtagcagctgcccctgttgtcacagcaaagagggtggcacagctgataaagggtagggaactctgcccatcactctctgacctgctctaactcctttcagcacatcaagttaccctgtgccattgtcccaggttccttccgtgtagagcaagtccttccttctgctattaccttgcagcagttaagagcacacgctagttcactaattctccaagtgtggtccccaaccagcaacatgagcattactggggaacttgttagaaatgcaaatccttgacccctgccccagacctagtgactcagatagtctgggggttaggtccagcaatgtgtggtttcccagtccctccaggagattccggtgcacacatgtttgagaaccactgggctcagcagacaccctggcttcaactcctggctctgttggcactcatcaactccgtgcctcagacagatggttaatcctgctaaatctcaaaaggatataatagtagcacccatccccatggggctattgtgaagaaaaaataagttaatgcataatgcaaggcccttagcctaattaatccttgataattggtaagcactcagtgacttagtacaattatcgcctgataagatttccctttactttttttttttttttcatccaggctggaatgcagtggcacaatcatggctcactgtagcctcgacctcctgggctcaagtgattctcccacctcagcctcctgagtagctgggactacaggtatacgccaccaagcctggttaattttttgtattttttgtagagatagggtttcaccatgttgcccaggctcacttcgaactcctgggctcaagcaatccatctgcctcagcctcccaaaggggtggaattacaggtgtgagccactgggcctgactcgttttcttaccataacatggttgggaaatcttatctaaagatatgtttctcaacatatctaaagatgtatttcattgctccttctcttctccttcaccactgtcatctccaatagccccattctcaccactctttggcttactagtctttttttcaatagcataagatttaccattttaatcaatttaagtgtacagttcaatgacattaagtacattcacattgttgtgttatcgtcaccaccatcgatccccagaacttttttttttatctttccagactaaaactctgcactcattaagcagaaattcccatggccccttccccttctcatccctggaaaccagcagtcttctttctgtctgtctctgggaatttgactactctagatacttcataaaagtaaaatcatacagtatttatcctttgtgattggcttatttcattagcataatatcctcaagtttcatccatggtgtagcacaggtcagaatttttatcctttttaaggctaatattccattgcgtgcatagtacacatttgtttctccattcatctacacatggacacttggggtgcttccatcttttggctgttatgaacagtgctcctgcaaatataggagtacaaatgtctcttggactctctgcttgtaatttttttttttttttttttttttgagacagtctcactttgttgcccaggctggaatgcagtggtgtgatcttggctcattgcaacctctgcctcctgagttcaagtgattctcctgcctcagcctcctgagtagctgggattacaggtgcctgccaccataccaggctaatttttgtatttttaatagagatggggtttcactgtgttgaccaagctggtcttgaactcctgacctcaagtgatccacctgccttggcctcccaaagtgctgggattacaagtgtgagccactgcatccggcctctgcttgtaattcttttgggtttatacccagaagtcgattgctggtggtttactaatcttgatagcccccatctttaagagaagccttagtttcctgtctcctctgtcaaggtggcttagcctccactaccagagagcagtacatcctccttctgcatctaggagaatgttataggagtatcttgtattcttcaaaaacttgaaactgggtgagtaaagggccagttttcctctaaaacatacttaggcccctctaaccctagacttcatttcatcagagtaaatggtttttattgtctgtctacaaatacaaactcctcaaagagaaaactttattttctgccattccactggtgacaaggacctgagaataaaggaggattatagggcagactgtctgctatgataacttatttttcttccagttgtttccaaccaaacatacagtattattaactttgactgtggtcgtcattttggcttcaggcttaatctattttgactaggaatattgtcctcggaaacactacaatttcctgaagagactgcaaatcagcagtcttgactaaactcatacatggccgttatctttcctctgcttgaaagatgtacaaagacagtatgtcattgtgagccaggaggttttctttatttagcgtctgccttctggctcagctataaggtaaggcaattaggtacccaacatttataacagacatgtttaacttccctgatatgtcctgcagaagttaagcaaacacaaagataatagattttaactagcagttaggaagtttagacttcaaacctttgagactgtataaaatatgatggcgagacaatggacaatgtattcatttactacttaaaaccatcttgaactgaaatatttaaggtagaatcatttctacctgtgaggtccacaagaaatgtgtactaaacatcttttaatgcaagactttgatgttgagcatggtcaagaataagcaaaacaaatgtgatccctctaggaggcagtgttgtgtagtggagatatcttgattcaggttggctatgttgctgttagcctccacctcatactggttatatgaccttgagcaaattacttaagttcttcatatctcagtttcttcacctgaaaagtgtagatactattagcacaggaaggccatttcctgtcatttaagggtaactggtatctggaaattcccacattgattgattgattgagacagggtcttgctctgttacccaggctggagtacagtggtgcaatcatatcttgctgcaactcaaactcctgagtttaagggatcctcccacctcagcctcctgaatagctgggacttcaggtgagcgccatcatcccttactaattgtttcttactttttttagagacgaggtctccttatgttacccaggctggtctctaacacttggcctcaagccatcctccagtcttggcctcccaaagtgctgtgattccaggaatgagccactgcacctggcctctagggctacttaaaataaatgcaccaaaatatcatttggaaaaagtaggtgttattgggacattttcttgaaaaatgaactaaaaattacaccaattataaaactgtcttacatttaaccaaatttagtttaaaatttcaactgtacagttattctcagaaaaaaattcaacaaataaattagtttggagcaataatctattgctttggtattggattctcccttttgaagcacttgtcactgttcccatcattgttttcttcaattgttaacaggttgagtcatgtcaaatccttgtttgccattggcttgcaagtagttctagtagctctcctccatcactttcatcaacttcatgaaattctaaatgtttagcaaattgtgctttttccctttgcagtccttctgctttatattttcaatgtagagtatcatgttgtaaatatctgacaattaatgagactatggccaacaagggtgactggcccactggtcagaaaatatgatggatcaaacaggaatagacatttgaatggagactgattttaataaagggccagctcatgacaatttttactttcccaacacctattaactacagagacgtggaaaatgagtactcagatagcataaacgctccatttctcattaaattgtcaaatgccatggctcagcacagtgtcacatgagtaacatgtgtgccttagctgttaatattctcattatttatttaagaggacccacatgttcacaaaggagttgaaggcatttaaatacaaattgtatataagctaagaagaatattttccttaaatcactccacttttccatcaataaacaccatgattagagaacaaaggaatccctcactcttaaacctgcctctattccttattcccctttccccttattttgtcttatcttctctcggcaacacttattgccatctgacagactgaaagtttatatataaatacatgtgtgtgtgttttcatctttctcctgccactagaatctaaatttcagagtgcaaggatttcctttgttcatttatttgtccctagcaccaagaacaagatctggcagatggtgcgtgttcagtaagatttgttgaataaatgatgaatggaagactcctcattccagggcccaagtgcccagggaccatcacagcaattccatggctagggatcccaatgcactatgtcctgaaagagtctctgatgtgaataggaaacacaatcagtggatactgtgcaaatcctaagaagaaaagacagcacagagattccaagaagcacacggtagattgaaaggctgtgcacagttactgcaaactcagccctgatttgtggttgaactaggctccattctaattcaattcaattcagaaggaatagaagggtcttctgtggggcaaaggaagcaagttggaattctcccttccacaaagaaaaagatatgtgtttttgcatcatggtgtagtggaaagaactacctgtacagatcagaaaactggtgtgctgatctcagctctgacgtgacttgggtctgtaactcagcaaaatcacttcaagctttcagggctctacagcttcatctgtatgaccagagggtgtgactagatcagcatttcctaaagcacgatccttggaacaactggcactctagacctgcactcacaggtagtcgctagacacatttagctattgagcacttgaaatgtggccagggtcacattttaaaatataaaaactaaaacaacatacaaggaaaatttaaagtgtctcactaataatttttatgttgattaatgttggaataataatcattttgtagattgggttaaatacattattaaatttgggatagaaggggaggctgggcatgttggcggaaaggggtatatggggactgtcagtactttctattcaattttgcagaaaattgaacctagaaccaaaaaatgaagcctatttataaataaataaaatttatataaaaagttaggtttacgtgtttctttttactttttaaatgcggctactaaaacattgaaaattacatatgtagttacagatacagttggcagaatatttcaacttgacatatatttctattgctgttctataatctgaaagaagaaaaaatgtttctctaaccaaacactgtacatcatatcccccacatttcaccacccctctcccttgtcatcacgctcattattaaggtgtgaatatcgacatggatatagggtgtggaaaggtagacaatggagatttggaggggcgatgggatgggagaggggtggatgatgagagattacttaatgtgtataatacatgttatttgggtgatagatgccctagaagccttgacttcaccactatgcgatctatgcatgtcacaaaattacactcataccccataaatttatgcaaaaaaatacccaaagtgtgtttaatacacagtatggagaaacatgtttgattggcattttctagatgcatttgataatggaatctattttccactgaccatctattcatacccttcagttctgaggaagatattctggaaatgtcagatctagattctctgtaaagtctttttggagtccaataatttgtgacattaggattctaaggatgtggaaggaggccatgagtgagagtctaacatgcctgttcagatagggagagttttaaggagaaatcatgttcttcaccaacacctcacaggagaggtagcagctaactgaatgctgaaagggaagaaaattgggagaccagagcctggaatcaagggactggggaggagagccaagctcaggcccagggggtctcctaagagaagtaaacctggctctctactgtgtgggatgctgatgcttgagaaaccagcaccacaggaaatgtcaaagtcctggatagaagttggaaatggaaaacatgaagttccagcagcagcagcagtatgagcaactagagggctgcagaaatcccaccgttgaaagaactccttccatgtcagtgggtcaaacccagccagggaggctaggctgctccacacttccaccctctcacccccagggctccagagagcagatgaggagaaacccgtaaggatttatctagccagataaagcactgaagccacagcctgtggcctctgaccgagatttctacgtgagtgataggaaacctatttctgtgcctgacatttctgcctgtttccagacagggtgtcccaactcaagtgctatgtggcttaggatttctggggttccattatgaattgaagtttctctgggatgaacctcaaaaattttcctaccgtattgcttcctaacttctccttggtcctctgaaactgccaaagtcttgctttgtagaattactttctgtaagctccaagtgtgtatttattttgaattaacattgtttacagctttattgaagaataatttatatacaataaacttcaccaacttaaagtgtgaatggattttagtaaatgaaaatagtcatgccaccaccaccacaatcacattttggaacactgccataaccccgaaattgtcctcaggcccctttgcattcaactcctgtccatatccccagccccaggaaaaaaacaatctatttattgtccctttagttttgtctttttaggattttcattaaatattttgagacagccaggtgggaagggatccccagagagactccaaccggcctgctccccgggaggagtgcgcactggggtggagccttgggaagttcgtgccatttgcagggggaggagcctggcctttcttcttcctgggtggaacccgggattcaatctgtgaggcggaagcctttactagcaggactctcactctgctgagggtccctgtttgccctttttttccttttcacccaataaattccatttttctcacccttcaaagtgtctgtgggcctaatatttcatggccgtgtgacaatgacccggctcttagctgaactaaggagaaagccctacaacgatttcaggtaaatggaatcatacagtactatacatggtattttgtttttggcttctttcacttagcctggtgcctttaaaattcatccacattgttgcatcagtactctatagaggaggaaaaataatttttcctctacctttcatgagttcttaattggaacagacccttgtaacaaaaaacagattaataagagaaaaacaaacagaagattaatcacatgtataccttatgcatatgtggaagatactcagggaagagtgaataaaatcgccagagtagatctcaaaagcttgcttacacttgagactacagtcatgtaccatgtcccctgaaataaagaaagaagggtgtgggaaatgcctagttatggggaactggccaggaaaagccccataaacgaggtttagatttgttgtacagatttaagcctatgccttctccattggcaagagtgtctagtgatctaccatcctttcctcctggtacagagagggagacaatcttacaaatggagagttcctttatagatgtacatttctcttacaaaagggtaacctctactctcattttcagagcttctcctgtgtctgctgtttcccagaagaatcacctcaaataatccttatgccaaaaaagcatattttgaggtggtatattctggtctcctacagtcatattttgggggtattgtgccctgtagccccatcaactccattccttttagttgttaatatttaactgtatatcaccattttctttttatctatatatcagttgatggccattcagattgtttccagttcggtgttattatggaatgatgttatgaacattcatgtatgtctttcagtgggcatattttctcatttctcttgggtaatacctaagagtggaattactgggcggtaagtgtatgtttaacattttaagaagcttctttttttgaaacatctgtattgttttccattgccaacagcagcgtatgagatttctagttgctctatagcctcaccaacacttattattgccagtatttttaaccttagctattctagtgtgggtgtagtggtctcccattgtggttttaagttgcagttctgtaattactaatgatgctaagcattttttcatgtgattttttgacagttcatgtattttcttttgtgcattgtctattcaaatatttttctcattatattattggattgttttcttaagttgtaagagaaattaatgttatctggatacaaatcctttgttagatatatattttacaaatattttctcttaatggcttagcttttcattttctgaattgtgtcttttgacaagctaatgttttaactctttatgaagcccaatttatcaatttctcttttacagttcatgctttttgtaatctattacataagaaacttgccctaatccaaggttacgaagattttttactatatgttattctacaaggtttatagtattggctctgagatttaggtctactctctgttttgagtgaaatttgtgtatgctgtgaggaaaaggtcaaggtacctttcttaatatagagatccagttattccagtataatttattgatggctgttcttttcttaccttggcactttatcaaaactcaattgactatgttagtgtaggtctatttctggactctcaactctgctgcattaatccacatacctgtccttatgccactaccacactgtcctgattttctagcttttctagtaagtcctaaaatcagatagtataattccattaactttgttctttttaaaaattgttttgggtattctagttcctttgcagatgctgcattttaaataatgctttaatgattgggaaatatagcatatctaatactatacccattttatttatttatttatttattattttttttttgagacaaaatgtcactctgttgcccaggctggagtacagtggcaccatcttggctcaccgcagcctctgcctcctggatttaagcaattctcctacctcagcctcccgagtagctgggattataggcatgcaccaccatgcttggctaatttttgtatttttagtagagatgaggttttactatgttggcccaggctggtcttgaactcctgacctcagatgatcagcctgcctcggcctcccaaagtgcagggattacaggcgtgggccaccacacccagccatgcccattttatagacaaggaagccacagacttatagacaaatatctgacttcacatcacaagtctgagtttctgtctttttgtggtcacgtctcattttcctactggactgccagtaaggatcctatgacagcagaaactatgtaggttttcttcacttctgaatcccaggtaaagtagcttttatagtaggttttcaacaaatacttcttgaacaaaagaaggaatcaggcccaagagaaattcaatgacttgtgtctggtactaaggtcagtagcagaactgaatccagaacttgagtttccaaacccttcatttagtactttttctatcatgcaatgtgagtggaggagatagagaagaaatgcaaagaagaaaaaacaaagcaaatgatgttggtgtagataagagcattattagaaagtttgataaatgcttttgttttgatacatctcagcctatagcctgcagctgccagccactaaacacttagatgtttatgttttgcttgaaatactttttaacatgcagagggatatccagatgattcacagatcccagaccacagcctaaacaggaggcaacatttccttcctgagcatggttctaggaaaataaagaacaggtgcatgaggccagaatgagtctctggggctcacagcagacagaccccagctgaactcttctggactgacaatgcttccaatgaggaaagatcttcagggagcaatgtttggcaatgattttctccctacaatctaattataaagtaatttcaatcaaatatatacaaacatatatatatatatgtatatatcttgtgctatagttcttctttttttaaacctggaaaaccaggtgccagaaaaaataataacacggtgttaatctgagaaggaaagtaactggaaaagaggataaggaacgtacaacaatcagacagtggaggtggctccgactccacaacctctaattcatgtgacatgtaatcttcttaaacaatgattatagatactaactgtgtatttgaaggggatggaattgtcattaagtgctatgcaatatcctgtcaaccaaattctcccttcaggtaaacacatgtcgcttctgttgaaattagtaggtgtcacaggtaaccgggaggcaagtttggttctggaaccttacaaggcactgtgaagactttgatttacaagcgattattaaggaagatttccaccagaagtagtcatccataggggagaaattaagtatctttatttcaatagagtcaagaaacattcgctgatggtagactttgttcagagcaagatgctgagtgttgctgcgacaatccaagaagaaacacggacagccctgccccaacttgctcccaaatctgcaggtgaaaggcagaccatctcttgtgtctgcctcattccctcagttctcagcttaaatgtcactttccctggatgacattcgatttgcccagtaagatgcagcatatttgtaattacttatttaaggcttgttttcctctttacctccaagaagaaagggaccacgcccatcttatgttggcaggctgtggatgtcttgagaagaacacaggttctagagccagcagcctgtgttcatatttcagcttcaccacttatctcagtatgatcttgggcaaatcacataacttctctaagctttggtatcctcatctgccagacagaaataataattctctagtacttatctcatagcactgctctgagctatgattaaatgaggtaaagccactaagtggcctggcatgtattaagcccccaataacaatgaaataaaatgtcagcagataaatgaagttcatccctttagtgaataaaaaaaagacaatggttgccattctctggttattataatgatgatacaacaacaataattcttattgaatgcttactatgggccaggcactgtaataaatgctttacatatagtcagtgaatttaggacatgtggatatcaagccatcgatgacaacccggccttttaaactcttctctctgggcatatcagcatttattagggaagcaggaccatcagaagagccagtgttggtggcatacgaatgtctgtgttagtcaatgtcttggaaggaactgaatgacatgctcaaagggttaattgaggaggatgaaatgaaagaactgtgtcaaggatttgggcacggttaaggaaaacaataagcatcaaggaatacctagggactagcagcatttgggctgttacttcccctaagcttgaatggataagaaagagaaatggtgtttccagggtgcagtgagatctatagtcaagggaggggagctgccctgcagatgcagtagtgggagatagaggatcccagccatgccaaaaccatggtgaggcagggagcatccagagaatgctcagagcactctcctcctgcttgcttcatctcctgttgctacctctccatggccaaactgtgctagaagccagacagtgatggagccaaggtgatgcagcccataattatctcctcctgaagcagagaatcaaacagagaagggctgagaatgaatctatttagaagagcaaacagaataacctgcacaaaaccactgaccatcacatctagtcaaacttgagtaaattcatgttgactacatgaagaacattacagggaagtgaggaatctcaacagttaagccaagcaagactgtcagagcttaaaaagttaaaaagaggttggggatctggttctcagtctctttctgggctaccttatagcaatttgaggctccgtcatcagtttctgcaaggtttcaaagatccaggagaagcttagtgttgtgtcaagatgctgatggacccatcacagaagtttaatccaacctccatcccagagtcttcacaaatgctcaccaaagaaaattcccaggacgattcaggggcctctcaaatctgctccgagacgttgacaaaaaaccttaataacttgactgtcaatgctagtaacgaatccccttcccctctaccggaatgttcactccatgaacagtctacaagagcaacaatcctcagggaaatcacagatcacttgctttacaggaggagaggagtaagaacattgctgtctgtgcagagagagaggatggcaagattcagatacatgttactcggcggagttcatccgcatgaaagaatactaacaaacactgggcttaagggagttaagaaggaatcaagaccattcagatgtccctgcagtttctgcttgtttaacagatgggatccttctgagaatgctagaatagggaattttgacaccaagccacttcagccataaaccttattcttgtacctttttttcttgctggtaattttatatagcagattgagaaagctactctatgctactatagactatacaccaatacttttgataatgagttctaggatgtatttttcttcttgtatctttttcttcccgctatgatactagtaatttataagggatctgtgtaatttgaatgtatttgaataactttagctctactgtttgatttgacccaaagaagccaagacgacataagtattcccatgtgtcttagaagcccaaagtcaatgagatgaaacccaacatcaagaaattgaagcaaagttacttgtggataaagaaagcattaggtagtttggctatagcataataattagattttctggctttcaaaattttggattgcaatcacagcaaactttgttatttttacagttttcagtacaaaaaggagtttatatagaaacagtaaagttggcatttgagtacctttaaaaaacaaagttaaaaagaaagacaagcttttatttcctgctacaactactgaagatgcaaaaaaggtaagggccattagttagcaaccagtgtctattattcctctttctgctgtcattgttgaaagatgaaagttcatgcaagcaggctccattcttgcacatgacctaattatcatatttagttgaatgtaaaaaccctagttttgctgatgaatctgaaacatcacagccaatcactttgccttcccattttcctgtctaacatcaactgattaagattgggagtatcttctgtttgttaaatgaagcacaattcttctggatgatatctttatattttatttttttgttgtgataaaatatataatacctaaaatgtacctttttaaccatttttaagtttacaattcagtggcattaagtactttcacattgttctgcaaccatcaccactatctatcttcagaactttgtcaacatcacaaaaagaaactccctatctattaaacaatatgtcccatttcccttccccccagaccctgacaatcaccattctactttctgcttctgtgactttgcctattttaagtacctcacatgaatggaatcgtatagtatttgtccttttgtgactggcttatttcatttagcacaatgtcatcaaggttcacgcatgtcatagcgtgtatctgaattaccttccttttttaagacggaataatattccacattatatgtacataccatatttcatttatccattcatctgtcaatggacacttggcatgcttccaccccttggctagtctgaatagtgctgttctgaacatggctttgcaaatatctgttctagccctcattttcaattcctttggtcatctacccagatgtgggattgctggatcatatggtaattatatgttttagtttttgagaacacgccataccattttccatagcagctgcagcattcccacagcaatgcacaaaggttccaatttctctacatcctcactaatgttgcagaactttatccttagttcagctaaaaccaggctctttcacacgaccaggaaagattatgcttgcggacatatacaagagtaaggaaaacggaatttattgggcaaaaaggaaaaaggcaaaataattcttagcaaagagagagagagtcctgctagcagatttactgcctcacagattgaatcccaggtcaccacacaggaacaggagaggccaggctcctccccactgcaaacgccatgaatttcccgaggctccaccccgtcctcccagtgtgcaggtgggcattattcagaaagaatcagtcaggaaatggcaggcttcatccagaaccagcagtctggtttttcagccttcaggctgctttaggctcaagggcggggttttgccaggggacttttggctgcctcctgtctctatcactaacacatatttactgtttctattttattttattttatttttttgaagacagtcttactctgttgcccaggttggagtgcagtagcacaattatggcttactgcagcctcagccttctgggctcaagcaattctcccacctcagcctcccaagtagctgggactacaagtgtgcaccaccacactcagctaatttaaaattttttttctagagacagggtctcactatgttgctcagactggttttgaacccctgggctcgtgagccccctgcctctgcctcccagagtgctgagattataggtgtgacccagcatgtctggatttttaaaaaaataataataatagtcatcataatgggtataaggtggtatttccttatggctttgatttgcatttccctagtaattagtgatgttgagcatgtttaaatgtacttattggtcatttgcatatcttctttggataaatgtttgtttagatcttttgtccatttttaaattaggttatttgttttgttgttgttgaggtgtaagagttctttatatattctgggtattaatctcctataatatttataatttgcaaatattttttcttattctgtggatggccttcctactctgtggataatgccttttatgcacagaagtttttaattttaatggagtccaatctatgtattttttctggaagatttatctgattttattttaagacagagacctcagctcactgcaacctccgcctcccaggttccagcgattctcctgcctcagcctcccgagtagctgggattacaggcatgtaccaccacgcccagctaatttttgtatttttagtagagacggggtttcaccatgttggccaggctggtcttgaactcctgatctcaagtgatctgcctgcctcagccttccaaagtgctgggattacaggcgtgagccaccatgcccggccaaagatatcttttaatgtaggctttgcacggctaaaatttttgaagagcaaggctcagattggatgtggttttggttgtggtggatttttattctattcaatttacagcagagcaaaaagaataaaggcttaggtttcataactcacaaaagtacactaactgattcatatactttggatgattccatcatatgtccagcactgaaatttttcctcatggcaattgagggatacaggtctccctgcctcctctccagtctattggatgctctagcaccttgccgggaggcaccagaagggagtcagatgaaagttactctttcacttgtaggtcacagtgtattagtctgttcttgcatttctataaagaaatacctgaggctgggtaatttataaagaaaagaggtttaattggctcatgtctcctcaggctgtacaggaagcatggatgcatctgtttctggggaggcctcagggagcttttattcatggtggaagggaaagcaggagtagacatcttacatggaaggggcgagagacagggagagagagagaaaagagagatagagacggggggtgtgtcagacacttttaaacaaccagatctcatgaaaactcactattgggatgacagcaggaagcgggatggtgttaaaccatgagtaaccacccccatgatgcaatcaccttccaccaggccccacctccagcattgggaattacatttcagcatgagatttgggcagggacacaaatccaaaccatatcacacagtaacccaactcattttcttaagcaaagacaaacttaaaaatgcggaaaacatttaaattctgctcagaattaattagctcctataactgaaagagagagcggtatcctggcttcaggtatgggtggctccaggtttgcaaacaatgtcccagctctgctcttcttgggtaggcaccatttttagttagtacttctcttttttttttttttttttttttttttgagacagagtctctctctgtcacctaggctggggtgcagtggcgtgatcgcagctcactgcaagctccgcctcccaggttcacgccattctcctgcctcagcctcccgagtagctgggactacaggcgcgtgccaccatgcccggctaattttttgtgttttttagtagagacggggtttcaccgtgttagcgaggatggtctcgatctcctgacttcgtgatccacccaccttggcctcccaaagtgctgggattacaggcgtgagccaccgcacctggacagtacttctctttatgataacaaaatgatgcctgttggctcttaaattatttcttaccttctcagcagctccaagcagaaaataagttctcttttccttatagttctaagaaagtccttgtgtgatcttttatcttaaaactgactacactgttggccccacggatgagtaaacatcggtgggtcagctgaagtgctttctttgttggggagacacgttctctgatgaacaactatggtcaatattgacacctgttacactatgaatgtatttcttcccatcattaacttgcttcagctcttacatggaggaaatactcatactgatggtacactattcagggctgcatgaagatgcccctgctcccaagatgcgagggaccagtgggctaagagcagcagaaagaaaaatccatagatatattttgttttggaaaccaacatttaggcgtacatcactgcctcatgtagtatttcaaagtaaatagaatcagttcactaatcacccaattctgcttgtttttaaaaaatataaacaccagctagactgaagacttgaataggactgagtgtatgtgcatataacataaggagaaaagctgtgagtataagaaaaacgcctatcttattttctgacacctgtccaaacaagcagaggaaggtgaagacagaagaccatttcggcatattaaatatgagaaagaaataaaaatactctggggcctgtgagccagtgatctatcctctgacataactgttatttctataaagtacaattttgaagctccttgacagctgaaagttgaaaaattacttgtttatctttttcactcctccttaaatgccaagtttacattttactcttcgtaccactatgttactttctacctattctgcaggcagtcaatttaaaatatgatgtatttggctgggtgcagtggctcacacctgtaatcccagcactttgggaggctaaggtgggcggatcacccaaggtcaggattagagactagcctggccaacagggtgaaaccccatttctactaaaaatacaaaaattagctgggcatggtggcaggcacctgtaatcccgactacttgggaggctgaggctggagaatcacttgaacccaggagacagaggttgtagtgagccaagatcgtaccactgcactccagcttgggtgacagagcaagatcatgtctcaaaataataataataataataatgaaaagatttatttgcctccttatgaaagaaaattttaaaataaaataaaatgtaacatattcccaccccaggacctttgtacttcttgttcccgccacctggaacactctttccctagagagctatatagctcactcctccacttcattcaggtctctgttcagtcgccacctcattataggggcttttccaatcaccctatctaaaatagtctcctccaaccccatcactctctctctaccttttcttacaacactcattcctacctgatattttatacattaacttatttttatctgttgtccccaatagactgtaagtactacaagggcaaagacattgctttgtacccaggcactgctttatctccagcacacagaacactgccttgtacatagtaagtgttcaatgtatagtatacagtgaatatatctcaatctttttttcattgctacagacaagacagcattgttcccatgcaagggcacactcccacagggataaacacatcatggcaaagcttaaaattaattttctggcagtacaaccaatggtggattttgttttagttggaaattgggggtggaactcaaaagcattttacaattatgtcaatgataaagatcacttatttaaagatcccaaagctcttataagggaaaaaatagaattatgtcttacaagacaacacagcaaatcaaatttaaaacttttaaatatatattttatatatatatactttttttttttttttgagatggagtctcgctgtgtcgcgcaggctagaatgcaatgatgcgatcttggctcactacagcctccgcctcccaggttcaagtgattctcctgcctcagcctcctgagtagctgggactacaggcgcctgccaccacgcctggctaacttttgtattttcagtagagacggggtttcaccatgttggccaggctggtcttgaactcctgacctcaggtgatccacccacctcgggcctcccaaagtgctgggattacaggcatgagccaccgccccaggctcgcattttttaatttattcattcagtgcccatcacatggatcctgtcaaccttcagtggaccatgggcatacactttgggaaacgctgccgtaaaacaaatacctgattaagtattcattttagttcccagtatgtgcctgatacagttcactgcttatgaaaggaatataaaaatatgaacaggcctttgaggagcttataaccgagtagatactcaataaatatttagagagatcaaattttagagatcaaagcaatgtatatgtctagtatcattagaaagaatgaaaacactggccgggtgtggtgactcatgtctgtattcctagcactttgggaggctgaggcgggtggattgcttgagctcagtagtttgagaccagcctaggcaacatggtaaaactctgttaaaaaaaaaaaaagaaagaacaaaaggaagaaaggaaggaaaggagagagggagggagggagggagggaaggagaggggaggggagagcaggaagggatggagggagggagaaaaggaaggacggaaggaaggaaaacacctttgtccagtgttgagaataaatgcaatacttccaactctgtggtctcaagatttgttttgctgtatctaatgcggatgacctttatcagcaagacacccattaacacatagaagataagttgcagtgtgaatagtgccttgagactgtggcaataaaactggagccacgcctgagtttgcagtttatttggccgcacgtggccatggaaagtgagcatgaaccatcattgtatgatatactcaaggctcaggaatatgtatacaggttattaagtcaaagtagctgtaaaacactgcacgagagttgattcagtctgttaaatattttacacctcttacaaaaatatctacccaaaaagaaaattagatacagtgaataattcacaacataaatgctcttgtgtgggcaggagttgggtggtatttgtttttatgaggtgaaatctgcagttataacatagacttcttcctagaatggcaaccaggattctaaactggcaacaggcagctgcaggcctgatgtgaatttacaggttgcctagtagtgctactgaaaaatagattgtgtggtaggaggttttctcataacttttttctttgtcattgcttttcttcttcttttccctgtgcaggctgtaaacagattgtaaaatgtgtgacaccccagaatctgagaaaaaatacaaagctacttttagtatccttcaccatagcctacaagttctttccttcctcccttcctcccttcccccaccctccctccctcctccctcccttccttctttcctgccttccttccttccctccttcctttttttgagacagggtcttgctatgttgcccaggctgttctcaaactcctggacccaagtgatcctccagccctagccgcccaaagtgctaggattacaggcgtgagccaccagcaccaggctgctcttgcttttctacccaaaactgctggacatgtgcacttgatacctatgacttcatctactttcagacagccatgaggggtaggagctagggaatgaaggtggggcccgatgaatgagtatatcaatcatgtttttaattttagatatcttttggtatttcaacattttggggaatttacagaccccagaagagaccacccctcccggggctatctaattcctaaggataataacttgcctataagcatgcctttcacacacaaaccaaccaaactcaagcccatattcaccaaccacctccttatctatctctcacacactagccaatatttcccctgagctaaattatctcagggccaggtattaggcaaccacagaccacctagataaaccaaagcctgctgggattattcaaactaggcaaagctgaactgtttgccctgccttacctttcctgcagaaacaaggctctagcctaagtgttcccctcgctcctttgtcccttctgacagaatctgcatgatgtggcgtttctcctctcagaagagcaagtaataaattctactttcaatagcatcggcctctccttgtcgtcactcagtccgtacctccataagttaaaatctcacagatgcaaatggagaaaatggacttttgtagccatttttaggaacaaggcagcttggcttcaaatcttgctcagagacaaactactttccccaaggcatcatcagtgaccgtaacacacacctagtcacctagtgtaggatgggagccaggcattctctctgcatggcttcctacttcccacgtgacataaggttgcatggccatgcgcactcctgtgttgactttctacagcaacattaaggtccagaaaatttgtgtggcctcctgaagaaagtaggaatgcagatctgtagagggagtgtaaaggtggagccctgctcttccgattctcacacagagccactggaacaattataacgagcatggctgtaaacatttatttactgagtgcctctctctctgcttcatgttttacatgcatcgtctcactaaacccttgcaacaaggccattaggtaagtcctattattatcccattttagaaatgggaatttagtgttaaagacactggtcatatagctggtaactggcatcttgggacttgacagactaactctaaattcatagcccacactctaaatccctactctatatcatctgtccaagctgaatgaggctacctctccctcatgagacagaattcaagagtccagttccctttgtgaatgaaacatcagtctgaaaaccttaactcctagttgggcacctttaattggctgatggatggtaccatgtctccttccaaaccaaacatatttttggtaggttttcagaagcaagatcagctccaggcaacactgtgaaataggcaaccctcttggtttctggtgactgaaaccaagtgccctcactacctctgcagatgacccagatcactctactcccaataccgtcttctgtggtctgtgccttaggccccaaattcattctctgccttcctaaacttatcagaattctcattccacttttttgaaatccattaagggctctggattcaaatgaacctggtttctaattccagttgtacagcttttagctgtatcaccttgagacccaatttccttatttgtaacactgtcacaataacatagactttctcagttttttttaataagaataaaatgtggcatatccagtgtgttgtctcaagatcaattcttaacacatggtgctccataacgatagttcagccatgaggaatatttccccaattttcatatatgctatttaaacaaaaagtaataacactggcttccagaaccacaaaagtcagactctttccattgtagacatacatcacaaatacgtcttgatagaccaaccaggaaagtaagcactgacctagcacatttgctgggaattcaagtgatatggtttggctgtgtcctcgcccaaatttcatcttgaactgtagctcccataattcccatgtgtcatgggagggacccagtgggaggtaattgaatcatgggggcaggtctttcccatgctgttctcgtgatagtgaataagtctcatgagatcggatggttttataaaggcgagttcccctgcacacactgtcttgcctgccaccatgtaagatatgcctttgctcctacttcaccttctgccatgactgtgaggcctccccagccatgtggaactgtgagtcccttaaacctctttcctttataaattacccagtcttgggtatggctttattagcagtgtgagaacagactaatacacataggaagttctgttaaaactagacagtagaataaatgaaaattaagcaattaatctaataagagatgtaagagaatgcagtctactttacaattttgtcaaatgtttggagctctcatgtcataaaattctaaaaggagaattttgtaaaaaattcgtcacggaaaaagcactaaatcaagcatcataagacaagcatcctcatcactgctctgccacttattggccatatgaccttgtatatatcacttgacctctatggatgtcaatttccttctctgtaaaatgagaatgttggaccagataatcccaagatcttttccagttgtaccactctttgagtcaatgactccgccattatccctccccttgttctctggagattttgttgccaaaataattagtgttgcccccgagtaacatcacgtagcaaagtccagtcacgcacaggaattctaggcactgtgactgcgaattctaatccctctttggtcatgccatcattgaatgaccttgggcaggcacctaacttcagctaactgcctcaccagccctccagggatttgcccgataaatttccaactccttactctccacaagctgccctccaaaatgcctttacaatgcttaacttgggaccacccatgacaaatcatgaaattaggctttttctctgaataattctcaatcatagtatgtttctgcctcaaacataaaagccttcttttcttcctgttaaaatcataaccgtctttcaagggaggtgaaatacaagtgaaaacttaaaaggctgaaaaatttgtcaaatctatggcaaactcaagtctgggtagaagaactgatacacattgtataatagaaccaccatgatttcattaggctagaacaaagggtggaaactaaggagaaatacaagccctcagcaggtatttttgagcagatgtgtcttataataggattggcactacagtctctgacctaaatttaatggaaaataagtccaatatttctattaataataataatataatagctgtcatttgttatgcaaatattgacttaggcattctgataagggatttacatgctgtacctattagaatgctttcagctgcaagtaagagtacctaactataaggggcttggtggtttcctgtctcacattggctgaggaggagttggtcccagggttggctaattgagcagcatgacaccagggagcatccatcctccaactctgctattttccatgtgtgggtaatatcaccccttgtggttgcacaatggctgcaatgattccaggtgccacacagatatttcaacatctaccaaagcacacctcccacatatctctttttattgtttaggaaaactgtacccaaaaacttcctacaaatttcccctgacatctcattgtccaggattaaatcacattacccatacctaaaccaatcaacgacaaaggaaatgggactgccaatatcatcttagatcaatcatgattcacctctggttcaccttccttgaacatatggtatggtgaccaccctacccaaacaaaactgagccccactggcaaagaaggggagggtgagctgggaattggcagttgggtagataacagtgtccactacacacaaattattatttcaacaaataccctctgaggaattattatcttcattttgtagatgaggaaattgaaactcagagaagtcaagtaaattgcccatggtcacacagctagaagttgagaaattctgtgttcttaaccaccatattgatagttctgaagtttcagtgtatgcaagaaacattagagagtttagtacaaacatagattctcaactcaactccacacccagggattctgattcaacagtctaggagaggagccctcagtcttcattttcaacaaataatttcagttaatttggatacaggtggtgtatgaaccacattttgagagaataggattggctattacttggacagaagtccgacttaaaacaaaaacaaggccaggcatggtggctcatgcctgtaatcccagcactttgggaggccaaggcaggcagatcatgaagtcaggagatcgagaccatcctggccaacatggtgaaaccccgtctctactaaaaatacaaaaattagttgggtatggtggcgcgcgcctgtagtcccagccactcgggaggctgaggcaggagaatggcgtgaacgtgggaggtggaggttgtggtgagccaccgcacagtctgaacaacagagtgagactctgtctcaaaaaaaaaaaaaaaaaagagcaaaaaagccccctgattttctggaagtcccagactcactatctacaaaagccatccatcgtttttaagtaccaccacagaaacatctcatcccagtccctctatagtccgtacaggtcagcccctatatagtgtcaagatcttgctccctaatttaagaaggttatagataaaactttcagatgaggggaatgagctccatgagagatctaacaggtcatctaagtaaccattgaagaatgtgggaagatttacggttgaggacagtcaactcttgtgggtagggatgagagaaagccatcatcaccctttaaatattgtctaggatattacgtgtaaaggacactcagaggtaggatcaatgataagaaattatgaggcagctcattttgttttactatgtgggagaacagactaataattaacttggtcaacaatggtaaaggctctccacctcacaaaacactccgaatgcattccagcagaggctggcagaccctgtgcctgtcaccaatgctgtagaagggagtcctccattgaaaggaagcattgtgcagatgacttctaaaatatgctgtgatccttcaaccacatcctctgcaaactgacttgtattcttttttcactatagtcatttctgctgaatacctaggggtaccatttaatttcgaatgcattaatgtcctattttcccaaattgatagaatatgtctgactcttctttgtgtcttcatggtacctagctcaaaaccatgctcatcataggtacttaataaattgttggtaaatgtaaaaggatggcgtagaatggcgggtaagcacatccagatgatgggtagaagataactgttagtacttctgccctgtttaccaccattcttccctctctggacaaggggcatggaggctatatttgcaatatgcaccctcctcgctggccattattgattgggtcagaaattaacatgtgaggcaagctagggccataagactgacactaagatattaagacaatcttttaaggtggctataattgtaacatgtgagctaaaaagcatgatctactgaaaaagaatgaggcagatgacagacaaagactgagctccctggctttccatctcctgggtccccatcccttcctgaggctcatgtataagtgcgcctttggtctctgagatgaacccctctgtctttgtaaaattcttcctccctccttccctttcttcttttcttgttttagattttattgaagttggttttagttcatctcaatcagaatatttaatccaaagaaatttgttcctgagtttgctgttgaggccactgatgcaaataactcatgctcttagaattccaagaaaatccaggatttgggggaccccagtgactacagagcatttagacctttgcatgttaccagatattttagaaggttcgagactggttctactgcaggctgattttcttaccactccaaaccctaacctgcaggggcatcaaagctcttatgaaggctccaccatcagaccacaggtctccttataacgaagatcccatcccctgcagaagaaattttgaggtaggaactaacctctagcgcaatgaggcaaggccagcccaaataacagatgggaatatttagaggtatctagaactccgttatgctacaaagtgtttctccgtacaacatcttgggtctacataaggcagtatccctgtaagatgcaaatcgtctttcaaaaccacatttatcagtgagtagtcagtcacatgaacctttgtacttcagttttgtggcaaaactgtttcccaagatgcctgtgtttttcttaatctgtgccccatgctgttaagcagagcatgtggcctgtcactttgacatacttaaacaggctgtgaacaaatccagctgatgcttttccaaaacccatttcaatcttggctgcaagggcatccctggctgtgaggggtaggtagaaacagatagtccaggagtaggcaaggagatcattgagaaatccatgtttttccctcctgcaattaggatatctcttatgttggctaaagatggcaaatcattaatacatgggagataagaaagaaccaatcctttcccctttcattcttattccttagagttctgatgatcatactttgcctaggacattcggaggcccctgccatagtcctttcatcagcccttactgctttttgatccttttgtttttccccaggcataactgccccttgtgctgagttcccttaggaaaggaatcacgtttcaacaaggtcctcacattgtagaatgaaatctctctgactcattgtataaatatgcaaaaccctaaattctcttaattaaaaaagtagaaccagggaagccaactcaacttcttgctctgaatctgaacagaagtgctgtttggtgaaagcaactcctcagatgtgtgaccagttcggcatccacagacagtaatgaggaataactttaataaccaatattctataaggatagggactgtcatcagaagagacatcaataatcttctcttggcaaatgaacaaacaaaaatcactcccattttttcactgatgcttgaaatttctttaacaggaattaaatatttctggagaggctatatgtaattttggctaaaagtttaggtatttacttgttattgcaactaggcaataagtatcaaaatttttcaaaatatgcatacctttcgacctcacaattccacttccagaaatttatttctagtaaataatctgaaagttgtacaaaaaagtctgtacgtgaagcttcattatagctttttaaaaacttcttataatgcaaatttcaaacatacgcaaaattaaagaggataatatgatgaaccactgtgtatgtaccacccagctttatcagttatccacattttacccagctcctgttttatttattctccaccattctttttcattgctatttttgctggaatgttttaaatgcaattccagccatctggcattagtcttttaaatattttagttgtaatatttttaaaataagaatttttttggatcttattattacctggtatctttctttcaccatccaagttagcaataatttctgaatatcctccaatacacattcatgtgcaattgcagaatgtcaaaaatgtctttttacaatttgtttaaatctggatccaaaaattttcacaggttggatttagttgatagttctcttaagtctctgtaacctatgacattgtctccactttttattatgccatttatttgttgaaaaattaaggtcattttgtcctgtagaatttctcatattctggatttggtcaattgtctccctcttgtatcatttaatcattttttttccccctgtaaactggcaattagagcctgaggctcaattgaatccaggttctctttctttcttttttgggtaagaatactttgtagatggctctgtgtacttcgtattacatcacatcaataggcacatcaggctgttcatcccatttttagtggtgtgtacatcaattagcagattcaagtgctctcagcctaatccctccattatatactttttcatcaatttttcgcctaatggttttagcagttattgatgttcattgcctagatccattatctcgttagagattttaaagtgttgatgttgtaattttttaataccatattgttacattagctcttccttctgtaatgaagcttttgaaccccagctttttattttttaagaaaatgtcagttatcaaatagtaaacacctataaccttcacctagattcaccagttgctaacattttgctacatttgctttatcactctcgttatttatacttattttttgctgtttcattcaaattagtttacagacattatggcaagctttaaatatttcagcttgtgtcttctaataacgatgacattctcctcataaccatagttccacactcaataaatttagcattgattcaatattatctaataaagattttttaattgccaattgtcaccaaaatgatcatatatgtatgtgtgtgtgtatatatatatatatatatatatatatatatatatatatatatatacttttaaaatccagaatccttcaaaggtacatgtgctacagtggtatcatgtccagtaattttctacttccatcttctttctacatttattagttggcattcttttgtaaagaagagctttctcttttcctccattgccatcattattttttagatgctcatattgactcaaatttgtccaatgcgagcaaccataacctggttactgcatcattttgacccagtcccattggtctttgagcatttccttattttctggcacacgtgattctaggctcaccttacactttcccagtctcacacctagaatcagcagtttctccaaacttccctggttcttttcaatgaaaagtgctgtttagaaaccaagatttggctgctagatatgcttctagatatgctcattgtttctagaccctgtcagtgcacagagctaagaaatatatctttcaagaaacgtgagttcatactgatacctcttattcaaatcctatatcatagagaaatcttcctccattctccctttttatattttatcttctcccacagtaagaaccctcatttccaaaaaaattaagtgttttattgtttgctatatgctttaaaatgcacaaaatattcttagtattacttagcaatagtattgtaccaccacaaaaaacaagtaaaattaaatatttctttaaagttccttctcttcataaaatatattttattaaggtgtattaaaaatttatttgaggctggggatggtgtctcatgcctgtaatctcagcactttgggaggccaaggcaggcagatcacttgagcccaggaatccaaaaccagtctggccaacacaccaaaaccccatctctactaaaaatacaaaaattagctgggcatggtgatgcatgcctgtaaccccagctactcaggaggctgaggtgggaagatggcttgaacctgggaggcagaggttgcagttatctaagattgaaccactgcactccggcctgggcaacaaagagagactctgtctcaaaaaaaaaaaaaattttgaattaattctgctttctatgtaggaatacttgctgtagagttggatatatagttaagttcatttgtttctctttatattcaatttcagtgttgcccttttcattcttttgatttaattttattttttgaacatgtataatttttacatggttcaaaagtcaaaactacaagaaggaaaactctaaaaaataacaaccctattcctatcctttatattctattattgtccccaagcctctttggtgtctagttttatgaattcatagattatttttgatatgtttatgcttgcaaatataatcaaatatttcttcttttttattactgttatatatattttgctatttaaaaagatttatatttttaacacagtggttacctttttactaatatttaattttttaagggtcataatccctttttcttacatagacttctacaattggtttgtacctttaaatgatatcttctgtctgccacatactacctacatatcaatcaatagtcttattttacttcctcctttccctttctcttcttcaatgttttcagttgtattatctctaatgtatcagaatgtataatatatacatatttttctttcacctctgttcccatctttgtttaagtcttagagctacaattaaatataatcagcactcaccatcagtgctttgctgatatctcatcatttcctggtgggatacatttattgtctagtagatttctcaggatggaatcatgattatgtgtattctcactcttgtatgtttacagctatttgcctatagccttgatatttgaaggtcaactgggctagataacacagacttgtttttaaaagtgggaattgaaacaattcaaggaatcaacaaagattggtaatataaataaataatggtcagttaaataatggaatcctgtccattcaaccattatacatactataaacagtgtggaaaaatagaaaatgatacataaacttgcaatggtcaaatttgtgcatatgaagtataaggatgctacaaatgtgtgtgcacatgtatttagtaaaaagagggttggatatacatgaaaaagttaacagtaattttctctggttagtagaattattggtggtctttagcttctttgtgtgcttttctgtattttttaagttgtagcatttgtgggattggagagaatacaatttttttgaagagcaagacaaagatctaaagttttcaaggtttatttttaatgtgctttctttaatcaataccacaagatagggtgtaccaaggaaaaagcagtgtgatctaattagcaagctcaggacagcataagctggcctcagtgccctgcctgcgctaggcactcaatcagttggtgctcgtgatgatgaaaactaaaatgagtccgttccaagcaagaaccttttggggagtagagttaacttttctgagtcaagctcctgcctccaggtttgcaccgaggatgaaatgaagtagtattatatatctgtaaaacccctgtcacttcatccaggcagagaagatagattgttagtaccttattctcaaaactaacagaaatgtgttcagttttacttgttctgaagaatataaaaacaatatggatgaatggccagtaaaaggagccagaagcagcctatgagagtgttctagaaaaacatgaaggggacaagaaaaagatacgagggatagatggataaggagggagaaagagatagagagaggacaagataaagtttagagcctatcattagaatatgtaatacttgggactttgccttccgtttaagtaaaatggaggaaatctgtgcccttacatcctgactgtgctgtcgttatgataaaaagaagtaaatggagtgcagggtacactatacacctgcttctttaagtaatccttgccaggtaactaatcgctgggattccaaaggttgttcttccagtgggggtgaccgtgaactgtaccccagagcaactgaatcagaatttgaatgggaaatgtcagccatagaatttgtttaaaacatctcttccaatgattacgatgactagcctggtttaagaactgctggcccatacatagggctaccatctatcccctctgctgggacagtcccagagcaagtattactagcagccctttctcttacaaaaatctctctgcagggtatatattatgcagtttcctatctgtaccttgcctccgctattggcattctcagtgaaggtgcatagggatagccttgtaccattactttcagtccagaactgaacacaagacgtagagaaaaattaccccacgaaattaaatttgcatcaaagtgtagaccaaagtcagatcttccctgagagtggaatctgatgtatacagaaaacaaaggcataactttaagtgggggagagagaatgggaaacccgagacatctccaagacaattgcttctgctacttcaccatttggctcaagccaattgagagagccagaaatgaacataggtttggttttatctgctggttatttaagaacttttgcttgtttcttctttacctcttccccagtttctggaagagtcaaaataagataatcatttggcagtgatataacattgctcttcaactgctgagaaaccaatcaatattccccatctagctaatgtgtcattcaatattgagtgttaccttgttctagtttaatcctgatctgttacctctaaaataaggacatgcaaagataaagataaaaacttgggcactctcaaaaatattcatgttataaatatgtaagggaaaatatttcaggtcatagtcctcagtacatgccaatacattcttggggtacccactttcctgcagcaccagaaactttggcttcctcctatgctctggacattttcattcttcctctttttgctcatcctcttcctgtatcccatattatgggccttttccatggaaagccttttcaattaattcacttttaaattcatattcatgttaccaagtttacaaattttaaaacatggttttcattactttcaattcaaactatgactctatctacaaagccagtaaaacaagaagatcaccttcaaaatttctctgacaagtttctagaaactccagtcgacagactaaactgcttaaagaatcaatctcaggtacaaatttaatcaattaaatagtcttaattttaaactgcatttgtaagtgtaacatgttcagattcatttttacgtgcttcaaatgcttgacaggatgaagttataaccataacaagcaaaaacctccctagcatttaaagatctcttgttgcaactctgatcaaataaacttaaaaatataaattgaattatcttaactattccagttctatttacaaacttatctttataaacattcaccttacaaatcccaagattaaaatgttacagattttatattgctatcataaagataactttttagggtcagaacgtgttggattcttttgcaatagcaaacatactggcccttttagagcagcttaatttgggcagatggaattcagcaacccctagcctaggctggattcaactaatctctttaccgcctgattgaattcttcattcctttcatattctttttgtccagctccatccacaaaagcccccatctgtctaaaaacgatcagcctttctttgacccaaaatttcatcaaatcatagtcctttcttcacgttgtgtctgaaaatccctttgaaatgcacatatactatcttggatggagactgcatcatggctttaattctcataacaccatcaacaccacacacacattggtttcacttactcaacaagaggctcaatgaggtaacagactattatgaaatgaatttcaatgtcttctaaaaacttttttttgttgttgatatttgtttaaaacacactgtggaaagaacacaggcctttttgtaagcaatttttgaaaggcttgtctcctaggcagctacaaactcaagacattgctaggagaaattctgttatatgaagacagggagagctggaagggatctgatgaccatttggtcccaccccatgctgtacaaagaagaaaactgagccccaaagagcaggggcaaaggagggtaaaatgccttcacttcttctatgttccaatttgtgtgcaagttgaacttcagttgagatgcacaaagtggcactcaatcctttcccactcatgcacgttgcagacattgccatgctcctcaagctcactcatcccctggccctgaattcctagaagaccactcagccttcacctccactgagtcagtggcaggtatcatacattcactcaccaccctcaaacttctaacccagcctcacaagaacctaaatactttgtgaacagaagctaaatttcagtgaaccaaagggtgaaaaggagatgaataagtagagactctctttccagaaatctggagaaggagcaaggttgcacagcagctgagggagggatgcagggtcaagggcaggagggaggctggagagagttgagcctattcagcttttagagggagacagagggaaggaattgagcctgtccacagagacatggaggaaggtgaatacatagggcagagagggaatgattggcagggaaggaagaaccttgagaagcgagagcaggcatggagtgcacaggttgaaatattgattttgaaggaaggagagatgcttcattctccaaaataggaggaagaaaaggtggatatgggcataaatactgctaaggatgtgaatgagaaaacagtccagatgaccatgaggatgggggataagccaggagggaatgtagactgtgtggataaggaagagtctaggatctggacaccttcacgagctaactgatggggtagtggggataagggaatgagtgagctgggaggacctaggagtttgagacttggggatgagggaatcctgagtgatgacgcagcaagttagggctgttgaaatcccgcatggcaaagtataggctacgtgaaaacattgaggccgaaactaaagatcggaagagttagtgcatcaggaggactgtcttcctggacactggagttacccagctggcagttggcagaacatgggggagagaaaggtcgtgagcctgctgccaaaatctttttttttttttttttttttgagacagagtttcactcttgtcacccaggctggagtgcaatggtgcaatctcggctcactgcaacctctgcttcccaggttcaagagattctcatacctcagcctcccaagtagctgggactacaggtgcacaccacgacgcccggctaatttttgtatttttagtagagtctgggtttcatcatgttggccaggctggtctcaaactcctgacctccagtgatccacccacctcggcctcccaaagtgctgggattacaggcatgaggcaccatgaccagccccaaatctcatgtgaatattggagactgaaaggcagattgacacatgatagggataacataggacaaactgtgaaccacaaagccaatggaaatttacataagagagaaggaatagtgacctggcaatagctttggagagcaagagagatattaattcctaactcccagcccagaggggcagagggcaggtgagcatgagccctcgccacttgagaaggataaaagggaagcaggaaccttaggggagactaaggttcagctgatagcagaagacagaggaaacatttaggaaaaatgttaaagatatatgaatagagttccaaagggcacagttgaatgatgtggaaggaaaggagaaagggcaaggagacaaaaagcatccctttgtaacgggataaagattaaagaggtttttatccaaggcaatggctgagattgagagagacaggaggcagggagacctctggccttaactgactagctgtgtgaccttaggcaagttacttgccctctctgtgcctcagtttcatgattgtgaaataaggataatactaatacttacctcataagattgttgttgctatgaagattaaatatgttaatatatgtaatgcacttagaaaaatgatcaacacatagtcagttgtgaagaagcattagttttggaaggaaaaagattccactccgcactttccttcaagtgacagacattcaattatatcaagtcctgaagaatacatcctcatttcccatcacttacacacagcaaaagcccagcatgcaaaagaaaaaaaaaacccaaaaaacaaaccctatcagagtcagtgatagattcagtttctcagtaattaactattatctgttcctgtacagaaagaaaagagtgcttaaaaagttggttgaagacagaaagaatctagagctataaatgttaaagatgaacagttaatatcatcagagaaacagaaatcaaatcaaaaccacaaggatatatcacctcatgcccattaggatggctactatcaaaaaaagcagaaaataacaagcgttggtaagaacgtggagaaattgtaacccttgtttgctcttagtgagaaggtaaagtggtgcagcactgtgaaaacagtatggcagttcctcaaaaaattaaaaatagaactagaatgtgatccagcaatcccacttctgggtacatatgcaaaagaatcgagagcagggtcttgagcagatatttgaatactcaaggttatagcactactcacaatagccaagaggtggaaacaacccaaatgtccatcagtggatgaatggatcaacaaaatgtggtatatctgtacaatggaatagcattcaaccttaaaaaggaaggagatcctgacacctgctacaatatgaataaacattgaggattttatgcgaagtgaaataagtcagttgcaagcagaaagatactgtatggtgtcccttatatgaggtcataggaggggcatagaaacagaaagtataatggtggttaccagaggcctcaaaaaagagaagaaggagagttgtttcatggctatagagtttcagatttgcaaaatgaaaacgttctggaaatctgtttcataatgatgtgaatatacttagtactactgaaatgtacacttaaaaatggttaagatggtaaattttatatgtttttataataaagaaaaatgaaaacaaaaagatcatctagtatctccccccttcccctttacaggtgactgaagtaaagcccagagaaggtaagcgacttatccaaggtcacacagttcacggaggcagaatcaggatcagaacctgggattctgacccctgcagtaagggtccgtccattacatcctgctctctatgtgaggtgctgaggtaatggaaaagatgacactgttgatttatcagtagtgacagtgacattccaatgaacctgaaagggataaagattctactctgcttataaatgttcatgtgcctgtgctctttctccaaatctcatcaggattattcaaaccagcagtctctgacaggccacagtggaaacctcaagatattcacagctgctctagtctggagacaggccagaaagcagatgagagcagtttttccgttcctgggctgttgcccctgtaatttagaagttccgacactggaaaacaagaagaactcaggggctcacttaaaagcaagctcagtgtggggtctccaatgtcgtgcagggaagctgctagtcaaaacttgctaatttgaaatgggttcactgactccttcttcggactcagggaatgaagtcttttttccccacttaggagtttttcttcggctccttatttcaaattccataaaagagacaacaggaaaagctggccctagcccaagaagcagagatgaaaaccagatctctatttttgtaagtgtgatgtctataggttgccttctattttatatcagaaagttctattgtttccatggaaacaatgagtgtggctgaggatccctacaggacctcagcacttttggggcttgggtgattggtgctattggcttggtgattccaaaaacctccctaagtttcaaaattttaaagctcaagccaaccttctcacacccctgctgtgctcctcccatctctttgacacacagatacctcatgcatatggcactgctctgagctctgaaggtgttaggaaaatcctccctgcagaaatatgacctgtgataaagaactaaataaaacattttttggcaagaacatttctgaagatctttccaatccagaaatattttttttgttttcagtaaccctaccaaggctgaaccaggatgcctataaaaagccttctgtgttcccctaagcactcttaatgaatcctcaggaaggatggaataagaggggggtcagagacctgaagcccgtgccagaggctgagcatgccagcttggcttggtgcactggtggcagtgctcagggcccctgcctcctgtcctcccattggcatggtctcagcccacactccttaagggaattggctgtgctcctggcttgtctcgcctgtgtgtctgctagttatcgaacaaagggtgggattacttccatgcccagtttcccagatgctcgcaagcacagagccaagaatcagctgaaacagaagggacaactgagcagagaagccctcttgatgagactcggccacacttgagctgttgttcctgccacgagacacacctgtcatataaaagccaacaagccatacaggaaacatggtgtgcctcctgtttacagccgatcctagaaaacaaaaactttgctgagacagcaccaaacgtgaaaatggggagaccagccaaggggcctgaaccgtgcacagcccctctccctgttgcatagacaggaggaggagtcaaaagctaagaaggttttgctgcttccagaagctgttccctcacctcctcctctccttcactaggtatattttccccaatcttcaaggactagcttcagagcctgaaactccaggagctgaccccctgataaaactttttaccccaaagtaaacgcaggcaagatgcttgctccgggtggaatgatgggcacctcttggttcatggctaccttctgcaagctaaaaggacctacagggtaggggtgcatactatccctggaaaccgaaacacaagaaagtctcttaaaacccccttgatcacccaaatgtccagaagtcattggaccatctgaggctcctccagccccaattccttcaggagctaattgcagaagaatttcaaaaacgatctctcatcaacttgtccaaggaaaccaggactcaatataccagaaagttgtgaaaatggggtgtccagtgggatgactagatccaaggtttagggagaattagaagggagataggagaattgaagaaaggtaaggacaaagaggaagattattccagggcaagagagaaaaaaccaaaaatattaattggagtaaataagaaaagtattaattggagctgttttgagggatccagagaggaaaccattcccctggcacaaggtacatgttttaagggcaagagaaaaaaacatatgaagagcactgagtaaaagcactgaatttttttcctggctactcctttggaaagaagaaaggggaattgtgtccataattatgcattttttttttttttgagacagagttcactctcttgcctaggctggagtgcagtggcatcatctcagctcactgcaacctccagctcccagcttcaagcaattcttctgcctcagcctcccaaagtagctgggattacaggtgtgcaccaccatgcccagctaatttgttttttaaatttctgtagtagagactggctttcactgtgttgaccatgctggtctcgaactcctgacctcaggtgatccacccgcgttggcctcccaaagtgctgggattaccagtgtgagccattacacccagcctatgtcatattctttacaaagctgaggttaaggaaaccaacttggtccttggatcaagtcatttatttctataaagcagctccaggctgctataggtaaggagaagagacataataatatagatcaatactgacttgggagtcttctcttctgtgagtttccatgaacaaaatttgggagtcagggatatggaaacagaagggagctgcaactcattgagcatcgctctgctttgagccctgggctgagtgctttatattcaggacctttgtactccagatccatacaagcagctgcccacccaatatccccacttgggtgtctaaaggcatctcaaactcatcccaaattgagcttctgctctttcccccatatcctgttccagccacagtccttcattcagtggatctcagctccatccttccagtggctcaagccaaaagtgttggagtcatgcttcaccctgtactgctcgcataccccatgcctgcttcagtaagaaaatctgttggttctaccttcaaaatgtaatctggaatggctgtacttttccctacccctactggctccaccctggtccagaccatccttgtgtctcacttggatgattgcaatgttctccttgcttctactcttgctcctttgcaatctattcccaccacagtggccagggggatgttttttaacatgtcatatcatgtcattccactggtcaaaatccgccaacagcttctcattctactcagagtaaaagcccaagtccacccatctggaccacattccctccctgattccatctagtgataccccttgcccactcggcttcagcctcaccagcctctaggcatcaaagcttttgtgcttactgtttcttctgcctagagtccctgtccctagatctcaccccctcaagttttttctcaaacattactgtggggaggctttcccaactaatctgaataaaatggccttctttcctgcttaatttgttttccagagcccatatacagtaactcttatttattttctttatttatcatatgtctctcttccctagaatgtaagttcctgaagttaggattttacccactgctgtatccccattgcctagaatggtcattgacacacggtgaatgcatgatgagtgatctatgtagttgtgccctctgtaaaaagtctgctgggcacggtggctcatgcttgtaatcccagggatgtgggaggctgaggtgtgagaattacttgagcctaggagtttgagcctgcagtgagctgtgatcacatcactgcactccagcctgggcaacagaacgagactgtctcaaaacaaacaaacaaacaaacaaacaaacaaataaataaataaaataaaaaagctatgagttgatgaatctatctcaaatctattcttcatccagagtcctcattccaagtgaactacgcacccagcatcatgagctgcctaaactgttgaccagagcatcagctcacgcagccccagggagatccctgatgttcaggcactgttgggggaggaagacaaggtacaaagaaaccaacaggagtcaatgtcaagaatttcacaggggataggaaattttgatttggttcatgcagcttggattccttcagaaagccttgaactgccaccattagaaaaagatacacacacatacacacacatgcacacacccacacgccctgcctgggagaactgacattaccaaattccagaaaaccgaaaacaatcttatcctaacagggagagagacatcatggagaacatggcatttagtaaggagaaaaggaaatatagctcctgagtttgaatggaagaagaacctaaaaataactaggcggggcgtggtgcctcactcctgtaatcttagcactttgggaggctgaggtgggcagatcacttgaggtcagtagtttgagaccagcctggccaacatggtgaaaccccgtctctactgaaaatacaaaaattagctgcacatggttgcaattgcctgtagtcccagctactcgggaggctgaggctggaaaatcacttgaacccaggaggcagaggttgcagtgagccgagatcgcaccactgcactccagcctaggtgacaaagcaagactccatctcaaaagaaaaaaatatgaaaataaaaaaataaaaataaaaataacttgccctattcaaagatatcttgcttgccatatattttataataaaaataaatacatgagttgagggaatgaggtgagggtatctttaatactgccttccattaatatcttggctttctttctgagaacacatggtacattccaggaagacagccctgtcttatttctaattttctaaaatgattgttcctgactttagcagtatgacatgggtttttccaagcccaatcactcatgattttttagcctagtaatctttaaaaccaaagatgcgttttgtcttggagctggggaagaggaaggcaatgatcatttacagagccctattatgtgtcagacactttatacttcactcctcaaatttgaagttcgtatcattatccctgtttcacagatgaggagactgaggcttaagagcattaagtgatttgcacatgattgcccagatagccaaggcttgacctcaggactaatgaactccaaaaatgctattccttcaactatgcagtgttgcgtttttcctacagtgactaacagaagagtgagagctgtgcctggacattaataatgaattagctttatttgtaaacccctgaccaagaaaatatgtaatacacaatatctatacctgtagacattttccttcattcaaggaaatagcacttcaaaagaatggaaataacacaaaacagtttgatggtaaaccaaaataatctgttcaggtcaaaagaagtcaaacttgatccagccttcgaagggcattttctagcatcatctgaacaaatcttactccatctgtaaggtggagataattatttaatttttaaatttttcatgtatgactttttacacctttaaacatctctaacaattgaaagtcatgatgtgtatgattcctgagcgatccattgggatgctacaaatagctgttaatagaaaatccaggctgggcgtggtggtgcacacctgtaatcccagcactttgggaagccaaggtaagaagatcgcttgagcccaggagttcaagatcagtctgggcaatagagcaaaacctcgtctccacaaaaaatacaacaattagccaggtatgatggtgcattcctgtaatcccagctactctggatgctgagatgggatgatggcttgagccccaggaagtcaagacggcagtgaggcatgactgcaccattgtacttcagcctgggcaacagaggaagaccctgtctcaaaaaaaaaaaaaaaaaaaggaaaagaaaatccaaatgggatgacagagtggttttaggttggcaatgtcagtagctctgtggcatgaccaggacacaggtttctctcatcttgccactctgccaccctctgtgcaacggctagtcttcttctcaaggcaggctcttgtaatggtctcaaatggctgcctcagttccagccaacattcagatgacaatcttgagaggtggaaaaggaatattcctgtcttgggtctcttgggtctccttttacaagtgagataaaacttccatcattctgggccaggcatgaaattgcagggatgacctaggaacctatatgctcctagtgatacagaggcacgagcaaagtccaactgcacaagcacattgcaagcctcctttttcatcccatctgttaatattccattgctcaaggcacatccatggcagaacccaaagtcaaggagcagagaagtatactgctcctgtgttggcactgtgacgagggttctgatatatgctactacagggagtgaagaattgggatcaaggatttaaactaccagctacacgggctcatgcctgtaatccctgcactttgggaggctgaggtgggcagatcacctgaggtcaggggttcgagaccagcctgaccaacatggtgaaaccccatctctactcataacaaaaaattagccatgcatggtggcgtgtgcctgtaatcccagctactcaggtggctgaggcaggagaatcactggaacctggaaccttggctgcagtgagccgagatcgcaccactgcactccagcatgagtgacagagtgagactccatcttgggggaaaaaaaaaagaatttaaactacctaaactaccacctgtggttatattaggcagaaccttatgaaactgccatatttcaaatacaaaatagtcgaatgctgaccatcctgtatgattcggtgtaatgccatcactggaacttcagcatgaccttttgtccactggctatcagaactctctggaaagcagaggacacagttggtggttcagaaaaagcagatttactaaggacataggaagtgaaaaacaggtaattatctgtctctgatatagcagtatcattccctttaagcagagtcatgctacatttgaatcaagcacttattagaatttaaagattatgtgaaaataaaccttcaaggttgagtcccaaagatatttttccctgggaagtcagatgtgtcatggtcccataggaagactattacttttaagtagagatttaattacattttaggattgtcttaattatccccgctcaataaacttcctttccaatagaatccacgagcagcacatcctaacaaaagttccctagtttgtcatcccctcatcccttttcccctccaccacgcatatacacccatgaacttgatttccctgcctccaccttagttcattctcatctctttggaatacctgttagtcacttgctgacctccagtcatcctttccacactcctgtccccatgcaaactacctcctctgccttcccataatactctatatatctgtaatatagaatttaacacattgtaacaaaaatatgtaagtatacatccatttcaccctctagattatgaactccttgagttcagggactgtgttttatttatctttgtttttttgttttgttttggtttgtttttgagacagtcttgctctgttgcccaggctggagtgcaatggcacagtctcggctgagattacaggcatgtgccaccatgcccagctaattttgtatttttagtagagatggggtttctccatgttggtcagtctgatcttgatctcccaacctcaggtgatctgcctgccttggcctcccaaaaaattttgtatttttagtagagatggggtttcgccatgttggccaggctggctcgaactcctgacctcaagtgatccaccctcctcagcctcctaaagtgctaggattacaggtgtgagctaccgcgcccggcactctcagtttatttttggcttgtgcaaagtctaaagcagatgtgcctgcttgggcagctctccaccaagtggtaacgcagggatccaaccttcttccatcttgacactaccatcttcaacatgtggcttctaaaaacagtgcaaacatgagacatgtcatgggaaaggcacagcagatgctcaccaccttagctcagagatgacacaaatgactccttggctagtcacatggcctcagttagaaatgggggtgtggcgaggaaggcgggtgggagggcctggatgagcaacaactctacacgatggaaagggagcatgaatctttggtagttagctaactatctctgctacagggaggagagaggaagaaaggtagggaaaaagggagggagggacttactcaatgcctaaatacatacatactactttttaagtcctgtgcaaagacttctcaaattttctgccacttagatccttaaaaccagatgtagaaagcagttgaacaatatgctgagagaaaacacaccaaatataaaaactaaaaataaggaggagcccattgcagtttcatgtcttaagcacagtcaggaggaaggaaagcttcaggatctggggacagggtatacatatgtctgcttgagttccatgtcttaacttgagagaggaagagagaagaggagaatagcaggaatctgctcaactggaaagcttctaaggagaggaggcttatgggagaagcgttatcaagggatacatcctgctatgaagaaggcagagtgttcacagtgaaaagcaaaccagggaattggggggacatgactgggtcatgagagaatcatagtcatcactatttgggagtggatgaggagtgaatcaccaatatgagactacatgtccagctattgcagttcaatgcgaaacatctctaacaagtcattttagcaccagtaagctcctgctcttgagaaaagcaaccactatccaggaggttgcatacagtgaggaggtctgggattggaagccggggggtgagagaggaggagtaaaagcatctgtggtggagactgatagctgttcactcaaatccatttcctcttcttcctgagcacagggcctcccttgcagttcagcattgccatgtcaatgaaatatgaatagaaatagtatgggcccctttcagaatcagcctataaaatcctcctatgtgtgatcctccaagtgtcttcatcctctgccagcaagatgcacatggcagtgaggtcttatgttttggtgaagccacatttgaacctgggtccttgaatgacttcatggaagagagcctacttgcctagctggacacctgccaggactgttagatgagcaagaaattaatttctactcaatgatagacactgtgactgccacccagattccatttcaatcaaggacttattgccacagctgaggtagtgctgtcagcaaagagtcccttcaggggctgcctccctgaagaacaagagaatggttttatttaaggttatgcccttttgagaaaagcccacatctggggatcaaccaatgtgaggctccatgtccaacattgtggttcaatgtaaagcatctctaacacggcattttagcaccagggcttctgtagtcttgaccaaggtttaaagcatctggcctgatttacagatcaacttctcttttgcccagtgctgcttccgtttactcttttctacaggtttttaatgaaagaacactctttaatcaacatctggcacactaaaccctcagagtcgccttcctggaccccctgtctccccctgccatgccccgtaaatacactatgttgttggatgtgtttcatctatatgctgtgttagttcagataagccatggcatatttgatctacatatagatgaaacatttcttctgctgacacggctatgctaggttggccagcacacatgttccttgctatgtagaaaagtctaggccgtctgcaataggagagaattttgtcaagacacaagcagtagagacagaggcagatgggagagagaaaatccagctggagtgagtctcttcccagtttttgtagcaatgattcctaaaacttttccttcagcaactctagtatcttccccagtgacagaagccattgactcccttttccttcctactttttttttcttaagatggcttaaactgggtttctgtcatttgcaaccaaaaaagtcccaatacaagcggttttgtgctatgtaagtgaatgagtaccctaccctttcactggtactctctcaaaagaaaattagagacagatttacataaacttttaatgaaaccatcatttattgagaactttctacatgccagttccattctacatacttttttgttttgttttgtttttttaggcaaagtctcactcttgtcgcccaggctggagtacaatggtgtgatctcggctcactgcaacctccggctcccgggttcaagcaattctcctgcctcagcctcccgagtagctgggattacaggcacctgccaccacgcccggataatttttatatttttagtagagatgaggtttcaccatgttggccagactagtctcaaactcctgacctcgggctatctgcccgccttggcctcccaaagtgctgggattacaggcgtgagccactgcgccctgcctattctacatacttttaatatattaactcagtcctcacaagagccccacgagatgggtaccattactattattcccactttcagacaggaaaactgagacacagagagattatgaaatacacccgaggttacccagtttatgagtgatagatacccccagcgcctgtgctcttacccagtgatgctctcttgcctgtgttcacacagcctgagatggggacatgagaggcttctgtctcatatgggttatattcatgaatgactagggttctttcccttctctctctcttttttttttttttttggttgagatggagtctcactctgtcacccaggctggagtgcagtggcacgatctcggctcactgcaacctccgcctcccaggttgaagtgattctcctgcctcagcctcccgagtagctgggattacaggcatgtgccaccacgcctggctaatttttgtatttttagtagagacggggtttcgccattttggccaggctggtcttgaactcctggcctcaggtgatccacccgcctctgtctcccaaagtgctgggattacaggcatgacccactgcgcatggtaggtccttccccttctctttgtgcatccattataacttgcaagagcaactaccttacagaagttaacagcaaaaatgaaccagaaggcagagaaattgatccccaaactaacaagcaaaagaagtaattaggggtgctgtgagaggaaaagccagggctgggagggtgtgcagacctgaagttatttaaatgataaaggcacggggtgctgcaggagagacgttgaagggttaatgttggacatataaacactagacccgttgggaagagcccaagaggcagagcaatcagctctgaacagtacacaggaggctgaccaaagagcagtgctttctaagccaggacatgggctagaacctgccagatagaatgtggttttctcaagaaccaggagaatggggtcaagaaaggtcaagctggtagggaaactgagagaggctctgagtcaagaaaaccttggagggtaaagtgtcaggtctctaacttcacagtccctattatcatgtaactgtgaactcttcacaccccgagacttcacatattggagtgaagaattggtttcttaaacttcaagggctaggtgagtgtgatgtttccttactgagccaaggaataacagaagagtacggggcagagctacattcccagagaaaagtcaagaggagtccagtcctgaccctgtgtccaccatcacccatgggagacaatggtgaaggcttctgctgctgagtgtgggggactctggcattttgtcaccactcttaaactgagtttgcctccaaatatgttagcctgctttagaataaacagtgataacaatccatttatttgcagagaaggacttccctccacttgccctgggttaagctaaagtagaatgaaatattggtaaaggcgggcaggcacacatttcatccatcactgctttttttccaggatgcttttgactacatcttatgtgcatataatgtctctgatgataaatatttcaagattagaagattctccttatttaccactgcctacagtcactttttacagtttcacaccaatttaactatgaataccaactatggtaggtgatgacatacattagctcacttagtgtttgaaactacctcaagaaaagggcattattatatttcgattgtggtaaaatatccataacataaaatgtaccattttaaccgtttggaatttacagttcagtggcattcagtatatctacttgttgtacaaccatcaccaccatccatctctaaaacccttccatcatcccccaactgtcaccaccatccgtctctaaaacccttccatcatcccccaactgtcaccaccatccgtctctaaaacccttccatcatcccccaaccatcactatcatccatctctctaaaacccttccatcatcagccactgaaacctcacacccattaaacaataactccccattccctctttcctcccagcccctggtaaccattattttgctttctttctttatttagctactctaaagtcaaattgtacctcagataagggcagtcataatatttgtccttttgtgtctggcctatttcacttagcatgtttttgaggtttgcctatattgtagtttatgtcagaatttttttccctttttaaggttgaatatattccattgtgtgtgtgtgtacatacatgtaagtatgtattttgtttatccatttattctttaataaatatttgggttatccttttggattttgtgaataatgccgttataaacatggatgtccaaatttctgttcaagtccctcctttcaattcttttgggtgtatacctggagacggaattactggattatatgctaattctatttttaaattttttaggaacctccctaatgtcttccacagtggcggcaccgtttttcactcccaccagtaatgcacaagagttctaatttctccatatccttgaaagccattatatttcatccccaacattacagacaaggaaactgaggctcacagaaatgaggacttctcacagttacaagctactgaatatcagatcccctacgggaagccaggattcctgactccctgtccatcgcacttccccagtcctacagctgcctcagtcacagaacagcaaaagtagaagcccactgaaacccaaaaccagcagaattatatccaggaaagaatttgtgtctgggagttactgtggggaaaagcaagagagatcagattgctactgtgtctgtatagaaagaagtagacataggagactccattttgttctgtactaagaaaaattcttctgtcttgagattctgttaatctatgaccttacccccaaccccctgctctctgaaacatgtgctgtgtcaactcagggttaactggattaagggcggtgcaagatgtgctttgttaaacagatgcttgaaggcagcatgctccttaagagtcatcaccactccctaatctcaagtacccagggacacaaacactgcggaaggccgcagggtcctctgcctaggaaagccaggtattgtccaaggtttctccccatgtgatagtctgaaatatggcctcgtgggagggaaagacctgaccgtcccccagcctgacacccgtaaagggtctgtgctgaggaggattagtataagaggaaggcatgcctcttgcagttgagacaagaggaaggcatctgtctcctgcccgtccctgggcaatggaatgtctcggtataaaacccgattgtacgttccatctactgagatagggaaaaaccgccttcgggctggaggtgggacatgcgggcagcaatactgctttgtaaagcattgagatgtttatgtgtatgcatatctaaaagcacagcacttgattctttaccttgtctatgatgcaaagacctttgttcacgtgtttgtctgctgaccctttccccactattgtcttgtgaccctgacacatccccctctcggagaaacacccacgaatgatgaataaatactaagggaactcagaggctggcgggatcctccatatgctgaatgctggttccccgggtccccttatttctttctctatactttgtctctgtgtctttttcttttccaagtctctcgttccaccttacgagaaacacccacaggtgtggaggggcaacccaccccttcaagttaccaccccagttattcttataatggtgatagctcgaaacacactgttgctagaactcttcaagcagaaatgtatgtggttcaatgacaagattgatcctgttgatttagcaaacatttcatccttcagtcatccggaattcattaattcattcaacaagcatttattgagtgcctattaggtgccaagcatatttttaagagctgtgaacaagactgccaagctttctcctctcatggaactcacattctcgagaagaaaacagacaataaatagaaaagcaataaattggatcatttcaatgttataagcacactgaagtctatgaacagggtgatgggacagagtaataaaggcagggaggaagagcgactttagatactgtgaagcctgtctggaaaaggtggtatttaagctccatgtgaaatctggtagaagaacatgtgggcatacagaagagcaatgtaaaggtgttgaggtagaaagaattggaatgttctaagaaaatcagggtgtcagtctggtgggaccatggaaacaaagaatggagagtagagggagatgtagtcagagagaggacaggcaccagatcaaatgggtctttatatgataatagctaatgtttatttagcacttactttgtgtcagatgctattccaagtaatttttatgggttagttattcaatcattatgcaaccctataattaaatactattattattcccactcttcagatgagggcactgaggcccagagaggctacataacttttccaaggagctctagttgttaaggggtggaacgtagatttgaacccaggcaatttggcttcagagtctcggttcataaccactttgtcataggaccatcttgtgattagatgttattgcaagatcaataagatatcaatgaagggctttaagcagaggtgacaggacttgttttgtattgttgagatgatcaccctagctgctgcatggagcaaaaagggaggcagagaaaccagatggaggccattatggaattccagctgagagaaagtcatggtgtggatgagggaggtagaggtgaaacagacagaaatagacactgttaggatacctttttgaagcagagctgtaggggtttgctgacaccttggatgtggaggtgaggggaggggaggaactcaggctcactgctaggttttttacttgagccatgtgtcaagtggagaagacatctagtgagttgggggaagaacagggtgtagaggggatatgtgttgagtatttgaatgtctagcatccatttccctaacagcacccccatttcttgttagggaacaccacctccttttttttttttttttgaagctgagtttcgctctgtcgcccaggctggagtacaatggtgcaatctcggctcactgcaaactctgcctcccggattcaagcaattctcctgccttagcctcccaagtagctgggattacaggcgcccgccaccacatctggctaatttttttgtatttttaaagagacggggtttcaccatgttggccaggctggtcttgaactcctgacctcaggtgatccgcccacctcggcctcccaaagtgctgggattacaggcatgagccactgcgcccggcgggaacacctctttcttatgagttatagtcaagccgagaggccatacatgattgagatagtccaatcaggtaatcctttcctggaatgcgaatctgaagaaggacaaaattcagtccctccaggagctcctaacaagttttttcttttgcaaggcatttgctgtgcttcctagttccaagtccaggactccagcctgccatcaattctgcgagtcccaaagccttccagcacattctgcctgcctaagttagccagtgccagttcttcttgcttgtaagcaaagaaagtacaggttggggataggatagggtagaggtgtgatgctcataatcaagagatacattttggacagggtaagtgtattagtctgttttcacgctgctgataaagacatatccgaggctgggaagaaaaagaggtttaattggacttacagttccacatggctggggaggcctcagaatcatggtgggaggtgaaatgcacttcttgcgtggtggcggcaagagaaaatggggaagatgtaaaagcggaaacccctgataaaaccatcagatctcgtgagacttattcactaccatgagaacagtatgggggaaaccacccccatgatcaaattatctcccactgggtccctcccacaacatgtgggaattatgggagtacaattcaagatgagatttgtgtggggacaacagagccaaaccatatcagtgagattaagatgcccataagacgagtcaaggaagctgtttgatatatgaacctatagttcaggggtgaggtctggaccagaaagaaagaaatttggaaatcttcagcatatacatagtatagttctgtgtgggaaaatatgccatatcttttgctaaaaggatcctgattttctttcggggaaatatccctccttcttggctaagaatcatgacaggctgttaatcaaagttccagattctcctctagccaagaagtaaggagaagtctcaggcctgaacagtcagcacaagccatttacccagtcgtagtgattattcagggctatgcagataacccagatcatttcaataagaattagccaaaggacttttagtggaacaataaggaaggaaaagttgttctttacagaagaattgctaaactggtacagtgcaagcttggagctaccagagcctttttttttttttttaaaccaccttgggactgtagcctaataagaatgagaccaacacaacacaacaggaaaaaagacccaagtaacagagggagagaggccacgtgctgatgcagcattgaggcccatgaggctgtcagtcctggagctaacatcacaattacatgaatcaatgaattcccatttttgcttcagagttgagttagtttctgctacttgtaaccaagtgggttctgacaagtacaaatggcatttaaatgagtaagatcacacaggaggaaaatgtagctaggactgagctgcaaaacactaataattaaagctccagtagaggaggaggagccagcattttggttagattgtttcttgtctttgatgacaattgggaccagaaaggtaatgcaatgtattgtatcgctgaaagaaagagaatctgttagcagagtatcgcaaattttgtttaactgtctgataggtacaaaaagggccttatgtttgcaaattcccaatataaaaaattcgcttgtagcttagtgttggcacgttattcctgtgtttaaaagtcagtacctcattgctgaagagcaccattgctgctgagtcatgccatccaagacaactatggctacctgccttttcttggcacccagcattccgagatgctggaattcagtgattttggcgaagacaagtcagacatgtgcggactgttggtaaatatgcaccagccctttgtggcttgactgcccaaagtcagggaagagcttggactcgatctctgctggcccctgaattcattttggatgaggcaggttggtgtgtgctaaccagggtccccgttcctaacaatagccagactggcatcgttggcttcaaaatggattgttctggctcccaagtcaaaagcggctctgcacaaaactaatattttgagcaaattgtacagagttgtgcacagtggaatgatgagttttacccaatagggagtgctgagacagccaaatggtggctctgaagtgagtgccaggaagctggtcttggggatgggagcagagtcatcatagaaatggatgaatggcagggactgcagaaacaatcaagtaagagtctgcaattagaggaaagagtttgctcttttagccagacacaagaagacaaagggaaactcttccttttgccacacaggaaagaaaatgtggatttcaagttgttttattctgggttagtaggctctgagaagcacttagagccatccagccagcccatgctttgaaaaactatcatcattgactctgtgaacacaaggctcattgataaacagcacaatgatgctcttaagtactcaggcactggagccagactgcctggctcaccacttccttccttaatgttcctgcgcctcagtttcctcacctatgaaatgaggatgaccatgaacgtgggaagcattatgttaatgaaataagccaaacacaaaagggccaataccgcacgattccacttatatgaggtgcctagaataggcaaattcccacagacagaaagcggaatagtggttaccaggggctggggggaagagggggagaatggagttattgtttaatgagtatagagtttctgtttgggatgtggagaaagttctggcagtggatactggtgacggctacacgacattgtgaatgcatttaatggcactgaactgtagacttcaaaatggataaaatggtaaattttgtgttgtatatattttacaattttcaaattaagtttgttgctacaaacaaaaaattgacctaagaagtcatagacaaaagaattagtgctgtgcgacttcagtacataaagtacaaaaaaatggcaaaaatcctcattggtgttggattttaggatagtgttgtaactgcctgaggggttcttcctgtgaccgcacaaagaaaaaccatggcattatattaaagaaagagttttatagacacaaggccggccatgccacgtggggaccaatttagtactgaaataattctcttccaaagctcctaggttaagagtttttcaaaggcagttcgggggaagtgatgggggtgattaggcctgctgctgattggttggggcagagatgaaatcatagggggtcaacgctgtcctcctgtgcactgaattgtttctgggtggggccacaggagtggggttgagggtccaagtggagccatcaggtcaaggtgaagccatgggtgtcagacatgcaaaaaaacctgaaaagatatctcaaaaagccaacctacaacagagatgttatctgcaggaatcactggggaagctgcatctcctataacctctggaataatgactaaacaatccttcatgtctataccttagcaagagactcaggctcttctccttcccctagcctggaggcctccccttagctttagaaaagcaattgagtttgagggaaggcctattatcatttaaatttacccaaatgtccctcaaactcagctcagccccaaagcccaggaataattaagggaaaggcaagatgggggtggggcgagggtagcccagctcactgttacaatttttcttactgatataatttttgcaaaggcggtttcagtgttggtgttggatatcaacaccactgagggtggtggagactggaaagggagtcttaggtggctggtcatgttttctttcctgatctgcaggctgattgcctgagtgtgttgcctttgtgaaaattattgaactgtcatttatatgtgcactttatgtatattagacttcaatgaaaagcaccccccacctctacaaaagacaatattatcctcctcagagggctattttagtattcagtgaattagtgcagataacaaacttagaacagtatccggcatataagggcctcctaagtcatttccagcagtgttaaaaaaacaaaagaaaagctttcctccagaaagctttgtggactcacccctgcggttgagatgccaatcattcccttcttatccacacttcctgtgctttgagatactttgtatttgctcctccaaattctcctccctgccaccaccaccccagaccccagccccggcttggctgtgtccctttgttagagtaggtagttaggcagacataagcagcgaaggagaggggcctcttagcccagaaatgtcaggcaaccatcaggtgatggtagggctgttgttaaactgtctctctaaaataataattggggtcagctggcaccagggaaagctactctaacaatagacagaaaacacctgaagctggtgattagcaacttccagataagatctcaggagctggatgagcaggctcaagcatgtgcattaattaagatgcaaaatggtggagtttaactggtatatgaccttcctccaggaacgctcaacttgtaagggaaaaatgcctcaagtgaacatgcgcacaacttccgtaaacacactgtgcagtgatccttcccaagcgctggcaggccactgtgcgtgaggatagcccaccccaagggaagaatcaagggaggagaaacagaaacccaggaaccacgccaatggagaaaaccccaagtcaaggatcaaatagggcacttggatctctcaagttgcccgctcggccctcttccaagtgtactttgcttcctttctttccttcctgctctaaaactttttaataaacttttaattctgctctaaaacttgtttctcactgccttatgccctttgggtgaattctttccttcgaggagggaaggatcaagtttactgcaggcctgtcggattcactgctggtaacacctttattaaaggttgcaggtcctgtccagcaggcccctccacttggctctctccccaggttctggtaactgcctcttttggcccaggggtaataatggtcccctgcagttaatccccaaggatactgtactactatcccttgtggtttcttgtggttttcttatgcccagatctttataaatcacttcttattaaaatcttctccagttttcccaattgcagtgtattattaacttctgggacctgactgatatctacccgcttagaaaagctatggaaagcaggccgggcgcggtggctcacgcctgtaatcccagcactttgggaggccgaggcgggcgcatcacgaggtcaggagatcgagaccatcctggctaacacggtgaaaccccgtctctactaaaaatataaaaaaaattagctggacgtagtggcgggcgcctatagtcccagcatctggggaggctgaggcaggagaatggcgtgaacccgggaggcggagcttgcagtgagccgagatcgcgccactgcactccagcctgggcgacagagcgagactcagtctcaaaaacaaacaaacaaaaaaaagaaaagctatggaaagcagccatgtaggctacgggacctcaatcagtcagataactgctgactagggcggacacaagcagctgaccacgctgaaccaatcagaatcatagaaacagagggattgaaccagtggagaaccacagaactataagatcatgcacaggtagagccagggttggggccatggcagcccaaaggcaccagcaagcggaagctactgtagggcagttgaaaaaaattggtctgtggggaaaaaggaacacatgcaaagtatcatttattcatgttttaaatgcattaatatattcaaaaatgtgttctaacaatatgcaatcaaatgtaaaatcatctaatgtggtcttcccagttattaaactccattttttttttttaatgtgggcatggaggggatggagtttcactcttgtcacccaggctggagtgcagtggtgcgatcttggctcactgcaacctctgcctcccaggttcaagcgattctcctgcctcaacctccagagtagctgggattacaggtgcacacaaccacacctggctaatttttgtatttttagtagaaatggggtttcatcatcttggccaggctggtctcgaactcctgacctcaggtgatccacccacctacaccttccaaagtgctgggattacaggcgtgagccacactctatctttttttttttttttttttttaattcttcagctaaaacagtggaaaaggtgatttattatatggttgttacactcggccacaaataaacacagaaatagtccagaatgtcacaggtccagggcagaggaccaacatgggcattttgtttatgagcaaggtgggtctcagaggtgatcggcgatcagagggcgatgaagttctagatccattgacacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcacagaggtttccaaaaaaaatggcgctaaggccgagagccacactctatctttttttaagagacaagatctcactttgttgcccaggctggggtgccatcatagctcactgcagcctcgaactcctgggctcaagccatcctcctgccatagccttcccagttgttaggactacaggtgcacatcaccatgtccggctaattttttaatttttcttagagatgggaatctcactatgttgcccaggctggtctagaactcctggcctcaagtgattctcctcccttggcatccacaaattactaggattacaggcgtgaaccaccatgcctggccttgaactgtatctttaaagcccctgaaatattgttcctaccaaagtaatataaatgagattatgtcctaaaatgaactgtatgaaatgcaagaaagctactcattatgaaatcctgttaatatatgtgtgttggggtggataaggtaaagaatgattgacgctacttaataaattgtggttatccattagtacatttttaaattaaattactaatgaaatacaacaaagtagaaaatatcagccttcatcatgcttctaagagcaaatactgatttgtgaaacttatttcagtgatacatatactgggtcaagtgtaaaatgtatttccactgggtcaaaaaagtttttaaaattctagttaactgtggttaaaatatgcagttcagaaattactgtgatgtactacagtgtgggagtaacacaggaagaaaacacagtagagttattataaataaaatcttgctaacatctatgggaatcatatattctgagccttaatatgttctttcatagatggttttaagttggaggtggtcatcgagctaccatttcatcatcatccttctcacttttctctttttacaaactggagaacggtactgtcatcatttaggtatccccccagtgcttggaacaccatatgcactagataaatgtttgatacatctctagaaaatggtcttttcacaaagccattgtgtttacatagaatcaatgatatgaataagatatttaaaatttccatatatgcactgctgtaatcaaacatcatatgatcactgtaatatcccataagcagtggttttatataaaaaaattttgaggccgggtgcagtggctcacgcctgtaatcccagcactttgggaggccgaggtgtgtggatcacgaggtcaggagatcgagaccatcctggctaacctagtgaaaccccatctctactaaaaatatgacaacaaaagaaaaattagccgggcatggtggcaggtgcctgtggtcccagctactcgggaggctgaggcaggagaatagcaggaacccgggaggcagagcttgcagtgagtggagattgcaccactgcactccagcctgggcaacagagtgagactccgtctcaaaaaaaaaaaagaaaaaaattttgaaagactacattttaaaaaaatgagctattattgttattctttatattatttttcattggcatttttatttagatgtaataatgttgatgctaataccgcgtcagtaacaaactttactagctgtagtgagttgaactgtggctcccaaaagttatgtccacctgaaacctcagaatgtgatcttatttgaatacaagtctttgtagatgtaattaagataagggtctcaagatgagatcatcctggattgagctgggactttaatccagtgagaaatgtccttccaagaaagagaaaagaagacacagagacaaaaagagaaagccatgtgaagaccagggcagaggctggagttataaagtcccaaaccacagaatgccaaggattgctgggagccaccagaatccaggagagaggcatgggatggattctccctcagaaccttcagcgggaacgtggccctggcaagaccttgattttgaatttgtggccttcagaacttagagagaataaatttctgttgtgttaagccaccaactttgaggtaatttgttaacagcagctctaggaaactaatataccagctgaataatatactgatagtttaaaggtcacaccaattatagatttggttttcctggcccttgcctgacctatgtctttcacttagagaatgttggtaagagtttattctgaagcagtagtattggattcccacagacaaacatacgaggtcacatggcagctgctttacacaggactgtcaactgggccattgctatggttagaatgtttgtgttccctacaaagttcacattgggattcaatccccagtgcaggtttattaagaggcaggacttttaggaggtaattaggttatgaaggctctgccctcatgaatggaattaatgctcttatacaagggcttgagagcctgtgcaatatagggggaccccatctctacaaaatatttaaaaattagccaggcatggtggtgcacacctatagtcccagctactctggaggctgaattaggaggatcacttgtgcctgggaggttgaggctgcagtgaaatgtgatcatgccactgcactgcagcctgagtgacaaagtaataccctgtttgaaaacgaaataaaataaataaaagggcttaacagagttcatttggccctttttgcccttccaccatgtgaggacaccacaagaaaccccccatgaggaataggccttcaccagactcagctgctggtttattgctcttggacttcccagcctctagaacagtaagaaagaaagtctgttcttaatatattattcaatctaagatgttttgttatagcagcaagaacagactaagacaactattgcttggattttcttttactcctcaaaagccaaatatgtccatggttgaaaccaaagaaactggattttcattccaactgaacgaccacagtagcagagcgatcaggaacatgggatggggtcaggtagttctggattggaatcccggctccaacccttaactgagggagtgaacttggacaaatacctgaaactctgggcctctctttgctcatttgtaaaacaagaattgttaaactccctcaaatgctgtcagacaatttaataaggaaaacaccatcttgacaaagtcttagtggtacctcagaaaaaagaagtcagggatggatatttatacagttttgagatcttggttcaagtaacctcaagagtctttaaagaagggaactgaaggtcaggcgtggtggttcatgcctgtaatcccagcactttgggaggccaaggcaggcagatcaactgaggtcggaagttcaagaccagcctaaccaacatagagaaaccccatcactactaaaaatacaaagttagctgggcgtgatggtgcatgcctgtaatcccagcactttgggaggccaaggcaggcaaatcaactgaggtcggaagttcgagaccaacctgaccaacatagagaaaccccatcactactaaaaatacaaaattagcccggtgtggtggtgcatgcctgtaatcccagctactcgggaggctgaggcaggagaattgcttgaacctgggaggcagaggttgcagtgagccgagatcgcgccgttgtactccagcctgggcaacaagagcgaaattctatctcaaaaaaaataaataaataaaagggaactgactggaattgggctaagatcatgatgtaaccttagcccaaggtggacgaagggaggatcttaaagcaagtgttgatgagtaaactatggcttgatgagagtgagcaatttgcccaagggagcagattgttatctcagataagctgatcagcaggaatttcctaatgcaaacagagaagttatttgttggcttacagtcttatctattctatgaaaagttttcagaacaagtaacttaagttatattgacacaggtggtctgagttctaagtccaaatagcaatgtcatgttgatggcagttgtcacagttctcaagagaatgatatctactttctgtggctgttgtcaggagtaaatgacatcatggttctatagtatctgccacacagcagggactaaataagatattattattatccattttaatttattttgaaagaccaaacagatgtaataggaaatttttatatctctcaaatttttattgcttttcataaataataagcaaagtaaatggcttgcggctttcctggagtttaggaactactaagttactaaggttatagtagaatttgcacttactgaaagaaaaaaaaaggggacaaaaggaaaaaaaacattgagagctctttttctttgccatgatgctagttgtcggcatatttgcattccccaaggacttgggagtaattagctctgcataagctgcacatcttcaggaagaaaacaacttttataaatgcagagaggtttcatgaaatggtgtgtcatatggaaatgcaataatttctggagactaggagtctttattcattccctctgcatattctcaattgaattagtaaaattttcttataagagaatgctacatctcttcagtctctgaacatacaaagcccagaggaacttcttgagtgtttgtatatttgagtgtttgacttcagaatctctagacggtggttgagtcttatcctcaggaacagaaagcaacatggtcagatgcctgtttgactccaagggcagtgctcattcaatgcccccaccccagctttctccactgaacctcgcagcagcattctaaagactgcaggagggactgccctggttttgcccccttcactccagggagtctgaacctgcttcactcaactttcccatctctaaaagagagacaaaaagtgcagcactcttaatgttttgatgcgtcattaaaacaaataaaataatccaaacgatgtagaagaaaattgttttactgacaaataataattatacatatttatggggtacaatgtaacattttgatacaccaagggatgattaaatcaagctaattaacatatccagcacctcacctacttaccttttttttcctagtgagaatatttaaaatctactcttagcaattttgaaatatgtagtaagttattattaactatggtcaccatgctgcgcactaacatttattcctcctgtctaactcaaactttgtaccctttgaccaacatctcctctttccctgtcccaccccgtacccccatccttgagtaatcatcattctattctctacttctgtaagttccacttttttagattccacaggtaagtgaaatcatggagtatttgtctttctgtgcttggtttatttcactaaacataatgtcctccaggcttatctatgatgttgcaaatgacagaatttctttctttttaaagggtgtctagtattgtgtagccaattcttcataatcccaagatatcattactatgtgataataaaggcaagcgtatgaagtaaaagaaactgtagtaggtcaaactaataagaaaaatgctgatctgaatgtctatacaatgcatagattgtgtttttaaaaatgcaacagtatataatttccggacctgctatagtcttgggaactaagcagtataaaacttggctagtgactagataaaatgatgatgtataacagacattagttacttatatgcttaattaatctgaacatttaccctacactcttattggcgttattaatttgttcaatttgttaaaagagtttcctaagaaaatgtggctttatttcagtacctattttgaatcccaaatattttttatattctggcttgataactgagtgactaagaggtttcagggccttgctacttgggtttgtatacaggcctaccattttctggctatgttttcttagattacttcacctctctgtaacttagtttcctcaatgataaaataaaaataataatcatggtcacctcatagggtagttaggaggattgaatgtgttagttcttataaagtgattaaagaaccaaatgcatagtatgttagttcttgtttatttttcttgaagttaactgtaggaattttaccacttacaatttacagtggcattgctctatgggaataatactacgtgggaggattctaccgtggtttttgatatagtttggatgctgtcctcctccaaatctcatgtggaaatgtaatctccagtgttgaaggtggggcctcgtgggaggtgattggatcatggggagtctttcccccttggtactgtcctcaccacagtgagtgaggtcctgtgagatctcattgtttaaaagtgtgtggcactcccccaactcctgctcctgcttccgccatgtgaaatgcctcacttcccctttgccttccaccatgattggaagattcctgaggcctccccagaagcaaaagctgctatgcttcatgtacaacctgcagagccatgagccaattaaacctcttttctttataaattacccagtcttaggtatttttttatagcagtgaatggattaacacattttatttcaaatttatatcctgtatagccttgcattatgaaaagagcacagaacaggaagttaggacatcttgctttgaggtctagaacagccatcaactatatgatcttgggtgagtcacttcacctctctgaacctgtttcctcaagaaaaataagcagagtaggctgcctgcgtgatctcaagacaacacactgtgctagaatgagtcttacagcaagagttcaaagttcaaattctaattctagaactcgttgagtgtaaaattcacagcaagtcatagaacctcttggaaccccagtttccacatctggaagaaggggcagaatagtatcaaaaatgcttcactcccaggaatgtggtgagcataaaattaaataatgaaaaagtcaactataaagcactaaataaatataaggtaaaactattaataaaatctcatttagtttaatatttctgctaaatctttttattttcctataatcttttccaagtatttgttcttctgcaggtagaattctgtgggttgaaaccagactataaaaatctgtgtgtttttttttttttttgtcactcagactatctgctatgaagaatgttttcccttagttaaggtaacagctataaatgttcagtttgcccctgagtcattatctgagtcatgattctgtatgagtcaagaaatctaagaaatatagaaattatctatttatcccctttcttttctttgtataaatatctctagatataaccaataaataacttgcctctatcttgggtttcttaatattttaaagagactgttgtagaggaatagggtaatgggagattatcttcatcaagaaagagcctgtgcatataacctgtacacacacacacacacacacactcacacacacacacacaaaatcaacaaaaccctatgctccagccagaaaaacaccttcttgccactaggcccctattagtgctggtccctccacctggaattcctgttcctctgatttctaactgttcaattatacctagaattcagggttttgttataatctcaaactttcagtgagatggattgagtggttctttgcccagtgaaaaatctttaaggccaatattcctttttttgcagatggtgaatctgacagaggaagaattaaatgacttgttcaaggtcacctttgaggaatttgcaggaagtttaacttatgtatatttttcccctgtagtaccccaggtatatcttttcaaatcatcctcgtctgaaccaatttatgctccccttacccatcaggttctcctgtaacacatatataataccacatgttgccttgcactatagttgcttgtgaatagatacctcccttcccagagagtaggtcccacagaagagtaactatcttattctccaaatcctttagagcttttagcactgagtacatacccaggtatcacaaattttgtatttgttgaattggagtggaacatctcaaggatatttttctattgcctttctatgaataagctcagttttgcatgagtccactttgattctcacctaaataagatcatgtagaaacaccaaaagcaccagtgtagatgcaagagatggtgaagacctgaggccttcactgctgcctcctgccagccctgcagttctcaaagaacaagggtcgttgggcaatccttccagacagcttctgggagtgacccgtccttgacacattgagttagctgtgctctgaaggcccaaagcgattcgaagcatgattttaatgactgtcattacttctgccattactaccacccaataaaaaccatcatcagcttgatgtgattatccctcggttgtgcagtgcctctggactccagcaagcaacagagcatatggtctttgccaatagcattattcatcaatggaggataaaattcacagtagcacccagcttgtcacagtggggaatggctttgggcaagtcacagcttcagctcagcttagctctttccaagatgtgggctcttattcacaatgcccttcataaaagtgaaaatgaaacacatgctgaatgggatttttagaacaataagaaccctataattaggaagcaatagctaaaattatattatccctgagagcaaagcatagtaacaagttaatgcaattactaatccagctttttccgaggtagaagcaaaccatgcaattatatccttagtctatattttttcaggggcctaatgacaggaaaacaaatgaagtggatccccatcttccacccttgcctccgctaagccatcagaggacaagtttcccaccccactctctccaatttcacttgaaaaataaaacaggcctccagctgtgaaatggattatgctctacaactatgtacctggaatagaagccatcattcttcatgaagtttgctgagaattatgtatcgcagcctggcagcttcctgttccctcgttagcctgcatatcccacttaacgaaagattcgccatgcactgacttgtatgtgactcacagtgtgcacagtatgcactgactgtgacctgtccccaaatgaacacagtaccagtctaacgtaccaccttacctatggctctctcccatacacacccaatccactgcaggcaaatgatctacccacaatctcccaaacacagtcttcactgtctggtcactgctcctttacacgtggcattcactctgcttgcagaggcattttagagtggatatctaaagaaggagatttctcccaagcatgcacataggagggcactggtctgatgctctgattgacagttcactactgcaaagaggacagatgagaaagcagctcagctctttgatgctaaggaaaaaacacagaacctcacttatctatatgtaatcacaaactttagtatccatcagtaccaagccaaaatagttcctgtttggacatacattattagaaattaacaacaaaatttagtaaatggttggccagttctgaacgcagaatagccacctctgagtgagcattttgatcaatctaactcacacatttctggttcaacaaagttattagatgagaagacccaaaacggtgtgtaaatgggacacagatttataaacagttaatttataatcatatatggcaaattaacctgtatgtcactaatgtgccaccaatcataagacatgccatcatttaatctgtcatgaagaagtgaaaaactcaattaaacggtgacatcatgcttcctgattagaaatgttcatttttttgttatgctaaatttacataaatacatatttatttaaacaacacggggccacaatatgaacatctatgcccaagtttctgcatgcccagcaatgactgccaccctgacaatggtgactgatatcatcaagtgtaacatgcatcctgattcaagttgttcaactgtgacacaacgggtaccttagcactgatgaaatatggtacccgcctgcgtcacatgagcttctcatgatccagcagcctctcctcacctgacactggctctagtccccagtaatgactctgatcctgtttgtcctaggagtcttctcttcctttgtttcccacttccctcactgggctactcagtaaccagttagctgttaaggcgcaagcctttttttattttaatttttattttttccaaaactcctcaacaattgcaattgccactttgtttctactattattgcccttgacttatttctttatttatttaagtttcttttgtttttaaacaagaaggctgggtacagtggctcgtgcagataatcccagcaatttgggaggccgaggcaggtggctcactggaggtcctgagttcaagaccagcctggccaacatggcaaaaccctgtctctactaaaaatacaaaaattacctagaggtggtggcacacgcctgtaatcccagctactcacatggctgaggcaggagaattgcttgaacctgggcagcagaggttgcagtgaaccaagatcgtgccactgtactccagcctgggcaacagagcgagaccctgtccaaaaaaaaaaaaaaaatctcaaggctgggcatggtggctcacgcctataatcccagtactttgggagtcacagtactcaggatcatctgaggtcaggagttgaataccagcctggccaacgtgatgaaacctcgtctctactaaaaatacaaaaatcagccgtgcatggtggcatatgcctgtaatcccagctacttgggaggctgacacaggagaattgcttcaacctgggagacggaagttgcagtgagccgagattacgccactgcactccagcctgagcaacaaagtgagactccatctgaaaaaaaaaaaaaaaaaaaaaaccaagagaatcttccatcatcaattgaaaaacagtaactgcccttattctcacccaggaggagagaatgaaaaaatgttatcattttaatatctttataattttagtaccatgtacataacatgaagtttaccatttaatcatttttattacaacaaaatattttttaatttttctgctattgttgtcatatactttacttccgtgcatgttataaacaccatgatacattgctataatttttccccaagaggctttcagaggtctgcaatgagttagggttgaaaaaacagtgatccaatgtgctagttcaaagactgcctctccttggcttccaggaagccttctaaacctaccttttctattagcctaccttttttttttctttccaatcttttaaaattctattacagatgtacagcaagatcaaagggaacaccttgtccctggggctttagctactggctggaagagaagcatagaaatgtctttaactctttccagtggatatcactaaggttatccaatcatcccatgaccactcggccagagggggtgagatcaccccaccacatcctttacatgcacacacacacacaaacacacacacacacacaaacacacacacacctttcaggcttactgttgcctttttatttactttgcttcaccttggaagagactgttaatgctcatgctaacctgatttcacctgtataaaaatgtccagggacatgtgggcattctgtgatttgtcctggttctaaatatccctgagggtggtcctgacccacataaaaacaagtctgcttcagagccagcttcaaagcctacctctctgatccccaaacctcaggtgatcgcactgtcctctggccagtgatggttcttagagtctgtacttcctatttgatatttatacgcaatggcgtgctggtaaatgtttagcacctggctctgggggtggagaggtaggagtctgggttcggcgggtttatagattcaatttctgtggtgtaaacactcccaccatggctatttcaagccaccagtatgatgtcactgaccacagtcaggaagagacgcagagtggcatattgttatgtagtatttctaccacacagatataatacacataaataacttcaagatcagagataatactgaaaggtaataaaacaattagtaatgagttttgactatttattatctttgttattagtatactttatttaattataactttatataatttaatttctaataatggctgtgtttaataaccagctcacaaaactggaaaacttagcaattggcttttgcaagccagtaggagcagctccagcccacaaaagtaataaagtatatgctatcttgtattattattttaaatcttttatgtccccaactaaattatatacttcagattatgaagttatttgtcttaaatacttctttttatttaccatgctgctaaacacaaataggtaattaacttctttttttttttttttttttgagatggagtctcactctgtcgcccaggctggagtgcagtggcaccatctcggctcactgcaacttccgcctcccaggttcaagagatcctcctgcctcagccccactagtagctgggattacaggtacgtgccaccatgcctggctaatttttgtagttttaatagagatggggtttcaccatgttggccaagctggtcttgaactcctgacctcaggtgatccacctgcctcggcctcccaaagtgttgggattacaggcgtgagccactgagcccagctggtaattaacttctaacattaataacgtttactcattgtaaatgtttttgagaggccactaaaattcaccaataacaaaatttagactgggccccaaatctgacccttcctgaatcatatctttaacctagaaagtttatgcactaaaaaaatttatcaaaaaagatatattggctgagtgaggtggctcacccctctaatcccagcactttgggaggccgaggctagtggattgcttgagcctaggagtttgtgaccagcctaggcaacatggcaaaaccctgtctctactaaaaataaatgaaaaaaaaaaaaaaagatgtattactgacagtgtaattgaatcatttctgctaccagctataagattgcctaccattaagagcagcggtgaccagctttgttatcaatgctgttaggaacattgattaactttcaaccccaacaagcaagcaagccaactcctatgactgctgaagtgagcgctctaaaagagagagtattcttggaggagggagccccgtggtgggtaaacaaactgagaaacttagctaaccaaacttgcaagaatgatcagtctctttataatttacggttaccaagaattggcatgtaacccaaaatgtcaacttattatcaaggagatactatcattatcctactgatggaatatcttcccagtaacaatgatattggtattcattaaccaggattcttccttcccagaaacaaggaatcagattagcaatgagaaggatatttgttgtgtatcaacatggagaatttaaaggtcttgaagcatatatcctctagatatgaaaaatccaaacgaactatctctcttccacagtggagtgtatctatttggtgcaaaagtaattgcagtttttgccattaaaagcaatggcaaaaacagcaattacttttgcaccagcctagtatctaatccccagactattaatatctaccaaagtgtgtctgtcatctatgaaaattactggtaaagtctgtgaaaattttcactgaaggtcagcaaaggcactattatctcatgctggagaagttacaagtgaatactagtactagtaactagtattcattaatactagttagctttgtacactacagttccatggcagagacagcttactgaaaatatgccccagttcagggttggcaaatacatagcacatgtgctgtccccatcccttcccatactcttggcagacatcactaattgatcactacactcttccttcattgagtcttacagttcttcccaacacagctctatatgcagcactaccaatcctggccctgagctccagaagaagaattaggaagcaaggcatgtgcaggtttctcacagggaggttaaggactacatggaactaagtgcattatttcaagttcattttgatagcttgctgttagaaggttaatgttgttgcctgctgctccttactgtaaacccctaggtcctgactaccgaggggatatcaagggctctatgttggctttggtttttctcctctccagtgttacaatatggagatgcctacgtcttacttacacagaacgaattgttcaccatcattttgtcagtgaatgtatgttttagaagtcagttactatgggtgcagcacaccagcatggcacatgtatacatatgtaactaacctgcacattgtgcacatgtaccctaaaacttaaagtataataataataattaaaaaaaaaaaaaataaaataaaaagaagtcagttacatatttaagcttcccttggctctttgccacttccactagagggcgccactgaaaaggaaaggaggtaaaactaaagggaagccatttttctccttagtgcctttctgttgcctctgctcagccttaccatccagaagaggaagtcctcaaccagtctgcacagcctctggtgtaccacggacatagcactctccacacaaacagaaacatctcttgctatacttgcccttctcctctgatcccaaacacccttcattcatctcaatcactttcccatggacttgttttccttctttcattagaaccagagctccatgagggcaaagctggtctttgtcttcccataccattatggtgcctggcacagagtaggtcttccatacacagttgtgtgttacaaacctcatgtgctgaaaaatcacaagcctcttattcaaggtgacagaaatggaaaccacaccaccttattaagtcgtagcaaattttccacaacttcataagcatgtgcttggaccctgctttctaattcttcaaaccaggaaataactcccacatgggcactagtgttctgctcttctacacagtggaattaagcttcttaactccgcatctataaggtttgatacaaaaggaaactctattgtcatttaacctgacgttctagcagttttccttgaagttctcacaggagaactttggggacaatcctctcatcaaaatgatttctagctgctacccttctcccaccttgaaattcttaaagtttcttgcccccttgttgactttaattatgttcttccaatagccttgtaaaattgagcaagttcccgacagcattttgaaaggccctgtgagctccctggtcagcattttcaatctctaattataaatctgcctgatggctttcacttaatacttctaaggtggggctgagggtaattgatggttttgaagctagctctttaatagcagccgtcaatgtatcaaggcttaatttctttcatgatctcagagaagttgctgcaagtggtgaggaacttatgttatcatccatcctaggaaaacagagagattttattagagtgtagtgaaatatttataagaacattagagcttgtgggactcaagaactgacttcacctcaaactttcatttgcatacttgcttccagggaaatctattatgggatggcctggatatatcactttaaaaatcctgcttttaatgaacaaatgagaaaaggtgagtagttttctctagaaagaacatttttctcacccactgtcttcccggaaagataaaaatatgctcaaaatatagcatagaaataaagggactattttgaaacagagacgaaaacattttaactcaagaaagaaacgtcagtgatgatggaggatttccttaacaagaagaagaggcttcactgtttgttcacaaagaaactcggtctctcagtctttagttgtgactttctgttttaccgaactattattttaattgtggcttctctgtgttctcgttgccttcccgtaacatttccatgttactttgttggtactcattgtccttctgacaagccatgtcagtctcttccacactgcctcttccatcaaatgtatactacagtaccttcattagcccattatagatgctatgtttattcattcattcaacaaacatgtcttgtgggtctactattggccagatgttatgaatacgaacacagaaagcagtccacactctcaaggaacttgcagttcagtgagaacttgactggttagaaaccacctggcaatgttacaaactatattacattttcaagctatattcaagttatcagagactgtcatcactcctccaagctagagattctgattagctgacacatttgcaacactgatctagtgaacaagatgtaactatgattccttgacctgaatttagaggcctttagtacaaaaacagtgctgggagagaaagctgagggaagactggtagaagtctggaacttcagcaaagaacagataaattcatagaaagacagatctgctttcctctagttcagcggttctagggtaagactttgtgcaactgggaattagaattttctggcagcaaagctgtatcagccctttacaggtttacctggaataattcacactcccttccttaacgttctacctggccaaactatccaggcctagcataaacctcagagcccacagtgagaatcatagtcacctagttgctctgacctactgcaataagaaaccaatgttttgttttgttttgttttgtttttatgaagtaaatgatgtttaatgccaaaaagcacactcgctttgggtagctcaagaggtgtaaattcagacagaagcctacctccaaagtacagagcagaaaaaagcattcccaaaaatgcattctggattttacctctccctcaagcccatgcttaaagtcagcatctgtgtaatgctaatgattagtaaatcaaaaggcatttatttaatggagccgcttcagtatgctgcagtaagttgccttctgccatatggctttgggtatgaaatgattaaactataatatctggagcctctgttgctggctatttaacggtgttatgcatcatgagctccgagatggctgcaaatctgttttcagtttgcattcccagcaaaaaaggactcctggcccagagggatttaaatcctcctccactaatcactagggcatacagaatcacactgatcctgcatatagttagtagctacagacaacccaatcctaactcaggaaagagacagggaccttcattaggcagccatttccggggtttaaaaacaaagaaaatgataatctgtaatggctaagaaagcaagaagaagggaaggaaggcccagcacagagcccttgagatgaggacaatttggggcacagtaaaaaggctgcaaactggaccttctcaaacactagtccattggctgatcataatcgctacctggcatggatagcatcttctctgccaggcactctgctaagcactttaacacatgctacctagggtgggtgtggtggctcatgcctgtaatccctgcactttgggaggctgaggcaggaggatcacttgagcccaggaatttgagacaagcctgggtaacatagtgagaacccatctccacaaaaaataaaaaacaaaaattagcagggcatcatggtgcctacctacttaagaggctgaagtgggaggattgcttgagcctaggaggttgaggctgcagtaagctgagatcgcaccactgcactctggcctggatgacagagcaagaccttatctcaaaaacaaaacaatacgaaacaaaaacatatctcacctctcttaatattcacaacatcctctatctagtaggtactactattgttcccattttactgatgacaaaacagaggctcagaggacttaagcaagttgaccgaggtcacagctggttagtggtggagctgaagttcaaattcaagtcggctagactgcagggccaaaattctctaactacagtcctagttgagcatcaccactagttccttaggtaagaaacactgatggtgaataccaccatcaggggatttttagtttcttgcttctaaatatgatcagtaaactatgtatgatcctcattgcaatgggtggacttagtcttttttttttttttttgagacagagtctcgctctgtcgccaggctggagtgcagtagtgcgatcttgggtcactgtaacctctgcctcccaggttcaagcgattcccctgcctcagcctcccaagtagctggaactacaggcggcatgccaccatgcctgcctggctaattttttttttttgtattttagtagagacagggtttcaccatgttggccaggatggtcttgatctcctgaccttgtgagccgcccaccttggcctcccaaagtgctgagattacaggcatgagccaccgcgcccggctgacttagtcgttttcaacaaatccttttgttggcttcataaaatccaaagttgagaaaccatttcaagtgctgttatatacaggcacctgatccagcaaaccatgcctagtatttaaatgatcccagaacttagaaagggcaaaaatagatagttatttcctgttcagaattctgcctcgatatggctcatgccattttatgtgctatccattatagtattgtaagtgttactaggaatataacccagttcctgtccccaagaatgttgcctttctactggagagactggaaacaaagaggtcagttatacttcaaagtataagcaatttaattcctcagtggaattaaagtaccatagacatggagagaatcaaaagagttcaaaagaaagccttggctactttgctatgtgcaagagcaactaccagagtaaaatcagaaaagaaactcttgttcatctattcaactcagcatgaataaatcacttaaaatcataattgttctggaactttgggtggctatgggcaaaaagtcctatagagaatttaataaaactgtaggctttgtatcaatcaattcctttggaaatttttagcataactcaggagttggaaacttccttcttacaaaagacagaggcactgtctcaccctcagccaatagcctcctccctcatgggtcctgcttcattaacttttaactggtgcttttactattcagtttgtacttttaaacttttaaagcttttatcagatgtcctttgaaaccaaagcataccattaaaacacacacatttccaacgtgaccagatttttttaaaaagacctattcacaaagaccttgagaggacaaagaatgtatttaatgataccaactagcatggcgccagtaatgaatggttctgttctgccaataatacccaaaactaaggcaatgatttttttgtaagccttgttttgctttagaaatttacagtaatatactttcccatatattatcttatttcatccttctgtcaaccatagcgccaagcagagttggttttattatccccattttaaaataaggaaactatggttcagagcatttaaataacagagccaggcttacacatgcagtaagcaacagagtcagcgccagaattccagctctctggtttccagcccattgccatttcaagtcagctatttatatcaaacaatataacttctattcttatgtgatctctgcaaggaaaggttgcaagtcctatttgtctttggatccctggcacctgacttgggacaagtcagagtttatggtggaccagaaataaaaacactttgttctagtgtctatgcttttcagtcactgttaccagttacgagggttaggctaacactaagaaggccaaagtttcaggttttaaatatgcatgggacagtgagttttctggtattccatggccacacaatcttgctaacctatcccaaaagggacctggcaggttaatggatagattggtccaatgtactcccctaatccatcgtccatgcttgaaatcagggactgtcactctcacaactaacttctcaggaaacatccttgcctgtagtctctcccaggaggattctgaggcagggccttgtagattggtagccacactctattcccagtgattctccctgtacccccagcctggtatagctaattagagcagagctggtgcttggttcaaaggctatggatgagcatccaaaaatctttgagatgtcctggcagaatgatacttcccaatggaaacagtgatttactgggcccatgaaatgttccttatcataaattcaaagtgaaggtgtatggtagaaaggaattcaccagggtgatgaaatgatgtacaacaaacccccatgacacatgtttacctgtgtaacaaacctgcatttatacccctgaacttaaaagttaaaaaaaagttaaggaaataaaaaagaatatagaccaaaaaaaaaaaaaaaggaatttgaggagaagtaatagagaaatttaaaaattaaaagactttaaaaaaacagagtgaatataatagaaaagagtaacttaggagtgagaagagagagaatcagagatgaagacacattgacggtagacccccaggggaggaaactcagggaagcttcccccctgggttccagccagggttacagagctgatggctgtctgctggaaccgaggttgggttttcttcccttcaagaccagttgctctttaatctttttggatcccaatcactttcatcatctgatgaaagatatgggtccttgtctcagaaaaatgtgtatatgcacattcagaccaatgactgcatttaatttcaagagacttctagatcccctaaacctgacttcagattcactagggacccatgggccacagggcaagaaatcttgtttaaactattagttcatctcagatagctatggtatcatagccatctctgaagctcagcatttagtatggggcctgaaacgtagcaggcattgcatacatcttggtagaatgattgagtgaatgaatgaatgaatgaatgaatgaataagtagatgaatgaaataaatacaacttgaagtttatgtcctactcagcacattgggagcatcctcttcttcttatgaaatactgtattaatgtaagctgagtagtatgtcaggaaggaatgcctttacccagatgatgtttaatatatccatcaacataattgatgggcacactgtcaccttctacatccggagctagaaggccattataccaccagttacatgcaaatgagaacttggaatgacatagcctagaagaacagctctactttcctagtagatatagaaatgaaaagcaactatgttttctacctgaaatatatgtgtaatgattattttgaactgtaagctactttttcctactatataacttgaaggcaaggttatgtgacatagctttgtacctgccccccttgctcactgccaatctaagtgtgttacagatagagagattttaattaaacttatctcatggactgtaacgtgggtagagaagacctgctttttggtttgtcgggtgatgggggaaaataaaagggaattatagcagaatataatgatctcaaactttaagtattgaagtcattgtttcaaactgattacatctaaaagtaagagtcaattctgtgagctattttttttatttcttaattcttgatcataaaactcccatatagtccaggcatagtggctcaaacctgtaatctcagcactttgggaggctgaggcaggaggattgctttaggccaggagtttgtgaccaacctgggtaacatagcaagaccttatctttactaaaaaaaaaaaaaaaaaaattagtcaggagcggtggcatgcacctgtagtcctagctacttgggaggctgaggctggaggatttcttgagcctgggagatcaagggtgcagtaagctgtgatcatgccactgcactccagcctgggcaacagagtgagaccctgtctcaaaaacaaaaaataaaaccaaaaagcctcctatataaaaagctgtgcttcaacctaaatcttcaataattagaattgcaaggtatggcaaacaattgcagttttcacgtagacagtcttcccctccttgtggatcccatgccctggtagcgcaagaagaacgagggcccaattcactcacagtgcaaaacttatggggttccatttgtctcagtacttccttatgggtaccagtggcataaaatattgtatggtgcttccacccaaggagcatgaacattctctcattaacatatttaaagcccagtaacagaaaatccatacttggcatgtgacatagctaaccctaaaaacctaatttttgctagctcttgagtcacttagcttacctaagcataacatttattttatctttttttttcttttttgatacagggtcttgctctgtcacccaggctggagtgcagtggcgcaatctaggctcaccagagcctcgacctcccaggctcgagctatcctcccacctcagcccctgaggagctaggaccacaggtgtgcgccaccacacccagcttatttttgttttgttttgttttgttttgttttgttttgtagagatgaggtttcaccatgctgcccaagctggtctccaacttctgggctcaagcggtctgccctccttggcctcccaaagtgctgggattacaggtatgagccaccacgcccagtcacatttattattattattttttaatgtgatttagcatattgctgctgtattcagcatgtgcctggggtgaaggacagtgaaaaaataattttctagctcggcacagtggctcatgcctgtaatcccagcactttgggaggccgaggcaggcagatcacctgaggtcaggagttcgagactagcctggccaacatggcaaaaccccatctctactaaaaatacaaaaattagctgagcatggtggcacatgcctgtaatcctagctactcaggaggctgagggaggagaatcacttgaacccgggaggaagaggctgcggtaagccaaaatcacatcactgtactccagcccaggcaacagagcaagctccatctcaaaaaaaaaaaaaaaaagaatttcctgaatacctttatgaggcaaggactttccaaagattatcttattgtattagtctgttctcatgctgctaataaagacatacctgagactgagtaatttataaaggaaagagggttacttgactgagttccacgtggctggggaggcctcaggacagttacaatgacagtggaaggggaagcaagcacatccttcttcacatggcagcagcaaggaaaagtgccaagcaaaaggaaagggagaaaagccccttaaaaaaccacaggatcttgtgagagctcactcactatcatgagaacagcatgagggtaaatcccccatgattcaattacctcccaccgggtccctcccacaataggtgaagattatgggaactacaattcaagatgagatttgtggggacaaagccaaaccatatcactcatcctaaggattttcttttttctttttttttttttgacccattttacagaccaagaaattgagctacagtgaggtcacacagccgagaatcacacagtgaagagttgggatttgagcctggaatactctgacctcagagtctggatgctagtctcttgctgcctcccctgtgttatgaggtcatgtctaaatcacctccgttactgaaaatgcttgtgaaagacctattctgctggatagagcagtcaccttagtcaaatatgatccaaatgttgccattaggtcctacccaaccccatcaaagatcagaacctggaggtgtggtaactccctccagtccagaaaaaaaaaaaaaaaaacaaacccagtaggtcagagtaaggagctgctctgagccatcagtgggagggttaagttaaagaatagaaagatgtaacctgacccaaaacttagctctcattttcaacaggcaagagctccttgcagggtgaccttgactcagacccacaatttcatcttttttttttgttttctttttggaatggcaataacaatgtctgcccagcatccaccactttaagttggtgtttacaatagaactgacacagccctttaagcaggctcttgcgtgcagagttaactctccccttgcacacagagcagatcgtcaggctccctccagccccaggacctttctctaaccataaaaaggcaattgtacctctaaaccccaaatccttacctatccctgctgcacccagctgtgcaaggtgagtcctaggaggtcacatcccacatgattccacgttttctcatcagtatcctttgctagttccagatattgcaacatcactactgttcaagattagaacttaagaacttgaaaaggtcaagaaagatgtggtgccttgtctccacatcaagtaaacagtccgtggcattggcctctgacaaatgacaacagactcacggggcagcagttgaggagctgtgcttacatgatacttaccatcctgagaagcatggatgtatggggatacccataccctggtaacccaaccccatgggctcagacagtgttgaacactagagaatcttcatcatttgctcagctgtcaccacttccacagatgcaagaaatggccgatggttctagaggatgaccccagcctctcaaatagaaaagggagtgtgttagatgtcatccagccagtcgtatagaaaggtggactttaagaaactgtggttaatgttggaaggaaacataaggcagcttttaaagctattttcatagtcttcaaagagaaataaatgaccagcgccgacggctgcagacagcaggacaggcagcctgacggagctctgtattcactttattctaatctgttgggggcaggggaattcatgggtccacactctatgaatccatgggtccacagactaattacatcatacattgtctgattaatcctcccgataattgatcctgctctggcatgagatagctgtgtgaccttgaaccaatcattaacctttgggcctgtcctcttctaatgccagggtaagaattatcaacatatatgttgaaatccccaaggattatgccaaggaatggaacagagaggaagacagtgagacatgttgagggggtagaggacttggatagagaagagtgaggcagagaagcagcgtaaataagtgggagaatatctagggagaaaaggaaagacaaattcaataagcagtttcaaagcatgagcctcaaaataaatgtctttcttccttgcaatattactgttttgtactggcttaagaagctagactatctcctgtctgcagaaaacagacaggataacaggaaacagttttggattccacagtgattatagctacttaagtttgacttaccaaatactgtctcaaacagatggtatgtaacatttgattaagggcttatcctgcaagcccgacagggaacatttctttccctcttaatatagaaaaaatgtagagaagaagggaaataaactgacgatcttgcccatgttccatgtataccaacgtttatgccttttctaaaatgaatctgtgcttattatgcaactcaagaccaaactgcatactggtgacaccatagaatttcagtaaaaaaggatattgaagatcatcctatataagccccttattttataggtaaggaaacagagacacagaaagataagtttgtttgcccatggtcacactgtggcacatctgggaccaggtctcctgattccaggtctggcattcacaccagtctttatatgtgcataatgttcaatatagggaaaacatacaaatctgtcagcaccattactactaaattagtgccaatctgtgatgagcaattatcagaacttgaagctgatgggtaatgccattctagtccagttaatgagccaaaagcttggttcttcaaaacacttaacattaatcagcatttggcttcagtttgtgacaagtgttttcaaaacatcacagacaattacaatattcctagctttgcctagtgtaaatacatgatgaaagaaagtcagaatttcataaatgacagtctccagaatggaaataatgagtcccttagagaaggtacaatgtgttcatctttcttgctagccaaaagtaatttgggaactaacgaggtcactgagaaattacaaagtgtgaacttctgctgggtgaggatgaaaaggcctcttttcacagtagcaaagcagagctagcacgtgagatcagccccatatgagtaatgaaggagtgacaccaggcttcatgcctcatcggccacccccacacacacccccttcccccttggttactggcaatgcctcaaaggcggggggctcccaagcatggagtactgaaatgctcatctagggaagaagaagcattccaagaggacttgggaactcattacacagtagcctgatgctgggaaagtagtagaagaaagaaaaccagaaaaaaaaaatggtggtttgtacgaagatgatgtcctcagctccaagctccacgtttcccaggacggttcttgcagaattttgtcccctaggatttctggagaagttgtctatgattgattgattgattgactttctgcaagccaagaacccaactgtggttaatattaggttttctgaaagacagagaattgcttaattaactgggcttaggatagtgttactcattagctagttttatattaataaaaatatgttaatcaattaaccagtcattgtcgatcacctggttaataactaatatttattgagaagtcattgtgtgacaggaacaatgtgaaatgttttcccttcattatctcattcactcctcaccatgagtctttgagatgatagtaatcataattacattcaggaatttattcgacgtatatattgagcacctgcttatcaatagacagttctaggcattggagatacagcagtgaacaggcaaaatttctcttgtctcttggatagattatatcaggtaactatcgctgcctaacaaacctccccaaaacctactggcacaaaacaattaacactaattattgttcataagtgtatgggttttccaagcggtttttctgatcttgatgggactcactcatgtatctgttgccacctggcagattagctggtctaagagggtctctactaggaaaactcatctctactccacaaggtctctcatctttcagcggctctcctaagcttattcttatagaaaaggcaggggtcccaacagaggggctggaaatgtacaaagcctcttgaggcctagattgggagctcatacagtatcacttctgccacactctgttagccaaagaatgtcatgagactagcccaggttcaagggtggggaaatggagttgacctcacaatggacagagttgcaaagtcacattgaaaacacagggtatgagaggtcattgatgcagaccatctactacatatataatgatgactaaaatgacactaaggaattcatggaaatatttcatttgagtctcacaataatccctggaggcaaattctattaccaatctctgctccccaaatgaggaaattgaggcctagggaggttacaaaacttgtctaagatctatgaatatttggtgatggcctcagggttcaaacttaagattccagtgtctgagcactgacccactatgtgattctctccagcctgcgcacttcatgagagaaagtacaggacatggtcactgcccgtaaggcacttatagtcctactggggatagataagtccctgaggaatcagtaaaaatacgtgtctctaacccaaacttggtaattgcccaacaagcagtaagaattaagggggccaggacaagagacagaagcttccataaagagattctccaatgaactgggctttgaagggtctaggcagtgaatagcaaaaggggagagttttctgataatggcatcctctcaccttcatgtaagggcttatagtataaacttccttttctttagaatggcattcagtgctgcaggcaatagaaaacctgattaacagtgacttctcatatagggatttttgtttgtcatgcacaacaagtgtgggaaaaagaagttcaggacttcacaatagccagatgatgtcatcaaggaaccaggttctttctgtctttctcctctgccattctacaaacataccccgattcctgggggtttcataatgccaggatggcagctgtattcatgagtattcttgtgcattctcaaataggaagaaggaggaggtgagcatgctagcacatcctgtccactgaactactttcccatgatttccacccattgtaccctccttactctctttggctagaactcagtcatgcgtagctgcagggaaagctggagaagctaatgtttcagttttctgaaactctgtaatatgggcaaacaagaaaaaaagggggctgtgaatgacttttacataatcaatccacagtgtcgatcccaacccgcccagcaccgtctcccagcactttccccagccactcctatgcaccagcaaacagaagtcctctgcattagtccattttcacactgctgataaaaacatacctgaaactggttaatttataaagaaaaagaggtttaatggactcacagttccatgtggctggggaggcctcacaatcatggcggaaggcaaatggcacatgttacatgatggcaggcaaaagagcgtgtgcaggggaactcccctttataaaaccatcagatctcataagacttattcattatcatgagaacagcatgggaaagacccacccctatgattaaattacctcccattgggtccctcccatgacacgtggaattatgggagctacaattcaaaataagatttgggtggggacacagccaaaccatatcatcctcattccaagtgcacttcaatcaattgttctcttggctcccttttttattttcataatgtcctcttgccttcatggactgttgaaattcttccatgactcttctctgatctcccgtagctggcatgacccctatcttgtgttaggccccttggtccttctgctgctgcccctgctgtagcacaaagcacattctgatttcatagttcctctactagaatgcaaactcttcaagtcaggggtcatgccctgtccagttttctacccacctttagaaccacatgcagctccaggatcatgcagacatgaaggaaattgagtgagcttcatgatttagcatgaggaggatgaggaaaagaaaggtggcacaaacaattgggggactgaaggagctgttgaggaggaaagaaaaagtctcctcttcccatttaggccctcttccaactgggcctaagaattaaactgatatatgacagattgaccggagaaaagcatacaagtttaattacaatttttacacataagcagggaccttcacaagagaatgaaggtctgaaaaattgaccagacagaaagattcttgctctgtttgcccagcctggagtgcagtggtgtgaacacagctcactgcagccccaatctcatggtctcaagcaaacctcccatctcagcttcccaaggtgctgggataacagctgtgagccaccgtgcctagtgtttttgtgccttttagacaaagaaactattaatttgtgaagaaataacaagacaaaagggtgttggccagggacagcaaattgtgaggaagtgactaagatacatagtagaaagaaccagaggaaaataagggttattttggtaactttgtttgtccagatccatttcagcattgattcccagtgcctggtgataagaatgttcctctctctctctgtctctttctctcttttcttctccacaccatgattctgtaaggaatgttcttctcttgctggttcagggtagacacctttctcatgggaaattttatggcctgtttaggttaaaaaaaaatgtggaggggaggggtggtcagaaagcccttcctgcatctgctgtttctcaagtgccttcagctcaaagtcatcaatctgccaaagtggcctattttggggtggcatgtcctgagctcctttagaacagatgacaggcacaatgctggtgccatcgtcagcaccagaacactgctgagttctgtttcagacttgttgagtgtgaggtgatcatggaattctcaaatagaaatttaaaacaggcatctactttcagaagaaaggtcaggatttctttttcttttttttcttttttttcttttttttttgtttgagatggagtctcgctctgtcacccaggttggagtgcagtggtgcaatctcagctcactgcaagctctgcctcccaggttcacgccattctcctgcctcagcctcccgagtagcgaagactacaggtgcccgctaccatgccaggttaatttttttttttttttgtatttttagtagagacagggtttcactgtgttagccaggatggtctcgatctcctgacctcatgatccgccccccttggcctcccaaattgctaggattacaggcgtgagccaccgcacctggctggtcaggacttcaattgtaagtttgatacaaagtggaaaaggctgaagatttcatccacagtctgaaaagaccatatgaaagaggaaggggtgagctccaaagaacaagcgtatgtcaaaagtagtggtgggcaaagactcaaatctaatatcactgaggcttctgccaggcagagagcagtggccgtctgctcaccgcagtggccagtgtgtctttgtgaagagcaatggaggccaggattgaggtgagtattgtcagtaccaactctaaatttcagattagctgtggatggaggcagtaaataagcaaatgcgtttgtccaatttccttacattgcaagttgcaaaacccacttgaagttgggtcgagaccagcttaagtaaagcagaatgtattggctcatgaaagagcaggatagctttggcttcagccatggctggattcggggtccaagtaatgtcctcaggactctgtctctttccatccatctctcatctctcttcatttttgattctctcttaatgttagattcattgtctctcactatggatggctttccccaggtatccaggaaaggtgacagaaagcaactctggtctatatcatctttacaatcttgtgatccaatactgaaaaaagagcctttctctctctctctccgcatttaaacatcaaatctcaaggaagaatctgattggcttttctagggttttctgcctcttcccattccaaaggaatagatttatctgattgactgaacttagatcacatgctaacttctctggaaagtgggggattccccataaaaaagtagttccattagcagaagaagagaagaaggcattctagacagaaaacaaaacaaaacaaaacaaaaaaaccagaagtcttctcttagaaggactgttgcaaacagggtttaatcatttgggtcctgcttccttgtcagtggatccagacgcatggagcttattgataagcacctgtggagacgtgtttgactcgcacccctgctgctgctgcgtgcttgcctgtttagctagaagccattctctacctttcagacgtatccccagcagaggaactgaatggagacttaggccagtcagtctcaaggctggttatttttagtaactggattctgccctagttgccttataattacatctgttttagattatatttggctcccccctccgtgccttcctgagctacatattggattccaactctgtatgctatttcttccaggcctagaatattattttcttctctcctgatataatccccttaccaagatcctatggctgggtctccactctttctttgaatggcagctgtctgtactagagctatctgcaactggatcctgagctctacccacttgccgagacttcttcctatctctactggttggaccacccctgcaccatctctgaaggctggttcagtctctgagtcccactccaccccgcactggccaatctccaattatgacagctgctaacgttcttataaaaacttccttagtctctaaatatagagggtaatcagaccacatggaacagaattcatggaagcacccaaactgtgtttattgcgttataaacatttgatcttctctgcagaaccatgaagaagtgggaagaatgcccagttcccctacttctttagcacactttgccacctgggccctgaaagagtttgtaccactggccaggtgcagtggctcactcctgtaatcccagcactttgggagggcaaggcaggtagatcacaagatcaggagattgagaccaccctggctaatatggtgaaaccccatctctactaaaaatacaaaaaattagccgggcatggtggtgggcgcccgtagtcccagctactcgggacgctaaggcaggagaatggcgtgaacccaggaggctgagcttgcagtgagccgagatcacaccactaaactccagcctgggtgacagagtgaaactccgtctcaaaaaaaaaaaacagtttgtactgctgaatggcagtgtgttagaaccttcataaaacagatcctactctttctgcctgagccttttcttccatagagttcagactttgtcatgggatagctgccctctggcccttccatttctcccatagctctttctaggcttttgtatataaaactcagttttcccttccttcaggaaaagagcaaagaactcatgcatatggatacacacaaatagattttctcaagtctgccccattaatttgccaaacatgcctgatgcctaaagagaaacaccagcagaagaataggttcaggttgaaatctctgcaataagaagagttgtgttactagaaaactgtttcccaatctgggtctatattactaaagcattcttggtatgtgtacgggatacctctcatgtaccacttcacatcctctcagccccacctccaagtgcagccactgctgcagtattgcgctccatgtagtctttgtccagcttcacatgagtgtaatctcatcttgtctgggtccccaccacatacctcttgcttcctgtaccaggtcttctctcatgccaaggtgcagtatatctaggggaacctgcttggcacccaaacgttataatccagaagtaagagcgtggctaaggctgttgggaccatcttgggccaatagatgacaggagttaatggctaggtagttcctccgttcctccttttgtcttccaggcatgctttttttttttttttttttttttttttttttgagatggagtctcgctctctctcccaggctggagtgcaatggcgtgatctcggctcactgtaaccttcgcctcctgggttcaagcaattctcctgcctcagcctcctgagtagctgggattacaggcgcccaccaccacgcccagctaatttttgtatttttagtatagacggagtttcaccatgttggtcaggctggtctccaacccctgacctcgtgatccacccacctcggtctcccaaagtgctgggattacaggcgtgagccaccacgccaggcccaggcatgcatttttgagacacaattcataaggctgctcagaaggttccagtgagatagaagaggagttgtctgtagctgtggccaaaccagtaactcatcctcttttgggcttttcctccttccctgtctcacatcccttgatccccactcctcttctctggaatcactgattttttttttttttttttttttttttttgagacagagtctcgctctgttgcctaggctggagtgcagtggcccgatctcagctcactgaaaccttcacctcctggattcaagcagttctcctgcctcagcctcctgagtagctgggattacaggtacccaccaccatgtccggcaaatgttttgtgtttttagtagagacaaggtttcaccatgttgatcaggctggtcccaaactcctgacctccagtgatctgcctgctttggcctcccaaagcactgggattacaggcgtgagccaccacccccagcctctgagatcacttttcaaataaaatatctcaggctctgctttcagagccacccaagacaagagagtatatcatggcttctttgtaattgtctaacagaaagaataaaattttggtaccaaagagacctcatgtcgaattctaacagtatgactgaaaacaaattatttagccatcttaaaacccaatttccttatctttagtacacagataacatgagtggcccccatgatgtttgtctaaatactaaatcagatagtctctctgagaagcataataggtatctgacacagagtagcactcagtcagtattcattctcttctccttattctcacccgttgttctgatagaaataagaactttttaaaaaagagttataaagtagaaatgaaaacagacataataaacagacggttgtatgttcaaagaaaacatactttaaatatgcatacttactagcatatagatggatgcatatgtaaaaattcattaagctaaacacttaaaatttgtgtgctttatgtaagctatgctgtaattgccaatttatttttttcaagagataaggtcttgctctgttacccaggcaggagtgcagtggcaccatcatagctccctgcagccttacacttctgtgctcaagtaatcctcctgcttcagcctcctgagttgctgggactacaggaatgcaccacgtggttattttttgtagagacagggtctcaaactcctgggcttaagcaaccctcttgtgtcagtctcccaaaatgttggtatcacaggcgtgagccactgcaccaggcttgtaattctttttaagttaaaaattgtatggatgtactaaatactccctaaaatgaaaggacacattattgttctaaaatgcatttaacatacatccacaatgggatgaacaaatgggttcttatttctatcagagtaggaactctttaataagttttaaatgaaaatgcccttattgaatatatatattcaaaacaaagtgtttacgtatactaaaccatccttgtttttcttttcttttgtttttagttgagacagagtctgtcaccttggttggagttcattggtgcaatgatcgctcactgcaacctcaaattcctggactcaagtgatcctcccatctcagcctcctgcataggtgggactacatgtacccaccaccacacccagctaattaaaaaaaaaatttttttttgtagatgcagagtctcaccctatcaaccaggctggagtgcagtgttgcaattataactcactgcagcctcaaacacctgagctcaagccatgagctcctctgcagcctcccaagtagctggaaatacagataccatgcccagctaatttttatcttttgtagagacaggagtcacactatgttgactatattggttttaaactacagctcaagctatccttccatctcagcctcccaaagtgctaggattacaggtgtgagccactatgccctgaaacttttatgaaactaaaagtttcatagtatgaatgacagattctttaagaatctgataaaaagggaacatcacatttttaatctcttgcatacttttaaaaatatgtcaacagagaaaataaaagattggatatttatatcagaaaaactaatcgtggccaggagtgaggcagaggtggtggggccggccagtcatcagagccaactcaggaggcgggacattgacacgaagggaggactttggcttgatctctatggaaatgggaaggaaagccttggtcttattagcggcagataaccaactgagataatcaaccaacagtggggtaagaaattcaacagtgaagtaaaacaaaaaagtgcatgccatagaagtcaccacacagccagagttggcggcgctgcttgaacacctcagagtaagaaggaaacccttgtcaaataaatgctaggatgctatcctctcaggtcttgacttttactgtactagcttctgttcttatcctctttccctcctaacatcagactggggaaagaggaatcatggaagacgggatcccttagtgcaagagcggaaggtgtcaccatctcccctcagttctctctgcccaccacatctaggggagtggcaatttcttgagtgccaccaccagtgccttgcacaggcagggaggcactcacagtctttgttgggtttgtggaatggatcctgtgacctacagacagtgatggggtgcaatgggtgctatcctgtatggaagtagagcggtagatggcccagtccttgtctggaggcattcatgatgcagttgagaagacaaaaaatgcactccagcaggggcccactgtggacaaggcttcatgccaagtgagggaacccagaaaagtatgtgaatgatgaccagtgtgagggtggcccagaaatggaaaaggaaggaaatatcatgggaatgatttgcttacattataagtatctaagggcaaacttgtacaatgattctaagatagtgacaattactgctcgaaagaaaagcacgtatcacttttgagatatatgccttcttgtaacacatctcaaaatgccaagaaaactacacacaagcctagagacaagtcagtagatactaaagagacagagccatattaaaacaggttgtgagggtagcagctatggcaggagctgagggggtaaaggaagcccatccagagagccgaatcttccaggttacggaagtgtagagccaggaagccccccggggccttccaaagacccacagcatgccgccagcctttgggtacctgctacatgggagcacccacaagccaacagagtaaggctgtggcacagcatcaacatcgtgaaaggactgcagatgtgagcaggcagctgagagacactgatcccttcttcttcccctcctccctacttgacacactgaaagagcgtaagaaagggtggagtggaagagagaagctgtgaaccagaatgagatttaaactatgcagacctacttttttaaaacggcaaatttctacaatctgccctagatgttgttggacagaaaaagggattagacatagcaccattgaaagtgctgattaggggccaggcacggcggctcacgtctgtaatcccagcactctgggaggccaaggagggtggatatcttgaggtcaggagtttgagatcagcctgaccaacatggcgaaaccccatctctactaaaaatacaaaatttagccaggcgtggtagtgggtgcctgtagtcccaactactcgggaggctgaggcaggagaatcgcttgaacccgggaggtggaggttgcagtgaaccaagatcacgccagtgcactccagcctgagcgacagagccagactccatctcacaaaaaaaaaaaaaagtgctgattttagggaccaagaagtgaacccattccatgtttatgcccccagtatgttgcaatttcccaattaactgcttcctgagaggtcagtgatgtaagagaggcgtatatacacgcagtatccattcatacaaacaaagaattgatttgaaaagattcaaatagtttcagggtaggataaaaacagcgacattcacagggggattcttattgtgccctggattgaaccaagttcattatcttaatctatttcaccctcccaacaagaattgcattatccccatttctcaaatgaagaaaccaagactttaagagactttgagagctaaggagtctgaagtcctactgtttgtaagtgtctagtaagtggctgtctgccctcaacctcctcttattgcttgtcctaagccaggattcattaaatcagtctagttttactttccattacctgattttataaatgtttaaacttagtcccagagaaattaaaagacttgactaaagtctttagtattcagtagcagaggagagatttctaacataaaaagatcttccaagttttactacagggcttgtaataaaaccattacaaagaaaaagaattattgcaaacttgcctaccaacatgtgataagcacttttgttctgagccgtgattgtccttaccttaagagaaacatagtacaaaaaaggtgactggctctggctgtcctcttatcgagagtgggcaatggaggggctttgtacaattcttgcattctcagcatctagcatagtgcctggcaaacagtcattactcaataaatgtttgctgaatgaatattatatataactcaatattccctggacacaaaaaaatagctcttttcccccttcacattgtggagagaacactaatgaacagattgactttgttttttctgccaactcacatcattccaagttttatttgcgtttgtaatacagatgcatacaagtggactcatcatccatcatctcgtctgagctaaccaccatgacatcattaccaatccccagataccaaggccagatcttctagatcagtctctctacatatgtgtattgctttttcctttgcattacttatttcctttttgtactatagctgatattccaggagctgactcctggaccctctttgcccccagtgactttcaaggtgcaagattctgttgcctctcttttgctgatagatgttgctgaaaggcctgtgtggaaacttacaaaatcaaatgagttttcttctcctccccttctgttaaattctaactcaccatccctcacccatacctgaagcccagctctctcccgcaggcagtctctgccagccaggccaggcctgagcttgttctctgcgtgtctgaagcagggagtcctaaaaggaaatattgctctcattccaaagttgcttcatcttcatgggcaaagaaaaaaaaaaaagcagaggaaggtaaatgcagcaactctgagaaattcttagttgattatttactgttgcttaaccttcaaaagattccactgtagaaagggagggccggtattcatacagttcctagcccaggtaacttctctttcctagacctgctagtccagttagcttgagctcatttgcaaggaggccaattctgtgacccctttcgtttcccagaatgcctcacagtggacactcaaagcagtcgacttgctaacaaggctaaaggagttaggttttacatcattcctgaattattgatgtgctttgcaaattagcttttcctgtgcacatgactctccttagctaatctttacaacatataagacagttgtcaaaactgttttgaaatatgattctggggtttcagagtaccgtttcacgggacttgagttttcagaacaaatctctgtgcagagataggaactattctgcttaataagtattattattattaattatctgaagcaattactcaaaatacctaaatgcaatttgcaaagtagtcaggtaataacaccatgtagaagttcatgttaagagctaccatttcaatgaatgtagggaacactatccacttttctcagagtccttagaaaaatatagtaagtgaaaataaaggccgggcatggtggttcatgcctgcaatccaggcactttgggaggccgaggcgggcggccttatttgaggtcaggagtttgagaccagcctggccaacatggtgaaaccccacctctattaaaaatacaaaaattagggctgggtgcagtggctcatgcctgtaatcccagcactttgggaggccgaggcgggcggatcacttgaggtcaggaattcgagaccagccaggctaacatggtgaaaccctgtctccaccaaaaatacaaaaaaattagccaggcatggtggtacacacctgtaatcccagctactcgggaggctgaggcagaattgcttgaagctgggaggtggaggttgcagtgagccaagatcacaccactgcactccagcctgggcaacagagcaagactccatctcaaaaaaaaataaataaaaaaaaaagtagaatggtttattacacataagaggcaaaggcaaaatgacacatggtatacagactgaaccaaaatatcaaaaataacaatgcactcttttctttttttcatccaacaagaagccataactttatttatgatagaagcagtacaaatttcaaaccaagctgcagtcactcatttgagacaccaataaaagttgctttcagatggttacactgttaattccataatagcatttacaatattattactttgttcttccaggctccaactgcctttgctctggacacattcccttgtgacatgaccaattctatgtccttaacttctacacctgtttcatcaacctcatcctcttcactctccttttgtacagttggagtctgtgtgttttcttgaacatttaagacagcttcaccctgaactttgaatttcgcagcagttgctacttgtgcttgctgagataaatcttcaatcttggcttctgccaaaacgatataggtatccgaagcagggctcttgtagacatctggtttcgcgatgacaaagaggatattcttagatttccagatagtgactctagtaacccctataacctgtcaaagacccagtttggacatagccttctgtgccttcttttcactccaactctgttgtgctttactgactggttcttcatcaatttcagctgctgccaccacaatgcaccctttattatggctataccagttaggaagagcaattggatgcaaatcacagagatacctcaagcagctaaagaaaatcaatggttactatcacacataagaaagtctgaaggtatgcagtcctctgtcttttgtatctgccatccttaacctcatgacccaagaaggaggctggagccctaggcatcacatccatatcccagaaaagaaaatgggaaaaaggacaaaaggggtaggccaggcaaggtggctcatgcctgtaatcccagcactttgggaggccaatgtgggtggatcatttgaggccaggagtttgagaccagcctggccaacaatggcaaaaccctgtctctactaaaaatacaaaaattagccaggtgtggtggtgcacacctgtaatccctgctactcaggaggtcaaggcaggagaattgcttgaacccaggaggcggagcttgcagtgagccaagatggcaccagtgcactccagtctgggtgacacaatgagactctatctcaacaacaacgacaacaacaataaaatgttcattattgactgaaattctaatttaactaagtgttccttatttgatctggcaaccctgaccacccaacatctcctgggatttcattagtcacccctactgtgaaggaagatggaaaatgtagccttttagccaggcactttcccacgctgcttattctaccaaggaagacatggagagtgaatactgggtaaggagccaacagtctttgcaggagtgagggtggttctgggaaaaagtgacagagctacatccatgccccatgccctctgtgaagaatttcttgactgcatcagcctcttgtggtcactgtgacctctgaaagcctatggccctttttgtcttagttctattaatagatacaaagtaaagattactgatttttaattaacatgtaagaactgatgtattcaggtggctactgtcttcttcaaagggttaaacacacaatattgccactcttaaaaacacttttagaacttagagctggtagaagcagaagtctccctttacaaggcatacgggaagctgcaggctgtaggcagggccagggatgcgttggaaatttgctaactctgagtgcttcaacaaattgcattctatgtcaaactcatgccattcctcgtagaaagaccaatttcaaatgtcctcactcatatggggaagccaaaaattataacaactgaactcatggagatagagagtagaatgatggttaccagaggctgggaagcgtagcagggagcaaggggaaaaatgggaatggttaatgagtgcaaaaatatagttaaataagatctagtatttgacagcacaacagggcaacaacagtcagcaataatttactgtatattttaaaattgctagactgtatatgtggctcacgcttgtaatcccagcacttcggaaggccgaggtaggaggatcacttgagcccaggagttcgagaccagtttgggcaccatagggagacctcttctcttggaaagactcaaaaattagccaggcatggtggtgcatcagcctcttgtggtcactgtggcctctgaaagcctatgaccctttttgtcttagttctattaatagaactgcatgggaggctgaggccagagaatcacttgagcccaggaagtcaaggctgcggtgagcagtgatcttgccactgccctccagcctgggcaacagagcgagaccctgcctctcaaaaacaaacaaaaatgaaactaaaagagtagaactggaatgttcctaacaaaaagacataataagtgcttgaggtgatggacaccccaattagcatgatgtgatcattatacaccacatgcctatatcagaacatcacatgtacccctgccatgaatacatacatgtattatgtacccataataatcaaaaattaaaaataaaaacttacactatttctccccagaaccttctcctacctttgtaggaatataggattatcttccaggatgtcaatagctctggccagtggggaccagactgatgagaagcagctggtttaggaaactgatgttggaaagctcatggcctctcataactcagtcatctgtggcctgatcaatgtcactaaagcatggtttgtactctgtggtatgtcctagaataaaggtagggaacaatggaggaaaacaggcctgaattaaaatgttctccatgtctctctcgaaaaattccaacttggaagtcccttttgcctgatagtgactgcttacagttcctacccaatgtaaactacagttccatgtttttccccctggctcttaactggctgaacttgggatgttttataagtgtctgtctgtacttcctatgacagccaatcacatccaacctatcctcaggtcccttccccaaattaactctgtggtccactgacttccaaaagtagggtcaaaattatttttctaagattaagccttaataacgtcacttatatgtttcatcttttcctggatggctactgggcaaaaatatcttcatgcaggtgctgataacagtaaacacatcatatatcttcagcctggggtttaaacacattcatttctgggtttgtcatatgttctctcgctatttatactgctttgggtcagctacttgatacttaataaaatttgcctccaagctgtcctgcagggaaaatgacctatctggggggaatgctgttccaactctataacctctgatgattgcccaatagtcctccaaaaaggttgcagggcaggagcaagggaaggtccatgccacttcctggcatttaatggcaacaagtgctttagtgtaagtataattatatcccctgctttcaggaggcctttccagccaacctctcggacacgggagcaactgtagatggcatgagcaatgtggaaattcggcttctgctcaaggtcagaacaagccgttcaccagcgttgattttaccaacctttcggttattttggaaagccgaaagagaacgcaacagaggcaagaatggatctatgggatggaaataaggagccatttataacccaaaatgagactgccaggaaaaacaaacacacagaaaagtacattttatcagaggcttgggctgcccagggctattggggtacaaagtactgcgtgttcagctccctgggccaagagctacagtaagtcaggcccccctgcaaagctcctctcctgtcagccccatcaagcagccttagccacctggcggagacaagctttagtgtttttaaagtgtgtgctgcgtgaatgtttcacatttttggtaaagatgtggggtcatgttgcaacacttaagtgcttctgcgtaaaccttgcgcaattccgacaggcactgggttcctagcatcagtggcatcctctgctcacatacggcttatgtaatgtgtgatcaggccccccaggtttctccttgtagcctttgaaaaaaatttcaggctctgaacttggccctggtttccggcagttctttgctccgaaggtgcgtggaatggctcagctgtcagcacctgctggtgagatacagaaaagtgccacgggttgatctttctctggcaccagtacacaggaggctggcgatgctccccagatgggcttggcccgccctgaggcaccctatagggaaggagagtgagggcggttcatctaaggaagagtaggtcggaggattgaacgggggctgctaccaataggtaacaaacatgaaaaggatttccccaaagcaaaactttctagccagagcagcagcacagtgaatggtttactcacagctcctttgtctgctgatgggagatttggcactgtgcttgcctcttgggcttacctgagcaaagttacacagtaggtcaagtgtttgatgccttctcacctccagtcactgtgctggcgcccgcctccgtgcctggcttctgtttccatccagacttccatccattcaacaaagctttcgagcacctgctctatgccaggtgctgtgccaagtgctgggcaccaggcagggctttctcaacacctggtggccccctgtggtgcgctggaccagtcctaacacaggcctcctctccagtgtcactctcggccccaccatttcccaaaattatccctccctgcattcacttcctatgactcttgtcctttcttcaaccttagggatgggactatttctttacagtttttatcatagaaatccaacaaattttatttttataaaagaattgttcttggtagtcacagatttctctctgtggaatctgagtttctgcagattaaaaagtgatgatgtgagctgggcgctgcaggtggtgcctgtaatcccagctacttgggaggctgaagcaggaggatcacttgagcccaggagttcgagaccagcctgggtaacagagagacccccccatctctaaaacattaattaattaatgctaattaattatttcaaaaatggtggcatgaagaaacaatgtcttccatggaatgaacaaggcattaattgaaaaatgtgaagcaggaaggaacaggggaggaatacattgtctgagcagaatctacaatttcaccaggtagacaagttgcccctttcacctctccatttattattggtgagctgtatgtgtaatggttaaggaggcaaattctggagctggactacctggggattcaaatcccagctctgaaggttataatctaagaaagctattgttatttgttccttaatttcttcatgcaaaaagagggatggtagaaatacctaagcacatctcacagagtggcttagggattaacataaattaatatgtatgacatttttataacaccgggatgcacagtaagcactctctatataaatattaactttgatttttcgtgaaggcaactctaggctttctactttgcagtcagattctcatggcagttactgcatgcgaaagacagaatttgttatttggcctgcagtttccacatctgcaaagtaggaagaaatgattgaataaagatgtgggggcggaggctgcgttctggtctgtgatctccacttgcttcgtgaccttggacaactcacttactctctctgcatcctggagattggacttgatctgaatttcccaaactcaggtcattcaaataacacttagagaatctttgccatattccagtccactttcctatactcagctactaacttgatgttttcctttagataatccttaaatcaattcactttcatatgtagcctcacaggaagcagtaatatccacgtatgcaagagtccgatatgctacagatttttgtttttcctttatttatttatttattgtgatagcgtcttgctatgttgtccaggctggccttgaatccctgcctgggctcaagcaattctcccgagtagttgggactacagttgtgtgccaccacagagggcatgatacactgtcgatttttctaatgcatgttaaaataaatgcctaatgaaagttttaaatgtttgtataatgcccaaatcatcttgcatcctatcaatgagatgaggacaacatttctggaaactctggatcaaatgttccctctggatccaggcaactgtaaaatctataatgttataccatgttcaggtggctatttaacttagggtatgtttctttataccatttgcctccttgagagctcagactgtggcttaaacctctttgggcacgtagcaaatagaagagtgcttgataaatctgtatttaatgttaaattaaaagcacaccatacatacatacaaatatatccatcgcctactcacccccagaccccatccactgccaaaatgctcatttctttctctccacctcagtgtcactgtgttcctcaagtggctgtctgtaaatgaactgaagcatgtggcgttccaggccttgtgtgggcactcaggaaatgttaccttccctgacccctttccctcttcctgtgcctctttgttcatgagttgccatttgtctgtgtgaaaagtgggccgacttcccaaggagtttatagcccaagctcttgggtcagaataattgttgtcttcaatttcagccctaaaagaggttccattgccaggtgcagaaacttctaatctaagaaaaaaagaaagtatacttctaaaagctattattaaagagatcttgaaaaactgtctggtgatttcctaaaattcatcagcaaaaattgaatacacacccacagtatcatgaccccattgtgggttcacggtctgagaatttcacaaccaaccagcatttactaagcatctgcttgagccctctctgtccataaccttgggagacacaaatctgaataaggctatctattagaccatgagactagaagagactaaaagactgaataccttgaaagcaaggaatatgtcttcatctttgcctccccaagggcttagcaaagcatcatgcatgtggtagttatgcattaaatatttgatccgtaaatgaacaaatggatgaatgacactgctccagcactgaaggagcttacagtctgtttgagaagaaagaagccatagataaacgatgggttaattaacaataaactccacattacaagagataacactggctaataaaaacgttaaatgaaaggggtgctgtcatttactttcccccaaaacaccaaatgttgattcagccgcaggtctcaaaaaagaatgtgtgttggccactcttctgtactttcatttttctgcacatgagtccaactttagaaggaagttgctaggttgttgtcatgtgactgatttttatttaattaattaatttatttatttatttttgggacggagtcttgctctgtcacccaggatggagcgcaatggcacaatcttggctcactgcaacctatgcctcctgagttcaagcaactctcctgcctcagcctcctcagtagctgggattacaagcattgccaccatgcccagctaatttttgtagtttcagtagagacagggtttcaccatgttgaccaggctggtctcgaactcctgacctcgtgatccacccgcctgggcctcccaaagtgctgggattacaggtgtgagccaccgcacccggtccatgtcagtgatttctaaaggccaccaaccttgctggctcctgggaatgagcagggtattatttaatgtaaataaatcagcgagtgtttatccttccatgcattcttctgccatccacaggcaaagagagaagtggcactggtgacttttttagagctatgaagttggaatatacaagagaagctgaaagctttcaattaatgatttcttaggctttaagtcagggtgacccttcaacataaaagggctttagccaccacttgctggggagaagcgctgggctttctacacagttctctgggactccaaattgttagcataaaaatagcagcccaaatcaatgttctctattattcattagttaccgaaatacttttcccaaatatacgcatagctgaaagatgccttctttcaaaatgttttaaaccactttcagcccatgaatcttagtccatctttaaagggcacccattttttttcaaaccatatatttcagtcgatttcattgggcactgataccatcaccagcaaaaccctaattaattgggaagaatgacatttccattaaaattctttttgaaaaatgatttatgcacctggctgataaaaatttcaaacagggcaaaacaatatggagtggaaagtaaacttccatcgacctctggaacccagtctcccaatctttttcatagaaacatccagtgttaaatttctggggtatcctcctagaaatactctgtgtatatataagtgcatacacacaaaagaggtctttaaaaagtttatggaaaatgcatattatgaaaaaactatgcatggattttcatttttcttgcaccaaaataaactcatactaacctgttataacatgtctgaacagaatctagttgaggcagtaagaaggataagacttcagtttgaaaagcgcctctgtcagagcaacatgaattctgctaaaattgaagcaagaacaaacttcaaatctagggtgaagtttgcatggaagaacagtgaaatcattgaaactgtacaaaaagtgtgtggggacactgccccaaagaaatcaacagtttacacatggctaattccttttaagaagagatgagacgatgtttaagatgaagcccacagcagcagaccattcgcatacattttggaggaaaaagttagtattgttggctcatgcgtataatcccaacactttgggaggccaaggtgcgaggatcacttgagcccaggagtttgaaaccaacctgggcaacatagtgagacccccatctctacaaaaaatttaaaaattagccgagtgtggtggcacaggcccgtagtcccagttacttgggaggctgaggtgggaggatcacctgagcctcagaggtcagcctgcagagaaccactattgtgctactgctctccaacctgggcaacagaacaagaccctgtctcaaaataataataataataatattgtttgtgccccaattaaagaggactgacagttaggaacataaacctaattataaacataataagcataagtctaattatagccaacaccatagacatctcaattggttcagcttacacaattctgaatgacaaattaaagttgaacaaacttttcactggataggtaacaaaaccactgcactcagatcagctgcagacaagagcagagctttcaatggaatttttaaagaagtgggatcgagatcctgaagcatttcatttaaggattgtaataggagatgaaacacggcattaccagtatgatcctgaagatgaagcccaatcagagcaatggctaccaggaggtggaaagggttcagtcaaagaaaaagcagactggtcaagagcaaaggtcatggtaacaatttttgaagattctcaaagcattttgctgttgactttctggaaggccaaagaatgataacatctgcttcttatgagggtgttttgagaaagccaaaactttagcagaaaaaatccaaggaaagcttcaccggagagtccttctccaccgtgacaatactcctgttcattcgtctcatcaaacgaggacgattttgtgagtttcagtgggaaatccttagacatccaacgtacaatcctgatttgactccttctgactttttgttttctaatcttaagaaatatttaaagaatacccatttttcttcagttaataaggtaaaaaagattacattgatatggttaaattcccaggaccctcagttctttagggatgcactaaatggccatcactgcttacaaaagtgtcttgaacttgatggagcttatgttgagaaataattttatatttttatttttatcttttaattttttccataaactttttgaagtcccctaatgcagcagtcaccaacgtttttgtcaccagggaccagtttcgtggaacaccatttttccacggaccagcatgggtggagggcagttttgggatgaaactgttccacctcagatcatcaggcattaattagattctcataaggagtgcacaacctggacccctcacatgggcagttcccaacagggttcacactcccataagaatctaatgcccgctaatctgacaggaggcagagctcattcgcttacctattaccttctgctgtacggcctggttcttaataggccatggaccagtaccagtctgctgcctggggattggggccccctgccctagtgtgtgtgtgtgtgtgtgtgtgtgcgcgtgtgtgtgtgtgtgtgtgtgtgtgtgtattgtgtgtgtgtattcccctccccttccttacatatactctaacattcttcagtgaaacttaacagatattgtgaagtttgctgcaaatctgtacagctgcactatatttcataatatgagtgtcccataatttacccagcctcttctgaatagacataatggtggttttcagttttttacttccacaaacatacttttgcacatatgtatgactaggactacagaatcaattccttaaagtggaattacagaatcagaggatatgtgagttttcattctgatagacattgccaaatggtgacacttaacttttgatgagaactgccaaaagtaaagtatttgttcgtgccagaaacagagtgaagatagcattttattttaaagtttaatacctcaggcaagcaagtagcacatttattcatgaaactcatttgcccctgtcttgcccacctaaagcacatacacattgttatgaacccattcaaaatatacttgtgacaacagcttactcaatgaggaacttgctagaaatttcgtatcaccaaattgtgtgagtatttgtcgcaatggggttagcttgcacgctctctactttgccctggctgtgtttactacctttcatggccctggtcagttagtaacactgtcttgtttttcttttgtaaccaaaggtcagtttgtgaccctgctccactccccacctcctctgccttagtttcttcttgccttagtttcctcataagagtaaccagtcttaaagtgtcagggcaggcacattactgatgtatcagtgaagagcccctgggcacaatggaacttgaatttgattttctattacctgtgagggtgagttagtaagcagacagccttgtactctgttcagcggcttcccttgctgcctttctataatgaaaaaagcagagacccagaacattctcccgtttctctagtgtttacccaacacacactctgtgctaccatccccatttgtggcttctttcctatttgctcttgtaacatgagaaacagtgtggaggttttatgcttgttttgtaaccagctataaccatttccttttctctgcctctgattataaacacatttccttcctggtaaccattgaaaatctatatctgaccaggttgaaaccaaatgaagtcattttggttccattggtgacaaccaattaaatataattctgtttacatttagaatgggttgtaaatttaagaaaatgatttaagccctacttaaaatattttttggctcataaaaccatgaaatcatttctgtaatatgagtaatcaagaagcttcatatttacatttacctttaaattgctctaaaagagccagagactggacattaaaaacaaacaaacaaaagattcagagtctgcaaggaagctatttcactatccccatgctgcgagctggttaagctctttagctcagatagccctattttctcagggagcaatggaaaaaacagatctcctacttaaaaataacagtaaaaacaagaaacacactgcactatattggtaaacctcaaactcacgtaagtcagttacctgccccgatgggagtttagaagttggtgctactactcttagtactgccataagatgtcaccagaaaacaggaccctgagttctaggaaaagggataagaatggacaacaggtgggagccaccaaactattccaggccggatgacagaaaccttaaaagaaaagttccaaatacaattaactgaccaaacccctccacacagtggagaggcttcataatcaataaagacaacttcccacctctgagcacttacaacaaagatgcagatgtatctttggcagtggacttttttttattgagttctatctccttttcttcacaagcatgtattaagcaagttttatgtgttatactttcactgggtgttgtgcaaagactaaaaagtcatcagctctgccccatagtgggtggttgttaaatgttgttaaatgaatggatctgtgaatatatgcatgtgtgaatgaatgaataaataaagcttataatatggttatgggagaaaacacagctttaattttctgttacttgtcagggtggtgtgtacagaacacagtggtatgcgtgaccagttctacccagggtagtgtggcaagatctcagacttgaggtgacaattgaatgggcgttggtcagatgaaaggagtttaacgtagacaagtaaaagaccacagaatgagcaaaagcctaaagcagagatcaacaaactacagcctgtggaccaaatcccatctgctgcctgtttttgtaaataaagttttatttgggcagagccatgctcatgcatttatattttttccatggctgctttcacactacaatagcagcattgagtagttgcaacagagaccacatgacccaggaaaccaaaaatattaactatctggccgtttacaagtaaatgtctgccgccctctggcctagagatatgaaagagctgaatattcaggaacctgtagggaagtcgtaatagctgaaacttgtagtccaaaaaggggctcagtgagagaagagacaaaacggtgatcagaggccaaccctgaaggttcttctgtgccatattaagaaattcagttttgccatcgcatgttctcactcataggtgggaaatgaacaatgagaacacttcgacacaggaagggggacatcacacaccggggcctgttctggggtgggggaagtggggagggatagcattaggagatatacctaatgtaaatgacgagttaatgggtgcagcacaccaacatggcacatatatgcatatgtaacaaacctgcatgttgtgcacgtgtaccctagaacttaaagtataataatacagaaaaaaaagaaattcagttttgctcctttaggaaatgggtaacaagagcaattttgcttttagaaatatctctcagggatcaggatagacgagagagatgcaagtttgcagcaggagatcagctctccaaacttcacatcttataaattccttgattcaacaaacattgaaaagcttaatgctgtcattatgcctcttgctctatccttgggaaacagaacctggcacacagacatgcccaatcaatatttattgaataaaggaattaaggaaagaaaaaagacaatattgtaatggcatcattattaaatggttttctgaataggctgcctctgctatgagacaaatagctgagattctcacagatttccagtttccatactagcaggcattgagatccaggcaaaaggaggttaatagtgaaacacaagccagagagaaattcctccccttcatctctggtgccaacatcatcaaataccagtcactggccaaacctgtgtttattccatgccctgtggcctaatgagaggggatgggacaagaagcagctctgctaataactgtcatgaaaataataatatcacttggctgtatgcggcaactttcattggaagctcttgaatcaattttttcctcttgcataactattatttccattttatttccactaaaggagaagccaaaccacagagtggttgtgacttgcccaaggtcatggagcaaatcagaagagcagtttttaaaagctgagaaggatatcaggggatgtaaaatccagttgccttcccagcctagaatgggctgggttcatgactcagtaagacacatggcgttacctaagctcagtgtctctgaaaatgagtcacactaagggagactcagggcctgaggggctgtgtcagacatacgttttcagtagtcactcattgtccctgcccatcagattttaacgtctgtcaccgaagcccatcacagacagggcctcttgggaggtttagcctatggaactgggaaggtctgccttgggggtgtctgtcttttctggatgtttacccagctgtcagttcctatgaagcccaggtctccccattccattatccatcaggagcccatggctggggtagctgtggcttccactcggtccatgatgattctggtgtttgcctgttgtcccagcataattactaataaatcttttttttactctaaaaaaatgccccagtttggaccataaattaattatatggtcactctaactgacaaatcaggaagcacctatgcagaaaccaaaagccctcttttcatcatgatgattctatctcagccacttttgtttcatggacctagaatcttgaacttacaataggcccaaactcccagtcagttaaggaatctcctctgagctatgtaaatgctcctggtcatagagttagctacacagcccatagaccagttaattactaattgtgaataatcacttccttaccttgtaccaaaatctgccttccatatcttttatacaatgatcttagcactattctcaagaagctgaaaagtcaattctccctcctgtcccataagagagcccccttaagtcctccgttgtacagcccaaacaccaccaaccatcaggaacaaattctaaacagcatttaggaatgtagctttggagtcagacatacctggattcggatctgggctccatcactccctagctagatagcctttggtaaatacttaacttctccaatttcactttctttgtctgtaaattttgaacaaacattaactacttaagctaggcatgactggttatggaaccaatagctagttctcctttctttcttactaacaaggggctcacttaaatgctcttggattacccaacttccttgcagctagatgtggtcatgcaacacagttctggacaaggagctgcaagtggaggtaccagctggagtttctgagaaagcctgttagagggcacacatccagcttgcattcaccttgtcagtttgtgctacttagcttctcccttctttcaaatacttcctgcctaaaaattagttgtgaagcacaaaatagaacagctatgctgcatacatgaggaagcaagcctccagcaaaagagactgggttcttgatggcaccatggggcctgcatactcactctgaagtgcttacagctggacttcctattacatgagaaaaataaatccctccattggttaaaccattgaaattgggtttctgccacttgcagtcaaatgaatcctaaatgacacatacttcagaaggttgttttgaacataaaatgaacttactacagtgcccagcacaaaacatatagtgaatggtttgctattatcactatcataattattatcattgctactcattgccatagaccttagagagaggggcaagaacatgtagctatagcaatccttccaacctctgatagcaccagtacaaaaatatctgtgatctcttaagcacacacaaaaaagtcagttgctgatgttttgacaagtgcatctctgttagtggctaatgaagccagttcttcaaagcaccagatcccgagagcacaaagaaatgaaattccacctggctggcaggtcagggagcaagttctttcctgtagtgaagggtgcgcctggtttcctctctggacaggggatccatccatattgtatagtgcatttcctggaagtgctgtcttctctgaacgacaagcaaagcacaacaccttaaggatgtcattatttcatggaaagagagtttctgctcagaaaccaaagccacacctaaaaccagctgagcataggagcacatgttcaaatggagcactgggaagtggaattagctttctataacctcactgaagcatctgccaagatcagacaaggatgggactagctatacattcttccctggagtccatcaagccacagatttgggttcacgggggcctatcatggtattcatcccacctccacctactccctactgcactctgcagatataaagagtggtgaagtgggaaaaaaaaaaaaaaaaacaacaagacaaaacaaaacatcataaatttcagagttcaacagacctagggttcaaattccagtgggtcacttctaaactgggtacctttggacagaccatttgccctttctgagctgcagtttttgtatctgtaaaacagataagagtttcacaagtttgcagaggattgaaggagaaagtctgtgtggcagtacctggtacagggttatcatgagtccttctttccctatcagcaggatggtcttggctgactttttgtattcatcacccaagcccaaggagtggacccagctcaggtcactgccaccaagggcagctcgtttgttgccttctaccccgtgcatcatcatccaagtttttgggccacacttggggagccaaagccttctccaaagctgaggtcataaagcagaaaaagacaaagctctgctttcagagagcaggtttggttggcagtgagcaaaccacctctctatagccaatctgcccttgggtatgggagtgagtccccagtaaatccagcaaaaagtggctggcccgctcagccctcccacctaccacagccacgcgcaacacctggacaaagatctaaggcctgggaagcagctttgcccagcctctccatctccgggcacagcccccttggggcacagcctcaggcaggatggaatatgacagtcacaagattcacacctcaagccacaaaacatattcttctcccaacgtcacctggcaggtgtcatcgtagttggttttatagctacagtggcaaacacagtgttttcttcacctctgtgtcacaggaatggccactgttactctcctcacttttaaccactggagtatctagggacatttgtcaacagggtttgtggatattgagactgaccggatattcatacatacatttctctgtaactccataagctggcaacataagaccatgcagaaaccagaaatttggggtccatacataatggctccacacaaaatgtgttttgtcacagagtataagaatagataaactagtaatagcaaacaatgtgctaactgtactgcaggctctgtgctgagcatgtcactttctacaattattattatctccattttacaaaaaaaaaaatcccttgagtcttcttggtgtgttctagatattaattctttataggtttagatattataaatcttttctcactctgtcacctttttgttaactttgcttgttgtatctaccctttacagaatttttaatttttaaaatatagtcaactctatcaaattttcaacttatggccaggcatggtggctcatgcctgtaatcccaacaatttgggaagccgaggtgggcagatcatttaaggttaggagtttgagactagtctggccaacaaggtgaaaccctgtctctactaaaaattcaaaattacctggccattgtggcacaagtctgtaatcccagctactggggaggctgaggcaagagaatggcttgaacccagaaggcaaaggctgcagtgagatgagatggcatcactgcactccagcctggtcaacagagtgagactccatctcaaaagataataataacaataatttcaacttatggtttgtgtaatgagtaccttctttaacacctctgatattttagctttgtaattttacttttgcactgaattcctctttggcatatgcttgagatagtgaacgaatgagctgtttctccactaccaagtagtaggttttaggcaatccatcccttccccactgattgatggtgccatgtttatcccaaagcaggttcctatgtagactcaggtctggctctcactctttgctctttccctagatgtattttactatgttcttgttccatactgattttatatggaagggtgagttccttctctttgctcttctttttcaaaatgacttaggcatcatgaacatttattccttcatatgaattttagagtaagtatgttgaagtcctaaaaaaaagacttgtaataattttgtctgaaattacattgaatgtataggttaattgtgagggaaattaacatatttatatttcgaagatgtggtgtatatttctatgtattcagatctcttcaaagcaacaactgagttttaaatttttcttggtaagttctttgataggttatttcctacatactttagagtttgggaatcatatcttattttttaaaaaatatttttgagatggttttgataaagaataataattcttaggccaggcacagtggctgatgcctgtaatcccagcactttggaagactgaggttggaggatcacttgaggccaggagtttgaggccagcctgggtaacatagtaagaccctgtttctacaaaaaaaattaaaaattatccaggcatggtagtgggtacctgtagtcccagctatccaggaggctgaagtgggaggattgctttagcccaaaagttcaaggttgcagtgtgctgtgatctcaccacttcattccagcctaggcaactctgtctcaaaaaaaaaaaaaaagcaaaacaaacaaacagaaaaacaataacaattgtttaaaagtgatcaggtattcatcatctctgctgaagtctcttattctatttagtctattgattaaatatgctgatacaaccttttatttcttttttctctccttttccttttttcttatcttcctgtcttgcccagaaactgggtaagcgttatatatatatataagaagcacaaaaatacgcttacttcaaaaaatatataaatgtgcttactcaaaaaaatatatatatatgctaactccaaaagctaataacttatcgaacttctacttgaactttattcccaaagagatgaacatattgaaataacatgattaacccacaaagctgataaagtgtccattgacttaaatgttcctccttagttatgtgccaagcattgtgcctctgtgtaacagcagcacagaaatggcaatatacaaaacaattaacagttaactgttgctaaacagtaacaatgaaagcaggttgtgtctaaattttcttttaaatcccattgtgtgaccctttacaactttcaaataacttccatacccattacaccatttgtgtttcataaacacatattagtagggagaacaggtattggctcattttataattaacattcaatatggttgggttttggaggatcaaaaactagaaaggatcaaaattcatattcaggtctttaaagcttcaagttctctcactataacaagctgatttatatataaacaaaatatataaaactacgtgattcaattcagtaacactgaattttcatttaaatctcattccatcctgaaaaagatgatctgatatcatcctatcatttttaaagaaaactgtatcagctgatattaaacgtctaaacattttcaaggtgtaagagccagatgaccatatcaattagggttgtaattctactaagaatttgggtctataccatggcaaaacagtcagttaatttggtcagtttaggtaaacaggtcagttttgtgggagggagggaaattgggtaagaaatattcatcacattaattttactaacattgcaatacaactaaaaatgttatttggttgggcatatttaaacatttaaaagctgctgtaaagataatattgttacctcatttttataagaagaaaaaactaagtaaatccatttcttgggtgtgcaaaaatagcccaaggggaagtgacagacctgtgaacagaactcatgaattaaacctgagcttggtctaccagttctctgtaatcaagccccatgattcactcatggaaatcaatgcctcttaaactcactgaatgacagacacctcaacagacacacatctgtggattcccatagctcctttaaaagtaaccatcaggaagcaattagggagtgcatctgtctctaacagtcaaggtatttttccttccatttcttgcatcttctcttagggaatgtgtaacggatcgtcctctcttaatggtgctgttacttggaatatacaaagtatgctgacttgtgaaagggtcccaggcttaaacagcaggaaaacacaaataaagctgtattcaaagaagatgaatcaaagtatctcagaagaggaaaccagaaaattgtaatctttcttaaatgcagctttgtgagctgagtaataaaatacaataatgtaactaagcaggaggcttacataactgaaaaaatgaggggcaaggaactgttccaaatccattgtacttattagaacctctgatttcctttgaaatggcacatgcaataaaatttactgtgagctagctaacaaaaaaatctcatttttatgggaaataagtattgtcagaaaaacgaatagattctattttaaatcctgaagattataaaattgaggttttaatagatgaagaaaaaaaaaggctccagaacagaggcatcatggaggcagtgatttctatttaatcttttatctgtaagagaaaaaaaaatcacctcaattgaaactaatatagttttctgtggcagaatataccacgatagctaataatgcactggctgtctgtattaagtgaattttctttttgttaaaaaaaatcagtgcttgttaagcacatgaactgtgcaagtttatatctggccaactcctgtccccgcacctgttcattcaggcattagccctaaggacttacaaagcaaatgaatgtatccgtagagcaatgggtaaaaataaactgaactattcttttaacactatcaaaaatgatctgaccaaatagaagatcacatttcacgaggtaaaatagccaaatgagatgtttcctcacgttttatgattggtttggcttattcactgcgtatgaaatagctgaccttcattccaggagaatgagcagcaaccaaatttaatgctgtttgctcaggggttcaaatctggtttagctggtttaattgcctctgaggcaaagtttctaaatgtgctactgttacacagagacccaatgcttggcacataactaaggaggaacatttaagtcaatggacactatatcagctttgtgggttaatcatgttatttcagtgtgttcatctctttgggaataaagttcaagtagaagttcgataagttattagcttttgcagttagcatatatatatattttttgagtaagcacatatatatatttttgaagtaagcatatttttgtgcttcttatatatgtataatgcttattttatatatatataaaatatatattatatatataaattatacatatataaaatattctctataataagaagttcccggctgggtgcagtggctcacgcctgtaatctcagcactttgggaggccgaggcgtgtggatcacgaggtcagaagttcaagaccagcctgaccaacatggtgaaaccccatctctattaaaaatacaaaaattagccgggtgtggtggtgcacgcctgtaatcccaactactcgggaggctgaggcaggagaatcgcttgaacctgggaggcagaggttgcagtgagccaagatggtaccactgcactccagcctgggtgacagagtgagactcagtctcaaaaaaaaaaaaaaaaagaagaagaagaagaaattctccaggacagacaattataaaatcaactagtactgtcactccctggctcactattctttagccatattggcaatggattccttgaaaaacctagatgtggttgactgaatcattgttcacaatttttcacatctttcctatattagataatgtatccacattcatctacattcttccaaaataccatccgctatgggtaaaatattttccccatcccactgattttgggctgggccatgtggcctcctttagccaatgaagtgttcctgaacatgttaagaggccttaaatgtgcttgtgtgattccatttgggctcttgtgctcctgtcatgtgctatgtaagaaacatgttcctggaagctattggtcaacacagaatgagtaacacacaagggagacctgaaccctggagtccagccaagccccaccagttgcagctggctcacagacccatgtggaaggaataaatgcttattgtttcaaactagagttgtggatagttggttgtagcacactgctatagcaaaatgtcatctcagtgcctcagcacattcccttccctctaccagaaatcatcttccacgaccactctttgcctagttaattcctactcatgcttcagaattcagtttaaatgtcttgaccacaggacagatgtcacaaaccagattacctgccccttcacatcctgggtttcctattttgtgagattcatcacttttgcaatgttttgcttcatgtcattcaactagaatataagcttctttaagcggtgggaccacagtatatttttcattggtattattcttagcacacgacacacaatgctaatacaaagtagatttaataaatatttgttacctgatttttaaaaaaggccatgtggttctactacttaagagttagaaaagaaacttaatttgtatgagttttggttttcagcaactataacatgaacacaataatacctatctcctaaaacagtgaggattaaataaaccaaccattaaatttaatgaatttgaggaaagacttgtaagtatctgacacatgggtgcataaaaggcatttgacaactgacagcttttattatggttggaaagataaatatatttgccctctgtctaagaacttgatttattttaaagagatatttttgcaactcaaaaaagaaaaaaatcagattaggttgcaacttatgattatttaatttggacatttcaaagtatcctgtttacttcccaggctctgagtcccttttagaagcactttcaggtagaattcagctaagaagaaacaggttggcgattgatacttggtttatttcaaacatttgtcattaaatgactctatccttttaaaaaagaatgaaattcatttttgctatttatgtttatttctatttgtattccttcccaccatttttgctatttaaaattttttccctgcttaattaattttttagagttggcacttacttattttcaaaatgtttttcttcattcctacaaatagcttttggaataggattttatacaacctaaatcagtttttttcttttgccaaaaacaatatgtatccactacaaaaaaattagaaaatacaggtaagtgtaaggaaggaagatttaaatgtttgtaatcctgccacccagagatatccactgaacattcctccagatagtttgattcaaatgcatatatttaataatggtggaattatgttgtacatttgcccttttgaagttaatatttcatttaattaccacaattatctttctatgccaataaatattcatctacatcttttattagtagccttccatcataacatcatttacctgagcaattccctattgttggaaatttagtacattttacttttttcttttactgttatcagcagtatcttcatgaataagtgaagagataaaaatgagttactcaaacctttagaaaacaccacttaatggggtcttgcagttcagagcagaacagatcattatcccaactgtaatccaaccctttccttgcatttcttattgtgagtctaggaccatcattggaaaataatcaagtttggtaggtgggctaaactagaatcagagaatttgaggcaacactttcatttctggtctcaataatgaatgtgtaaaccagaacctacaaatcgactcatgatcaaaaatatcataacagaaagcaggaattctgaaatgggaataaaggaaagagaaggagacctacagaccactgttgctctccctatctgcggctaccacgtccatatttgttttgacaaacactcctttaccacaatcgggtctctggtatcataagcactgactttcccattttacagataaaggcactgaggcacacacagaggggctgacaacagtgtccacagtgccacagttagtagcacagccagggtctgagcctgtgtgttctgcctcacagacaagtgctcttttcatgctcacagagttctcagtaatactgggaattattcagaagagggaacaggacgcaatgcagcagggagattagcagaaacataattctcctgagagtcagcatggaggtatttgttagctactcaacactggtctaacatcctcggtaagaggatcataaatacctctatccacctccctagggcaatatgagcattattgcttatttagaaatttgtccctgtaagagctttgatattctcaaaggaaaggtgctgccaaaaagtgaaaatattttctatgcttccactatgcacgtgagagaaaggagatttggatcaggtaaaagaagtattgtcaggcacataaattctttatctaatcatattaggataatactcctgagctccttgaatggaggcatcatgagtacctgctgcgcttagcacataccttacaaaacactgaaaatcttactcaacacaatcagaactgctcattaatgagctcatcagtaatgtcagtcaagaaaaaaaaaaggggatacatttatgttgtaaatgtaatcagtcgacaggttcttcccgcctgatgcacagaagaaatcaattcactgacaccatggtatcggaataaaggatgagtttagttaatgcagggctgcccagtggaaggactggcgttatcactcaagttggtctcccagaaggctcagaggctaaggttgttcaaggatagtttggtgggccagggactagagaatgggtgttcctgactggttggggatgcaatcagaggaatgtgaaaaaattatcttcatgtgctaagtctgcctctgcgtgagggccacaggacaggttgagtcatgagtcacaagtccaggtggggttagtagattgccagaatgcaaaaccctgaaagacatctcaaaagaccaatcttaggttctacaataatgatgttatctataggagcaattggggaagtcataaatcttgtgacctctggccacatgactccttagcagtaagagatgatagaaactctgcctataccttagcagaatccaggccccttccataatcctaatcatgtggcttttcattagtcttgcaaaggcagtttcagcccctgaacaaggagaggatcagttttaggtaggtactattatgatccttgtttcaaagttaaactatacactaaattcctcccatggacagcttggcctacacctgggaatgaatgaggacagccagcctgtgaggctagaagcaagatggagtcagccatactagacttttctcactgttgtaatctttgcaaaggtggtttcataaacattgtattttattttattttttaatctttttaagatggagtcttgctctgtttcccaggctggagtgcagtggtgtgatctcagctcactgcgacctccatctcctgggttcaagtgattctcctgcctcagcctcccaagtagctggtatcacaggcatgcgtcatcacacccggctaattttttttgtattttttagtagaggtggagtttcaccatgttggccgggatggtcttgaactcctgacctcaggtgatctacccacctcagcctagcaaagtgctgcaattacaggagtgagccaccgcacctggcccataaacattatattttaaattaaataaatataaatgtatttaccaaactggtggaaggccatggttctttccctcactatagattcactggcaagggtccaataccaccttttctggcctaaaccacacccataagatctcatttttcatttccaacttttctttctttgtagggggtcagaacttaaagacactcatgagcaaaatactgtagagtttattatttttcctaatctcttactgttaactaatttaacattagtctttccaaagcattccatttaaatgtcattttaataattctctctctcttcaccctcatgttattaaagtaatattaaagtaaatagcataattttaataacaagtaaaaccagcacaaatatgtcagggaacaaacaattctgattctcataaagcacaaaactcaactcctcaaagaagaaagggatcagtgaggacagatggacagctctgttcagtgtgttttgagcaccagcccaagccttacagagggaatggatgctggttccctctatgaatctcttaagtagaagttggtttaaagagtgcccaccatagttttttttttaaattagttaattattaatattaaacagtgtatttgtggacaatgacaggtgacagtcccaggtaggagtttaaatcatatgtatccattcatactcaaagttttaaaatcccatcctccctacccaaataaatttccagagtctgtcaacttgcctgtctacataatagatatgaattcacattatcctgctcgtaggaccataaaagacccagttactcaccagggaagcctcttaagatgagagggaagagctagaagagcaaattaaatctcaacttttattttcttcctactacttacaaacattgtaagctttcttattatttcttattttctgtctcccaactttggaaggtaagttctgcgagaggaaggatttcatctccctcacctacctctgtattcttggcacacttagaagagtgcctggcacagagaagttacataataaatgtttgttaagtgaatgattgatttaatccaggtaaacacaacatggatgtttgctacacaaatttgatcccacttaatggttaactttttgtttttccattttttaaataaatttctacactgttagaaatttttcaaatttcttggcaaaaatataccatgcaaaaggctagccagattttaatcttgtctaaatcaggtcagaaaaatcacttttattccagaaaacacaaagggcaaagtacaatggccagagctgtataacagctacactcaccaggtgtgcaaagcgatttaatattgtcattcagactcagccctaatgagcaatcttgtttatctacaaaactgtgaacaacccactgctaacaaccggacattgtccccaagcccagcacacttcatgtcaactctcgatgcacccacaatctaggaccgttattagaacttctaataaggaccatgatagaactgctgagaaataaagaaaaaaatggatttcatgcacgtgctttaaaactttatgtttagttattttaagcatatgttttgttctggtacacttagatttgcaactgaaaagagaaaggcatatcagaaagaagttttttgttaaagcagactgatgaagaaaccaatgctagatggaaagcacaactcattttaagttaccggagaaagcaacagaaagtttctccaaaagaaagaaaaaataaagaaagaagcagccaattggagagttacttatttttattatgccaattaaaaagatagtcaaggggccaggcacggtgggtcactcctgtaatcccagcacttttcaaggcagaggtgggtggatcatttgaagtcagaagttcaagaccagcctggccaacatggtgaaaccctgtgtctactaaagatacaaaaattagacgggcgtggtggtgggtgcctgtattcccagctacttgggaggctgaggcagttgaacctgggaggcggaggttgcagtgagccaagattgcaccactgcactccagcctgggcgacagagtgagacttcaactcaaaaaaaaaaaaaaaaaaaaagtcaagggcttcatgccacgtctttttttttttttttttttttgagacagagtctcactgtgttgcccaggttggagtacagtggctcagtcttggctcactgcaatctctgcctcccaggttcaagtgatcagcctcctgaatagctgggactacagacgtgtgccaccatgcccaacaaatttttgtatttttagtagagatgaggtttcaccatattggccaggctagtctcgaactcctgacctcaagtgatccgcccacctcggcctcccaaagtgttgtgattacaggtgtgagccaccatgcctggccccacatgtctccacagagtgaacatgaccacgatctttcttcaagcatcacctttgatagcctttcaatatagagttatgggctttacttcaaacattaactcgtcttccacattcagttatcaaagccattgaatacaacctttaaaacattttgcaagttcagcacttcttctccatcccattgatactgattcagactctgctcctcattgcaatgagctgttataacagctcctgaatgatatacttgccagtgctctatccttgtgctaatccatctccatgaagccaccaggcttccctctgacccagactccctggcataccatttaaggctttcaccccaactcaacttacctccgaaatccttttttttttttttttttttttttgctctatcgcccagactggagtgcagtggcgcgatctcggctcactgcaaccttcatctcccgagttcaagcaattctctgcctcagcctcccgagtagctgagattataggcgcccaccaccacgcctggctaatttctttgtatttttcaatagatatggggtttcaccatctaggccaggttggtctggaactcctgacctcatgatccaccagcctcggccttccaaagtgctgggattacaggtgtgagccaccatgcccggcctgaaatcctatttctagtcaatccccctgcagcatatattttatgctttaggcacaattagtagacagtgggctacatgagtctgaagcccagtgggacaatctggagcaactgaacatttgtaaatagagtagttcacgatttctgtggtggatactgtgatgcgccactcagatccttcaagagcatgatgctcattcttccagctgcaggggagtgctgactcacagctaactctctttccaaagaagctgccttactcaagctcacatcccctccaaactggcagcccatatccagtgactggttgaggcagagcacagaagcccagaccccttgccttgatggcagataactctgaagggtgatcccagcttgaggactcatcctgcgccatgggctctgtgttggctatattatagcttaccttctccttctgtccagtcctgcttcccttacttccaaggaattcttccctataaagcttctgcataggaatcttaggcacagggcctgattccaggaaaccccacctgaggtggttttatttacattttactcgaaatattattatcttataaaaatgacttgctttttaattaatgtttatgcttgaccatttcaacttttttaaggtttcattttaattcaaagtgtttaattgaaaggaaggaacatctgtatatatttttaaagtattaattcctatccagctccacaatcagatattgcttaaaatattggagtcagaactctgaaacctggctccatcatttcccggctgtgtaatcttcagtaggttacacagcccctctgtgtttccgtttcctcacctacaaattgaggataataacaacaaaatgatcctaaataaactactgggaagactaaatgagttatcatatataaagcattaagaatgatgcttagcaaaaatacatgtgctaaaattcattagggtaacactagctgctataacaaacagacctaaaattgttcaatgacttgactatataatagatatttcttcctcatttgtctacacggttttacaaggacttaggttgatagatgcacagttttcttcactacatagtttctccatcccaattggccagaaaagggaaagaacatgaaggagtatgtaccagagaattctacggaggtcattcttcctgctcaaatcccattggccggaacataatcacatggccacacctaactgcaaaggaggctgggaagtgcaggctagacaatggattgtaatgactagctgtctatacagcagactttgctgtactgataattattgttatcatctcattattaccaactttcgagcttgggctcttatctccacttacctagaatgttgcaaaagcctcctcactggtctctctaactccaggctatttgccatcccaaatccttcctccacaacaaacccagagttatttatgtaaaacaccaagtctgatcttttccctcaccgtcctccagcttcagtttaatatccttctgtgacctccccactgcctcaggttccagtcaagtccccttcattgccttcgtgactcagtccctccacatccctttagttcatctccaaaatccccgcccaccttgcagcgggtgtttgcgatttgacacccactttgtgcctgcaacagtgctggacataggctactccagtgaagaaagcgggcgggatccctgctacattttaatgaggtagcagaaaaaacaagtaaacaaataaatatgtaatattaagctataaggagtacagtgaagaaagatacagggtaaaaaaaaatgggggcggtgagctaaatgaacaggtagtaaataacagcttaaatttcacgtgcaagtgatagccattctgcagcaggatgcattgtggactttttatcttcactatcattacccacacccctgagactgcatattacaaaagagttcttatcattgacctatatttgcattccttttagcttcttttatggctgttattcagggaaataatatagagcactaaagattgcctaatgtgctatttgtgtgggatgctgagagaatatcatttgctattgccccacggggcagtgacggtacaaatgactcaatttttttccctgcaaccttctttgcaggaaaattcaactaaaaatatttaataaaaccaagttttactcaagtataaaaaactgttgttttttaaagttccctgggctatgttactgtcaccgtggtagcttaaaaagtattacatatgtgatgttcctgtcactttactggatttaggttttcaaattcagagcaggtgaaattgaaggttttctttacagaggctgttcttttaaccagggtgatttgctcccacccgacttagtcatttttaaaattcttatttttattttagagacagggtcttgctctgtcacccaggctgcagtgcaggggcaccatcatagttccccgcagcctccaactcctgggctcaagcaatcctcccacttcagcttcccaagcagctgggactacaggtgcacattacgatgcctggctaattttttatagagacagggtcttgttttgttgcctaggctgctctcaaactcctgggctcaagcgaccctcccacctcagcctcccaaactactaggattatatgcatgagacaccacgcccagcctgaattttttttaatataagaaatcaatataaagacaaaataaaaacgggtaaaatgtgtgcctttaacctaaggtatagacaaacccttattatcctcatctaacacacagaccttaattctactgctgatttccttcccacttctcttcaactcagaagcactttctgaggcaaaacatagcttcagctttctggtctcatggcaacttggcagcacaaggcttctaggctaaaatcccagcttccatggatccacgctgtttcagtcacaaatatttaccttgcctggctccgcaggctaattaaaggggtaggctctgttcctcttggctctcctctaaattgcttttagaggaagaagcagtggcgggaccagaatggcagccccatcactcatctccacagccacacggtgactaccttacaaatatcctgttcagatcagaaaaggggtttgcagccacgcccttgcctctctccagctagatctgaaattgcacatcccaacgatgatttcccctggaagctgacattagccctagcagcgtatgtgactgatggtgcctctgaaagagggactctcaggatcaaatactaagagcttattataccagttagaacacagtgtttcactgtgaatatatacttttattataaaaatgacatatgcttattataaacaattcaaggtgaagaaaagttgggaagttcacagggaatttttcttctgctctcactcagccccagcactgatccaaagactgccctccctctagaaacctcttttatcagtttctggcattttctatgcatccacaagcaaatggatatatacacacacacacacatatatatatatatatacacacacacaaacatacatatatatatatatatgcatttaaataaatcactctaaaggctttaaagtgatttcataataacaagcaagtccacatttgataaaccataaaatggagtcacatagttccagtcagcaaagggcttggcccttcctacaaagcagagtcactgggtgaatcctgcttacaactcacaatcgagtcaagaagccagaatcaaattgccaggcccaggaagcaatcagaacatgaggtgaggttacaactctgaaaacagatactcaaagtctgggcaggggagggaaatcaatggagaaggtagaaatacactctgaaaggcaaggggctcagagtgctgggtctagttggaaggggaggtgatatggtttggctgtgtccccatccaaatctcatcttgaattgtagttcccattatccccacctgtcttgggagggacccagggggaggtaattaaatcacgggagcagttttttcccatgctgttcttgtgatagtgaataagtttcatgagatctgatgattttataaaggacagttcccctgcacatgctctcttgcctgctgccatgtaagacatgcatttgctcctccttcaacttcaccatgattgtgaagcttccccagccatgtgaaactgtaagtccattaaatctcttttcctttataccagtcttgggtatttattatagcagtgtaagaacagactaatacaggagagaaagcaccccagggtttactgtcatcactggggtgatgggtagggagcagaagtggagaagtggcaatttgagtttgccttacaggaagaagcaaagataccactggaaaaacagaacacatccatccacaagttgagaggagacagagaagcccacaggggctgaagctggatggcgtctacctgggaggcagtctccctctgcctcctctttgagagatttctaataatattataagttgcctttcagcttgcttttgttgctttcttcttttaatatagtaaaatgtatatgtaatgtaaaattcatctttttagccaattttttagtgtacagttgagtggcattaagtatgttcacaatgttgtacaaccggcatgatcgttcatctccagaactttttcatctccacaaactgaaactctgtcctcattaataactccccattccctactatattagttcattttcatactgctatgaagaaatacctgagactggctaatttataaagaaaaagaggtttaatggattcgcagttacacatggctgaggaggcctcacaatcatggcagaaggcgaaggaggagcaaaggcatgtcttacatggcggcaggcaagagagtgtgtgtaggggaattgccctttataaaaccatcagatctcatgaagcttattcactatcataagaacagcatgggaaaaactcacccccatgattcagttacctcccactgggtcccttccacaatatgtggggattatgggagctacaattcaagatgagatttgggtagggacacagccaaactgtatcacctacttctcccagcccctggcaattatcattctagtttctgcttctatgaatttgactactctaggtacttcacataactggactcatacagtatttgtacttttgtgactggcttatttcactcagcataatgtcttcaagtttcatctatgttgtagcatttgtcagaatttccttcttttttacagctgaataatattcccttgtatggatataccacatttcatttattcatttattagttgatggacacttggattgcttcaatgctttagctattgtgaacaatggtgctatgaacatgggtgtactttcaggtgcttttctaaatgaagtattctaagccgtgaaaggtgaacagggtttttctaaacagaagacattcccaagtgagggaaagtgtggtgtgaggaagcacagcttgttcaatgaaaggtaggaggccccatgaggcagcgatatgaaagaggggaagaatgacaagtgagataaaaaatgtgggtcaggccattaaacttaaaaatacaaagaagaatagaatatattcaccacctagttgtgctgtgtcttaatatcttgccctatttactcatttttcaaagaaatatggtattacagatacaattgatccttcctgcaaaatccctcatctcattctttcattccccttcataatggcaaccattttcctgaattttaaatttattttttcatgttttataaatttacaacgtatatgaaccatgtcatgttttgcatacttttacattttatatgagtgacatcacactctgtatatatccatttccaacttgcttctttaaatcaacattatgttatagggttttacttagattatttcatattaatacttcatagtataaatattttacactgtatttttgtaccattacaaacagtgcagcaataaacattcttgtacattttccttgtttatatgggtatgactttaggctatggacctaacagcctcaatttgtaaaggcaaatttctctccaactaagtggttatatcaatttacaccccaacaaacagggttcacttgttcccattctgccacatccttaacaacagtgagtattgtcaaatgtttaaatttaacaagttgataaaatagaaggtagttaagaactcagattttagagccaaaccactagtattcaaatgctggctttactgtttactagttgtatgatttcagccctactttccctctctggaagaaaaaaaaggtcgtaatacctacctcacacactcattgccaggaatatgtgtgttaacatatgcaaagcagttggaataatatatatattgttaatactcagtaaagcctttagaataatacacggtgagtgctcaataagtgtgagccttgttttaacattttgaattggccattcaagtcttgtctcctgtgaattttctattcctttccttaccctaggacttatcattttaacttaactattctgaacataatcattcatttgtggttatatgctggaaatatcttcttttagtctgtggcttgtcttttttgtttttatgacattttttgttaagaagttttaaattggaatctagtcaatatatcgttctttgtactcttttttctcttgtttaatcaatccttctctttggtgcggtcatacaaatattctcctatattttatttgtaaaagtttttaaagtttgttcttcacatttaggattttatgatttaatccatgttgaatttaattttgtgactagtgtgaggtaaggagttttttcaatcacttctccatatgagaaaccaaatattgtgatatcattaatgaatttgtaatgtcatttttgtcatgttatttctatatatgaataggtctggttttaggctttctgttctattactctatttgggggggtttttgtcttttgttttttttttttttgcctacaacaaacatttctttttttcttttttttttttttttgtttgtttgttttgagacagggtctcattctattgcccagactggactgcagtggcttgatcatagctcagtgcaacctcaaactcttggcttcaggcaatccttctgcctcagcctcctgtgtagctgggactacaggtgcacttcaccatgtccagctaatttttttattttttgtagagatgggatctcactatgttgcccagggtggtctggaactcctgacctgaagtgatcctcctgcctctgcttcccgagtagatgggaccaccggtgcatgccaccgcacctgctaatttttttttttttttttttttttgtagagacagggtctccctgtgttgcccaggcttccactgtcttgattacaatagctttaacattcatcttgacatgctaggttatttcattaccactttggttgagctaggaattccctttcctgtctggttccaggtccaagttggccaagagaagaccttgtgtgagactttgggatgtggaagtgaagggcagttctttactctgtgaagctcttcaaagttagatggggtgacagacacagaagtacctaacagattccaacttgcccttgttctcctctgctttgcatcctgctgttcttcccaaattctggtcccgcagcccaagacctactaccagatacttggctaagagccacagagaaggtggcttcacaaaggcaacagcttcacacagacatctccatgagttcccttggcaggacaaattcagtagctggatgtgtacttggcttcttagatttttttctgtaaactcgatgttgtccacttatgccagtgctttcaaaagatagtttagactcttctctgagctcccagcttctccttccagatcttcatctccccagctcctcccacaattggataaagtctgctttctagaataaatcccatgtcataacactctttgtggctctagttccttgattgaaccctgactgacatatttgataggttaaagtgagccttcctatcttggtcttctacaaacttcttggtcctttgctcttccacatggctttttaaatcatcttgtcaagtatcaaaaaaaaaaaaaaactgttgggattttgagttgggattgttttgaattcattaattaattaaggaagaactaactttttatgatatttaatattttaaaaattatttattgatgttgatagagtgtaaattatctttatactaatgttgtgcttagtaacttgttgattttttatgttagttccaattgcttgcctgtattttctcttagactctatgagggcaatttctataaatagcgattgttttgttttgtttttacaattagtatgtcttccttttactgccttactgttcaactagaacccccaaataatgattggctacaaatagtaattgtaggcatcttgtcttgtccctcatattaaaggaaataattctaaagatttaccactaaatatgatgtttgctgcaagtttctgatagacatattttactctgtaaagaaaatctgcttctatttgtatttcttaatttttttaaatatgaaagtgttaaattttaacaaataatttttctgcctctattgaagtaatcatgtgctttttctcttgcaatttgttaatgtggtaaattatattaatagatttttctaacactaaaccatccttgctttcctgggaactcaacctggttatactgtattataatatagtatatagtatagcatatttttgtttttaaacaaaatatagttttgttttatacaaaatatagtgtgtttttgtttttaaagtaaccaattttgctaaatattattagaatttatagctttatatttagaagtgaggttggcttacaattttcatttatttatttatttatttttgagatggagtttcactcttgttgtccaggctggagtgcaatagtgcaatattggctcaccgcaacctccacctcctgggttcaagcaattctcctgcctaagcctcccaagtagctgggattacaggcatgtgccaccacgcccagctaattttgtatttttagtagagacggggtttctccatgttggtcaggctggtctcaaactcccgacctcagatgatccacccacctcagcctcccaaagtgctggaattacaggtgtgagccaccatgcctggcctacaattttctttactgtccatgtcttattttggagtcaatcaagcatacgtcagtctaataaaatgagctttggagtactccttctttttgtaatcttgttatagtctctggaatagtttatataagattgggattatacattccttgaaaatctggtaaaactcacctgtaaaaaattatttgtggccaggtgtggtggctcatgcctgtaatcccagcactttgggagactgaggctggagggtcacttgaggtcaggagttcgagaccagcctggccaacatggcaaaaccctgtctcacaaaaattaaccaggcatggtggtgggtgcctgtaataccagctacttgggaggctgaaccaggagaattgcttgaacccaggaggcagaaattgcagtgagccgagactctgtcttaagaaaaaattatttgtatgttatttcataatataggtagctataatcattgatgtcatatctttcaagatcatataatttaggctatttcttcttaagtttatattgattattgttttctggaagttaaccattttgtatgtcttccgaattaattgacataaagtcatacctgattgtctcttgttacctgttttaatttctggtatatttgtagttatgtccctttctaattcacaatttcaatattgctttgaatatcttttgtatgtaacatcatgctgaaactggctgtaagaaagccaagttttaaatagttttaatagctaattcttccgaaaacccagagttgtaaagaggaatagaaacagaaataccactaaaactacttctccataacttctacctactgtccctaattcttcccctgggagtcacataacctcaaatgtgtacttctacatactccttagaaattattactcttaagtaaatccaaagtggtggtgttttgttcagtccgttcaagaaacaagagacaatacatatctctcctgaaatacatcttttgcagtttaaggagcctcagtttttctgaaagttactcaaacaccctgcatcccaagctctttgctagcactcctttctgatgatccatccccaggcatcagcatctggaactgagtcctttagtccaagcgtagtctgaccaacatgaggagaatgagtctaaggctatcctctcactggaccattcccttcatacttcctaaaatacatttcttgcttgttcatcacactgttgactcatgttaattttgcagtcaaccaaatatttgagtctttttcacacgtgctgttgaggaatctttatccccaagtaataaaagaagactccattatataactccctagtctacagacttcaaaagagaattttaagcatgtttgggccttgagcaaagcactgagataaaaagttgagggtgaaggagtagcagacagtactatcctcagcaattagaggaggagttctttctttataaaggaaggcatctcagctgggttataccatagtccaatttccacaaacagggaaggaaagaattcccttttactgagtaccgactgggtgccaagtctaggttaggtgctttatgtgtgtttatctcggctttcgtgctgataacatcattgggtcaaggtgcagtgtaaataaagaaggatgtaaataaatgctaggtaaagttattcccattttatgtatgaggaaacagaaattcacagcatgactcgccccaaatgatacaactaaaaagtaatggggccttgttcaacttctgcactctcagccaggaatgaatgactacaagtagagaggaggcagcaggcaacaagagcaattggatgatgctttgtggtttaatgaaggacaggactttcacctacattaactcttttggatcacctgctccacctaccataagaggctgattctcacaacagcctcttatggtaggtggagcaggtgatacaatctttattttacataaagattacagggctcagagaactgagggacctacccaaggttgcccagctagccagtggtagagacactttgaccccggctttctgacagcaagcacctcttttggcagcaggtatggggcaaggagaacagcagggacctggggcaggtgttgacagatcaatgtggacatggggaaaaaagccccaaaacccctcaccaaggaaatgtaatgctctgttatttatttaaaaaaaaaaaaatttttctcaagcctttgagatgcacagaagaggcctggcgtggtggctcatgcctgtaatcccaacactttgggaggccaaggcaggtggatcacttgaggtcaggagtttgagaccagcctggccaacatggtgaaaccccatctctgctaaaatacaaaaatttagccaggcatggtggctggcacctgtaatcttagctacttgggaggctgaggcagagaattgcttgaacccaggaggcagaggttgcagtgagccaagatcacaccactgcactccagcctgggctacagagtgagactctgtctccaaaaacaaaacaaaacaaaaagaagatgcacagaagaaagcaagcccagtgtattagtctgttctcacgctgctaataaagacatacctgagactgggtaatttatatggaaagaggtttaatggactcacagttccacatggctggggaggcctcacaatcatggcagaaggcaaaggaggagcaaagtcacgtgttacatggcagaaggcaaaagagcatgtgtggaggatctctcctttataaaactgtcagatctcatgggacttattcactatcatgagaatagcacaggaaaggcctgcccccatgaatcaattacctcccaccgagtcccttccatgacacatgggatttgggtggggacacagccaaagcatatcacctaggtcgatgacagaagcagcagaggtgcctaggacagaacacatcactccttctgccacaagcatgtgctggaaatgcctccagtcaagtatccttagaacaatcgttttcccagctatttaaactccactgaagtcaagcaccagcttattccaggccaggctttgcctgctaattaacaattcacctgctggttactagttcccacagggcctcaagtgagaccaaatcccccagctggaaggtcctctttttttttccagcactgctaattcagctctgttgcccatctcaagcctggctgagaagttgttcccctgcagcccccttagttgccccagggattctagatgccctctatattcaagccaacattcatcgtctgtcaacaggtggtggacatgtacttttatgattgtactcaggttcctctgagttttgttttttcaacccagacattaagaaatccttatttcctatagaggatttaagaaatagaaaaatggcatgaacctgggaggcggagcttgcagtgagccaagatcacaccactgcactccagcctgagtgacagagcgagactccatctcaaaaaaaaaaaaaaaaagaaagaaatagaaaaatgaaattaaaaaaaaagataaaagacattaagaaatccagaagcagaaacacaacttctccagtattttccaagcctggctatggatcaaattcacccaagcaccttaaaagaatatacagatacagaaaggattctgcagcagagaaccacgttaaacattacttggatgccatcagcaaaatgcagactctggaaaaaaagaaaaaagagagagagagagatgaaggaagatgaagggagaacttgtacattaaaagagacttaagaaacgtaacaaccaatgggatgtttgaacttagttggttcccatttcaaaaaacacaaggtaaaaacagacaaatgaaaaaagaaaatttgggacatttgagagacagttaaaattttgaacactggctatatgatgatattaaagactttttattatttctgtttagatgtaataatggtattgtggttatattttgaaaagatttcatatcttgaagagaaatgtactgaaatatttttggctaaaatgatgtgtctaggaattgcttcaatatggaggagagcgagtggaaatccagacgaagcaggaatggccatcagtcgatgatttttacagctggatgttaggttcatggaggaaagtggggttcattatactttttgttctacttcagtatatgtttgaaattttctgtaataaaagtttaatctccccagttttgtgaactattctatttattttatcctcatcctttaacacacctatgtacacggaacttcctgtgtaaaatgtttattgagtgtttattccccagaggagaagcaaagaggaagtaagagtaggatatttttgaactatgtacaaatacaaccagtttcagacccttttatatgatctatactcattctagactgagccacatagaagagctgttcctgaagtcagatcagcctggttacctctaaaagaccaaaagactaaactaaaacagccttttttttcttctgtggaagcgtacatgtgtgtttgcatgtgtacgtgtaccgaacagctgtcatggacctttgtgcaggctgtgcactgcacaagtttgtcacatctaagggggcatgcttcacctcatcaacacattgcagatctatatatttattgtgacaacagtcttgtaagtggcagcaaaatgtcttcttctaacaaaattggtatttttgataactttccaaaagatggaagcaaaaatatcttaaagtagggacttcttttctaattatgtacttatggtatgggctagcagtggacctgaactgactgtcttgcctgagtttgaatctcttcccccaaactcactcactgagtttgttatttaatagccttgagttcaagtttcttcatctgtaaaatgggatgataatattatgtaccctgagagcactgttcagagcattaaatgcatatagacagtatctggcccataggaagccttcaaaaagtgttagagattagctattaccatatctgttcacccatatcaaattttataggtgtcggtatgttgcgttattcataaactcaactaataaattttgcagtggactgaaaaaagactgtctccactatttcatgaatccaaactattttaaaaagaggattttcccctaaccatcagttctgaaaaatgcaaggaagctcaagctccaggtaagcagccagggtttctaagcctctctgcgcacagaagctgtgtgcatatgctaatgaggaacctttgaagaaaagtgctggggtttttccaacgctctaactacttggccagtaagcctttaatgatgggaaaagacccagtgggagttgccagccacaaaaggggttttacctcacaggcagaatagtcaaaatgcttcaagacgttaaaagcctatttttaaaaggaaagaacacagagtatgtctttaacttgatgttaaaaataaactcagccgcctcctctgcgtttcccaccctctcccactgtccttccgtcccctgcactgccctaaaggaaagaaagagtgcttttgtttcatttttatttttctcatgagcttttctttcattattatttgtttactcttagccaaacttgtttttccgttcacaaaacaagttgcatttttctcttaaaaattcctcggggattcccaggaagcaagacggattatcaattagaactagcccgtgtcaggatgagtaaaagattcgcgcggagataagcaaagtggagcccttacggcgtcccttgtgcccagaaagtatctgcaggggacgttgttcaagcaagggggccttttatttattttttatttttttattttatgtatgtatgtatttatttatttttgagatggagtttcacttttgttgcccagactggagtgcaatggcgcgatctcggcttactgcaacctctgcctcccgggttcaagttcttctcctgcctcagcctcccaagtagctggaattacaggcatgcaccaccacgcccggctagttttgtatttttaatagagacggggtttctccatgttggtcaggctggtctcaaactcccgacccccacgatcctcctgcctcagcctcccaaagtgctgggatttgaatgctttttcatattggggtttaagtacagacacttcctgaggcatgactagacatagcaacactactttgctgagctgccttcaataaattccattaagcagccataaaattccaatagatcagatgtgccagtttttgttcatgaaaaagctaatctgtgtagcagaaaagctgccagctggagtggaaaagctggatttcttattgtatattgatggcggagggatttcaagaccccagtggaagccaaagttgttgaaagacaaggagacccaggcctgtgcatagtactatgatttcactggagggaaatataagagatgaaggggtggctgaaggcttgagaccctgtttacttaaaaatattaaaaaaaaaaaaaaaagaaagcccttaggcaatataagataaaggaaaaaacagcaaaaatcattttaagaaataaaattctgccagtgtggtggtaaacacctgtaatcccagcactttgggaggccaaggcggaaggatcacttgagcccaggagtatgagaccagcctgggcagcatggtgaaaccccgtctctacaaagatacaaaagctagctgaatgtggtggcatgcacctgtagtaccagatactctgagggagtgggggaggctgaggcgggggatggcttgagcagggtagagagagacctggaaggaaggaaggaaggaaggaaggaaggaaggaaggaaggagagaaagagagaaagaaaggaaggagggagggagagaggggaggaaggaaggagagagaaagagaggaaggaaggaaggagggagggagggaagaaaggaaggggagggagggagggaaaggaaggagggaaaaggaaagaaaagaagaaaagaaagaaaaagctctagctgggtgtggtggcttgtgtctgtagtccagatattgggcaggctgaagcaggaggattgctggagcccaggagtttgaggccaacctgggcaaagtagcaagaccccatctctttagaaaattagaaaacaaagttcctgtctagggttggcctctaacttgcagcatgacctcagtccagtgattttcttccctacaatttctttttcacaaaatcagatccctctcttcttgaatctgttctttaataggaatatataattgataaattacatataattgaaaacaagatattacatcagagcgcttaataagtgaaaatcacagtacaaacgcatgcttaaacactgttgaaatttaatgaagtaattttgacacatgtctagaaagtcagaagggaaattttgttactaaaggttgagtttgagccaattgttttccaattttcatgaaagcgaagcactgtaatacaaaagcatgcctaggaacactagcacctaactcaatatgccttaacaaatgagtaaaggaagaatgccaagatttccagcctgcaaagcttcacctctagggaatctatggccttcttgcaatggatcttctagtttataagctcaccaacataatttgacacccagtgaaaatgatattttcaccatatgtatatgccaccattttcaaatgtgtgtagattggttgtgactaataaaatacaataaaaaattataaatttatcatttgtatatgtattaataaaatacagactcatttaaaacattaccaaaattgagtcaattgtcaacatctatttctggatcaaccaactctaaaattacaatttcttccagctgggaactctggagtttaatatactatagctttttgtcataaattgatctctgctgtattagttcattctagaaagtgatggaacattgatactttgagtaacttgtgtgccagtaacaaagtgcttccctaaagcacagccaggaatcaagtctatgattaaaaacatctgagtcaataactatttatttacttatttgtgttgtcctgggaaggcttgaggatggcttaccaagatgcacaaaattcagcaagataccatcagttaaataaaagtaatgggggaaaaagataggatagaaaaatgagtagcagggctgtggttaggacataaaaggcgttctgtgaaatcccacattcttccaagtgctggcctatttggctctgccctttgtaagcagccaaagggaagaggaaaccattattagatacataactcatattagctgttaataaatatacatcaacttcttataagaagcccaactctttctgctggaaagatgagagaaacttcaagaaatggcagcgtccccaacaacataccagttgcaacagatcaaaaactcagttttagcccatgtcctcatgccagagccagattcagtaactaattttttacagactttctctaatgatgaaaaagtacttttccaacactccgtgaaaatgatctcttccctcttgtttaagtggggaaacagaggcagagaacagtgaattgcttccacttcatatactaggtcaattgctaagataaaagtagaaataatttgtcctagctggatataattacctccagatgtgcatttgcagattacatgatgattatgaagtgctcttgaggactccttaaggtgtaatggtgacctttgactccatttcattttctcttccatccccctgatgcaattttcctcaccctgactcttatcctcttgccttggtcaccactgagcactcaaggatgtagaaaatagatggcctctacaaggcggaggtccaggggaagccatcacagagatggatgaaatagcagagctggaacactcgggcatgcactatggagatggcctggaatgagtttctgaaaagagtctgggcctccagcacctcactgctgaccaagaagtccagaaacacgtctgtgcaacttccacttccacggcaccagcaaatcaccaggccatttaataattcaccaagcaaatacgtactgagtgccttccaagacaccaggtgctgagcctgtgctagggaatcaaaggcaaaaaaggcacaggtgtgtccccatagaaactgtagcttagctgtaagagagtccatcacacaggaattttaatatggcatacacacattgactctggaatcaaactcttgagtcctacttccacttttgctatgtgagtaagtcaaactcttggggcttcagttttatcgtctgtaaaatggagatagcaactaccttctagagaaagagcctagaacagtgctggacacagttcccatgcccagaccactgccttctcctgggatccttatctctgtaagaatgaccaaaatttactgtgcgtgtgatattccaggcactattcaaaatatttgaagtgtgtcaactcattttccctttatcatagccccatacagaggatatcactattattttcattttacacatctgagacatgtgattcagtgcctggccccaggttctcagagtggcagtgtacatcagtggttaaggggacacactctgggaccaaactacctagactttgcaacttagaagttgtcagagcttggaaaaagtaatgaacttctctgggcctatcttctacctatttctctcagtttgttccccatctttaccgcgacctctgcagactacattttcccaggctcctgcccatgagtgtctggttagctcagccgacaggaagcagtggtggagcttagcagtaggatgagggaatgtcagggtacttaagcccctctcagtttggggtggctgctctgacagtggctgcacctcctctagagctccagttcccgctgggcagtcccagtgcctcacctctggtgacatccccacttccttctgtccctccaacctggagcagcagcttcctactgtttctcatctttggattgtcttgcatcctccatttgttttttgtgttcttgcaacagacttatagtcagagccccatgtcagacttcctctggtgaactactagagtggcagatgcaccgtgctccaacagtctcatctgctaagtggaaataataattgtgtctacctcatatggtttttgcaaaattaaatgagttaatatatttaacgtgcttgggacaaaccatggcacacagagtgacagccatactgtaacacacagccaaggcaccaaagtccctttctagaccccagagaggagatccccaaagcctttgagaatgaataagactcaagcaggtgcagagaagatggaaggacattcgagctgtcttagtccctttgtgttgctatcaagaaagacctgaggctgggtgatttacaaagaaaagagatttctttggctcatgattctgcaggctgtacaagaagcatggcgccagcatctgtttctggtgaggtctttaggctgcttccactcatggtggaacatgaaggggagctggtgtgtgcagagatcacttggtgagagaggaagggagcaagcagaagagaaggaggagccagactctttttaacaaccaaatcttgtgggacctaagagtaagaactcactgattaccacaagaatggcaccgtgccattcatgagccatctgccctcatgacaaaacaccccccacgagaccccaccttcaacactggggatcaaatttcaacatgtgatttgaaggagacaagtatccaaactgtatcataggcaaagggatcagacaactaagtggccaagaggtaagagagagaagggggccttccgggagccaggaaagggaagaaacacaggaagacggggcatgctaacagagcaaggggaggggatggagtcagggagaaggatgaggctggagaaaacagagcccagagcatacctttttaggcatattggagtccagactttgccctgacaatggggaaccattggagcattttactgaagtgacacatttgaatttatgttttagagaggtttctttggctgcagtatggaaaatagatggggtggaaaggagagatgagagaacagcaggaagagctgttaggaagccatcgtgagtgcccaggcaagagataatagcttggactatagtagtgacccaggagcaaaaaaaaaaaagaaaaagaaagaaaggctcaagttattcaggaggtaaaaggaactggattggcattggattggatgtgggagccaggggagaagatgacatcaaaaatgatgctccagtttttgacttgggtaaatgtacaacagcaagcagcccagccgagtgattagaagcatgggctacagtttcaacagcctgcattcaaagtctggctctgtccacagctagctgttgaacctggggcaaggcaccgattcactgggtgcctcagagtataagagagggataataattgtatcttctgtacagggctctggaaaaggttaaatgaggtaaagtatgtcaaatgcttggaacggagcctggaatatcacaagcacagtaaatcttggccactattacatagacaagatctcaggagcaggcatagtttgtgggggtgggagcatcatgagctaggttcaaacacactgattctgagacatctagggaaccacagaacaagttctgggctggagatgtagatttcatttgagagctgccagtagtagagacggtaattgaagccatgggaatggaggtgattgtccagggagtgtaggtaaagtgagaatagataagtgccaaagggcacagtctgggtatgtcaacatttaagtgacaatttcagaaagagaagccaaggaagaaaccagagaaaagcagttggagaagcaagaaggcaaccagaagtggccttggtacagctgtgatggggagacaatgacgaaacagcaggaactggcactgagagttattggtgtagcttgggctctcccctcatcatcctctccagctgggagtcatgtgacagaagcaagaagcctgtcacagcgcacatgtaaaagagcaaactccagacacacacgtcttatctgtgctgacggcccaccttggtgactggaaatgacaccatccaattttttctggccgcaatgttgcacccctgattttttccttcatatgacagacttcacagcaaatactcctactgagtccaaacaaccgctacgattgagaacaagcatgaatccgccacccaccttctcctggaaataaggtgatgtgtaggttcctcatctcctttccagtgtccacaaacccatctgagtaattgcaacttcaaatttttcttttctttttttctgttacagacactgattccagaagagtgttccatatgctatgcttttttaaatttattatttattatttttatttttttgagacagagtctcgctctgtcacccgggctggagtgcagtagcacaatctcagctcgctgcaacctctgcctcctgggttcaagcgattctcctgcctcagcctcctgagtagctgggattacaggcacacaccaccacacccggctaatttttgtatttttagtagagatggggttttaccatgctgcccaggctggtctcgaactcctgacctcaagtgacctgtccaccttggcctcctaaagtgctgggattacaggtgtgagccaccgcgcctggcccatatgctaaatttattagaacccccaagcctggccaaaggcctcactcctaagattctggtggcaatgccagcatacactgggctcagaggaggtcttcagataccaggaggattactctaattcaacgcagaaatgttgtgaaactgctttatattctgtctagcacaagcaagtgggggttactatttttgtaatcattataagagccttcaactatataattttgggaagtggtgataaaaaacagagtacttctcccttgaattctaccagccccaaactttcattaacatccaattaattttcttaaaaaagttcagcatgaaactctctgcagcactttggcacagtagtatctatgcatttggaatgacacagtaatttcttatcctagggaaaaaaaattactctgtcaaaatgaatcttttagcctaagatgaactggttccatttctcatttctcttttctcaaggttattgggttgctgaactcccatgaaccaaaaagaaaacactgaatggtatccaaaccagcctggaaaggacagcgagaaaagccagaaccaaggctgaccagcctgaatgctggtaaatgttatcaaggtaacaacttctcatgtatcggtatgtgaccaataaaaagggaatgtgcttgattagcaaaaagaatctccatgaaaaataaggcatattagcatgatgactttattatacagcaataacataaatggcaatccactcttgtagaatatttgtgttgaaattaggaaatggcagcagattcaaacacaagagttaatggaagccctaaatatagatgatattccatctggctgccaagagcctgcctcagcacattaaccagaagaccaaaccagagaagggaaatagcttttaaaagtgcaaaagagaaaagagattcacttagaattttatctggtaaaaaaaaaacatctagtcataggatgaggagtcatctgtttcatggactatttatgactcagatgttaattcggatgctgtctttaaatacatggagagaagagagaaattttccccctttatttaggcttgaaagagttttgttgaagcaggtagctcacagctggtaagtggcattcagttgtttaaaataatttatatgatttggctttcatatttgctacatttgtgcaacaaacagagctgctgttttgattcctccaaaaccattttaaactctagcaccatggggaccatgtacccttagcattttgcaagagttatactttgcactaaatgaacagcaagcctgtgtttacaaaacaaaattatttttttccagtttcagttttgcttattaacaaagtagatatttctcaagtcaaaatttctcctttgtttatggttggagatcttggccctgatgaaaaaacaaaaatccactgatgagtacagaaaatcaccaccatgcagacatctctctttacaacaatcctgtggctcacagagccatcatgattgccagtgtcctcgtagaaagtcaacaatagctatttgcagttgattcggttcctctgtttaggagattttttgtagcataaatagattacagtgtttgcaaaaatgtgtgtttatggttgacccttatgcttctcagaatctgtttggagtactaaggcatgctatcctgggtgtgttgatttctctttgtgcaaactctgctgaaaaccaagggcaatcaacaggatgaagaaagtttaattcaggaccccggttgatagagattacctctgggtctaaggtcagggatgctttagtcctccttgttagaatctccagggaaaccctaactcccagatattaatcagatctgtagaaccctgcttaaaaccttccagtggctctgaattactcttaaataaaactccttaccctagctgataacacagtatataatctgacctctgttcagaccttaccagacctattatgcgctgtttatcctgaggcctctcaccttgacctgcagaaggctgtcttctccctttgtcttcacatgacctttcctctgtgtgtaactgtgtcctaatctctctcttcttagaaggacaccagtcttactgggtgagggcccacccagaggacctcttttttgccttaattacctccttaaaggccccatattcaaagacagtcacattctgaggtactaagtgttgggacgtcaacatatgaattttggggggctataatttgcctattctgcacatttcatataaatggaatcgaacaaaatgcggcccattgattctggcttctttcacgtagcacaacgttttcaaggttcatccaagtggtagcaggtatcagtgacagagcaggagcaccgtcatcttggacaaacatcgccatttcaagttccggctccttttctaatctcaggcatttcaaggaaatcacttctcttctaacaacaagcagccagaaagagcagacagtaaaacacagataagacagctcaggcacagaaggtggggggaaagtctcttgggtaactgccaaacttcacactcatacaatgggccccagtaaaacagtgggccctaataagcacattcctttccctttaggtacactaagatagggaagctaaaagcaggcttgggtatgcctgcagctgaaaaaaaaaaaaaaaaaaaaaaggatagaaacaaacacaaaaactccctctcaaataagcaagacaaagaaacacagaaatattctgagcctgtgataagctctcctgccctaaacccttaaatactcttagtctgtaacagagagtgcccctgacctaattcagccagaagcccctctcgggtttattctccaaaataaacctgtttttaactgtgaagccacttttcatgtttctttcttccttattcaactcttactatcagtactttcttcttttttatgactgaatagtatttcacggtatggctgtatcacattttatttatccattcctcagctgatggagatttggattgtatttgctttttgcctgttataaataatgttgctataaatgtttgtgtacaagtttttgtatgaacatacgtcttcagttattgtgagtatatacctaggagtggaacattctgggtcataaacacacataactttgtgtttccctttttgaggacccaccaaactgctttccccagcagctgccagctgcatcattttacattcccaccagcaatatatgagggcatgtttctagagattacataatcacaaacgaagggcattgtcctttatagcctgctgaagttcaaaagagagaggaagagatgttcaagtaaggaagagatgttttattaggaatatgaagggttcacaaagtcctgcttactcattttcagccaactttgccatggcattatttaattagcattttcacctcatcttcaatcttaacatgaatagcctgggtctcaaggccatcttttcccaaccagtataagcaccttcgagacagcattcaatatgtgtcaatttatttcctattcaataaggaaaattaggtcttgctttgcccactcagctttattcctggaaatacacttttcaaaaagtagaaagttcagtcttgctttaaaccaccaagctgcctgaatggatttcatccattatttgggctttattttaaactttgcttttaataggcacagaaccaatgcatattttaaacttttgacgcaggcaaattttatatgtccaaaagactcttggaagttaagcagacataaggggtaccgtgtgtgtgtgtgtgtgtgtgtgtgtgtgtgtgtgtgtatcacagaatgaggggcacatgctgccaatttagtaattaattatcaactaacagaaggccactacctatactgtctgtggcagccagagcctcaccacactgacaccaagttgctgtgcctccttgacagaaagtaacacagattgccatcaatggatagacaaaaaaactctgaatctatggttatacgtgtgcatcttacaaatggagtaacaacaaatagaagaaatatatttacaaatgaaaatgaacccgcatttatttacttcactaaaactgtttttttttcttctcatcaaagatttctctattcatgctactcaacatcccaaaaagaatcagcataaggccacaaactcaacaaaattccttctcctgttcattaaactcctgtcctgactccaagttcacacctaaataaacaggcaagcctgtgctctgcaccctgaggaacagtctcctaggctttgtccttgcagagagcccatttccaaggacaggccgtccatctacccagcttttctcaaggccacatagctcctctctaaagacagccatccccaggggttcagttgatcctgacagctgcgcctacagagaaagaagggaagagagatgggagaggaagatctcccaggagtcaggatgcaaggtgaagccagctgttgatcagcggtcactcagcagctagaccatgcgacactctccttctgaaggctgcaggctgtgagagtgttctgagtggcatttaaggatagctcccatgcagcgtgccagcttcggcagggcctcctatggtaagccctaaaacacagagggaaaagaataaccaagtggaagtggatcatcatgccatctatcagagacaatgcatgtgagaatgctgctactaaatgaatgaaaaacgctttgtaaactcaaagtctgtggttctcaaacttgagcatgtatctttttttttttttttaaattaaaacgctgatttacttggccttattctagaagttggattcattcggtctggggtaggacctagaaatttgcatttctaacattgcatttcccagaggatctgatactgcgggtcagcggccacacttggagaactagttgctaaaacacaggatccatgtcagctgaagctataatgggcaatcatgagccatgcccagactgagcagtaaaaggaaacaatgttactgtctaaaacaagcaagaaaataatagaatatttaaaaataacagaatatataatgcttgagttgccagtagcaaagtgttatgattaggtccttgaagtcggaaaaagcagagattaactagacatttctgaataagccctgtcctctaactcagcagaaaggaagagaccaagtccatcatcctctcagtaaaccattagccctggagcattggctttccctcttcacagatgaggagttccatcttctaactcacacagagcagggagaggataagagctgaggaaatgccatcagccctcagctggtgactgtctctactagtagtgcctcatatgggtataaggctttgtggttttgaaaagctttccagtgatcaaaacaatgtgacatgggtgaaagaatagacaaatggaccaactgaacagaatagagagcccagaaaaagacccgcccaaatttagtcaactgagctttgacaaaggagcgaaggcaatacagtggagaaaggacagtcttttcagtaaatggtgctggaacaactggacatccacatgcaggaaaaaataaactagaatctaaaccaagaccttacatctctttcacaaaaattacctcaaaacggatcaaagacctaaaggtaaaaatgcaaaactgtaactggtgacagccagaaagaaaaaataataattgagtgactactagtgccagctatcgagttaagtacttttaatagcttatcgcattgattctaaactctgtacacaatgtattattcccaaattgcaaatgatgaattttttgccagtgataaagtataatttctctatgttattccctatagaatctggagcaggagcctcagtctcctatcaaaaggagaagaacctgaagaaaacacttctcttccttctctctgcctaggggcagtgaccttggattcaaccaccatcatcccttccagacaccagaggggggagtcccacaaggcagaaggtgcccctgtgacccatccacttctcttccatgttctttacctccttgctcaggaagccataaagttgagctgagtggaaggtgaatttcattgcaaagtttacacaggctctgctgacaggttcatgaaaacactactgaatatgttacataccaccaaggctcacagcacatcctgtgttggaagtgatacttttccattaccagtaaacctccttttgtcctaggagctcactgaacagctaaaatcaggtgatatttttatgtggaacatgcaacgtattaagtccttttgctcagtgacccaaaaaggaactaaacggtacccagactagaaatcaatgtcaaattattcaaataaattccacttaaagaatggtggtttggaaagcgctcagtcagaaagaattctcccaagattagtttactgtgaagtagaagggaagaacgttttaactttggttggaaatctgatgacattacatagaaggtgatgaaacatcctctaagaaacggttctgatccattgtatggcacccccctctcacattcccccattttacccactaaagaagttcttttacaagaggctaaggaaaccaagcaatataagatctaatcaaaactgagtgctggaaatgtgtggggagaaatccataattaaactgagcaattaactccagaaagttaactggggccaactctgacactgctataaagttataaaatctccagcatctcatttctttgtccctctacccaatttcccctcaaaggtaagcctctctttctctctcctctcttcttcatatttaataaaactgtttgccagaaaggaaagaatcttaggttagtcatttacactttagtgcgaattaaagccagtgtgtcaactctcacaggaatgagaatttcaagccatacttctaattgtggaatggctgtcattgaattcttttaagggtatttcatggaacaactaaatataaggaagaggagagaaactgcccaagtctgcctatgcctaaagtcagccttaagttcaatcttgagggtgacagctttcatctgccactcccaattgaaagtgaattcagattaattcctagatgtttgtttgttgtttttttttttttttttttttttttttttttttttttgggacggagtctcgctctgtcgcccaggctggagtgcagtggcgggatctcggctcactgcaagctctgcctcccaggttcacgccattctcctgcctcagcctcccaagtagctgggactacaggcgcccgccactacgcccggctaatttttttgtatttttagtagagacggggtttcaccattttagccgggatggtctcgatctcctgacctcgtgatccgcccgcctcggcctcccaaagtgctgggattacaggcgtgagccaccgcgcccggccaattcctagatgttgaatgagagttataatttatcctttcaggatctactggttttcttttctttttttcttttttttttttttcagacagagtcttgctcttgttgcccaggctggcgtgcaatggcatgatcttggctcactgcaacctccacctcccgaattcaagctattctcctgcctcagcctcccgagtagctggcattactggcatgtgccaccatgcccggctaattttgtatttttagtagagatggggtttctccatgttggtcaggttggtctcgaactcccaacctcaggtaatacgcctgccttggcctcccaaagtgctgggattacaggcgtgagccaccatgcctggccggtttttctttcttttttacttttattttacgttgaggggtacatgggcaggttatgtaggtaaatgggggtttgtttacatatattttgtcactcaggtactaagcctagtacccaatagttattttttttctgatcctctccctcctcccaccctccagcttccaaaaggccccagtgtctgttctcctctttgtgttcatgtgttctcatcatttagctcccacttagaagtgaaaacaggtggtatttggttttctgttcctgcattagttttctaaggataacggcctgcagctccatccatgttcctgccaaagacatgatctcattcttttctatggttgcatagtattccatggtgtatatgtaccatgttttctttatccaatcagtcattgatgggcatttaggttggttccacatctttactgttgtgaatagtgctgcaacaaacattcgcatgcatgtgtctttatggtagaatgatttatattcctttgggtatatccgggatctactggtttcaatatccacctcttctcctctaggcccagaaaacaggttaatttctgatggcttttaagtgtcagccctataggacccattctcacttgacaccaggtatctccactccagatgcccttccccctaccaggttttacttgaaaagcacaacatgagtggcttgggccaaatgtggccataggtccttcaacaaatgttgagtgagtgtgacccttggagcagaaagttgacagggatctgacacatggctcgtcccccagaggctctcactgctctcttagctggaagaacttcaaactctcagacagtggaaaattcagtctgttccaagcaggagacacaaatgtgctcttaaaattcatactggcgtttggaactgcccagggtattataaatataatcgttctgaagtgtgagtgtgtgtcagggagagaaagagatggagagagagagagagacagacagagtgtgtgtgtgtgtgtgtgtgtgtgtgtttgtgtgtgtgtgtgtgtgtgtgtgtgacgacagaaaggaaagtgagagcagacccagggccagcaagtatccatgccaagaacacaaggccaagcccagagaagaatgtccaccagatgcccagtgactacattttggattttctactgcttcctcctcagagaaaaggggggaaataaattagagagaacgcaaagggagagagagagtgagcaagatgggtggggatggagagagaaaggaacaggaagtgggagccttactaaacatagagcaagaggcccagactgagagagagaggctgtcagaatgaggaactactgagagatcacaggcttctccaccagttacaagtgattaatatctacatttattgtgttttgaagccatcaagttctatgtccaaatgaccccacccctcccataatgcagcaccaagactaatccaccatccacagggcattctgtttcctgccaaacagatggggcttattgaggttggtcttacacagcctcttccaggtcttggacacacgctggccagcctctgtggctgaggaatagaataaagttaagtgaactgaccctacacgtgggcccctatgaccttcattgctcttgaactaactgagctgaccagccagcctgaagcaacatggccccagggcaggggctcttaaccttttatgcaccaggcttcctttggcaggctggtaaagccacagactcccttctcagaataatgttattaggcataaaatgaaatacataaagctacaaaggaaatcagttacaacatcaaatattttaaagattacaaatacagtaatatttttactcttttatcagtgctttaaataataggatctggtgagaggtcaaataacaaccatcatttcaaagagtgatgagagaaggagtgtttccattgtctacaacaactaccaggtgatatgaaaagatctgttatttctgtggcaagagtcataggcgctgctaataccagtgcagtttcttgcctacattcttaatagaaacaaaaagctagatttcagtgagaggttagataaaataaagatgcaatttttccccatccaaatttatgaaccagaacaaaggcaataaaaggaagggagctgcaacaacagtaatcgtagtgacaaagcaacatctgctacaagaacaacagcaaaaaatggctgccatctctgctctgtatcaggccctgggttaaatgctttctactcatctttctctttcattctgagggaggcatcattttgcccactttacagatgaggaaactgaggctttaggacattagggaacttgtctaggaccatagccaataagtagctgtggcaagaatggaagtcaaggctgtctgacactgaaggccacattcgctgtgcactgtgtcttcagaaagagatagggtgtgtgtgtgtgtgtgtgtgtgagagagagagagagagagagagagagagagaaagctgtttcctttttctcattcatgccagaagaattggactggtttaagcatctatactttcacccatcttgactatccatttccatctttttaatgtttgctcttttcagttcaaagacccttatgcttcatacattcatagccagtacatatatgttgggtactggctatgtttactgacaccaaaaattcaaagataaatatgttctctgactttcaggaagcttataacttattggagaaaacagatatgcaaacagataaattataatatgcagcaattagaattcaaggtaatttgcacaataaggagaatttattgactcatataactgaaaagtccagaagtagacaggcttcaggcactgtttgattaggtcttcatcagcagtgtgctaggaagtatgtcacaactaactgactttccagagaaaaaagagccatgagtttgtctatttccatggtgtaaatactcccaccacgacctatttcaagctaccaacatgaagtcactgaagatagaattaggaagagatgtgcgcagtcaccccttgcctgatgcaggctagctccagcatgctatgaccattctcatttcttcacagttctctcagtttttccatcctctgtatgctggttttgtcctgatgatgcaaccagcagctgggactgtacactttccttctagtgtctagcaagcttctcttctactaatcaccaaaaaaaaattcctgagctcttctgaaagaatcgctgtatccaaggaatatcacccagctggcttagccttgggtggcatattaaaataagcaatagctaccttctctcaaggctcttcatttcacctatcaagtactccttgttggacaaagctacggtctgaatgttcttgtcccttcaaaattcatatgttggaacctaatacttaaagtgatggtattaagaggtgggggtctttgaggaagtgattaagtcatgagggctccaccctcatgaatgagattactgccctcataaaagaggttgaagggagtgtccttgtcccttccaccatgtgaggtcatagcaagaaggtgccgtataaggaatgggcccttactaggtgccttaattttggacttcccagtctccagaactgtgagcaataaatttctattgtttatgaattacccagcctaaggtatttgggtatagctgcctgaatggactaagacaggcagaattagcaccaaaaacctatcctctagaaggtggaattatcagcaagacaagaaaatgatattcttgtttacccattttagtgcctgtgtcaaccagatgttcccttcagaactgagaccctcattttcccactctggaagtattgatggctgatggctcacagctgagttcctcccaaagcattgctctgaccaaaaggagctgccagactcgaggatattgtcccccttaagaggacactgcctctaatggctgatcaatgagtgagtataaaagcctgaggtcacctcaattcaggcatgtctgaaggatcatcctggctccagcgcttccaaaggggaatcagataaagcctctgttgaaatcatatactgggtcaatttctccctctgtgccatcatccttccctctcttgcctacatcattcctatgtgtcctccccactaaacctcctgcatgcaatctcagtgtcggtttccatgaaactgaatattcaatgcctatctctaaacaagtcaccagatgttctagacaaatcagggcccatcctggagctgggagtggaatcagtcccacccacatcccatggctgccccacggtgggagagggttgggatgtatcttgagaaataactgcactgtctgctacataataaggcatactgggtgatgtaaaagacgtatgaacaatatcacagtccaatggctgagccattataggcatagagaaagaaaaaagcaggccctgacatccagaaatagtcaccggtagacctcaatattattacaagctgatctgacactcacagccaggctatagttctcctgttggacatagacaatctcacagaacaccaacctcagacaagcttattctgaaccacgataaaatgaaacaaaacaaggtcactacctaattttgtccatgcacaaaaacaaggtcactctgccccctgtaatgcactcaatcatagaattgcctggatttctgatggtatctgacctagagcaaatctttaatttcttaagccctccacaaatcacccaaccaaagtccaaatcttctagtagtttctttctaacacagttgctaagatagtgtccttaaagtatgttctccctaaatcaatgagtagtaagcccagcttgtttaattatcagtgtgttcctggtggtctttggctggagggcattggtagccttcaatcagtgtttgtatggtgaataactgggtgtgtaaatggctatgttgcccctctttcaagaaaggcttaacagaagacctttgagctggttcttaaaggaagattgagcttttccaagcaaagcagggtcagagagaagtcattccaagcaaaggaagcaagatgtgcaaaggttggcatcactgaaatgaaggatgaagagtccatatgggtggggtgttgggtggaccggaagggtgctaggaccaaatgtggatatccttgtaagtcacaactaatcttttaggcaaagaggacagagaagcaggagagagacagagagctcgaaatttgaaatctgattgcagagagtattactggagtagccataactatttttcctccaaccctttctttcttttttggagagaaggagaagacatttgctttggttgaagcaaaattgcatattttgagttttctcagttttcccaacctgacatttaaggcgcacacctaacaacactgagcccttaattccctggatattgtgaatgcttcgaagacatcatggccttctctcaaaggtttgataacttgcacttcactatataattcctcttgcttgtcagaagtgcaattcagctggtcacttcctctgttatttataattaaatgacttaccatacattccttaaaagagacttccagatgccctgatagaaaatgccaatgtcttcccacttccttgtgtgtgtccacctttgactctccattcgtggcgcccccaagatgaccttcatcgtctaggggtcttatctctaggacctcccaggccgtacgattcctgcagtccctccgtctgtgtttaagtcttgcttgtgctccacaaaatccttctgccttaacagccctacagctgcacggcctcctcttctgttcccttctgtctgtcttgccctgccctgccactgagcactcagattttataacatcttgccttgccaactggttttgtgagtatcatataagtatctgttaattatagatcttttacaaataacatatacctgatacagctgaaggagactgaaatgtccccactcttacaaatccatgttagtgctgccctagactacccttaaaaagaattttgtgtatatttgtgaaatccacattttctacttttactctctctatatatatctcaataacctatgtattactttgtgcttttaaacataaagataatcatagtgttgtatcattttattctatgctttttatactcacaattatgttttaagattcagttttgttaatatatgcaaagcttttagaacagtgcctgtaaacaccatataagtattagctactattattttcagtattattattattgttattttgaggcagcatctcattctgtcacccaggctgagtgcagtggcatgatcacagctcactacgcctcaacctcccagggtcaagtgatcttccaacctcagcctcctgagtagctgggactaactacaggcatgcaccccatgtccagctaatttttgtatttttggtagagatgagatctcaccatgttgcacaggctggtctcaaactcctgggctcaagcaatctgcttgcttcagcctcccaaagtgctgggattacaggtgtgaaccaccacacccagcctattattttcaatattattaataaatgtatttacatcattccttgtaattatagtaagctaacattgatcatacaacattttatttatcccattcctctcttgatgtgttgggacttagaaaacgacaccccagagtgaaggcctctgaagcaaagtctctctctgaccttctcctactctcctgtctcttgcccctcattcttccctaaggcaagccatagaaaatgtgattcctcttccccaaggcagatcttagaaaccaaaacagattttacatgaagccagtcataaaacctaaaaatattactgtaatcttcccctgcctttctgtgtaagaactggctgcaaagaaattaagaccctcgtcccagagggttcctattccatacctgggagaaagaaatgctgcacagagaggccaagaagaagctgagctgacggggcttgataggtatcgcgactcggtctatttccattagattattcctgtttcccccaattgtagttctacatggctgtacattcttcattgaacctaagcataaaaaaagggatcaatttttcctggatctttggtctccattctgaagactctcatgtctcataaaactgtgatcaaataaatgtattatgcttttctcttgttagcttgtctttgttataggggtgttggccatgacccttatgacagggaggaaagggatcaccttctttctgcccctaaggtacatatttaggttgtttccaatttttcacaattaattatcagcagtatcccaaagaatatccttaaatatgccatgttcatatgttcaagagttggtatttgcttaaaagtggacttgctgggctgtaaggagaatgtattttaggttttgctagctattgtcaaattgtttcccaaaatgtctgtaccctcagcagtgtatgagaattcttatttttctatctttgccaaccaccactgattttttcaaaagtttgtgagtacaaagtaataatcttgttttaacttgcattcttcttttcattaatacgtgatatttgtacattttttttctctccatttattggccattatgcactgggccttaacctttgctggggtcttagacgcctttgagaatttacttcagaaaaatacacacatatatatatatacacacatacactttataaacacattgaggggcttcacagagtccctgaagacccatccacaaagccccttcagagcagagactctcgagcttttagtagatatgagaaccttctgggaagtttttaaaaatgcagattcctaggacccatctttgaggatcctgactcagagggccctagctaggaactgaagggctggtgcaggtgattaaaaaaagaaagaaagaaagaaagaaagacaaccaagactatactttcaggggccatttctgtagttcgttaagaaagacaatcttgagtttctggattcccagtaagaactcctatttctgctttccaaaacgttcccttctcctacagctatgaagcaaaggataaagtcaccaagtttaatgtactaaagctgtaacttgcctttaaattgatgctgtagctacttttaaatccatggttacttctgcagatataccttgtgcctctctcctccttagctggaaaggtcggtgagggaatgaataaatagggtgacatgtgagacaaagaaaaacacaaggaaaggaaaaaaaattaggaaattcgaagctattcagaaaatgctacataaaaagcatcatcctactaaatatgaacagcttgtgtttggaatggtttgtgtttctaattttatttcatgagcaagctcatttttttttctctgccagatacttcaaagattctcttgcaaaaagaaggaaataaatttattttcctcttggatccaaattcacataaatgattctgttgtaagatgaagaaaattgattgcttcaatggcaaataagatacttttttaatttaaaaatttagtactaaggaaatcatgtgccagggaattctcaaaacattttgagagaggttgagaatcccggtatgatgagatgatgatgttactcatgcacatattcccccgctttctttttcaagcctgcaagtgtcaagacagagttaatccttatttttgactcagtcacacgcaaatgcgttcttctctgagctggtcagtggccagtatcctcttgaacctttggtggaattcaggtccgtgaatgatgccaggaacaagaattaggatctgattctaggactttataatgactcactcggtacctttgtccagtaacaatagaaaaatgactcggttgctctatccatgaaactagggcagtgatgctggctgcctgcctcacacagggttgaggggaaaccaggcttacaaaatgacagaggtctccggagcacgggcatcacatgggaggaggtgggggtatcttcacagagccagaagacaacagagggggcaacctgacacagaaccaaaggaggtccttgaaccctgccacaccagcctgggtggagggtattctgtatacactgtatacactggagaacatggaatgaagtcaacttacatcttttgtctttctggagaccatctttttactttcacacattactcatggattaagaagaaaagtggtggccatgacattttctaacattttctggtatccattatcttgttcgcttggccatacagtgcttcttacactctagattttcagattctagacagtatgttcattaaaagcaggaattaaaattgacatatagatatacatagacgtgtgtgtggtgggtaaggtgcctggcactcaatataaacactggatataataaatgagtgaattcctacacacagaaaaacacaacacacacaaacacaaataagtcagcatttttccaggacccaagccacaaggaagaagatttggggagtgggagacttctgctgccaacctcattcctgcctgtattatttaggatataaataccattgcagtaaaggagactgagtgaccataacttaaacaaaatagaagtttgtttttctctcatataacatggctgctctgtggtatcacaaccccaagttccttccacccttcttagagtgttatctccatctgcatggtccatgtagctcaccgcagcatctgcatcccagctgatagaataaggaaaggaaggagagcatatcttccctttcaaaaaggctgtatttcttgggccagaacttagtcacatgaccacatctagctgcaagggaggctgggaaatgtagtctttattctgagtagctgtagatccagttgaaaaataagcattgtcttaaaaaaataaaaaataaataaatattgggggaagtaactgtccctgtcacactgaaaaaataaaagcacaaagatgtaggtttctcagaatcactagaaaaattcccagtaaacctaggactagtactaggctgggtgcagtggcttgcacctgtaatcccagctacttgggtggctgaggcagaaggatggcttgaggtcaggagtttgagactagcccagtcaatatagtgagactctcatctctaaaatataaattagccagtcatggtggcacacatagaacaagatcctatctctaaaaaggaagtagctaatacttagttggtctcacaagcatgtcaatctactaagcagatgttcactccagagaaagacagttctcaacttcttacatttgccttttaaacaatttacactttcctctattaatctctgataaatttaagcttcatttcccataccaaatttgggttttcatactgcaggtagaattttatattttctgacctctaggagaataaatgcccaacctgatcaccacacatacaaggctagaagatgaatacatttggtgtgaaatcagagatctgccagcattcagcttgggaaataagaataaaaagccaaggagcctgtccagaataggtaaggttacgaatgatcagacaacctaatagtgataattaacgtaaccataacatagttaaaatctatggaggacttactttgcatcaaatgctttgcccacatcattttatttagaattttcttttaatgttggagggtgtattagtctattttcatgctgctgataaagacatatccaagactgggcaatttacaaaagagagagatttattggatttacagtttcatgtggctggggaggcctcatagtcatggtggaaagtgaaaggcacatctcacaaggtggcagacaagagaagagagcttgtgccgagaaactcctgttttaaaaaccatcagctctcctgagacccattgactatcatgagaatagcaccagaaagaccgcccgatgattcaaccatctcccaccaggtccctcccacaacatatgggaattatgggagctactagatgagatttgggtggggacacagagccaaaccatatcagagggctatcctgttactaaccctatttatagtcaaggaaatgggcttagaaaaaagttgaggaacttgaccaagatcacacaaataccaattgacagagcctggaccttaactcaagaatctaactctactgttggtacctgaaatcactgatcactgtggagtctcaattaaagaaaaagacaggctggtgggagcagggaaaagcaacaaaaaaaggcaaatacactataagtctgcctttcttcatggtccaggacatacagacctcctgtgcaaataattcataatcttcctgtgtccagctatcaccagaccctcagctaatacaaaaaatgcaagttagctccctgcaaacttggtattagcagtactgcacgtagcattctgcagcccaaaaccgtcctataaaatctccagcaagcctttgtctcctggcagtcagcttctgttctgctgatttgcccgttgctttcttgcaatgtattttcatactttctctaataaatttacctttctttatctacaactgtcttggtaaattcttttacctccacgccactggcccagataatcatcactccccagcaataatctctaccactacgctgatggcaaggaggacagtgagcaatgtcccacgcatccttcccgcccaccatcacatggataggtatcaatcttgttgttcatcctatctgggagtattgagtttggtgacctaaaaaagaatataaaagttccaaccatcagtatttaagaagtgatctcagaaatttacttaaatctccacataacctttgtaaaacaaaaaaatccagaaaaaaattgaaatatattaaaagagacttcaaactttgatgaaaatgttttgtaattactaaagtttacaaaatctacactattgcagatggtcatatctacaaactactcttttatggcacttactgctattggaattcatcacgtaataatttgtgtaagtttaccttgccagtggagagaagactccaagaaggtgtttgttcctaaatcgggaacagaataggtgtccaataattatttactgagtgaatcaatgtttttctttcaacatatctttttagaattatttgccacttattagaaatagttaatataaataattatattattagatgttgctgtgcttcaaaatttgatactaagagcttgcactataaaaagttttgcttaatccgtgttaacttatcacaggaatttaatatcccactgacttgtgtgtgtctgtgttccctgtgggatttcatttctattaataagtttgtttactggactactttttgcccccaacatttcgtgtggtcggttttaaatttgacactgctggatatgaaggagtcaagtcattaagaactcaaactgctttagaacatggtaattatgctccaagtggaatgaaccgtggatccatctgactttaataaatccattcttgaaaagaaatctcttctccctgagatatataattaatgtaacatgaagtctaaaactaaatttctccccagaaattccaggtgaaaatttcaggacactttttaccctagaattttgattcttcgtcacataggcagacagattcttactaagtatgcacaaatgcttaacgggcccaagagactttgacttccttaaggttttctaaatggttgctctctcaaatgcatgttcatgttactgtttccttttgtgagcaagccctccctccacagctccctctcaatccagcctttcagctgcaggattgtaaagaactgaggattccccaatgtgagaattgaccaagagtttatataccccactaccttttataggttgtgggagccattcgtctcaaaaggagaacagcgccctggtgtctttgtgagtttgcatcaagggctcctcactgaacagaatgtttgctagaaaaagacatgcagattggttagctagtttttttccatgaagatttccccccaccccaactttttattttgaaaattttcaagcctacagaaaagttgaaagcacagttcaatgaacacccataaacctttcacaaagattaatcagttgttaacatttgtcatgtcccaaagaacattttctacctctttacatatctgtatgtgtgtgcttacaaatatagaaacagggtcttgctatattgcccaggctggagtgtagtggcaattcagagccccaagcatggctcactacagtcccaaactcctgagctcaaaagatccatgatcttcaccttcctgagtagctaagactacaggcatgtgccacacacccagcgtgtgtctgtgtgtgtatgtgtgtgtgttattgaaccatttgaaagtaagttgcaggaatcatgatgctatacccttaaatacttactcttatttgtcctaaaaaaaaggatactttcctacatagttataatatcattgtcatacccaagaaactttcctttgattcaataacattatctaatatacagtccacaatcacatttccccagttgttctataatgtattttacagttgggtttttttaggggagtgcctatctgtattcattcaagattcatgcattgcatttagttatcatgtacatttagtctcttttaatctaattctacctacctccagccctgcctttttggttttgctctgtcctttcaagttttttgaagagtttagggcagttgtctggcagaatgtgccctaatctggttttatgtgattgtttccttgtgattcaattctgcttaagcaattttggcaagaatgatacaatgagatgctgttcccatgaactttgaataaactcaaggacagggattttaccaagcctgagtgatcagattcaaagaggcttaaaaaaaaaggcatttttgaagatgagaatttagtaagtatatggctcttcatagcagggtgagatgtcccaagcaaaatgaaaaaatggagcttctaagattagtgtccaagattattcatgacttgaaagaggcccttgttatgtcaaatctagcaacctttgttgaatcatcaggactgagatttgggcagagtcaacctctgctgttgtaaagtggataattactaacttggtgcaatttcaggaatgcagaggccactcttccccactcagctacactgcctccattatgggagtggtgacgcctgtctgctattattaaagatcagagctgctctctaatgactatctactatatgtcaggccttgtgcttagtggtttattaatctgttccttacaaaaacctcatgaggtaaacattattattcccatttcctaggtgggaaagtgaggcttaacaatgtaacttccccaaggacccaagcagctaatttaagatgtgaaccaaaatctccctccataactaaagttccataattccatgttccatgtgatgctcctctattccccagtcccagtcttacctcattccctaaatggcttttccttctctctctagagcatacattacactggacatctgattaccccattttatgccaatagatccttctacaaatgctaaccattattgtgtgtgccaggtccagtttgtgccaggcaccttgctgaatgctctacacacccaaactcatttactcttcccaagaaccccagaaggaaggtgtgcatcagtaatgtcctgtgaccactctgatagtagatggcagaaagagaatctgaaccagatctgacttcaagcctgagttcctaacaaagataggaagaacaaggcaaccccggatgatacagtagccagacacttgctagtaaaggccagaacactgactcactaagctctgaactcctctgcccccatgctgccaggggcacaaccccaacagactgcccagcacactgccctaatggccattgactcatctgctccaacgagcaagtcactgcacaaaactcctcccccacagaaaggtgttggtcctccggcattcagaaagaaccaggagccaacataccactcacaggaagaaaacgcacacactgtctctatttgttattcctcctacacaaactctttaaaatgattgagtttaataaaggaagatgtttccctgcagctgtagagaggaaatgttctaaagtaaaaatcagaacacagtctgactaggatcactatgcctatagcaaggatgtcctcaagcggggaaaatgaactcggctaaatgcatccagtctgttcctctggcccttctaatgagcaggacctgcagaaggcgaggaaggttatggtcgcacccataaacacctcttggaggcacctgccttatccatgccccgttctttcacaagtgcaccccactcccgaccccacttccctgacaaagctgacagcaccaacagtagacgcctgttagggcatctttcctagattctctcctagagactggtatttagcaattcctgctcttgaaggttcttgaacttagagcagtagaaaggccaggaggaaaagccagtcttggctgagcagaataaagcagcctcagtgagagatgagatgagagacagacacgagcccaggtggacccgtcacagccccgtctcaacaccgcccagtgaatctatcacacatgcctagtacatttgtctccccatttccaaaatgaacattctcctctcttgaaaccccagcccacccatgcccgccctacccttcctttgagtcctgaattgtattccttattgccttctccgggactcctctgtcataattatgccccctcatggattattcccatgaacatagagtaatactgcccatcttttaaaaacaacctccagctgggcaccatggctcatgcctgtaatcccagcactttgggaggctgaggcaggtggatcacttgaggccaggagttagagaccagcctggccaacatggtgaaaccccatctctactaaaaatacaaaaattagccaagtgtggtagcacaagcctgtaaacccagctactcagtaggctgaggcaggagaatcgcttgaaccctagaggtggaggttgcagtgagccaaaatcgtgccactgcactccagcctgggtgacagagagagactccatcttaaaacaaacaaacaaacaaaaacacacacaaacaacctcccttttccacacattttcttctagcctccacttcattttctgctcctcttcaaagcaaagagttgtctctatttaccaccttcacattttaaaaaattttctattctgtcttcagtccactttagccaagcttctttcccaatcaccttgttgaagtcaaaattaaaatatagagacaaatctctacaagtaatgttttctttggcaagaaaggatcccaatgtggggtgtacacacagtctggttggtttttggtatgtccaaagaacaaatagaaggttggggattttataaaaaagagagaggattgttatgtgtggtcctgaaagaaagttcattgtgattagcaaagatttggggagctggcaagctccaattggtgggcgagggtggtgggcaaagttagtcctagaattgcagcaagttatcttagcagctgtagataaaactggtttcaggttacaaccagcagtttcagctgctgggcttgcagaaagtaacatttctagagcaagttgagcatgacaagaatgacccaattcatatgatcaactttcacgaccccatgaagactggtgtcattaaggttactaatggctttgatgtttgcctaatctaaggatcacacactagtcctttctcacttggatggcctgcagcatttgacaaaatgatgatcattttctcccatgcaagatttgcatgacactcccttctcctggccttccttctccttttctgcctccttttccatcgcctttactgtgtccatcttctcttgttctccaaatattgagggaagggagagtgaggcaggaaaggaaggaaaacaaacacaatgttgcatccctgagctggctttctctcaggatcatgcatggccagttactccatgtcccaggacttttcgtccaagagaccacaggaatgaccacatctgagcactggctgtccaaggagaggaagagggaggaatttatccaccagctcccattccccaatggtcaaaagtttactccacagggtgttaactcctcctcacttctcagtcacttctacagaggcattgagcacgtttctgtcatcaataagaaatccccgagatggaaagtgacacccacaaaaggtcagtgggagcaacacagagccagccacagaggcagaacaaatctgcaaggcccctgaggcacgtgagcctgagagcacctggagtagctcatgacaggtgtctatgacaccccagtcctctgtgcacaacgccagacttgccaacttcacatttcctcatgaatgtctaataggtatgtgaagctgaacgtggccaaaagagaacttttcttcctctattccccaacttgctcttcctatatcttccctatcttggtcagtaacatcttaatccagctagttgccaacctaaaaagtgaagggttactatagacccctcttgcatcctcaccccactcatctatcagtaggtcttgttggctccagctacaaaatgtatcccaaatccatccacttctcctgtctatactacaaccaacctaaccctgcccatcaccatatctcagatagattctgcttttcttaactggtctgcctgctctttgtccctctaaaacacagtctccacacagttgcaaccagagatactttcttttttttttttttttgcaacatctcattatttaaaaatttcaagcatatatagaagtaaaaagaacagtaaatcaaaacccccactacccaccattaacaagcatccaatcatggccaatgtcattcacctctatctctaattttgaggtaaatctcagatattacaccatttggtctataaatgatctgattttgcatatgtttgcgtctcttaaagataggaactttaaaaataaccacatctaaggaaaaaatcaataaaaattccaattaaaaaaacacaaagtgttttttttgtttttttttgtttgtttgtttgtttgttttttgacagggtctcattctattgtccaggctgagtgcagtggcacaatcatggctcaccccagcctcgacctcctgggctcaagcaatcctccctcttcagcctcccgagtacctgggactacaggcatgtgccaccacacccagctaatttttgtattttttgtagagacagggtttcaccatgttgccctgtctggtctcgaactcctggcctcaagctacccacctgcttcagcctccaaaagtgctgggattacagacatgagccactgcacctggcccagaatggtcttttcaaaaagtaaagcagaacatgtcatttctttgtgaaaaccttcccgtggcttcccatcatgctctgaacaaagccaaactccttcttaagactgctttcacatggctcctgcctatgcctctggtctcatttccagccaggctctccctgtccgtgcacaccagccaccttcgttcttccctgggagcccttattctagtcgttctctctacctaggaggctcattcctgtcatcttcctatgcttggctccttcttgtcactcaggtctcagcttatataaggacatctcttatcacctgtgtcaagtagccacccagccctcgccacatgactctactctaattctcgccatagtcttttgcccatgacatttccagtgtgtcctggacaggtttactcttattgtcaagcatgactattaatagcacctcattcactctcaaaagtaggcaacaaggctggacacggtggctcatgcctgtaatcccagcactttggagggccagggtaggaggattgcttgagcccaggagttcaagaccatcctgggcaacatggtgaaacctcgtctgtacaaaaaatacaaaaattagctgggtatggtggcacatgcttgtagtcccagctacttgggaggctgagtgggaggatcccttgagccagggagtttgaggctgcagtgagctgagatcacaccaatgaactccagcctggtgacagagcaagaccctgtcgcagaaaaagaagtaggaaacaaattttatgatcactctacttataagaaacttatttttatttgactttgactagcttatcacctatctccttctatgaggatataagctctttgacaggaggtctctctgattagttctttactgtatctacagtacttggctcataggagatgcttgataggtatctgtggaaggaaggaagaaggagggaaggaaggaagcaaggaaggtaggaaggaaggaaggaaggaagggaggaagggaggagggagggaggaaggaaggaaggaaggaaggaaggaaggaaggaagcagggaagggcatgaggaagggaggagggtgggtgggctcaggccctgacttttcagttcctggtttcagacatcttttgtagtacgtactgggcttccataatctcccgttaaaattcctgttttgcttaacatagatggaatggttttctgtgagttataaccaagcaattcttgacacctgctgatttcttttaataaattgtccactttcctcttcatgctatactttacttctagtgaattgctttatttaataaagaaaaagaaacttttatcagcaccatccttttaaaaagtgttttctttaatcgtaagctgttgagaagtctggaattgcaaacaaacaatcctaatacaaggtaattctttctgctccaaaatctacaataaatattagtgacactggcaataaagcttcagatcctgattatgcatgaacccgtttttacaaaaacgtttcagtggaagatataaatgcattgtcaaaacagcattaaacccttgaaataagagccagattttttttttataattcaagtatgtaaagcatgtgtattgccatggcctttgggtcattccatttcaggaaattcatgctttaaaatagtcattgtcaaataagagccattcttggaggaaacgaaaggttgggtattattcattcaaagagaacaatccaaatatcaaaactcattttgttttgtttttaataggggatgctgggggttgggggttttctctgaacttcagataacagataatgacaggaatgttgattcatagtgcacaatattgagaaaaaataaataagctcattccccaagtaacagtaacagtctttgaacaaagaatgaggaagccaagcatggaaggagataaagaagttttactaaagaaatgtgccccataccacttctccaacctcagctctgctctctttcccaaaagaaaagattatatttaacaaccaaagaaaattagaagatcatcgcacctccttccagtagcccacccccaaaagcaacaagtgccatttctgtaagaaaggcactataaattcatttatttcatgaaaatccattgtactgaaatgtgctaggatttggatgtacagtgtgagtaaaacagacaaaatctctgctttcttggggcttgcaatcttcttgaaccctcagaaatggcccaaatcccagcctatgtgatttttccatcaaggaggcagcattccattggccctatagtcagtcaaggggcctgggtgaaaatcctggctttacagtttacgagctgggtgatctcaggacagttacttaatctccctatgcctcagattcctcatctgtaaaactaagatggtaataacatctacctcatagggttgttgggaggattacatgaggtaagcaatgtaaagcagttagatcagtgcctgacatagattaagcaatatttaagagtttgccatttttatcattagtacagcaaagtgggattgaccaaaaaggtctgtatttagaacagttaatcaatgaatataatgcaccaaaacatccctgtacatagtttcctggtagccaggcccagacaggaattatgaggtttcttatttggagaaactgaatggctccagagaaaagaccttgatatggttaggctttgtgtccccacccaaatctcattttggattataatccttataatccccataatccccacatgtcaagggaaagaccaggtggaggtaactgaatcacaagagcagtttcccccatgctgttttcatgatagtgagtgagttctcaggaaatctgatggttttataaggggctcttcccattttgcttggcacttcttcctgccaccttgtgaagaaggtaccttgcttcccctttgccttccgccatgattgtaagtttcctgaggcctccccagccatgtggaactgtgagtcaattacacctccttcatttataaattacccagtctcgggcaattctttatagcagcatgagaatggactaatacagacctccataggatagcattcagaaatttctcagttcacaaagcattcagctccttaatttaaaaagaaggaaaaaaaaatttccaagtattgcggccaactccctgctgccaatcgtcctaaaacaactaccctcagaaagttagccccaatgaggtctgaagcatccccgctccactctccagcagctcacgcttcattatgcatgaagagctaagggtgaccagaactttgataatagagagacaccaagaaaagcaggcatctcatcagaaacaaagaaaacataagaaactgaagagaacctgaagcccctgaaagatcaggggaagatattgcaactataaaataacatcaaaattctatggggacaaaaaaaaaaaaaaaccaatagagaacaagaaagtttggggagcattaaaaataaaattgctcaaattgaaaattcattagaacagttggagaataaattaaaaagcacacacacatacacacacacacacacacacacacacacatatatatacatattagtcaaccctgttcccctcccttaacagtggcatcaagagtctatcttccctaacccacttttcttccctatcccgtgccctgggctatattagagtgctcttgacactagagacatctggcagatgaggctggaaaatgtccaatgagggatggaaagaaggagtgatggcagaagtggagcccaacttcatacctttgcagccgcctgggctcagtttctgctgcccctccctaggtgctcttcccctctgcatagaggcgacacctgatgaagttttcataagtacacaaacactggactggaattacacagactggttgtgtgtccaggctctgctatgaagtttccaaagaggcaagaagcatgtccatcagaacagctattggcttgcaatcttgttgtcaccattaaccaaaaagaaagtatcaattttatttgaatggcctttggcaatgttggtctgagaatatgtggcatgaaataataatgattactattaaattgattataagtacatacctatatcaactgatatataaaagaaatgattgagccaggcacagtggctcatgcctataatcccagcactttgggaggccaaggcaggaggatagcttgagcccaggagtttgaggtcagcctgggctaacatagtgagatcctgtctgtacaaaaatttaaaaattagttgggagtggtgatgtgcacctatagtcccagctactcaggaggcttaggtgaggggatcacttgagcccaggagatcaagtctgcagtgaactgttataatcataataataataataataataataataataaactgataatgtgaaagaaaagattaatatgtaaaggattgatccaagatctcaaacatttgataggagttcctgaaagagaaaaggaaggggataaaataatcaaataaagaactttttccaaggtttgaagaacataaatcttcagattgaaagaacttagcacagaagaaaaacctataccaaagaaacagcatcatgaaattctagagcatgagacacaaagagaagaaataacattcctacttcacacgatacaccaaagttgatgccaggtagattaaagacttaaacgtggaagtcaaacttgaaaactttaagaatagaatatagcatagtatcctcatgtccttaggatagagaatgatttttcaaataagacatcaaatgtacaacatataaagaaaaatctgtggctgagcaggttggctcatgctgataatctcagcactttgggaggccaagactggtggattgcttgagctcaggagttggagactagcctgggcaacatggcaaaactccatctctacaaaaaatacaaaaaaacggccgggcgtggtggctcatgcctgtaatcctagcactttgggaggctgaggcaggagtttgagaccagcctgaccaacatggtgaaacccactgtctaccaaaaatacaaaattagccgggcatggtggcacgtgcctgtagtcccagctcgggaggctgaggcagaagaatcacttgaacctgggaggtgtagattgcagcgagttgagatggcaccattgcactccagcctgggcaacaagaacaaaactctgtctcaaaaatacaaataaataaaaataaaaacaaactagccaggcttgctggcacacacctatagtcccagctactcgggaggctgacgcaggaggatcacttgagcctgggaggtcaaggctgcggtgagccatgatcgtgcaactgcactctagcctgggtgatagagtaagaccctatctcaaaaaaacaacaaaacaaaaaacacccaaagtgacacatttgactacattaactttaaaacttatatttaatcaaaggagtctgacatgatttggatatttttcctgcccaaatctcaaattgaaatgtaatccctgatgttggaggtggggcctagagggagatgattgggtcataggctcagatccctcatatcttggtgcagtcctcatgatactgagtgagttctcacgacacctggttgtttaaaagtgtgtggcaccttccctccctctctcttactcctgctctcaccatgcaacgtgcctgctcccactccactttgtgccatgattgaaagcaccctgaggcctccccagaagctgagcagaggctggcacaatgcttgtacagcctgcagaaccatgagcaaactaaacctcttttctttgtaaattatccagtctcaggtattcctttatagcaaaacaagaatggccaacacagagaacatatcaaagctgcgtgattgttcactcatccttttgtcctttcctcctgtactctgactgcagttctcagccttacttgcagcaagtgtagccatgtgatgacatagtggtcaatgaaatgcatccatctgggacaaggcaccctccatcacttaaagatacacagctaacagggcgtgtgttttgttttgtttttgtttttgtttttttattctcagtgttcaagacatatttgaagggaggaggaggtagaggttgccatgagctgtgatggtgccactgcattacagcatgggtgacagagagagaccctgtctcaaaaataaaaataatatggaactcagaatagcagcatttaactgttcctagaactttctagaaatggtcatcattcaacttcagcaacacgtatgcattactactacttcacaccaaaatccccatagttgcaaataaaatatgaaagtgctttgcaaatataaaaggtaacataaacagaagtgtgctaagaggaaagaagtgctaaaaagagagtgaaacccacaaaaaacattattttaatttcagtaagaagaaacaattgcaatgtccttagcaattcacttaccctcacttgttcttcagtgtctaagtctgtaacatggaggtaataataatacctcccttataggattggcgtgacaattaaatgggtcaataaactttggagcttagaacagtgtctggcatttcagcataataaatagtttgtttttttaataatattgccttaaaaatgtcaatgctcacagccctcagtaaaatgaaaaaaaaagagaatgaattgagagaagagggggctgaaacataaaaggagctgggcattttttacaggcaatctgacttgaagcctctctacaaaattatgaagcagataacactgtgcctgttttatagataaggacaaagagtctcgaaactatatggctattaagtgtacttcaggcacattttcatttcattttactttttttcctccttttattttatttttccataatttattggggtacaggaggtatttggttacatgagtgagttctttagtggtgatttgtgagattttggtgcacccatcacccaagcagtatacactgcaccatatttgtagtcttttatccctcgcccccctccagtccttccttcgaagtccccaaagtccattttatcattcttatgcctttgcatcctcatagcttagctcccacatatcagtaagaacatatgatgtttggttttccattcctgagttacatcgcttaaaataatagtctccaataatagtctccaatctcatccaggtcactgcaaatgcgttaatcattcctttttattttattgctgtgtagtattcgtatacacacacacacacacacacacacacacaccacagtttctttatccactcattgattgatgggcatttgggttggttccacgattttgcaattgtgaattgtgctgctataaacatgtgtgtgcaagcatcttttttgaacaatgacttcttttcctctgggtagatacccagtagtgggattgctggatcaaatggtagttctaattttagttctttaaggaatctccacactgttttccatagtggctgtagtagtttacattcccatcagtagagtagaagtgttccctgttcaccgcatccatgccaacatctgctgcttttttatttttttattatggcctttcttgaaggagtaaggtggtatcgcactgtggttttgatttgcatttccctgatcattagtgatgttgaccattttttcatatgtttgttggccatttatatatcttcttttgagaactgtctattcatgcccttagcccactttttggtaggattgtttgttttcctcttattgatttgtttgaattcattgtagattctggatattaatcctttgtcagatgtatagattgtgaagattttctcccactctgtaggttgtctatttactctgctggctgttccttttgccgtgcaaagctctttagtttaattaggtcccagctatttatctttgtttttattgcatttgcttttgggttcttggtcatgaaatccttgcctaagccaatctcttgaagagattttccaatgttatcttctagaatttttatagtttcaggtcttaggtttaagtccttagtccatcttgagttgatttttgtgtaaggtgagatatgagatccagttttattctcctacatgtggctagccaattatcccagcatcatttgttgaaaagggtgtccttccatggactactacacagccataaaaaaggatgggttcaggtcctttgtagggacatggatgaagctagaaaccatcattcttagcaaactatcacaaggacagaaaaccaaacaccgcatattctcactcataagtgggaattgaacaatgagaacacttggacacaggaaggggaacatcacaccagggtctgtcgtggggtggggggagggggagggatagcattaggagacatacctaatgtaaatgatgagttaatgggtgcagcacaccaacatggcacatgtatacatatgtaacaaacccacacgttgtgcacatgtaccctagaacttaaagtacaataataaaaaatgataataataaaaagaaaaggttgtcctttccccatgttacatttttgtttgctttgtcaaagagcagttgactgtaagtatttgggtttatttctgggttctctactctgttccactggtctatgtgcctatttttataccagtaccacgctgttctggtgaccacggccttagagtatagtttgaaatcaggaagtgtgatgcccccagatttgttctttttgcttagtcttgctttggctatgcatgctgttttttggttccatatgaattttagaattgtttttttctaattctgtgaacaatgatggtggtattctgatggggattgtgttgatggcttttggcagtatgtagattgcttttggcggtatggtcattttcacaatattgattctacccacccatgagcatgagatgtgtttccatttgtttgtgtcatctatggtttctttcaggagtgttttgtagttttccttgtagagttcttttgactcctttgttaggtatattcctaagaattttattttattattttttatttttttcagccattgtaaaaggggttgagttctggatttgattctctgcttggttgctgttggtgcatagaagagctacggatttgtgtacattaatcttgtatccagaaactttgctgaattcttttatcacttctaggagctttctagagaagtcctaaggattttcaaggtaaacgatcatatcgtcagcaaacagtgacagtttgacttcttctctactgatttggatgccttttatttctttctcttttctgattgctctggctaggacttccagtactatattgaagaagagtggtgacagtgggcatccttgtcttgttccagttttcagagggaatgctttcaacttttttccccattcagtgttatgttggctgtgggtttgtcatagatggcttttattgcattaaggtatgtcccttgtacgccgattttgctgagagtttttaatcatagaggatgctggattttgttgaatgctttttctgcatctactgagatgatcgtgtgatttttgtttttaattctgtttatgtagtgtatcacatttattgacttgggtatgttaaaccatccctgcatccccagtatgaaacccacttgatcatggtggattatctttttgatatgttgttggattcagttagctagtattttgataaggattttagcatctatgttcatcaaagacataggtctgtagttttcttttttggatatgtcctctcctggttttggtattagggtgatgctggcttcatagagtgaattagggagggttccttctttctctatcttgtggaatagtgtcaaaagaattggtaccaattcttctttgaatttctggtagaattctgctgtgaatccgtctggtcctggacttattttgaaatggtaatttttaaattaccatttcaatcttgttgcttgttattggtctgttcagggtagctaattcttcctgatttaagcttggaaggttgtatttttccagaaacttatccctctcttctagattttctagttaatgcatgtagaggtgttcatagcagccttgaatgatcttttgtatttcagtggtgtcagttgtaatatctcctgtttcatttattagtgaggttatttggattttctctcttcttttattggctaatcttgctaatgatctatccattttatttatcttttcaaagaaccagctcttgtttcatttttcttttctatttttgtttttgtttttttccatttcatttagttctgctctggtcttggttatttcctttcttctgctggatttgggtttggtttgttcttgtttccctcattccttgatgtgtgaccttagattgtctgcctgtgctttttcagacctttggatgtaggcgtttagggctatgaactttcctcttagcgccgcatttgctgtatcccagaggctttgatagattgtgtcattattgtcattcagttcaaagaatttttaaatttccatcttgattttgtttttgacccaatgctcattcaggagcaggttatttaatttccgtgtatttgcgtggttttgaaggttccttttggagtggattttcagttttattccactgtggtctgagacagtgcttgatataatttcaattttattacatttattgaggctcgttttatggcctatcatatggtctatcttggagaaaattccatgggctgtcgaatagaatgtgtattctgaggttggatgaaacgttctgtatatatctgttaagtccatttgctccaaggtatagattaaatccattgtttcttcgttgactttctgtcttgatggcctgtctagtgctttcagtggagtattgaagtcccccactattattgtgttgctgtctatctcatttcttttcttaggtctattagtaattgttttatgaacttgggacctccagtgttaggtgcatatatgtttaggactatgatattttcctgttggataaggccttttaccattatatactgtccctctttgtctcttttaaccactattgctttaaagtttgttttgtctgatataagaatagctatccctgctcgcttttggtgtccatttgcatgaaatgcctttttccacccctttattttaagtttttgtgagtccttatgtgttaggcaagtctcctgaaggcagcagatggttggtgagttcttatccattctgtggttctgtaccttttaagtggagcatttaggccatttacattcaatgttaatattgaaatgtgaagtactgttgctttcatcatgctctctgttgcctgtgtactttggttttttggtttttgattttgctttttaacttgtatttttgttttatagatcctgtgtgatttatgcttcaaagagattctgttttgttttgtttcaagatttagagtttcttttagcagttattttactagtggtttggtaacggtgaattcactcagcatttgtttgtctgaaaatgactgtatctatctttccttcttacatgatgcttagtttcactgaatacaaaattcttggctgataactgttttggctgaagataggtccccaatcccttctagcttgtagggtttctgctgaaagatctgctgttaatctgatagattctcctttataggttacctggtgcttctgtctcacagctcttaagattctttcctttatcttaactttgaatgagctgatgacaatgcctaggtgaagatctttttgtgatgaattttccaggtgttctttgtgcttcttgtatttgcatgtctagatctctagcaaggccggggaagttttcctcgattattgccccgaacatgttttccaggcttttagaattctcttcttcctcaggaacaccaatcattcttaggtttgatcatttaacataatcccagacttcttagaggctttgtccatattttcttattcttttttctttgtctttgttggattgagttaattcaaagaccttgtttttgagctctgaatttcgttcttctacttgttccattctattgctgagacattccagagcatttcacatttctaaaagtgtgtccaaagtttcctgaattttttattgttttttctttaagctgtctattcccatgaatatttctccgttcatttcctgaatcatttttttcccttgcactgggctttgcctttctccagtccttccctgattggcttaataactaacctcctgaattcttttttaggtaaatcaggaatttcttcttggttggacccattgctggtgaactagtatgattttgagggggtgttgaagagccttgttttgtcatattactagggttgtttttccggttccttctcatttgggtaggctgtctgaaggaaggcctaggactgaaggctgttgttcagattcttttgtcccacgggatgtacccttgatgtagtactctcccccttttcctatcgatgtggcttcctgtgagctgaactgcagtgattgttgtctctctgctgggtctagctgcccagcgagtctacctagctcagggctggtactgggggttttctgcacagagtcctgtgatgtgaactgtctatgggtcacttagctgtggataccagcacctgttccagtggaggtgatggagagtacaatggactccatgagggtccttagctttgtggtttaatgctctatttttgtgctggttggcctcctaccaggaggtggcactttccagaaagcatcagctgtagcagtatggagagggaccagcagtgggtggggcccttgaactcccaatattatatgccctttgtcttccactaccagggtggatagggaaggaccatcaggtgggggcagggctaggtgtgtctgaggccagactctccttgggcgggtcttgctgcggctgctgccggggatgggggtgagattcccaggtcactggagttgtgtacctaggaggattatggctgccttttctgagtcatgcaggttgtcaggaaagcaggagaaagccggcagtcacaggccttaccagctcccaggcaaaccaaagtaccagtctcactcccaccatgcctcccacaacagcccaagtctgtttccaggtggagggtgagaagggcttgaaaacttgcccaaggctatctgcctcccagctgcaagagaaaaaagctttagttctgcccttgcctgtgaagtctgaacacctgattcacgccctccccttagttctggccaggaggcttcttgccctgtttaaattgttacaaagttcaactagagaattccttctccctgtggagttttaccctctgctcctctggccaccctctggatggatccctgtggtgtcaggcaggaatgggctgtctggggacccagcaagctcccaaggcctttctgctgcttcctctacccctgtgttttgctcagctctctaacttgactcaggatcatgtaaagtcagaagcttctcccacaaacagtacttcagtttctccagtgggggtgtgtgttcgggaaaggaggatctccctttcccaattcaacagttggggcactcacagtatttggggtgtctcccaggtcctgcagaagcagtccacttctttcagagggtctgtggttcctctcaggattgctggtttgttcttgcagttgatctggagataaaattcacaatgcaagcctccgcatgctgcattttcattttaaaaggcactacaagtgctttacctttcagagaagccatataattccatagacacactccattatcatatgctaaagattatttaagctgttcattcttgctaaattgaaccataatcaaactgtcaagaaggcatagaaactcaaagactgctgttaaatcacccttttgccccctcattagcagggaaactgacctcagatgttttcatctcaccccacaagtgttatttctccagcctttactcactgccccttccctctacagtcctgagcctaggtttctagaagaagagaagctgctttggatgggtcccttctcccatatgtcccaccctctctctctatttaattttggcaaccttggctaatgtcaccagagatgtgtctgattttgtcagttttctcaaagaagcaacttgccattattgataacttttattttatctttgttttctattctatgtaatttacatgtattaagtttttagcctttgtagtgtatagttctgtgatttttgacaggtacaatcatgtaggcagaaccatgaagatataaagcattccgattatctctaaaaattccttacaaccctttgttgtcagctccttccctcgcctccaacccctgaaaattaccatgtgttttctattcctccagctttgccttttccagaatatcatataaatgaaaccatgtggcatatacctatttgagtctggattctttcagttagcataagatatttgagattcacccagttgttgcatgtatcagaagctagtttctttttattgctcagtggagttccattgtttggatggactacaggctgtttatccactcaccagttgaaggacattggggtttgggatgtgatatggtttggctatgtccccgcccatatcgcaccttgaattcccacatgttgtgggagggacccagtgggaggtaattgaatcatgggggcaagtctttcccatgcttttctccggatagcgaataagtctcacaagatctgttagttttaaaaaggtgagtttccctgcacaagctctatctctctttgtctgctgccatccatgtgagatgtgatttgcccctctttgccttccgccatgattgtgaggcttccccagccatgtggaactataagttgattaaacctctttcttctgtaaattgcccagtctcaggtatatctttatcagcagcgtgaaaacaaacaaatacagggtgcttatgaataaagcttctataaatacttgcacacaggtttttatgtgactatatatttgcaatttgcttggataaacatctaaagttggtattagtgggtcataaggtaatgatattttaactttataagaaactgccaaactttttctaaagtatccataccattttgcattcccaccagtaatatttaagagagagttccagtttgggtacagtggctcatgcttataatcccagcactttgggaggccaagggaggaggatcacttgagcccaggagttcaagaccagcaggctccatctctattatagttaaattaaaaagagagaggctgggcacagtggcttacacccatcatcgcagcactttgggtggccgaggtgggcagatcacttgaggtcaggagttcaagtccagcctggtcaacatagtgaagccccgtctctacgaaaaatgcaaaaattagctgggtgtggtggcacatgcctgtaatcccagctacttgggaagctgaggtgggagaattgcttgaacctgggaggcggatgttgcaatgagccgaaatcaggccactgcactccagcctgggcaataagagtgagactccatctcgggaaaaaagaaaaaaaaaaattaaagagagagttcctctgcatcttcatgagcacttggattttttatgtttctttttttgttattattatttttattttttatttttttctgagacagagtctcgctttgttgcccaggctggagtgcaatggtgcaatctcggtgcactgcaacctctgcctcctgggttcaagtgattctctcacctcagcctcccaagtagctgggattacaggcacctgccatcatgcctggctaatttttgtatttttagttgagacagggtttcaccatgttgaccaggctggtctcaaactcctgacctcatgtgatctgcctacctcagcctcccaaagtgctgggattacaggcgtgagcgactgtgcctggccagcacttgggttaaaaaagttttttttagctactttattttgggtttagtggtatctctttgtggttttaatttgcattttcctaatgatgctgaatatcttataaatgcttattgggcatttttatatttaagtttccttttgagttgtttgcccattttttaattgggctgtgtttttcttattttcgagctttaagagtccttcatctattttgtcctacagcacatattgatttcctgcttccttttttatcctcccaggggccacatctaacatttttgagatgagcatacagattgtgttttgcccagagccactagtcacaagggaaggaggggtccagatattgataaaagatgggaaaggccttgattgtacagtaatccaaagttttccactgtcttcatctaagttagaacaacacagtgggtctatgataagagaaaataaagaaacaacatggcacaaaagtcttaaggaatgggccaagctagtgaaagaagttagtttagtagctacttcactctgagacaggaccagaaggtacaattttcattctaccctttgctcaagattaaggatttattgtatgcccctcatcttcagtttcaacaggactgatctgattggctgagcactggagccaaaacagagaggaagaggtagcgtccaaagacgaggagacactggaaggagaggaagaggagtgcccttgcgcacaccagacagacagctcagtatgtactgagcaatgattttcttttctttgcttttttttggttgttgttgttattgttgatacaggatctcactctgtcgcccaggctagagtacggtggtgtaatctcagctcactgcctccctggttcaacctatcctcctgcttcagcctcctgagtcactgggactacaggcacatgccactacagactaatttttgtattttttgtagaaatagggtttccctatgttgcctaggctagtctcaaactcctatattcaagtaatccacccgcctcagcctcccaaagtgctgtgattacaggagtcagccaccatgtccagtaagccaccatgcccagcctgagttatgattttctatgttgcaacattatctggactccttgtgcacacttggtcaatagaaagatttttaggtaggaaaggcttagaaacggtaatctgtttaggagtaaaagaaagagcaggaggggcatgccgctatgtttgcaaatctcctcccaaaagattacaaatatcaatactccatatcaaagaagagagcagagatgaatctttatgctaatggactgtaatatcaatcttctagccattcaggacaaagtgaggataagaattagctcaactccccatcactgtttccactacatttttactttcacaaaggagaaaaattttaaatattctataaattataattatatactataaaatataattgttatatgataaatataatatataattataatatgcatatttgtatattttaatatatgtactcaatcactggcttttaactttagtcaaataatcgaaaccatcttcaaatttctgactccatattacttacttgacctgagaatatgttgtgattttgaagtactcacagcatccaggaaatgaaaaaagacaacctcaaattgcccaatctttctatgggaaacataagtagtatatttttatttcctttctctatgtcaaaagagacaattaaacctgcaatacagaagtctgaattccttcaaatcgacatcaaattactgtgccctagtaagtcaccaaatgtcttgacctctgcagattttttgttgacccctatactttggattatttccttaattatcagaatttacatagggctgttccacattgtggcactctatgcaagatgagtggttcagaaaacacatcatcatgggtcatcgtttataatgagaagtagattaacccaggggcatgccatcagatgatctgccaaaggtacagttgacaaagtcttcatcagtcagtactgatataaataccatcctcctcagcagatcatttgcaatgtgtctctcagagctaaatcagtactctaattgcaacatcagttaggggccctacttggtgatgagaggggcaaagataagaggatgttctcaactgaagctatttatacacaccacgtagtccttaattatctgtagggagaggagggaaataaagagaaggttgacatgactgaaattgaatccacccaccgccctttgtgccactccagcaagagaaaattcttactaagtaagaaaagtacttactttctaagagaaaaaggtaagaaacctccagttctatgagagtacagcctactcagttgccaactgatatttaaatgctaatactcctttttattgtgtgagtcttacaaccattcaagacttcaggagacttaaaaaaaagaaaacttaagttttatatccccaaaattaaacaagcagtctaggtagaatctccttttatcgttatagaaaaaagttgtggattagaaaattgattcagctatttcagaagtttggtcagtaaaaaatccagacttaaatacaagaaaacttcctggaactcaacatacaattattgataactgttggggctcaaaaaccaataccccagaatatgatgttttgccttcctgagctgaagaagcgtcagggtctctctgaccttccctgcccccgtccaagcgaagctgaagtttctttagctgcctaagatgcagacccaccaagaacaattgttttttcttaccaagatataaccacacctgagcagacccctttatcatttaaattccaaacagaactatttacaagttaatcctgcattgccccttaatagaattcctcttccccctcttctataacctgttttaccaggatccaagcccccattccttctgtaacctcaagatggtttataagcttctataccacactgagtagctgggccttcattctgaaggctcccgtgtatacatggcaaatagatttgtatgctttttctcctactaagcaatctgcctcatgttagtgattttcagtgaacctttagggggccaagagcctatggcccccacattacatattcataaattgatatatgccaggagattcaaaagatagtacaggatcaaacataaggtacacttgggaagaaataactgtaataataactgcctttatttagtgcttctatgtgtctgggactgtgctaaaaattttgcctatattttctcaataaattctttcagcatctcagtaacagatacagaattatccatgtattactgataaggaaactatggctcagaagattaatcaatccaagccacatagcattaaaggagaagtattaatattcaaatactcatctgactccaaagcctatatcctaaaatactactctttatggtacatatttgtatcaacctcatggcttatcttacccatacttcttgtgttcccataatgttgactgacctttttgttgatactggcccaattgtcccatagaactgatgtttatggttttttaaataaacagaaattgactctccttgatcttaaaacttgaaacttacattgttttatctgagttccttcctcaggaaactgactctcaggtaagaaactgaaactcatcagatcactgcatccagccagtgaagatgccagacccctcatccgtcatgattgcttcctgacccctccatgatttctgttttcccctacacagctaccttcataccctgctgtataaccactaaataaacccccaattttatttggttgggagagatggacttgaggctgatctctcctctctccagctaacaagatccaaataaaaagttttcttccctggcaatactggttgtctcagtgattggttttctgtgatgtgagaaaggtgacctagactgaacccctggcatttcagtgacattatgacctttgaaggcatctcttgccatttccccatgcatctttaagctgtgaatccactgtgaactgtttaactttctggttatttcccagctccaatctaacaatgaggtcattgtaggtctacatctttccagtctgcacagagactttgcactgggcaccctgacaatccagtgattgtgcatgtgtcctatacctagtctcattccaatcagccagtggctggcagagagggagcaggagaggaagggtaccctgcccttttagcaggggttctgtgtgggccagctttccttggcaaagctacagaaactgggattgacttgggtaacacaaatgcagactagtttgaaaccatcaaaaatgatactgtaaaataatatttaatgacatgaaaaagtccactaagttaaaaaataaatatatgcatttgtatatatgcactcaaagtctaaaagaatgttcattaaattattaacaattatcttgagaaccaggaacaattttaactttcttttttattcctttttgtgttatttgaacttacaataataaatgtatatatttgtaaatgttaaaaaatatgtaaatgttttctcttttggaaagaaataagaatctatgcataccatttgatgaagccatattattattattattattattattattattactattattattatagatggagtctcactatgttgctcggactggtccaaactcctggcttcaagcagtcgtttcacctcaacctcccaaagagacatattattttttaaatttatcataaaaaataaagatgaacttaaaaatatagccaggaaaacattcattgccatattggcaagataaaatttcaaataaaagagtccaacaacacaacattgaataaatatatccatcaatggatattttgtaattttaaatatattttattttaacagatatgacatggaaatatgtgcacaatatattaattgaggggaaagttacaaaacaatagagtatggatctgttttatagttaaaattcacgttaaatatatttacgcctagaaaataatctaaatttaacaaaaagtaggtgggattatagattattttaatcaccttaaatttatgtatctatatattttttattatcctacagtgaaccttcattacctatgtaattgttagaaataaaggtgggggtttgggggctttatctggttggggttttcttttcttttcttttctttttgtttttttttatacagatgaggtctcactaagttgcccatggtggtcttgaactcctggcctcaagctgtcctcctgcctcggccttgcaaaacattgggatcataaatgtaagctactgtgcccagccttgggtttctattttatttaaatatcaatggctctcattgggatttaggagttttcttttttgtcatctcacttgaccttgctgagagcacatgggaaaaccatcagcagttaaggttgtatagtcccaaaacaaaacagactagactaacgagtgtacattttaatagagaaggcagaggcaatttctcaatcaccatattaggttttcttaatgagtgttcatgtattcatcattgagtggcagattgtccccagagcctggttctactctataaagtcctgtgcgcctcatatccatggtaacaaaatatctgagagtttttatttgcaaacttggcaggctgctggaaagcaatggtgaggaaacatgaatattctaaggtagtacattatttcacagtagctgtaatatgaaaattatacctttatgaaaagtattatcttcctcaaaaaactgaaaataggattgttactggtagctaatccatatgggtctgcagcaacctcaattcttgccaccacagaagaaagaatttgaggggcataaggcagaaggagagactgaagcaagttttagagcaggagtgaaagtttattaaaaagctttaaagcagtaaagaaaggaaggaaaatacacttggaagaaggccaagcaggcagcgtgacctcctgatttggggttttataggttggcgtgcttccaggatcttgcattacttcttctcactcctgagatcttattgggaagctgctgatcagtttcaaatgttttctatctattaggagactgcctttccctggcaggagctgtaaccaattattactttacagaaacagttaacgatgttgcccaacactcctggtgtgtgtgtgttgcaggggctggggccctctcctgccctgctcatacctcactatcttcccactgtaacagggttaccattgatttggcagttccacttctaagtacctacccaaaagaattgaaggcagggacttgaatagatatttgtacacccatgttcataataatattatttacagtagccaaaatatgggagtaacccaaatgtccattagtggatgaatagataaacaaaatattatttagtcttagaaaagaaggaaattctgcacctgctacaacatggatgaaacttgaagacattatgctaagtgaaataagccagccacaaaaggggaaactgagtatgattccactcatcgtggaactagcccctcactcaacattgatgtaagatttgtccatgtgaatacctgtaaatccagttaatcattttaactagataagtcatattcatagagacaggaagtagaatggtggttgccaggggctggaggggaggaatgaagggttagggtttaatgtctacagaatttcagctttgcaagatgaaaaagttctgaagatgaatggtggtcatggttgtacaataacatgaatgtacttgctactgaactgtacacttaaaaaatagctaaaataatatattttatgccatgtaaattttataatttttaaagaaaaatctatataaactaaaaaatcattgtcaggcatgtaatttctcatgtagctcatttagctctaagatatatttcaaaattgtcttctttccacttccatggtccctggcccagttcagaccttcttcctcttatatgacctgaattactgtaatggcctccagaacttggccatgtctttctcccctccaactcattcctttacctatctccaactttatctttctttttccattttatttatttatttcaatagcttttggggtacaagtggtttttggttacatgggtgaaatgtacattggtgaagtctgagattttactacacttgtcgcccaaggagtgtactttgtactcaatatatagctttttatccctcatccacctcccacccttccctcttcttagtctccaaagtccattataccactctatatgactttgcatacccacagctttgctgccacttacgaatgagaacatatagtatttggttttccattcctgagttacttcacttagaatgatagccttcagctccacacaaatttctgcaaaaaacattatttcattcttttttatgactgagtggtattccatggtgtatatagatcacattttctttatccactcattggttggtgggcacttaggttgtttccatatctttgcagttgcgaattgtgcctcagcattatctttctattatcctttcatttacgaatttttttcagacccacagaagataatataagcacccacttacctgccactcagattcttaaagattattatcagtcacatctttttttgtattctgtggtgaccccatttctctccttccccagagtaaaaactattctaaagctggtaagtatcattctgtccatacttttacacttttataacatacatatatatgtgtgtatacatatttatgtgttgtctgtacatgcatatgtatatatgtatatactcatataatatgtatatatgtatatgtatatatgtatatactcatataatatgtatatatgtatatactcatataatatgtatatatgtatatactcatataatatgtatatatgtatatactcatataatatgtatatatgtatatactcatataatacataatatgttgtttcatgtgctttaaaaatctgacacaaatgctattatgcactatacagctttcctcaacttgctcctttcactcaacattgatgtgagatttgtctgtgttggaacatgtagacccagtttatttattttaactgctctagagtattccactgtagaaacagtaccatgatttatttatcccttcctctactaatggtcatctaggttagtttccattttttgttttacaaacaatgaataatccttccaaatatgtaagttcctctagggtgtacacctggaaaggcaattactagatcttaggatcaatgaggagcatttggatacagcaagggaaaacctggctcacaaaaggtctagagaagaatgttgctggaattgattcaatggctaagagatcagtgcctttattaatcttttgaccttcccttcattgtctcaacatgactatagcagttctaaacaccacttcctcagaccatactcaaaatcaggcagtgagggagagtacataaaaccatccagcagacatcctatttctcattggctagaaatgagtcacatagcaaccactagatgcaagagagaatgggaaagttagtatttgggttttccagcctctacagtgggagatgagaagggagaagttgttggaaatggcttttgggtacccaaccaatatatctaccacatcattaagttaactagatattgtgaaattgctcattcaatatagttgaacaaatttacacagcctcaagtaatatatgagttcccatctcccaaaattctgtcgatattgttagatgctttattttttgccaaaataatagatgtcaaattgtattatctcattgtggctttaatttgcattgctttaattattagtgaaatacagtgccttgtcaaatgttattgattatctagggttcctattctacaatttcctgattatatgctttatcccttttcccttgagtttttttgtcctttttttattttgttaaagaagttatgtttttttaaatatagtctagatactggtatttgtcagttttatgtgttgcaaatatcttctcccaattagtgaatttcttttagatttgtatataatgtccttgtctttatgatttacatttattatggtcttgttttaagaaatctttctctactgtgaagtcataaagacatttcctatattttcttccttcattttttaaagtttctgatctgacaaataggtcttaaatctctctaaattgatatgttcatatgaacggatattcatttttccatgtgaactatttcagcattgtctattgaataattcacaattcattgatttacaatgtctttccatcatatattatcatatatgcttgaatctgagtttatatgtcagcaataaattttttaaattgtgttatttaaatagtctatacctttactaatttttggtctatttgatctaccagtttctgagagagatatgacaaaatctcttccctttttatcataaatttgttgatttctactggtcaaatttttctgttacatattttgaggctaagttgttgaatgtatgtaagttcaaatgtagtaatattttcttggagacatgtaccttttattaatgtcttctttaatccccaagaatgattattgtctaaaatttttttgactgatggtgatattgttaatgcagcttttttttactcagtatttttgtataatttttttccattctttgattttcaaatttttgtgtcatgttctagaagtgtacattatattcctttttcctccctatttgaatgaaaactttatgttctgttttattattttcatagttaccctttaattttgagcaatactgaactaaaattctaaaattaatcaatttccctattgctctctggaaaaaactattagcttcttaaaatactttaattctaatccccccttccattttccatgctattattgtctagcattttcattcccccttgctttaaaaccctctaaacatgtctacgtttgagcagtcaatacccatgtagacttatcagcatgtttaccaatttgcttgtttaccattcttgcatcctactcttatgaggttattatatccaaagtatatccattagcaattctttcagcaatggtttgtgactctcaatgtttcatctttctttgaaaatctctttagtttgccctcatttataaatattttagctcagtatacaattctaggttaacaattattttccctcaacacttcgatggtatgagtccactgttttttgacatctattattgctgaaaaggtactgctgtaagtctatttacaactattgttcactagttggtagcatgtctaacattttatagctatgaagtttttcatttttgcctttggtacttcactatggtatgtctaggtgtgaatttgttcttagtttttattaatgctgctttaacctgagaagatatttttcttcaagctggaaaattcgtcattatcttttcacacactgcctctcctacactttttctattctctcctgaaactcttattagatatctattgtaccatctcattctattcttcgtgttttcatcttagttaagtaaattaagatattttcatacctttatttattttttttctttctctaagctgtattctggatgatttccttgaatctgttttccagttcattaattttctcttcaactctatgtaatcagatattaaatcagtcccaaatgggtttactttcaatgaacataattttcatttctagaaattctatttgtatccttttcaaatatatgaattttacattaatgttgccctattctttcctacactttgaatttcttattattaaattatatttatttaataatattaaattatattatatttattattattaaaatataaatattttaaaaatatttattatattctcactcagattattctttcatctcagtttgttgggatgttatttttcctattcattgcatctgttagttatcttacagtgttttgttttttatgtaacttgtaaatattcttagcattttgaattcattttcacctggaattgccttttctaagggaatggtctatatcctgagttatgggtgcttatgtgcagtacctaataagaggtgaaagtttcccaggtccaggaacaaagtacagtagtcccttgttatccatgggggatacattacaagacccccagtagatgcctgaaattgcagatagtacgaaatgttatatatactttgatttttttctatacatacatacccatacctatgataaagtttaatttataaattaagcacagtaagaaattaactttctttagcatatatttggcttttctttggcatatcaaaattgccagcatcactactattggccttcggggctgttatcaagaacaataaggtttacttcaacacaagcactgcagtaatgtgacagtcgatctgataagcaaaggctactaagtgactaacatgtgagtagtatatacaacatggatatgctggaaaagggatgattcatgtcctgggtgggacagagtgagatggcatgagatttcatcatgaagctcaggacagtacacaatttaaaacttatgaattatttatttctggaattttccatttaatatttttgaactacagtagactgtgggtaactgaaattacagagagtgaaactgtggataaatggggactaccgtattacagaggtagcaggagctggccacagagtgttgcagggggcggggggtcatcatatgtgcctccagccacaaggtatcctttttggaatttgacagtgtataaatatcattactattataccctagattttcctaatacagtcataatttcagacattgtcagtcctcatgttaagccagcgtttttcgctgcaggttgtgaagtatcagtgggttgtggaatcaatttagtgggttgacctgcagggcttttgtttttaaaatgaaatgcagattaaaatagaataggaaatgtcagagttgcattatgtaagaggaagtgttgggatttgaaatgttttgcagttacaaatgtatatgcatgtatgtgatgaaaaatgtatttcatgctgtgggtcatggtcaaaattgtttgaaagcctctaagttagataatatgtccagatatgagaattagaaaaaatggaataaattataaattagttgattttgttaaagtatttctatcagtaatcagagaagccagcaaaacatggtggaatgcaagtccttagtgttcctagtttatcactgcccttttcagaagcatatttctttctgaattcactccaacgtctccacaatctcgataggattttcagctctcttttgtgataatcacgtagaagtatgtctgtatgtgattatcataaaaggaaagcctaagtagtaaagaatatcaacaaatagcagattgctttaatattttagtctacttaagtaaacaaggatttttcctacccctctggctctttaaacttataagcttacatgttgatatgcctcagaaaattttatcttctcaacctcttgggttaagagaggcctagtgaggacaacatgggcggtcgacacgcttgcccaggatgaagcagtcagctagttgataccatgtgaaaccatgggaccccgtgttaacaaatctaattttcaaagagaaatgagaaatttttatttttatgtgaaatatcctgtttttaaatgttggggccaggtgcggtggctcacgcctgtaatcccagcactttgggaggctgaggtgggcagagcacttgaggtcaggggctcgagaccagcctggccaacatggtgaaaccccatctctactaaaaatacaaaaattagccggatggctgggcacggtggctcatgactgtaatcccagcactttgggaggccgaggcatgtggatcacctgaggtggggagttcaagaccagcctgatcaatatggtgaaaccccgtctctactaaaaatacaaaaattagctgggtgaggtggtgtgcgcctgtagtcccaggcactcaggaggctgagacaggagaattgcttgaacgcgggaggcagaggttgcactgagccgagatcactccactgcactccagcctgggtgacagagcaagactccatctcaaaaaaaaaaaaaaaaattagccaggcatggtggcacatgcctgtggtcccagctacttgggaagctgaggcagaagaaccacttgaacccgggaagcagaggttgcagtgagccaagatcatgccactgcactccagcctgggtgacagagcgagactccatctctaaataaataaataaataagtgttggaaatttattcaaaataatttcaaacactgtgaaagacaatgtgtccacaggcagccccatttgtgatctcttcccccagaagcatactagataaaacttcacaacgattactcctcagagcctccctaactttaccccattctcaccttccctccctcaccctcacgtcaactgctctccactttgagttactaacgcaattgatatgtgcctctgttacactgcttatgacattatatggtagttatgttgttgctgtttgctgttgttttcttttaacatatccatcagctctgctaaaaaataattaataattcaatgtggaatcctgaggttggggctgtcatagtttgaggaaatcagtttgaatcccagccctgatgagacaactttgggtgggttttcacatctaaaatgtgagtgaattataataatggataacatggttgttgcattgtcagccttgcaggagaagccatcacctcgaattcacatgtgcaggggacactgcaatagaactttctttgccttgatgtaaactgatgtcaattggacagatgtttcttggataccatctattcccttttgctgcagcctcttaatggccctctcaagcttctcaaactaggcatgttccatatgctgggaaaagtcatgctctgtttgacagtcaccttccgagggcctctgatagcagaactcggtgaggattatggagatagattgatggggagatcagccatcttgctgccacacacaccttgacagagagatttactgcctctccaatatcgcttccgaatcaactttttttttttttttttaatgggttctcactctgtcgcccaggctggagtgcagtggcacaaacatggcttactgcagcctcagcctcctgggctcaaggaatcctcccacttcagcctcccaagtagctgggactacaggcatatgccaccacacccagctaatttttgtattttttgtagagacagggtttcaccatgttgcccagggtggtctcaaactccttggctcaagtaatccaccagcctcagcctcccaaagtactgagattacaggcctgagccactgcacccagcccaaatcaatttttgctgttcattcccaagaggagaaaacattaaaaggttttccttttttccatttttcctttcttttcccctcaacctcccttcttcacccttataccatcctccttccttctggcactggttccccctcaagcaaaaagataacgtgtacctccaggattcttgataatcaaacaccatatgatttctatcagctgaatgcctggcaaagcaatacttccctcatcaaaaattaaaactggagtggcatttactttcctccaatatcacctaagaagttatagtaggacacgaagccagaaacttctcaatctcagcttttagttgagattattttgcccattggattatggagctctttcaatggtgaagttagtaaatttaaattatcgggaaattaacctttaaccccattgaaatggtcagagtaattctcaatctacagaaggaaaaaacaaaacatggcaactgagtgatttgttctattacaaatcctgtacaaggaataatttggaaactgggtggcttgttccaactgactataaaagttgagcaaatagtcaaaatgcctattatgctaatttttctttttttctggattctatgcataaggccagtgtgaacttaaagctctagttctttcatgcctgtaataaaccaaaagtttctgctcagagcagagtacagaattagaattgcccatttgtccttttttactattcttttaagacttttgcaggttcacaaatgatataacaggacactcatgaacgctgagctacagcaacagagacacatgtgtatctgtagtcagaccttcccacaaggcttcaggaagaaaccttgagtgcagactgatttttttaaattaagattatgggtagtaggccaggcgtggtggctcacgcctgtaatcccagcactttgggaggccaaggtgggtggatcacaaggtcaggagtttgagaccagcctgatcaatgtggtgaaatcccatctctactaaaaatacacacaaaaaaaattagttgggtagcgcgcacctgtaatcccagctactcaggaggctgaggcaggagaattgcttcaacccgggaggcagagggtgcagtgagccaagattgcgccactgcactccagcctggggcaacagagcaagactctgtctcaaaaaaaaaaaaaaaaaaaaaattatgggtagtgggtggaatattgagagtttatatgagccaggcactttctagatgctttataaggtcccatcatcttcacaacaactccaaaaggtaaatactagcattatttgcattttgccagtaaagaaaatgaggcatagggaggctgaaaggcccctctactatgtgtctgaattggaaccaggaaggcccatttcaaagcccacaatcttgaacactccgcaggctaaagcctcagaaccatgtctttctctcaatctggttggttagtgatgcaagaaaatggatagtcacatatacctttgtgtcatttatattccttttgtggagaaatatgcttgcatttatttatgacaaaaatctggctgggtgcggtggctcacgtctgtaatcccaacattttgggaggctgaggtgggcagatcacctgaggtcagaagatcaagatcagcctggtcaacatggtgaaaccccatcttactaaaaatacaaaaattagccaggcatgatggaacatgcctgtaatcccagctactcaggaggctgatacaggagaattgcttaaaccagggaggcagaggttgcagtgagccaagattgcaccactggctctccagcctgggcaatggagtgagactctgtctcaaaaaaataaataaataaacataaaataaagtaaaataaataaataaataaaaattaaaaaatctagagtggctaacctagatggaagtttgcctgtggacacacgaaagggggctggccactccatggttttaggcaggtttctctaaggggacaaggtttgagaaaagctctcaacaaagagaaggatgggggttggcagatgtggaaaaagagcttcctcttgcctgttcctggcacctcggccccaacccagatgtagagagcttgacttcagagactgctgccaaccaggcaggaatggggccaggggtgacagctggcttgggaaaggtggaggctgcccaaactttaggaaaactctttatcttggcaatggcaggtcttcccattcatcatggaaaggtaaatataggaagccatgagataaccatctgctaatgagggtttactttactaaggcagttcttacttacagatcaatccctggcaagtagttggtatttcccattgttagggaaaatagatttgtcctccaagatactctcaatacttcaaatctgacactaaataaaagaacaaacagtgttttctatgctcacactcagcacagaacacttctgtgaccagatgtgtggcctgttcccatgccagacaattctccaattcccacgccagacaattgtaggacaactgggtgtcctacaatttaattcaattcagacactatgtacctggaagtagcgtcagatcccacaggttcagggctcagtaccacaagacttctccccacctctcccccacacttcagacaccaatcatgagcccaagttgtcactggtgcctctgactgattggctgtaaatcagagcttcccagaacccatctcaggttccatcgtttcctagaatggctcacagaactcagaaaaacattttgcttactagactaccagtttattacaaagggtactgatagggacaggaggcagagaaattctaggcagaaaagggcagggtccctggtgaagccccaccttcaagcatggaaccataacctaaagtgaaaacgtgcattcctgctttcccgctcaaatgttgccttttccaaaaccacacacggccctctccaccccccatcctgtacccataaaaacccctaacccaactggtggagggcagagaaggggagaagagaagaagcagatggacgtcagagactgcggttgcacatcagagagaagcagcttgactttagagggacagcttgacggtgttgcttcagagaggagtccagctgggtatggctgtactccaggggaagatcaccttcctgctccatcccccttccagcttcccttcccactgagaaccactttcattggcaataaaatcctccacattcaccacccttcaattcgttcatgcaacctgagttttcctggacaccaaacaagagcttgggtgccacaagtgcagacactaaaggctgttatgctgatcctctgccctcatgaataggtagagggcccactgaactgtttaacacttaaggcatctgtggacagcaatgctaaaagaccactgtaacacacgccctctggggcttcatgggtcacagggaccacaccccctctccgcccagatgctgtcacagggcctcacagagttttgctcctgctggcgcccaaaaacgcttactccagctcctgcacccgctcacctgcatgctccccctccctcaaggggttaagagctgcaggctgagtaagggaagcaccccatcacaagggtcaagggaaatttcttgtctcagtacaactcagaaacagccagatggaacagatatgttgcccttgcatatgggaagatactggacacagggtgcagagcttccttgccctctccaggtatgccacccaccaggcacctccgcaaggtcagcaacccacaaactctctgagcccatccttctgagtttttaaggaagcttcattactgcataggcatgatcgattacatcacttgccatcagtgatcaaccccctcagccttcagcccctctccccttacctggaggtaagagttgagtggtggggctgaaagtcccaaccctctaatcacatgattgtttcccctggcaaccagccaccctacctccaccccaccctgcttgtccagaggccatccagaagcccccagccttcagtcatctcattaacatacaaaaagacacttatcactaaggaaattccaggatatttagttagttagttagttagtttttgagacagagtctcactatgttgcccaggctggagtgcagtggcataatctcggctcactgcaacctccatctcctgggttcaatcgattctcctgcctcagcctcccaagtagctgggattacaggtgtgcaccaccatgcccaactaatttttgtatttttagtagagacagggtttcaccatgttggccaggctggtctcaaactcctcaagtgatctgcccaccacggtctcccaaagtgctgggattacaggcatgagccaccacacccagccaattccaggggttttaagagctgtctgccaggaaatggaggcagtgaccaaatatatttttgttactatatcacaccatgtacatttttaaaggcctgagtgtcatttctaaagaaaggagggggtagtaggggctgtcagaagtgggtgcaacattctaaacacagttgccctcactggcattataaatcattgctgttcatttttaaataactgtgcacaagaaaaaaaaacagctttagaaacctttacaaatttaggtaaacttgtctggagtttttggttgtttcgtttgtgaaaagctgttttcacaatcccaagcattgataaatgaaagctacagcatgcctgcataacccaggaaggctctggacagatgacctagctgagaatgagccagcacttgtatccacagtttctaccttctaaagatagaaataactgggcacggggcagggaagggtgtcccacagggacattttgaccaatgctaaagaaataaagaggacaggagcccccaccacaagttcagccagattcagccagatgagaatggtaagtgggacttcaggggagccagagccaacaagagagaagtcctcggtcatgagggcatgaaatcagagggacaccttagggtggcctattggccagctttcagtgtcccattgaaaaagcatgggttgttccaagccactgagcagctgccctagggagcattcagatacttgcccaatagtccacagggtgacccacatttttgttgctgttgttgttctttcaagaggattgagcaaggcagtcgactgacaacttgaaacccagcccagctcactggcctcatgggggtagaccagcctgctttgtgtagtacatccaactctaaactagatttccttgcttcctactgggccagtccaatgtgatgcccatgtcttacagtcttccaatagttttaaaaaaaagaaaatggaaacaaaggaaggaaggagggaaggaaggagagaaagaaaggatggacagacaagctggatttctgcacctaagtattccagttaggagacaggccaaaggctgggcttactttaccctcaagacaatctgtaattgcccaaggggttcagcttacccactgcctggacagagttaatttctcaagacagggggattgcaatagagaaagagtaatccatgtagagccagctgtgtagactggagttttattattacccaaatcagtctccctgagcattcagggagcagagcttttaagggcaacttggtgggtggggggtaaggcagtgagccaggagtgctgattggtcagggatgaaatcatagagagcagaaactggcttcttggctgggcacggtgactcacgcctataatcccagcactttgggaggctgagacaggtggatcatttgaggttaggagttcgagaccagcctggccaacatggcaaaaccccatctctactaaaaatataaaaattagccaggcatggtggtgcgcacctgtaatcccagctactggggaggctgagacaggagaatcacttgaacccaggaggcagagattgcagtgagttgagattgcaccactgtactccagcgtaggtgacagggcgagattctgtgtcaaaaaaaaaaagaagaagccagcttcttgcactgagtcagttcctgggtgggggccacaagatcagatgagccagtttatcaatctggctggtgacagctgatccatcaagtgcagggcctacaaaatatctcaagcactgatcttaagagcagtttaggaagaatcagaatattgtatcctccagctgcataactcctaaaccataatttctaatcttgtcgctaatgttagtcctgcagagacaacctagtctccaggcaagaaggaggtatgctttggggaagggctgttgtcatctttgttttaaactataaattataaactaagtttctcccaaagttagttcagcctacgcccaggaatgaacaaggacagtttggaggttagaagcaagatggagtcagttaagttagatctctttcactgtctcagtcaaaattttgtaaaggcggtttcaaatcctatgaaggaaatactattccttttgtctacagataagaacatcaaggcacagagtgcttaagtaatctgcctcaacctgtcaatatttttttaaaagtctatgtggctctagaatccagatgtttaaacactatcctgtcctccctctcaattagatgattaaagtggtttgacagtacctgctttatagaaagagttcaataaatattggctacaattattattctccttttatacatggaccttcatattttagttaaaattatcagctaagattatcagttaattaaaacatttaaaataataatataataatttgtcaagtcatatttcctaggaatttctactaggtttaggaagtatctctggtagccagcctccaagatggccgccaacaatccctgcctcctggtattcacacccttgtatggtcctctcccatatggtatcagggttgatctgtacaatcaatggaatgccacttctgagactaagttataagaaattgtgacttttgcctttctcactttcacaataagatccctaactcaggtgggataagttagctgccatgttgtgagtagctctatggaaaggcccctatagtgaagaactgaggccacctaccaacagccatgtgaacgggccatcttgaaagtggatccttccccagtcaagccttcagatgggcacaacccaggagagaccctgagctagaactactcatgtattagtccattttcatactgctatgaagaaatacctgagactgggtaatttataaggcaaaaaaagtttaacgaactcacagttccacatggctgggaaggcctcacaatcatggtggaaggcaaaggaggagcaaaggcacatcttacatggtggcaggcaagagagcgtgtgtaggggaattgccatttataaaaccatcagatctagtgagacttattctctatcataagaacagcatgggaaaacctgcctccatgatttaattacctcccaccaggtccttcctacaacatgtggggattatgggagctacagttcaagatgagatttggatggggacacagacaaatcatatcaacctagctaagccacctccagactttcgagcccttaaaaacaatatgagataacaaatgtgtattgttcaaatccactaagtttggggtcactgttatgcagtgatacataactaatacatcatctcttctagaagccttcaactgacccccagcattctgtgccatatcatagcacctactatattctgacttacatcttttcccttcattctcccattctagataatgagatcaaggacagggactagctcatactgatttttgaattcccaggatctagcataatgctgcaattggtgtggacttcaataaatgtatattattgagctgaactatcttcacttactgtacatcctttgtccttaaaatatagtttgcatttcagatttctcatgaattcaggtagttcctgccatctaaacaattaggcctggtttcactcaactagtatttgattattaaagtcaatattaaaattgtactatccaagatcttagacacatcttttttatttttgcaatagaatcatatcaacttgtaacagaagaggtttgatagtacgtaaggtagcaacattcctctgttttcaaagtaattgtgccattagcccagaatttttcttttttccaaataggattaaataacctggagataaaagtagttctccaaaggaaaaggtaaaataatttcacagaaaatatttcctgagttggtcatatgacatcagagattgggattaaagattttatttttttaactcatttaattcatggaatataaatttattgttatcaaagatatcagttcaattttattattgaacctgtaattcattctatactttgatcctgtgaagaccaaattcatcattttcttcaaaaatgtcatataaaacttgagtgatcagtgacattctttattttgtttttgtaaaataaggaagacattaaagccatatgaacttcctcagtaaatggaaagcagtccacatcaatgcattcctcatcatggtcattaccaagggattcactacttctaggaggctctatcctcagcaaacaaacaatggcccacttcatcatttccaagttgaagttccttgccccaaaatatactacaatccaacaaaggaatggacatcattcttgctgatatgtccccagatgacagcattcttaagagaagtttcacagctctggataatgtgagtttatctgcaagcattgacacaatacacattcaagggaagtggtggtggtcttggcattgacacacagtggaaactcaacagtgacgtagactacagtcaacacacatgtaacatcctcaggttatatcccacttcagtctagcctggcagaaacaactaaaataaaatacataagcatgcaacatccatataataagttcaggaattaaggatgagaatgaaaaccatctatcccatatacacagcttgggaactaaggacttgacctgtctctctaactctctccctctcaacacacacacacactcacacactcactcacacacatacatacactttctttcctacattaacgtaagtttactactccactgtcttcattagcataactttactattccaggagattctagcctaagcaaataatttgattattcattacagaaacttcccaaaaagatccttcactcttcaacaggaagtaccagcagacggttaacaccctaaggatcttcaaatccctcaactcaaaatcctttccttgctgtttccaattctacactgttgtgttattatccttattcaatcttcatcaagctcccttaccgaaagatcaccttaaaccaaactcccaataaaacatattttttaattcaccactgatcggaaggcataaaataattttttaaataataaaatacaaccttgcttttttcccctcagagatattaccaaagctctgcctaggaggtgatcttccctaccacaataaacaatacagatagctttgacttatcagcaggttgtgttggtgatatttggagagccagcatttgacaagtacttagtatggatcgagcaataagctaaaacatttggaaactgatatatggcttaatctaagctaaaactaaagcatctggaaacttaatctatttccccctagaggtcagaggccctcactgtttaaacaattccacatctggacatttaaatttctgcctggtccagcatttgctaccgtatgttaagaggaattatttgtctaaatgaaaaaacgtttccatggtcaaacaatttgaagactgatgagttaagaataaaaagcatcatttcttcactgtgggacttctcagggcctttagggtatactactgggtatcaaaaatatccaagagggagttattaatatatagcctacgcaaaatgtatatagatgctttgtcctacagtaactccctagattctcactggatacaacagggatgatggacagttttatctaaccttccatcctgccgtttattcacaggccatttccagagaacatggtcagaaaggaagataaatgaccacagctgtcttagccctcagcaatcagctccgtggtaattttagggctgccttgatctgtgggcaggggaaaatgaaggaaatgaattagcctgagtcctgccagcctttaaatgaggatgcctgtgtgccctgagctatgcttagctaattccagcccttctccccaaagggaatgctggtctttcaatatactgccaggagttccttaaacctttcccacatctgtgaacaccaggcagaagttgtccaaatggtccaagttgctgatctttgctcaaaggaaggccctgctggcatggacccctcagtttacaaagaggtggcatctgacatactctgccccactaacagctaaaatcctcatgctgttatctttcttgactgtacccttctgctaagatctccacttaaaggacattgttttggtcagcactctgacttgcttgttttgggtaaaggagaggaaattgacatttactagacactttctatgcgtctgatgtcacataagacactttacatgctttattccatgtaattctaacaagtgcaaaaaaatcataatagcaaatgtttatctagtgtttcccatgtaccatgcactgttgtaaatgctttacatagtctcactctctcaaggctcaaggcaactctacgtggtagatgctgctattacccccactctataaatgagcaaatagaaggataaagaggtgaaaataatttgtgtaaggtcacatagacagtagcagagccagatcggaacacagtcacagtccatgcatctaaccacactaccattgtctgccattatctgtcctgtcagatgagaaaaccaaagctcaaagaagcagctctctcaaaggcacaccggaagtggaagaactggtaccagaacccatgtctgtctactcccaagtccgtgtttctcctctagaccacaggctctcagagcatagttcccagaccagcaacatctgtaacaactgggaaacttgttagaaatgcaaattcttggccccactccagatctactaaatctgaaagtctggcatggggcccagtcatctctattttaacaggactccaggtgattcccatgcagactaaagtttgggaggcactcctctacaccatgctgccttctgtagagcactgaattttgattttaccggcaaggactagagatagtgctgtctagtggttagaagctctgggaagctaagaaacaacttggtcatgacccagcatatttcactgtccttgacagtagacaggccaggggttgctttttccccccttagcaaattcatggagcagaaaaagaacagctgcactgtggtcaagaggaagactggattctgtccttggccatcctttaccctgctgatcacttttcagatccagagattctcagtgcctttctgttcaatgttctgctgcttttgcctgccagctttgtcagctcctacctgtgacccttcttgtctttcaacccctcccacttcaggaggaagcacttctgtggcaatatgttcagctgatgagctgccctcctggttcagatattgtgcaatgcaaaacatttcttaacaattccggaagcaaactttttttttctcctttattgctgtcaggatcagttcagtagctacactaaagctttcaccactcactgcttcactgaaaagtttaagaccagagcgttctgctgaatcaagctgttgttgagaggttcagtgtacgtatataaaacagaacaataattgatttttatagaggctgaaagaaagttaaggaatcttggatggctcagggtgggagcttgaaaggcttttgactcaggatgaaggatcacatggtcctcaatttgtgcttaatagctacaacatggggaaagagagagagagagacacggtatataggggaagaagctaagttagcgccaagctgagtattttgcagtcagggatcaaaaggatactacttttaaaaaccatatttcttctttaacaaacattaattcaagctcattgagtttctgtaggtcatacgtttcaatccaggatcagcaacacagagtgtgttatttcactttcaatgctgagggtggggacctccccctgcgagaacatgctgtatgttgattaaagttgcaaggagagctatgaaggatctgcccaaatctccttaatctctttttcttccttcttgataggtttctagggatctgttggttgaattgttctgtgcttgatatggaatcttggtttttattggcccacagtaaaactaattactactggaaagggcaccaaattaagattagcaagcctgacttgatttatcaaaatggaatgtatgtatgtaatgggtgagtgtgtagatgttagaatcaggcagaacactcctcagtttatgacctctccaaaacctggtagcggccgggcgtggtgctcacgcctgtaatcccagcactttgggaggctaaggtgggcaggtcatttgaggtcaggagttcaaggccagcctggccaacatggcgaaaacccatctctactaaaaatacaaaaattagctgggtgtggtggcacatgcctgcagttccatctactcaggaggctgaggcaggagaatcacttgaacccgggaggcagaggttgcagtgagccgagatcgtgccactgcactcctgcctgggcaacagagcaagactctgtctcaaaaacaaaacaaacaaacgaaaaaaacctggtggattatcttaaggattaagtgggaaaatacaggtaattcccaacctgcacagctggggcattcaatactgttaactgttatcagtgaattcgcactcatcggagtctagttggtgcccgcccctgtgctggcgaggccctgcaggatcacagagggactctctgttgggggcaggcctagttgcagctgcactattgtcagcacacctgcccccaacctagccctgtgactttcgagaagctctgtaaacccctaatcctccataccttctcatctgaaaaaacccacatcctcctggggcttacagagagcaagtgaatgaaattgtctgaaaatttcaaattgctcttccaggctaataagagagtatcataatttgttatataaatagaatatacacttttaaatttctcaatctgattttagttgaacttttagtgctgtggcataatagaaagaattccttaaattgggattagaaaacctgaatgtaggtcctggttctgagatactgccatttattagctgtgcaactctgggctagtcacctaaccaccccggacctcagttttcttatctaaaaacctggctaagattatctaccccttaggcggattttttttcttttctctccacactctgcctaccccacaggtttttgtttgtttgtttgttttttgagacagagtcttactctgtcactcatgctggagtccaattgcgcagtttcagttcactgcaacttctgccttccagattcaagcgattctcatgcctcagcctcctgagtaactgggattataggcacgcaccaccatgcccagctaatttttgtatttttagtagagatgaggtttcaccatgttggccaggctggtctcgaactcctggcctcaagtgatccacccacctcggccttccaaagtgctgggattacaggcatgggcctccgtgcccagccccctataggtttttatatcaaaaacatcactccagcctggtcgagagagtgagatcctgtaaaaaataaacaaacaaacaaacaacaacaacaacaaaaaacacctcacaactctacaggcaggaattactcttcctggcttgcaaatgggctcagggacttaattatccagaagtcacacagtgaataacctgagatttcaaaccaatacctgagcccacacatgtaatcactattattatcactgttcttttattgtgcgtgccatttttggaagaacaatgaagtctatttgggttgacgatcccaaatcctccatcttaaatcttcttattaaactgtgtgaaaaagttaccatgtaatctaaattatgatctgttttcctaccttcactcctccaaaataattgcaattataaaacacttgatgtaaattaatctctgttcctcaaacttgagagttacattaaaaagtctcaattataaatgacagatagatgctgttcctagagcgaaatctatcttggtttgttctaggattttaaaaaatatttgatgtaggccaggcacggtggctcacacctgtaatcccaacactttgggatgccaaggtgggtggatcacctgaggtcaggagttcaagaccagcctgaccaacatgagaaaccctgtctctactaaaaatacaaaaattagccgggcatggtggtgcatgcctgtaatcccagcaactcgggaggctgaggcaggagaatcacttggacccgggaggcagaggttgcggtgagccaacatcgcgccattgcactccagcctggtcaacaagagcgaaactacgtctcaaaaaaaaaaaaagaaagaaaaagatgtaaaatatgccacagagagagagagagagacagagagagagagtctttaaagcttccctcaccccattcctgacaaaagcaacagaaaaaaattttcccaggacccaagctcgagatattcctgataccagccacctccacaagcaaggctgctgtcagtggaactgagaagctgccaagaagctaggccatttctactccacatttggtctgaggccagagtgttgtctttcagtttttagacaaatctcccagggtgatgtagacccagcaataaccatatgtgaccatcacagcctgcaggaaagagaagaaaggtaaagacggctttcataaatggccctgatcttatctgcaaaagctggacagctctttttccaatacagaagcagaaacagtcgagattaagctttgcttagggaggtagggagttctagttcaatggtccaaatcatgctaatcaacttctgcaaaggacagtgtcctggagctgtgggccttgaacagcaagctcgggtccacaggtttggccacagtatgactatgcctgtgttatttaaagtttgtcccaaggagtgttatgatgtgcttggtatgggcttcacccccagcaggcacaagcatgtgcatgcctcattggcactgtgtccgtatggagcattgtgaagggactatgtggaaggaacaggaaaaaagagactacttaacatcctttgctttgctctgccacgttttatatttacaagcttctgtgtagaaggatactgatgtatgttcttggcttccataagacagtgggggtgacaggagtaaaaaggaagacgcctaaagacactgaagtttcctggtctatttggtcaacaactatttaataggggcccaccatgaatcagataaggtacacatgctgcagatacaaatgaccaagagcaagcctgactgctgcccttatggaacttggtatctagtaggggagtcagccaacaatcgaatagtcacataaatgtatggaaaatggaagctgtggcaagtgctaagaagacatggtcatggtgccgtgagcaccattaatggaatctgacccagtccaagaggtcagcaagggcttccctgagaaagtgatgcttcaactgagaccttcaagatgagtaggtgctaagtagtgaaaggaatgaggatgggaggcaaaatcctggccaagtgaatagcacatgcaaaggccctgttttgggagagaaacagcttggtggaaggtaggagatctgacctaagtgttaccaggaaggccccccaacccctaaacacctctgcctcctaaaattccaccattattaaggaatgctttgggttaagattgtttttctcttgaaatattcccttttttttttttttttttttgggcaggagaccagagcttattattactcaaatcagtcttgctgaacatttgtggatcagagtttttaaggataatttggtgggtgggggaaggccagtgagttgagagtgctgattggttgggtcagacatgaaatcgtagggaattgaagctgtcttcttgggctgagtcagtccctgggtggggggccacaagatcagggggccacaagatcagatgagccagtttattgatctgggtggtgccagctgatccatcaggttccgggtctgcaaaatatctcaagcactgatcttaggaacagtttagggagggtcagaatcttgtagcctccaactgcataactcctaaaccataatgtctaatcttgtggctaatttgttagtcctacaaaggcagtctagtccccaggcaataaggtttgttttgggaaaggattgttactgtctttgttttaaaccataaactataaaataatttcctcccaaagtcaattcagcctacacccaggaatgaacaagaacagcctgaaggttagaagcgagatgtagtcagttaggtcagatctcttccactgtctcagttacaattttgcaatggcagtttcaatccctccctttgggttttataacaccttaacctcaagatgttggcaattgaagatggaaaaagagcaaagactgctctaacttcttcctgctgatcaagggcatagtgagggtaggtgtcgaccccaaggtaaggggagtagaactgctttgcaactgtctgaaagtactcatgcaggcctggctggggtcccaaggcttgcatggcaaaggcgttagtattattatttgcagttttagtaccacgtttgagggaatagtatgctataacgtaaataatgagtactagtgtaaggaatgcaattcccagttttaaaagcaaaaattttaaagcattactttgggaacttgtagcccacaaagaatttaggatttagccaaactgaagaaaaaactcaagaacagctaatagcagatgtactatagacttttgttttgttttggttttggttttggttttggttttttttgagacagagtttcactcttgttgcccaggctacagtgcaacgacatgatctcagctcaccacaacctctgcctcctgggttcaagtgattctcctgcctcagcctcccgagtagctgggattgcaggcatgagccaccatgcccggctaattttttctatttttagtagagatggggtttctccatgttggtcaggctgatctcgaactcctgacctcaggtgatctgcccatcttggcctcccgaagtgctgggattatagcatgagccaccgtgcccggcccagatgtactatagttttttgaagcataatttttttctttctagtttccatttttattaaaaacaaattatgatagaactgatttgtttgcaaaagtaaattttagtcttattagatttggtctgattatttgcataaagtgtagcaagaatgattatttcccacagaggctttttaaattggctttgatggaactctattccataaggaatcttagataagactttttaaagctgagcccagccatgggtttgtaagcttaaatacctataagttgggtaaatttctcttgacatcccaagataacttggggctcctgagcctgttagaaagtgacatttttttacttactacaggtcgggaaccctgtacagggattgtgtagacaaggtatgaggtcagttttcccaaggggcttttattggctttgtaagtcaactttgatttttttttgtttgctttttttttgttttgctgagacagagtcttgttctgttgtccaggctggagtgcagtggcaccatctcgctcactgcaacctctgcctcctaggttcaagcaattctcctgcctcagcctcccaagtagctgggattacaggtgtgcgccaccacatctggctaattttttgtatttttagtagagagagcgtttccctatgttggccagctggtctcaaacttctgacctcaggtgatccacccgcctcagcctcccaaagtgctgggatgacaggcatgagccactgtgcccagccacattagtgcatctctaatgctaaaggtagttttcaaatacaattttataaatctattcagttttaattaatttgaccagaaggtaagatttccataaactttttagaaccctttacaattttccattaaacagcagattaattttttaagaaaaccgtattatttggacacatgggcccataaaatcagtatgattttaatgttttaacctatagaaacaagctaaataatctcctttaaattttagccaacttgcttatacccacagaatgttttacaaggttaaccctttacaaacccttttttaatttgcttaaaccttcgattttgtcccattactcttctaggttaagacaatcttttaaaaccctctgaactagacaaaattacattctctttaacaaaaagcatattcccatatcttcttataatctcccaccaagattatattctgcttttcttctatacctgacaacttatatgtaaaactgtttctccagtagtctcaattgtatgttacaatgttaactcttagcaacttttatttttggtgaaaaacctaataagtaggcgatttatttaggtacgaggtgtggagcctaggacatcaggagtactgacccttttcagcatagctaggggacatggctttccatatgtccccaggccttatctataatatcatactccaaagtaggtaaattgaacaattttcaaaagtcaaagaagcagtttatgacttaaagcatttagcaaatctaatatctgaccttaattgagaccaaatgtctaaattttgaagacatttttattttactaataatctttaaaactgaagggttacttcttgttgttacttcttgttgtgaacaagaaggcattaaagtttctatttttctgataaaatatgatttaagtgctttttttctaagccaattaatcagctcttttatatataaacatcacacacacacatataaatacacagacagacagaagatccagtagttgtaagacttttcatttgccagttttttaattggattactggcttcagggtggatcccttggatgagcagggccaggaaagcatgcagtttttaggacctaataagtaggcacagctggaaggcaaagacaaatcctcaaaattaaaggtgccattttatactggatcctggatccccaaaaaggagggaaatactacaagagaagatagtgcagtgcttctaccatgcatttcattgcaaggcaattcaaagccaatcagcccattttttaattagcccatccccaacgggagtctcatctttcagtgggggttggggatgtttccatatcccacttccaagtggccaagagcatgcttctttgacccaagcaagtaaagagataagtatctcttcataactgacattagccatttcttaaagtatatatatattttttacctagttattacacaccaaggctaaaagctttcccataaaataatttgattattatttcccataaagtaatttgataccctcaaaagtcaaaaccattagctaaagcaaggcaaaacaaaacagagccttagattttgagagggatttattgttttcaattcctggggttccatgaggaaaagaagtttttcccagaatggggtctgtggtgccatctctgtttttccccaggagtcccaggttgttagtaattatcttgagttttttcctgtggacattaacagtggcaagaagacaaaatggagaaaaacaattcagtctactgagaagaaaaaaactttttcagaaaaacacaactcaagaagaggaaaaaagataaaggccttttaagtatgtataccttgggtatccatttttaattaagttgaatttaaccataaagttcttttctcaaaaaaaaattgcttattacccaggacagccaatatttttggcttttgaattgtaccacaggtaaccttccatgagaaattagtaagttttaactaaggttatgacttaaccatggatgcacaaggtgtttcaaagacatgataagcagtttttttccttatttatttcttttcttcttttttttttaacaagatttagaatctccacaagggtcgttcagagaaaggaaaatccaatcaggaaatcagaagctatccatggggcagggggaaaaatacacctcaatattagtggcaaagttacacaaatgacaaaccagaaaggaatcattctggaagccaagaattgaacccgagccaccattgtcaaaaggcaaagccttacctactgagctacacgccattgagcagtttctattgctgtgccctgaagaagtctaaagcagccaattccaagcttgcaaagcctcttaactgttcaaaataatttttagggctaactatgacatgaacccccaaattcctgtcctctggttggaggaaaccaaaagaaagtatctccacatggtcacaaagttaagctcttgaggacacaaaacaagacagagaaatttcatctggtattcgtttcagggaccctcagcaaagtttgtaacagaccagcctgccaggctggcttgaaaagcgggaatataggagttctaaacctacgttttatcttgtgatgcccatctctccattatagaacaacatagaaagacaaattcttagcacaaagtacaccagatttgctacaacctaagactagtctcacaaatcctttcttctattaatcaaacccttgtagaggagacaaatagtggtgtttaccatttacacacatacacacacacacacacagagagagagagagagagagagagagagaaagccgaaacttggctggtaagattttcttatcctttttgctggcatactaggtttccaggttctctttcttcgcagcttccacagaaacagagtggcttttgatgatcctgaccactgtgccataactgtgagggtcaagccacccaacaaaagaaaatcacccctttctgttttatggaaccataggcaaaagattctcaattttgcaagatgttgcccaacaggctgcttggggaaccaaattaacattctccatcccaacaaaatacacacaacaaaacagacactagtcacctcgttcagtacccaatattgatatggcaaggctcaaactttctcctcttggtttctgttgcctttggtctactccaggtggttgagggatgacttcagaacagtaattcaatgggtggtctctgggaaagacaaagagcagacagtcaccccaagtcagtcctgttgagcttacttcagggttcactgaatgtaaccacacaaataaggagggttctccgagttaggcctgttggacttctgtcagcaattccttcggagatcccctccacatatacaaacacacataaacacaagacagacagaaggccttccaaatcaagatccctaaccaagaattccaggagtacttcttctaaactatcttactattctccatttgagaaatctccccaacatcttctgatggaggagaagtctcccaaaccaagactcttcctactagttagggagagccaactgagaacccccaggagctgaactgagacagacaccccatggtggagctccaggcagacaccccacaatgcggctacagctagacaccccaccatggggttacagaaccagtcaggagaaggaaggagacattggcagtgcctaggatactcaccaacccagatactccataatggggctatagctacagacactccatgacctggctacagcaccccgccatggagctatggacagacaccctgtgacagggcttcagttatgagatgtctcctgaggactatttctccattgcaattaaatccatgcacattgggttggcagtgcccaactggaagagacggtgccagagtcacccactgtccaagaaaattaggtggccacttgagctgacctccagatccattgccagaggcaggctaccaaaccatgggcagctagccacaagggctatcctggacaagcccccaaatttgtaactgcccaatgggttcaccttgcccactgcctagacagagccaatttattaacacaggggaattgcaatagagaaaaagtagtttacacagagccagctgtgcaggagactggagttttattattactcaaatcagtctcttgaagtgttcctttatgctcagaagaatgactcattaagtcaagtgaatggttttatctgataaattctctccctaatagcagaagtcatggccacaagtccctgagattagtatgggaatttgggtaggtgggtttattttaaagagaaaaagagttacaaaaatgagagatgtgtgcctcaaagatcaaacctcatatttttctaaatttatcccaagaccagccctaccagaatttattaaaagtctgatctccaggaaatcacgtaagcttttgcattcagcaagactaatcaagatggtctcagcctttgagagaaatctatgaaaaggagcaattcaaagaaaagaggtaaacatcatattatgagaatgccggcatttttttccataagctgagtcctccatcctaaaccagcttcatcagcttgagcatccttaaaagtttcacagctgacaaaatatagtcatgcactacataacaacctttcagtcaatgacagactgcacacaccacagaggtaccataagattataatactgtatttttattgtactttttctatgtttaaatatgtttgactacacaaacactttccactatgttacagttgcctacagtattcagtacagcaacatgctgtacaggtttatagtctgagaacaataggctataccatgtggtctgggtgtgtagtgggctgcagcatctaggtttatgtaagtatattctatgatgttcacacaattatgcacttctcagaacatatccccattgttaagcaacacatgactgtatattaattcagtattttgttcctagagtctcataacagatgtttctcccccatggcacataaacaagcagtaaaccataccagcttttcagtcacttaggcctggattcaaatcctgactcttcagcttagccatgtgaccatggggaggtcatttaactgccctaaaccttgttttctcaactgcgaactgggaatcattgtccctatcccatagaattgcttggaagatgacataaaaataatgcattaaagagcttaccgaagtgcaggtcatacaatcagcacttaatgggagaaagttaaaaagaagggccaggtgaggggaactggcaaagacagagaaagagtgtggagctcctgagagacacaagtgcatgggttccaggtgatgcattgcttgggcaaaaccacacacaccaagtctcaaaagaagttgaaaagcctgagagaaagcaggcctggaatttacaaatggaaagagtcctatctctcttgtattttctcttggaacatgtgagatgagttcacccagagacaggaaagaaaacagcaaggaccgcccaggcattacagcatgggttctgcctgaagaggcccatgacaaaagagaatttagggtaggacatccacctggaaaacttccaggcagagtggtgcctgggaagctgctaaaagcttaaataagggggagtaaaccagagagctggacgaaaaaataaaaagccaaaaggaccctcctggtctccctgcagattgccagcctcatcccatgaaactggcctcagttattacagacagaagaatttcctgctggaaagctctttgaccttactgagcttggcctaggatattcaacattctcaggcttggcatggcattccccagtaagattttctctttctggaaaaaagtaatacagaaaaagaaaaggcaactatatagtgaaaataccaaagaatgtcaggaatctgaatcatggggaagagaattcctaaatttatctttcccaaagttatttttatcaaggagaaagacatttccttactgaggctctgaatctataagtccctaaaactctttcttatgaaattcatgcttgtgctttattttttattttattttattttattttatttttgagacagagtctcactctatcacccaggctagagtgcagtggcgtgatcttggctgactgcaacctccacctcccgggttcaagcaattctcctgcctcagcctcccaagtaactgggattataggtgcccaccaccacacccagctatttttgtatttttagtagagacaggctttcaccatgttggtcaggctgatctccaactcctgacctcaagtgatccacccgcctcggcctcccaaagtgtgttttattttttaaagatataggcactttgcatacctctttctgtatcaacccttttccctcctgcccacatagctgtgagaagaatttcaacaggcccagcaaatgacataaaatgatataccatgtgcattttggaggctgaggtatgaggactgagagttgtaaataaagtgctgacccaagtgagatccaaagagcacctgggaagctctgggtgcagggtagcagcccagagccgctggccccttcctggccatctgggtgctgggcatagatttctcaacaagaagactctgctacctcccctcaccaggcctctattcttctgagaaacacaaagcaataataaaagaaagtgttaaccaaataaataaataaatagtgctgaaaagggctcactgcatcctggagttgcagctcctgtagctgtaataatgaatctggtagcccttagtgattctcctttatttgttttgagttggggtctcactctgtcacccaggctggagtgcaatggtaccatcttggttcactgcagcctctacctcccaggttcaagtgattctcccacctcagcctcttgagtagctgggattacaggcacctgccatcaggcccagctaatttttgtatttttagtagagacagtgtttcaccattttggcctgtctggtcttgaactcctaacctcaggagatccacctgcctcagcctcccaaagtgttgggattacaggcctgagtcaccacacctggccttctcctttatttctctaagcctagtttcctacctgtctgaggagaccaagcagggaataaacagagagcatctgcaacgccttgttagagggaactgctgtcctcaagcatccaacaaccccagtgaggaaaatacggccaaacctccctcccagtgttacaggaagcaaggctagaaattggaccagcgataagttttccaagaaagtgaatcacacacgtgagacttcaggaccacttaatgcagagcagattttcggaccacttaatccatggaaaaaaaataaacggattaatagttgcatagaaaaaaatatgctttaataaaaaacaatgcatcacttatgcatacccttctgggttatgagattgtagccatgtttattgtctttgagctactttgtaaatcttcgtaagttgtaggtaactgatagatatataacttctgtcctatctggtagtgatttaattgactccccctggccctatccttcactcatggataaaacagttttgcctccatttgcaattcatctcagcattcctttacttgtaaaaaaaaaaaaaaaacctgtgctgttttgacttttcctttgagccagttgctatgggttgaattgtgtccccttcccccaaaaatattgaagatatgtcccaacccccagtacctgggaatgtgagcttatttggaaatagggtctttgcagacgatcaagatgaggccatgagagtgggccctgatataatatgactgtgtccttaagaaaaataaaaggtgatttagacacagagacaaattaccttcctcttcatgcatacacaaaagaatgccaagtgaagaggaagtgagagataggatgatatgtctcccagctaaggaacacagaggattgccaccaaaaccaccagaaactgggagagatacacagaatagattcccctcaaagcccccagaaggaaccaaccctaccaacaccttgatttggaacttccagcctcgacaactgtgagagaacaaatttccgttgtttaagccacccagtttgtcataccttgctgtggcatcccaagcagacaaataaaccagttataacatgtttcttattccctagtatcatataagcaaaataaattttttagcacatgttcatttttgtatctatagaagagtcatgatttcattaggttggggaaaaagctattgtgatttttgccattaaaagtagtgatccaaaccgcaattactttgcaccaacctaatacctttttctgaacgttatcttttaacagtttcagaggattcaccaagatgtcctgtggatttgctgaccagagccaggtagacttcatccacagaaaagtgcaccacatgggcagttgaagcacagaaatatattttcctgattcatgaggtcaagtaacatgaagtgaacaatagaactttgctgactctgtttttctaattttattttgcccttactaattttggttttggtttgtttatagccagtaaattattccccattgagaattagttttagggtctgaccatttatgatctttgtaaatgtcgcatagagatctagtctctgttgggtgaaaggctccagggaatttagtttgtttgcctttttggttgagaatttggttgctttttttttttttttttttttttttgagtcaaagtctcacgctgttgcctgggcggagctcaatagcttgatctgggctcactgcaacctctgcctcctgggttcaagtgattctcctgcctttgcctcctgagtaactgggattacaggcacgcatcaccacactcagctaactttttgtatttttagtagagacggggtttcactatgttggccaggctgtctcaaactcctgaccttgtgatctgcccgtcttggcctcgcaaaatgctgggattacaggtgtgagccacagtgcccagctggaatttggttttatgatgagatcatcggaggatctctgcaaatgaattaatagtttacatagaacttgtttctgctgggtgagagataacagagaatctggtttgttagtcttttctgcgtgttcacctttatattttgaatgcaaattattaagagtttaaactgcaagggaggaaaaaaatttcctcctctcctctaagttcaatggctgggaccctgcaaattaaacaatctgacaaaagacagattaacaagagaaaaacaaatttaattaagtatatttgcacacataggagttcacaaacaaatggagcttgaggacatggttagaatttgcttttttttcttttccttttttttttttttttgagacagagtcttgctgtgttgcccaggctggagtgtagtggtgcaatctcggcttactgcaacctccacctcccaggttcaagtgattctcctgcctcagcctcccgagtagctgggatttcaggcgcccgccaccatgcccggctaattttttttgtatttttagtagagatggggtttcaccatgttggccagtctggtcttgaactcctgacctcaggtgatctgcccaccttggcctcccaaagtgctgggattacaggcatagaccaccaccccgccagaatttggagcttatctaccatcttaacaagaaagataaggtgtggagaagagattagaccaaggaaagagggtgctttttggtttcttggagggtgggggctgtaaaatgatcatgggaaggtgagtaagaaattaggaaatgtatggtaagtaaggttgtttagtatggtttgttatacagatgagtctccagtgataagaattgtccctagtagttctcttcctcatatagaagagggagacaactttacaaaaaagggatgtgtatgccctgcttttaaacagaagggagttttttcctgcatctgctatttttcaattatcttcagctcaaaataatccttatgctaaagtagcatattttggggtgacatattctggtccccttcgatacctactaggaaaaaagctctttgactggtgagttttataaatgtatgtttactttgactcatgactgaaaatctagaattaaaactataagctccctctgtctgtttccacgcttatgtttctgcaattcagaaaggcatttaaatctcacataacaattttcttttttatttatttatttatttatttatttattattttattattattatactttaagttttagggtacatgtgcacaatgtgcaggttagttacatatgtatacatgtgccacgctggtgtgctgcacccattaacttgtcatttagcattaggtatatctcctaatgctatccctcccccctccccccatcacataataattttcacctcttgttggtattaataaattgggttagaaaatccctgaaattaaaggagctctattctgattagcttatagagataaataagtgtttgtattgattgtttctagaattgctagaaaataaggaaatcgaacttctaatattttcaatgtaatttttatagaaagtaacatggaaatgttttaagattgcaagttcacataatttaggtaagtcttcagcaaccaagactagttaaataattttggtttaataaaaacagctacagattagctgataatcagattagttagataaattctgatttatcagcattaaatataatacctgctagtattttaattctacttgggcatgtacttcttaacacaggtttcttgattgaacaagctaccattacttctacttaatacttaagattacagaaaatataaatttgtgtttcattgactcattctcacaattttgtttgcctcgggttatggcttgtgcaaacaatgagtctgaaaggctacgaaagctgtcaaattttgctcaattttgacagacttgttcccttggttactgtttattgccttcatctacaagatgaagggctttttgtttttcttatgtaatcggcgtagacagcaaagattctgtgttttactggaatagccttcaatggtttatgctgaatttattattatgtccttgactatttaagaaaacaaaagtttctcagttaggaaagatctaagcctccttacagtcatgttaccttctatgtttactttttaaatactttattgtcacttagaaatgaggagccaaagagttttgtttcagtttttgttttgttttgggtttgttttttgtttgtttgtttgttttgagacgaagtctcgctttgttgcccaggctggagtgcagtggcacaatctcggcttactgcaacctccacctccccagttcaagcaatttttctgcctcagcctccccagtagctagaatcacaggcatatgccaccatgcctggctaatttttgtatttttagtagagacggggtttcacccccatgttggccaggctggtctcgaactcctgacctcaggtgatccaccagcctcagcctcccaaagtgcgaaattacaggtgtgagccactgtacccagctcccaaatagttttttagacacctagatccgattcctgtcatagtgttcaaattgcctgacagtgtctggtttttgcctccctaaaatggaattctaaatataaaataaaatgaagctttcaggattttttttgctactaaagctattttgagatttcctagggggcccctggaaaatcacaaagacttattttttagccttttgaaaagagaggtgttagaaataattaggtttacttgctggattactattgatgaaccacatgaaaggcttgtgaaatcagaagagatgctcagcctttcctaggttaaattggtatatgttgcatgttgttagtatatttcagaaactgtacgctatatgggcattttccagagctttgcagtgtcctcgccgtccatgacacatttcttcttattagggccctagtgctgctttgccatattagacaatgacactacagtgttatcactcatgatttcagttttgttttgtttttttttttaatagaaatggggtctcactctgtcatccatgctggtctcaaactcctgggttcaagtgatcatcctgcctcagcctcccaaagtgctggaattacagatgagagccactgtgcctggcccaatttcagttgctttctaagtgttaacttgatcacagctttacttatttaatttgaatctagtatcttctagggcagtggttttcaactggggattgacatcacttacataattttactaacaaacagatgtctaagaattactgaggaccacgaactctctttacttgatattcttgatatatttttgttatattcttacttagcaaattcatgttatattatgtttcagcattattacgttatatctcaagatttttttctctggaaagattatgttcatccatttttataaattagatataacgttcactgtcttcttttgttgttgttgttgttttgagacagaatctccatctgtcgcccaggctggaatgcagttgcaatcttggctcattcgaacctccgccttccaggttcaagcaattctcctgccttagcctcctgagtagctgggattacaggcgtgtgccactacgcctggctaatttttttgtatttttagtagagacaggatttcaccatgttggccagactggtctcaaactactgacctcaggtgatctgccagcctcggcctcccaaagtgctgggattacaagtatgagccacccagcctggcctgtcttctttaaaaatagagctaatcattgtaagtttttttggtttttttgtttgtttgtttgttttttagagggagttttgctcttgtcgcccaggctagtgtccaatggcgcgatcttggctcactgcaacctccgcctcctgggttcaagaggttctcctgcctcagcctcccgagtagctgggattacaggctcccgccaccacgcccagctaattttttgtgtttttagtggagacaggatttcaccatgttggccaggctggtctcgaactcctgacctcaggtgatccacccgcctcagcctctcaaagtgctggaattacaagcgtgagccactgcacctggcctgtcttctttgaaaaagggctaatcattatgtttttaactattttatctaaaatttttttgaatcgactttattttctttttggcatgccacagaagcaaccaaattttcttatcggttgcatttttattggaataaattcttatcagaacttttgcttttgaaaattatcagtaatacattaagcacagtattttaagccttttgtcatctagaggtagtttttttgttttactctgacgcttccttgaaaatgtttcctcttcaacaaaggactgtctcagagacccgtggaaaaggactatgttgggtattttggggtatgtgctgctgatggcatcacttaaacaattttgagaccataccagcaaactgagtaaggatttccagaactctaggcaagaaacaaatggagtcatgaaaatgctaacccaagatccagtgaaacaagaattaattacatagggctaaatgaactgatgaggaatgattgtagtttatggtgggcggggggagtattactgattttttttctttttctttttacaaaattatttttattcttcttcacagcatctgcagctgtgagattattgatgttttaatatacagaagccctttcttttttcttttatctataacccataacaatttagtagactctgtttttgtaaatggaaatgaaacatttataaatgatatcatattcttccagcctaacccctccagaatctggaaactcttaatgaacattcttcttttcataccaatatagttatttccgtagatgcaataaggacatatctgggacttaattttactgggatttcattgaaaacattggttatacaaccaagaacttgcctggaatgtcatatttgaaaactatgtttatttactcgtatatcaccaagtccttttaagtaactaaagttgttttatggagtcaaggcttacaaaaccattgggtgcagtggtgcacacctgttgtcccagctacttgggagactgaggcaagagaattgcttcagcccaggagttcaagaccaacctaggcaacatagtgagaccccatagtgagaccctgtctttaaaaaataaacaaataaaaaataaaacgcttatacaaccctcttgaaaaaactggcctgggacctggtttacagggtttccagacttactcttttttcattgagtttttgagtttcacgaaggcatcacaatatatctttttaaaaacaacccataattggaaacttaactaatcaaaatgggccacctctcctcattcatacaaatgaatggaagagattggagcccacacagctgccaggctctatgcagggcacttggcacataatctacaggatgtttaaatttttattttactttattcttattttattttactcttatttatttattttattttattcttttttttttcttttttagagtttttttgaaagtccttgtcagacaggtaatgtgtcaacatcataacgaggtttaagggaggtacagctcacacatgagcatgaaaacccaattatcatgcttatgaactacaaaaggatcacaggatatttttgtaagtgcctacccaacagatctcccctccttctgtggtacaatgtgtccagtgttgaactagtagcattcacatttccccacaagtgtcacgaaagggggactgtctcccaagtttccccagcagtaaaacccgattggtttaaggtctgcagggcggatctagtcctcttgccagtgattaattagacatgactgtataacatggctgggaggtgggagcagaagatgagattccaaaaggaaagggtttatgctcttgaaaagagctatgtgatgcctctgatgaagcctatgttagtagagacatctgagagtgtagatgaatgccaatggccctcatggaaagagagagagatgagaaaaagcacactctttttttgcatctacatgtgatgtctggaattacagcagccattttgtgatcatgagagcagctggcttggctaaggacaaaattcgtcacaccaaacatggcagagaagaaagaagattctggattcctgataatatttttgagccactggactaaccaagactggaattggtcttccttgggacttcttaatatgtgggatagtgaattttcacattgaagtaaattttgaatggagttttctgtttcttatagccaaaaccatcttacctgctacaaatattttatttaatttcatctttacaacagtcctatatctgtggacattctcattttatagataaaaatctgagattcagaaagttttagtaacatggccaggcacagtggctcacaactgtaattccagcactctgggaggccaaggtggggggactgcttaagcccaggagtttgagaccagcctaggaaacatattgacactctgtctctaccaaaaaaaaaaaaaaaaaaattacctgggcatgatggtacatgcctatagtccagctactcaggaggctgaggtgggaggattgcttgagcccaggaggtcaaggtagtagtgagctgtgatcgtgccactgcactccagcctatgaaacagagcaagaccctgtctcaataataataataatgacagatagaacaaccacacagaagataagtaaggagagagaggacttaaacaacataataaaccaactagagctaacggacatatacagaacactctacacaacagcatatacattcttctgaagcacatgagacattttccagaatagactatacgttaggccacaaattaagtctcaatacattttaaaagatagatattataggcctggcacagtggctcatgcctgtaatcccagcaccttgggatgccaaggtgggtggatcacctgaggttgggagttcaagaccagcctgaccaacatggagaaaccccatctccactaaaaatacaaaattagccaggcgtggtggtgaatgcctgtaatccaagctactcaggaggctgaggcaggagaatcgcttgaacccaggagatagaggttgcagtcagccgagatcatgccattgcactccagcctgggcaacaagagcgaaacttcatctcaaaaaaaaaaaaaaaagatagatattatataaagcatcttctctaagcacaataggatgaagttagaaatcaataacagaagtaaaactggaaaattcccaagtttgtggaaattaaacaatgcatcaataatcaaaagaccaggtgcagtggctcaagcctataatcccagcactttgggaggccaaggtaagtgaatcgcttgaccccaggagttcaagaccagcctggacaacatagttagactccacctctatttttaaaatatatatataaaataaaaataaatacagtaaaaacaatgaaaaaccaaatagatgaaagaaaaaattgcaacaaaaatttgaaactacagaagaacaaaaacaaaaacacaaccaactaaaacttacaggacatagcaaaagcagtgctaaaaggaaaaactatagctataaatgtttaaatttaggaataagaaagttctcaaatcaacaacctaactttacaaataagaaactagaaaaaaaaaaacaaacaaaacctaatgctagcagaaggaagagaataacaaagattagaacagagattaatgaaatagaaaataggaaaacaaaagggaaaattaataaaaccaaaagttgtctctttgaaaagatggacaaaattgacaaacctttaactaaatggactaaaaaaagagaaaagactcaaattactaaaatcaaaaatgaaaatgggaaaattactaccaactctatggaaataaaaacgattgcaagagagtactgtgaacaattgtatgtcaacaaatagggtaacctggataaaatggaaagattatgagaaacacaaaacccactaaaactaaatcatgaggagacagaaaatatgaatagactgataactagtaaggagactgaatcagtaatcaaacatctcccaacaaagaaaggtcctggacctgttggcttcactagtaaattctaccaaacatttaaacaactaataccaatccttctcaaacttttctttaaaaattaaagaggaggaaacacttcctaaatcattctatgagactagcattaccctaataccaaagccaaaaacactagaagactacaaatcgatatcctttatgaacatgtgtgcaaaaaccctcagcaaaatattagcaaactgaatttagcagcatagtagaaggattatacactatgagcaagtaggatttattcctggaatgcagggacagttcaacatatgaaaatgaattggccgagcacagtggttcatgcctgtaatcccaaaactttgggacactaaggcaggagaatcacttgagctctggcgttcagcctgggcaacataacaagaccctatctctacataagttaaaaaattagccgggcatggccgggcttggtggctcatgcctgtaatcccagcactttgggaggccaagggaggcagatcacttgaagtcaggagtttgaaatcagcctggccaacatggtgaaacccacctctactaaaaatactgaaaaaaaattagccaggtgtggacgggcacagtggctcacacctgtaatcccagcactttgggaggctgaggtaggtggatcacctgagatcgggagtttgagaccagcctggccaatgtggcgaaaccccatccctactaaaaacacaaaaaattagccacccatggtggcgggcacttgtaatccctgctatttcggaggctgaggcaggagaatcgcttaaatctgggagatggaggttgcagtgagccaagatagtgccatgcactctagcctgggcaacaagagtgaaactccatctaaaaaaaaaaaaaaattagccaggtgtggtcatgggtgcctgtaatcccagactcaggaggctgaggcagaacaattgcttgaacccgggaggcagaggttgcagtgagccaagatcatggcactgcacttccagcctgggcaacaaagcaagattctgtctcaaaaaaataaataaataaataaacaacaacaaaaaaagctgggcatggtagcacacagctgtagtcccagctggtcggtagactgaggtggaaagatcacttaagcctgggatgttgagcctgtagtgagctatgactgtgccacttcactccaatctgggcaacagagtgagaccctgtctctcaaaaaaagagagaaaatcaatcaatgtaatacatcccattaacagaatgaaagggttaaagaactacatgatcatctcaatggatgcagaaaaagcatttgacaaaattcaccaccttttcatgataaaaacctcaacaaaccaaaaacagaaaaaagctacctccgcataataaaagccacatatgaaaaatctacagcagacatcatactcaatgctgaaagtcaaaaagcttttccctaagatgaggaaaaaaacaaaaatgcccattctcggcctggtgcggtggctcacgcctgtaatcccagaactttgggaggccaagtcaggtggatcacctgaggtcagaagttcaagaccagcctggccaaaatggtgaaacccccatctctactaaaaatacaaaaattagccaggtgtgatagcatgcacctgtaatcccagctactctggaggctgaggcagaagaatcacttgaatctgggaggcagaggttgcagtgagccaagatcacactactacactctagcctgggtaacagagtgagactaaatctcaaaaacaaaaacaaaaacaaaatgcccattctctccacttctattcaacctagtactaggggttctaaccagagcaattaggcaagaaaaagaaataaaagacttccaagttggaaaggaagaggtataaattatttctgtttgcagataatatgatcttacgtgtaaaaaacttaaaaagattccacaccaaaaaaaaaaaaaaaaaccctgttggagctgataaattaattcagcaaagtggcaggttaaaaagtcaacacacacacacacaaaaaagtcaacacatagaaaccagttgcatttctgtacactaacaattaatctgaaaagaaaattacaaaacaatttcatttacaatagcataaaaaaaaaaagtaaacctgggaatgaacttaaccaagaaggtgaaagacatgtacaatgaaaactacaaaacattaatgaaaaaaagtaaagaagacataagtaaggccaggtgcggtggctcatgcctgtaatccctgcactttgggaggctgagacaggcgggtcgcctgaggtcaggagaccgagaccagcctgaccaacatggtgaaaccctgtctctactaaaaatacaaaaattagccgggtgtggtggcgggggccagtaatcccagctacttgagaggctgacgcaggaggatcacttgaacccaggagacggaggttgcagtgagccaagatggtgccactgcactccagcctgggcaacagagtgagactccgtctcaaaaaaaaagacataagtaaatgaaagcatatattatattcttatattcgtggactggaagacttaatattgttaatatgtcaatgctacccaaagtgatctacaaattcactgcaatccatatcaaaatccttgtgaggtttttgcagaaatagaaagttccattctaaaattcatatggaatctgaagggactctgaatagccaaaataattttgagaaaaaaaaaaagctgaaggactcatacttcctgatttcaaaacatactacaaagctacagtaaccaaaatagcataatactggcataaagacagacatatacaccaaaggaatagaatggagagcccaaaaataaaccctctcatatacagccaaattatttttgacatagatgccaatattattgaatgggaaaagcccagtcttttcaacaaattgtgctgggaaaactgcatatccagatgtaaaagaatgaagttggaccgttatctaataccatatacaaaaattaactcaaatttcatcaaacacctaaatgtaagacctaacgctataaatctcttagaagaaagccaaaagctacatgacattggatttggcaacaacttttttggatatgactccaaaggcacaggcaacaaaagaaaaaaatagacatattggacttcacgaaaattttaaatatgtgtgcatcagaagacaatattaacagagcaaaaaggcaacccacagaatgggagaaaatatttgcaaatcatatatctgataagggattaatatctaaaatatatacagaacttccaaaacttaataacaacaacaaacaacctgattttaaaaatgggcaaaaaggctgggcgcagtggcttatgcctgtaatcccaccactttgggagagatcacttgaagccaatggatcacttcagcccaggagttcaagaccagcctgggcaacatggcaaaaccccgtctctacaaaaaataggaaaatgagcaaggtgtgttggtgcatccctatagtcccagctacctgggaggctgaggtaggaggatcgatttagcccaggaggtggaggctacaatgagcagagatcaaaccactgcactccagcctgaggaacagagtgagactctgtctcaaaaaaaaaaaaagaaaaaagagaaaatgatttgaatagacatttctccaaagaacatatacaaatggccaataagcataggaaaaaatgctcaacaacactaatcattagggaaatgaaaatcaaaactacaagataccatcacctcacacccattacaatgactactatcaaaaaaatggaaaataacaagtgttggtgatgatgtggagaaactggaagccatgtacactggtagcaggaatgtattaggttggggcaaaagtaattgcagttttgccactgaatgtaatggcaaaaactgcaattacttttaatgaaatggtgcagcgactatgtaaaacaatatggtggttcccctaaaaatagaatcactatgtgatccagcaattccacttctgggtatatacccaaaagaattgaatgtaggatctcaaagagatgtttatacaaccatgtcgatagcagcaatattcgcaataactaaaacgtggcagtaacctgggtgtctatcaatggattaacagataaactatgttatagccataaaatggaatattattcagccttaaaaaagaatgaaattctgacatatactacaccatagatgaactttgaggacattatgctaagtaaagtaatcctgtcacaaatgacaaatactgtataattccacttatatcagatacttagagtagtcaaaatcatagagacaaagtgaaatggtgattgccagggactggggagagggaggaatggtgagctatttctttttctttttttttttttagacagtgtctcactctgtcacccaagctggactgcaatggcccaatcacggctcactgctgcctcaacctcctggctcaagcaatcctcccaccttggcctcccaaagtgctggaattacaagcatgagccaccatgcccagcctactttataatgagtatagagtttcagttttacaagatgaaaagagttctgaagatggatgttggtgatggatatacaatattgtgaatgtatttaataccactgaactgtacaatttaaaatggttacaatggtaaattttgtgttatgtgtatttcaattgaaaaagttgaaaaaaagaaaactttcttttttatgtgtgagacagacagggtctcactctgccgcccaggctggagcacaatggcatgatctcagctgaatacaacctccgcctcccaggctcaagagaaaagaaacatttcttagaccatagagcttagtggttaagagaaaactttggtgtcagcagacctgggtttaaatcctgcttctgcatgacctcagggcctctttagggctccttttctctatgcagaatgaagatagcattactgtaacataaggttgtgatgtagactcagtgaaactatgtatgtaaagtacttctgcatgcccagaaaaagaatgatggctatggcaattattaatattatcatgcctctcattgttaccctaatcagtaggcagccagcattttgtttttgtttttgtttttgtttgtttttcgtttttttggtttttttttttttttagatggagtctggatctgtcgcccaggctggagtgcaatggcacaatctaggctcactgcaacctccgcctcccaggttcaagcaattctcctgcctcagcctccctagtagctagaattacaggcacccgccatcatgcccagctaatttttgtatttttgtagacagggtttcaccatgttggtcaggctggtcttgaactcctgacctcaggtgatccgcccacctcggcctcccaaagagctggaattacaggcatagccaccatgcccagctagcagccagcattttgaatggaaagagagcatcttgttcccaataccacagagaggtgtcatcaatttcacttcaggcctcttagagcctccctgtccatgctaaaacttggagctcctgctcttcctgcccagccaccatcaaaagcagcccaactccctgggagcacctttgtctctgctcacattacctccctcccaccattcccagggcgctgagagctttgatgttcacgtggctgcatggcaggggcaggaagataaaatcccacttgttctctctctctacaataccacctttccgcaatttagagggggacagagataaaagagcaggttttttctctttttcttttcttttttttttttttcaacaacaaatggtggtttctctttaccagccgctacttcagagccatgccaacatcaaagagcatgaaatcagtggaaactcaagccagaggacttctgtcccaccctggggtggtgtgtcggggtggggggagcttggctgtttacaaaagaaacagaaagtggagaggagaggagggaactgtgtgcagaggaacatcccactgaggatggcaaaagtttgttttcttagcatttcccctatgccacattaagcttgccaaacagatgggactgagacaaggagggatgcgggaaaaagaaagctcaacttgtctcacgaataaatcttgagttgacttgacatcttctagtccagagggattaaggtggtgacagtgggttggcctgtgtatgtgagtattcaggtgggactcacaagtccgatgacattctctgctctaaatccatgtgactgtgtgcaagggcagaaggaaaagaagaaaagggtctacttgcataactaggaggcctgttgttttccagagtgtgccccatgtgccaggtcctgtgctaaatacctcacatgtagcaaccatggggtaggtaggcttgcttttcccacttaacatatgtgagaactgaagtttaaagagctgaagtccaaaaggagaagcaggatctccactcagatctgcatcaaaatgtgtgttcttggccagatattataaagctgcttcccacggggattgagtgtaactttgaaaagtgacaaacaagataccattgtagggcatcagttattggtgggaatgtgattccaaaaaaagatatgttaaagtctgaacccgcagtccagtacctgtaaatgtgaacgtatttggaaacagggtctttacagatgtaatcaagttaaaatgatttattggggtcaggagaacactaatccaatgactggtgtttttatttgaagagggagattttgccacagatcctcacagagggaagatggccgtgcgaaggcggaggagggagctggagttgtgttgccttaagtgaaggaagaccaagtatggcgcagcccccagaagctgggaagaggcccggaagggtcctcccctagagcctgcgagagcgtctcatgccaaccccttgattttggacttctagccttcagaattgtgagggaataagtgtctgttgttttaagccacccagtgtgtggtactttgttacagcagccctagcaaactaatatcacatctgcctttctgagtttggagagagaccaagacagagagacagagagtcagagagtgttgtggggtgggaataaggcaagacttcaattttcagacaaatatcgtaaagattatctctagcatactggtctggggaatgaggcaaagatgccagccaccagagagagagacagagagagaaatcgaggggggcggtggggtgaaagcagtgaaacaaggggtttcactgaagtaaggggaccaggaagaaagagaagggagctggaacccaagtgagacaggtcagctccttgaacatgaggagagtcaaagaaggttccaaggttccctgccaggaggggaggggttgagaaagagcaggatgctgccaccgtccacgcctgaggacgaccttgcccgcgccagcgcccctgccttctcacacctcaacagggctcttgcatcagactcttcttcagttactgcactcagggaacatgtatttagcactcacaaagtgacaggcactgatggggagaggtggggaggactgccagggtcagagagccgcactaaggacccagggaatggagagccctatgacatcctcagcctggactgctcttcacttcccaatcagcctagaaaatgtccgctcagatttctaggcccactcaacttgactagggcctttaccaccttgctgggcccatgataccttccgtacacctttaatgcttggtagctgtattgtttctttctacctgtatctagatctagatttcaaagaaagcagatccagaagctcacagtctaatggagaattcatatatctcaatctctatctagacctacatatagacctagatctagatagagacatacacgtttttctctttttttagggaaaaaaaaaaaaaggccaggtgcagtggctcatgcctgtaatcccagcactttgggaggctgaggcgggtggatcacttgagctcaggagttagagaccagcctggccaacatggtgaaacctcgtctctactgaaaatacaaaaattagctgggcatggtggtgggcacctgcaatcccagctacttgagaggctgaggcaggagaatcacttgaacccatgggggcggaggtgcagtgagcagagattgtaccattggattccagtctcggagacaaagcgagacttcctcattagactgtgagcttctggaaggtggggccagcatcctattcatctccatctagtctgtgcttttgtggagcctggtgcaacttagttgatcagcaaatagttgacaaatgaatgttctgagtattttagaactcaaacaacaaaaaatgtaaataattttaaaaaataagcaagtgacataaatgcacaactcatgaaataaaatacaaatggctcctaatcgcacgtactagtcacgtcgattccagtcataataagaacgcaagttaaagctatgctgagaaaatattttacctcttagcctggcaacatgtcgtatcaggaggctggggagggagccgggcacaggcaggctcatacctggagtgtgaaatggtgtgtccctaaggagggtaatttggcatcgtcaatcaaaattacagatatgtttatctttagtccaaaaatctcacttctgcaggatacctgctgaatatcttacagatctgcaaacataaaatagctatatgtatagggttacattgctacattgcttgtaacaacaagatatttaaaccaaatcaaaggcccttctctagagaactgggaagataacctgggtaggagcggggaccagcgtggatagctggcgagagaggaagatctctcaaggcgtaactttcatatcaggttgattttttttttttttgagactgagtctctctctgttgcccaggccgtagtgcagtggcgctatctcggcttaatgcaacctccatcccctgggttcctgtgattctcctggctcagcctcctgagtagctgggattacaggcacgcaccaccacacccagctaatttttatatttttagtagagatggggtttcgccatgttggccaggctggttttgaacttctgacctcaagtgatccacccatctcggcctcccaaagtgctggtattacaggcatgagccatcacacccggccgggttgattcttgcattatgtgaatgtattatatagtcaaaaatgatgaattagaaatgaaaaacaggtacgtagtgttaagtagtagatctaaagatagagttggaaaagtcttatgcctgtcttgtccactgcaggaaggttcatggaaagaaataaaaatgactctcaaactcagaataacttaaaattttaaaatggcattaaaatgtacctatcagttaactaattttctgaaagacttaagatggcgtctgttttccttaagaacaacaaaaaagcatcataccaaccaaaaacccctaagtcatctgaaggaaatgccccattgctcactgtggggcattttatatgctcaggacatgggctgcctaaccactatgttccctcattttcccctgccaatcccatcagaattttatttatttcctactttcaactttttctagccagtttcgacctctttttcagaacgcaatatcctcacatatcttggacttttcttttttaattttttccctctctgccccaccaatctgtcttggacttttttttttttttttttttttttttttttttttttttttttgaggcaaagtttcgctgttgttgcccaggctggagtatgatgacgcagtctcagctcactgcaacctctgtctcctgggttcaaacaattttcctgccccagcctcctgagtagctgggattacaggtgcttcccaccacgcccggctaatattttgtatttttagtagaggtggggtttcaccctgctggccaagctggtcttgaactcctgacctcaggtgatccacctgcctcaacctcccaaaatgctgggattacaggcatgaggctctgcgcccagcctgtcttggacttttctagcctccatgccatctatcaaagtcttctaagatctctgactccattcaacttacacatttatactcaaaaatctagattgccttctatgcatatgatgccctacccaagccaggacacaataaatacctcatgtaacccaataaatatctcataacagtcctgtaagatgaagaccatcacaatccatcttctcagcattttacaggcttttttttttttttttttttttgagactgagtctcactctgttgccaggctggactgcagtgactcaatctccactcaccgcaacctctgcctcccgggttcaaacgattctcctgcctcaacctcccgagtagctgggactacaggtgcgcaccaccatgcccagctaatttttgtatttttagtagagatggtgtttcaccatgttagccaggatggtctcgatctcttgacctcatgatctgcccaccttggcctcccaaagtgctgggattacaggagtgagccaccacacctggcctttacaggcattttttaaatggagcctggagaggtctagtactttgtccaaggttatgcagtaaggggaggtggggccaggaagtcatcttgagcagtctgactccatggcccactattcactagcactgcctccctagatgcccccaaaatgcttctggccatagacctttccttctgcttctcatccctctatgcttctttaccttccatgcatgcattcatttgtccataatatccctggccacctgctgtatgccaggcactgtgctaggcgaggaggatgcaaagattaagaagacagtagtccctgacagcagtccctgactttgagaagcttacattccatagagaatgcacagaggtaaaggacaaccccatgcacaggaggttctacaatgtgagcctaggatagggccacccacacacacttgtatgcctttcttgtttttcctcctctgctcaaaaagtcttcatttaaggccctgtgttcatcatgatgggaaaatcagctcaagaaaacttcaggaggattcctccaggtaaattaagttacccaaacagactaacatgctaacaactttcagatttggaatctgctcctctagagcctacagtttgatgactgtcatttcatgttgaaacaagaacaagaggattgcttatgtttgcttctctctgcaagaatctaggttgaaaacaaaatgaaaaggaaatctaatctgaggacacttctcaagtagaagtcagaggaaagagcaataaagaagaactcagaggtcttacctgttacccttaaatgtcttcttcctgatcacagtccaaaggactcatgttactaataccattgttctgacaaagctagcaaggacagtctgctgagcaagtatgcagtcttctctgtgatctattctgtcttcacaggcaagagtgattgcccatgttccatcccccaacaaagcatcaaaaccaaccacacagacctgggttcaaaggcagactctaccacttactgagagatcatcagtgtccttatctggagaatgggaatcatccctaacaggtgcaaagactctagccttgggcatgatcaaattcaaagccttcttgggacactctcataatcagtcactgcaggctttcacctgcacaaccatctagctcagctcttgtgctaatatatcagagccctggccccaactgcccaagggacttgtaattatttttgcagccgtaagtctggcatctagtcctgcagatgggtagggagaacaggtcctatgacctgggaagagagggagttgaaagcaacagagtatcccagctgcagtcacacaggctggggctcagattacactccagacaggatgcagagcaagagtacaaggaaatccaggcgaaaagaaatgctgcaagttggagggagggaagtgtccaggatgcccccagagacagactgagtccatagttagatatcaacaaagcagcacccaaaaaatgactacagaaagaattccctacttcccaaaaaacactcagaaaatcacattgagggaaaaaaatctgaactatgttggactggcctgaacttttgtatagtttaatattgtttttagttttaatacacagaagccaggtgaaggtagggattggaagacatcatattcttctccacgctaggtccactatggttcctaatccagcctggcctattaaataccaatgagatttaatgtatgtctctctagattgagggtcagaaacccaaatgcctacagaagtcaggcagattagataaacgagaaactgtgctaggtgggggtgtaggagctggaacacaaatgctctatggatgcaggcagttgttaatcagtcaattgctgccacagagaagcatggcctgagttgctggatcaatttacttttacattcccacatattaattctaaaaatgatttttccaactgtcttagtctatttgaacttctataataaaattccataagaggagtggttaataaacaacagaaatttatttcccccagttcttgaggctgtcaagtccaagatcaaggtactggcagatttggtgtctagtgagggcctgcttcctagttcataaactgcttcctttttgctataaccctacagggaagaaggggtgagggagctttctggggcctctttcataagggcgctaatcccattcgctacggctctgtcctcaaaacctaatcacctccccaaaccccaccttcttatacttcacattggtgattaggttttaacatatgaatttgggagaacataaacattcaaatcataacaccaacctattttgggggttttttgggggttttttttttttttttttgagacagagtctcactctgtcacccaggttggagtgcagtggtgcgatctcagctcactgtagcctccacctcctgggctcaagaaattctcctgtgtcagcctcccaagtagctgggattgcagctgcctaccaccaggccctgctaatttttgtatttttttaactagagatggggtttcaccatgttggccaggctggtctccaactcctgacctcaagtgatctgcttgcctcagcctcccaaagatagcaccaacctttgttcaatttataaaagatgtttgaaattaaagtctgattaatttctattttcattatggattactaataatatcagctaacacttccataaaacttacatggcaggcagcattctaagtgctttattcacgttgacccatttaatcctcacaacagccatttgaggcaaatctatcatcatcctcctgttgtaaattaagaaattgggagtctctgagcctactctggctcaagaggctgcccaataagaaataagaaattgttttttaatatttaaaagaaagttaaagaaaaagaacaaacaaattaagaaatagaagcataaagtatcaagcaaattctcccaactcactcagataatttgtggcacagctggagctacatggacaactaaccctgggttcaagatgagtttaactttgaggcttccagaaaagacatgagagagccctcctgtaaatggtgaatggttttcttttaccaaagtctttataatagctcattcccccaaaaccctataaatcagagaagtcaactctgaccccttgtctgtgttagtcaaaaagtttcattggagcagaaccatacctactcgtttatgtgtcctctgaggctggctttggtgtatggtctctaccatgagtagtcataacagagaccatgtggctcccaaagcccaatatgtttattatctggccctttacagaaatagtttgcaaactgctactctgaatttaaaaagattttttaaagttcttatactttatacttaattgtactagactcagattaagaaaaatatgtccttgaggccgggcgtggtggctcattcctgtaatcccagcactttggaagggcgagacaggcggatcacctgaggtcaggagtttgagatcagcctcaccaacatggcaaaaccccatctctactaaaaatacaaaattagccgtgtgtggtggcacacgcctgtaatcacagccacttgggaggctgaggcaggagaatcgcttgaaccagggaggtggaggttgcagtgagctgagatcatgccattgcagtccaacctgggcaaaagagcgagattccatctcaaaaaagtaaagaaaagaaaaagatgtccttgaggccaggtgtggtggctcccacctgtaatctcagcactttaggagtctgagacaggcggatcacttgaggtcaggagtttgagaccggcctggtgaacatggcaaaaccccatctctactaaaaatacaaaaattagctgggtgtggtggcgggcacctgtagtctcagctacttggcaggctaaggtggaagaatcacttgaacctggaaggcagaggttgcagtgggccgagattgaaccattgcactccagcctgggcagcagagcgagactccatctcaaaaataagaaaaatatgtctttgaaacttcaattaaaagtatctcctcctaaagttgaattcatagaaggaagaaagctcttaactagaaagttccttaaaaacacacagatatggccaggcgcggtggctcacacctgtaatcccaacattttgggaggctgaggtgggtggatcacctgaggtcaagagttcgaaccagcctggccaacatgaagaaacactgtatctactgaaaatacaaaaattagctggacgtggtggtgcgtgcctgtaatctcagctactcgagaggctgaggcaggagaatcgcttgaacccaggaggcggaggttgcagtgagctgagatcataccatagcactccagcctgggcaacagagtgagactctgtctcaaaaaaaaaaaaaaaaaaaaacacagatacataaacttttatggaaattttcagtttcttctataaaagcagaaaaagaaacaattcaaaccacaattccatttctccaattatcaaaaatctgccaatcctttttttatccaaaaagacaacttttagtggtaaaagctgcttttttgtggcaactgttcttgtttctattttatttaaggttttttgaataactagaacatactagaattgtgtttaagaagactgagaatacatcttacatttgtgactaatgaccctcttagactgaaaatcaatgtttaggcaataagtgtaaattttacagattacaataaaataaaaacaagttagtacacagctataatttgatgaagttaagatggtatttttaaactgaaaggtcaagtttcttgtggaaacaaatatgtgtttccaaggattgtctcattagtaactggtggaatcatttataaacaaataagacaaacaacctttccaggcctcaattcttaagataagatatagaaaaaggtcattttaagaccctaggaagtgtcacaccatcaggacctttctacaaatgagtgtttaaatatactgatgataaatacctgaagaaattaagttgaccttaaagaaattaaattaagttgaatcattggattttgtcctaaactttgcagaatcagagatcatttcgactttgcagacttcaagcagggtatttttctgctcaactgcagttgacatttcttgcatggtaggggaaaaaatatctaaacaaatggagggatacactgtgttcatggattggaagtcacaatatgttaaaatatcagttctccctaaattgatctatagattcaatgcaatcacactcaaaattccaccagacatttttgcagaaattgacaagctgattctaaagtatataagaaaaagcaaaggaagtaggatagccaaaacaattttggaaaagaatgttagctgcctcacactacctgatttcaaggttttgtttgttttttttttttttttttttttgagacggagtcttgctctgtcgctcaggctggagtgcagtggcgccatctaggctcactgcaagctccgccgctcccgggttcacgccattctcctgcctcagcctcctgagtagctgggactacaggcgcccgccaccacgcccggctaattttttgtgtgtttttagtacagacggggtttcaccgtgttagccaggatggtctcgatctcctgacctcttgatctgcccgcctcggcctgccaaagtgctgggattacaagcatgagccactgcgcccggccttttttttctttttaattttttttagagacaggatctcgttctatcgcccaggctggagtgagtggcatgatcgtagctcactgcacctgggctcctgagctcaggcgatcttcctgcctcagcctcctgtgtagctaggactacaggcacacacaaccacacctggctctgatttcaagtcttactgtaaagttaacaataatcaagatattaaagaaggccaggtgcggtggctcacgcctgtaatcccagaactttgggaggctgaggcaggtagattacctgaggtcaggagtacaagaccagcctagccagcatggtgaaaccccgtctctactaaaaaaaatacaaaaattattcgggcatggtggtgtatgcctgtaatcccagctactcaggaggctgaggcaggagaattgcttgaacccgggaggtggaggttgcagtgagccaagatcgtgccattgcactccagcctgggtggaaagagcgaaactccgtcttaaaaaaaaaaaaaaaaaaaaaagatagtaaagaataactgctgcaaatcacttgggcttaatcaggtggtaaagatttttgtttccagagtaactaaaattttaaaaactaacaatatcagccaggcgtggtggcttacgcctataatcccagcaccttgggaggccgaggcggcgggcaaatcacctggggtcaggagttcgagaccagcctggccaacatggtaaaaccctgtgcatactaaaaatacaaaaagtagccgggcatggtggcacatgcctataatcccagctactcaggaggctgaggcacttaaacccaggaggttgcagtgagccaagattgtgccattgcactccagcctgggcgacagagcaagactccgtctcaaaaaataaataaataaataaataaataaataaataaataaatataagaatacaaaaattagccaggcatggtggcacacacctgtaatcccagctactcaggaggctgaaccaggagaatcccttgaacctggggggcggaggctgcagtgagccaagatcgcaccactgcactccagcctgggggacaaagagagactccgtctcaaaaaaaaactaacaatatcaagtgttggtgaagatgtggagcagccagagcaaagtggtgtgtagttagaaaaatgaaattaagtcaaagaaaagacttggacaagagtgtttatagcagatctattcgtaatagatccaagtgtccagcaacgagagagtggattaaaaagtgtgatatgttcatacgatgagataacaaacactcagcaataaaaaggaacaaactactgatacgcagaacattatggatacatctcaaaatcatcagcttggttgaaagaacccagaaacaaaagagtatattctatattatcccatgtgtataaagtttagcaacaggcataactagtgacagaaatcagaacaatggttgcctctgcaaaaggcaggtattgaccaccaagggacacgaaggaactgtcaaggtgagggaaatgttctatacatatcttgacttgggtgacaatcacatgagtgtaatcatttgtccaaattcgttgacaaattcacttaaaattggtgcattttcctgtatgtaaaatatatctcatttttaaaacttgtgtttccacattgaccagaaagatcaacacatgatctatctcttattcattgtgctttcatttttaggactagttggcagaaatctaaggctttaaacaggttgtctatgattctagtcagagctaccaacctcttaacacaagacgctccttctttcattcattctacaaacagaccacaaaacaatcaaacactgtttcaatatataatttatacaatacataatttatgcacgaacatggcactcttctggctttttatattcattagttaatctaaattctactttttaaaaatatgcagtacgggccgggcgctttggctcacacttgtcatcccagtactttgggaggccgaggcagacggatcacgaggtcaggagatggagaccatcctggctaacgtggtgaaaccctgtctctactaaaaatacaaaaaattagccgggtgtggtggcgggcgcctgtagtcccagctactccggaggctgaggcaggagaatggcgtgaacccgggaggcggagcttgcagtgagcagagatcgcgccactgcactccagcctgggagacaaagtgagactccgtctcaaaaaaaaaaaaaaaaaaaaaaaatgcagtacggccaggcatggtggctcatgcctgtaaggcaggaggatcacctgagaccaggaattcaaggccagccttatgaacagagcaagaccccatctctacaaaaattttaaaaataaaaataaaaaaattgccgggcatggtggtgtgcacctgtagtcccagctactcacaaggctgaggcaggaggattgctcgtacccaggagtttgaggctgcaatgagccgtgatggcaccattgtaccccagcctaggtgacagagcaagaccttgccttaagaaaaaaaaaaaaattggggtaggaatatttaacacatgagaatcaaggttcagaaagatcaaggaacttccccaagataacataactaaggagtgatgtcatgaagactcaaacccagatcctaagcacacaccctttcctctccccagtaaatactcttacaacgcacacttgtgtgtgtgtgtgtgtgtgtatgaaatattcaaattgctaattgtagattttccattcttttatcatgaatctgtgataacagtttttttgtgatatttaaaaataaataatcaaagcctttataaaggtctggagcacatggaaagtttgaaaccatagcctgattcaccatacctggctctcattctcaaacccctgtttgctttgaattctaggggctggaatactgacagtaaaagaaggaaacatttgtagtgcttgccaaagggtaaagggggagtttctcttgctttgtttaggtgtaaaacataatcctctattatcctgcacaccgaagtattgccagcgtctttagaagggaggtagacatactgtttgcattttcaaattttaaaattgaggtagtggctcatgcctgtaatcccagcactttgggaggctaaggtgggtggatcacctgagatcaggagttcgagaccagcctgaccaacatggtgaaaccccatctctactaaaaatacaaaaatgagctgggcgtgatggcaggtgcctgtaatcccagctacttgggaggctgaggcaggaaaatcacttgaacccaggaattggaggttgcagtgagccgagaccacaccattacactccagcctgaacaacaagagcaaaacttcatctcaaaaaatgaaataaaataaaataaaattgaaagcaattagcaggaaaagagaaatgagcttcctcatctgcaaccactggctgctcttccaagccatggtccttagaatatggttccttactgaattttttgttctcattagtggtttttaacagtgaatttctaactacccaagtctataccaaagccataattatttaattctgatctgttagaaactttctaagaatccacccaaaaatgccagaaaaattcaaatgactctcgtgtatatagtgagattagtattccacagaaatgcctcattaatgtcaaaataattcacttaaatcttatcctagcaaagcataaaacagctatgaaaaagaataatatcgtgtagataccaagacagaaacaagctgaatagctggtaatgtttatagacgagcaatcaattaactgatgaagaaaaagaaaaaaaatcactattgaaaaagcaggcttctagtctacttccataatactaatgctctaaaagtcattttgcatcatccacagaaagctcccacatatctggccaacaaaattggaagttggtttccaatctgttttcaagtcctaatcctagtttccctaaaaaatagtttgcactttaaagagcccaggacaataattcccctggagacaatttacttttgtggctggcttgtcattctacatataaaccatcttaggcatcagctataagctaaaaaatctcattcctctccttggctcttggagcatggaaataataaaagtgtttccccagatcttacacccttctgagttccaagcagcagtgaatatgattcccaggattgtaaatagtcttataaatcttgccttccctgacaggtttaacttttcatttttcttaaatattagcaataaaagtactgtgtgtaaatatccttaagatttgggcaaagctatcacaggattcaaaatacccagtgcctataaacacacggcttttcatacagctaacagtggagaaacaattccaggagtgtgccaggaatagagaggaaagattctaaataatacaggtgaggtagaatcataaaggaaaaaaagttaactttaaaacacataatttttgttctgcaggcagtttcaaattgggtcgttcaagccagggtgttttttgactttggttctccctagggaaaagcacacagtagcaaaggataatgaaaaggcctggagaacttggatacagacggtctgggatttcaatcccactttaactctcccaagacaagaaacttgaacaataataaattgataataacagtgaacagttattgaaacttaaggtgtggtgggctgtcctaagtgttttgtttttgtttttgtttttgagatggagtctcttgtcgctcaggctggagtacagtggtgcgatctcagctcaccgaaacctctgcctcctgggttcaagtgattctcctgcctcagcctcccgagtagctggaattacaggcgtgcaccaacaagcccagttaatttttgtatttttagtagagactgggtttcaccatgttcgccaggctattctcaaaatcctgacctcaagtgatccgcctgcctcagcctcccaaagtactgggattactttgggattactgagattacaagcccggccttgtcctaagtgttttatgtacattaactcatttaattctatgaggtagtgaagtgtttaggaggataagttccggagctacactgtgtgagttcaaaaactttcccatttgctaactatatcatcttgggcaaattccttttctgtataatgatccttcaatggtatctacctcctaggttacttataagaattaatgagctaatactaaccataagcacttagaatagtgtttggcacaatgtaggtgcttaattgtttgccattcttattttcattttacattaggaaactgaggcatagaaagtctgtttactagagatgcagtaattaatatctaatgaacctgtaatatctggtactttgtaaatattttacacgatagttattttttattccataacaaacaaagaggttgaaaggttcttgtattggttcaaaccccgagagcacaccaacagataacacaaggcggtgtggagcaacatgctgttttaatgagcgcctgggtgcaggcaggctgaggcctaaaatggcgtcagcaccaagtgaggatggggcaggggttttatagtcctctgtaaacaagaagtgtcccagtctgacgtgactgctacgtagtacccagacggcctctttctcaatcttcaggggtacatgtctccctgccagagtaggtgtcttccggccagggtaggtgtcttcctggcagctctcttcctgcttctgctgtcttgctgatgcacgcaagtggccttgagccttgggactgggcctgagaagggaggagttatccctccaagctttcagaccccgggagaatctttcagaggtcactgtgaaaacaactccccctttgtaattcaaaattgcgcttcgcctatgtaaaccaaaaataaaattataagcctcccaactgactgaatggatccctcctcttggccaaggggattccagaataagcctgaaaaactacttcaggccatgatgggaaggaggggttgagtatgcctcattatactctcctccctttggaattcaggtacaactgaccaacagtaacattaaaatagagatcccaagactgacaaaacagattctttgtagcaataagataccaaattccaacctgactctagtataacatcacatgacagatagcaggccctgaaagaaattgaggcattttaccccaaaatatatttctttgacagattttgaaatggccctgcaaagctatctcctgtggggaaaaatctacattctgtagagaatcctcttcccttttcaggtcttttcctgatctgggggaaattaaaagtctagcacctaaaaaataaattaaaaataattttaaagaaataaaaataatttttaaaaaatagtctgacactttttaaggtctgataagagacatttactatctatcctctctgaagcctgctacctggagacttcctctacataataagaaccttggtctccacaaccccttatcttaacctacacattccttttgattgattccagctctttagataatgacttaattcttttttttttttttttgagacgaagtctcactctgtcacccaggctggagtgcagtggcatgatctcggctcactgcaagctctgcttcctgggttcacgccattctcctgcctcagcctcccgagtagctgggactacaggtggctgccaccactcctggctaattttttgtatttttagtagggacggggtttcactgtgttagccaggatggtctcaatctcctgaccttgtgatccgcctgcctcggcctcccaaagtgctgggactacagatgcctgccaccacgcccagcaatgacttaattctttcaaccaattgccagtcagaaaatctttgaatccacctatgacctagaaccaccccactctgtttcaagttgtcccacctttctgtacactttacatgtattgattgatgtctgcgtgtaattcctgtccccctaaagtgcataaaatcaagctgtaacccaaccaccatgagcacatgttctcgggatctcttgagactgtgtctccagccttggtcatttatatttgactcagaataaaacaaaacctctttacatattttacagagtttgacactttttgtcaacacctaaactgatcataaaaagttccaactgtagatttctaatacaaaactttttttttctttttctgagatagagttttgctcttattgcccaggctggagtgcaatggtgtgatctcagctcactgcaacctcctcctcccaggttcaagcgattctcctgcctcagcctcctgagtagctgggattacaggcctgcgccaccaagcccagctaatttttgtatttttagtagagatggggtttcaccatgttggccaggctggtcttgaaatccttacctcaagtgatccgcccgccttggcctcccaaagcgctagggttacaggcgtgagccaccgcatccagccataaaaaacatttaaatagctgtccattactatcatgcccttcttgcattcctggtaataaatccagagcacattaaaactctacacattgaatggagacattctgcaataactcttgtgttaaatcatctttccaatagtagtcagtttactgatctgtaaaatgggaaaccaacactagtccccacagcagggcaccttagggtgaattctctgctgtctacattgtggcccacacactggacagccttggaagcttgagtagagaacacagccatctctcagcgacaaactcccctaaaccaggctcatcatcaaggcccatatataaaactaaaacgtcaaattatttttctttttattttttatagaaatgggatctcactttgttgccctagctggtctcaaactcctggcttcaagcaatgctcttgctttggcctcctaaacagaatgatgaattattaatttataaggagatatagcccgccaagcaggcctgagaatagattagttgatggctatatttgctccctggaggccagagtataattaggttgcttgatgaatgcagaaccagaaagcaggcagagtcatccacctccagaggaactggaattgaagagtttgtactggggcctgatgaggcggggcctttgctctgtagccaaccccccttaggcacagtttagtttgccctcctctcgggcgaattaatttcctttctgaagggcacattctttctttgtctctgtaaataacttcaagcctattagtcaagtcttgggacctagaagccattccatcctttaaggtaatttgcctacataatctgattccttttatgtttgttttgcaatttagctctctctgaaggcaatctcctttctgaagttcaaagcccatagggaagtatatccctgtttcttccatacaccaacagtaagataatcacctagtctagcacaaaacaaatgctccagaaaagtaatcccctttcgtaatgcccttcttccaaaaggtcaacaatagttttacctaccggtggaactttagaaatgctcatggggggacactggcagatctaagggtgagttcattcattcattcattcattcatcttctactttctggctattaggtgccaagggctgagaaatgtgctatgagtcaacaggatgtgaaaaagacatggaccatgccagcctgaatctctaaggtctttgaaacaaatattaacaaattaagctacactgtaatcctaccagagaaggcaaaattataacctgagaaaagtactctgaagaagaaaagaaatacaattcttttagaaaacaaatgatcaggccaggcacagtggtttacacctgcaatcccagcactttgggaggccaaggctggtagatcacgaggttaggagttcgagaccagcctggccaacatggtgaaaccccgtctttactaaaaatataaaaattagccaggtgtggtagtgcacgcctgtaatcccagctacttggtaggctgaggcaggagaatcacttgaacccaggaggcggaggttgcagtgagccgagatcacaccagtgcactccagcctgggtgatagagcaagactctgtctcagggaaaaaaaaaagaaaacaaatgatcagacccaactcaggcagttgaaaaggctttcctgaagaaatgagatgtttgttgaggttaagaggagagaagtagatgttagctggtgggggcagagagtgggtgaacgggcttaggaagaggagagcctttcatccgaaggaaactgcacttgcaaaaatcttaaggcttgcaacagtgagcagcaaatgcataagaagaacctaagaaaggccagccaagcaggggagcaaagaaccattgagcaaagcagtgataacacaggtggcataggccaggcatggtggcttatgcctgtaatcccagccctttgggaggccgaggcaggcagaacacttgaggtcaggagttaaaagaccagcctggccaatatggtgaaaattcgtctctactaaaaccacaaaaattagccaggtgtggtggtggagtgcgtctgtaatcccagctactagggaggctcaggcaggagaattgcttgaagctgggaggcggaggttgtggtgagccaagatcgtgccactgcactccagcctgggcaacagagtgagactttgtttcaaaaaaaaaaaaaaaagacaggtgccataggtaggaaggggctgacccatgcagggtctggctggccaaaacatcaattttgatctttataccaggaagaagagttttagggcaagttgaagatccttgagcagatgtgtacttctaaagatcactcttcctgcatagtggagagtaagttgaaaggggctaaagaggaggcttggggaccaacttaacaggatctgcggttgtccaggtgagggatgctggttcccttagtgcagatgaggagaaatggacagggctgagatacagagaaaataaatgcctattaataagcaaaggttaagaaaaattgtccataccatgatgtcaacctaaaggaaaaaactgaggcaaaatttgtataagtatagcgtttatttgggccagatttgaggactgcaacccagaagcatagattcaagttgctccgaatatacactccaaatagactcaatgaaataatgggacagaaacttaggggattggccaacgagaatggccaggaaagagcactaaggaaacttgggaggtgaaatcttgtgttggtggttacatgaatataaattttttttttttgacatggagtcttgctccgtcacccaggctggagtgcagtgtgcgatctacaacctctgcctcctgggttcaagcaattctctcgcctcagcctcccacgtagctgggattacaggcacctgccatcatgcccggctaatttttgtatttttgtagagatggggtttcaccatgttggccaggctggtctcgaactcccgacctcaggtgatccacccacctcagcctcccaaagggctgggattacaggcatgagccaccacgccaggccataaacattttttttaattcatccaaatatatgtttaaatgattaagtttcattgtatgtaaagtacacctcaataaggttaatattttttaaaaatcagtttagcttaattattaagagcaagtacatggattttggaagtgtacagatatggctttgaatcctagctttaccattagtaattgtgcactctaagaaagtcagttagccaatgtaagctttaagtcttatcactggtaaaatggggagggaggatggctgttttgaagaccaaattgcctagcttagcagactgccaaatacaaaggcaagagggcttttcattcaaattttattccttgccacagtggaagtattaggtgaaaaattaatgtttcttgagtgtttccttgttttctttttctttttcttttttttttgagacagggtcttattctgtcacccaggctggagtgcagtggcatgatcacagctcacagcaggctcaacctcctgagctcaagcaatcttcccacctcagcctcccaagcagctaggactacaggtgcatagtcccacatctggctaatttttttaagtttttttattaaaaataactatattgcccagggtggtctcaaactcctgggcttaagtgatcctcccaaagttctgggagaacaggcatgagccagcagacccggcccatttcttgagggcttcctattattaggcctatggtaggccctttacaggtgttgtctcatttgatcctaatggaaactctaagagatggtctttgttcctatagcttagaaacttcccaggaaccagtaagttggtcaaggtcattcacagacagaacatggagccaaagttccttgccacagtgagagaatgctgccttcgccccaccctcagtgactggggaggaaacatgagggtcctcacaggggattttccaaaagagagtttaaccccaagtggtctgaaagatgattctaaatggcacacagtaggtcatttattattttgcttttattgtattcagttaacttctgtttcatagtagtcttccatttatgataattaatttaatctccttttaaaataagcttaagtttttaaagtgagtcaaattaaagaaaattatgaaagaattgatagtatgggcattacttgtgtatttttcaaaattgggaagaagatttggaaagcttgagaaaggatgggccagcccaagcagagacatgttaaggccctgagatgccagaaagacagtccaaggaggcggggaggattctggctggcttatgaccctagaacacctgagaagaggctagagggtcagaaagggggtgatccctttcctcaccatcacaggggttacagctgacacctataacaaaagacaggtcaacaagagaaaagcctaacacatttatttgatcacagttttatgtgacacaagagccttcagaataaagacccacagatacaaggaaaactgtccatttttatggcttaggttcaatgaagaatggacagccatgtagaactgtggttggacagaaaaggaataatctaaaggaaatagactgagtggggaaacctattaagccctgtggactcagattcttcttggcctctctgcagcatttctttcttcccagtatggggccagaccctttctgcaatgggagtcttatgacctattaccaaacaaggtaggttagagaattttttatggcccctcttacacagaaaggcctgggaagtttagagtaatatttttagcttttctggctggctttggggaagagcagttctatgacccgccttgcggaaggattctagtttctacagctagcctcaagggagaacaaagggtgagagacaggaaggcaggggaaagtcagagagaaactttgcttcagtggctgcttctgataccttcactttggggtattgttttcggagccccactgagggcttatgctcacattactattgcctcctatttgagcagcttcaagacatctagggaaaatacctggaccccagagaaggaataaagatggggaaggaagacatgggaggaggagagtaggaggaggatggaaggaagctggagaaagtgatccagatcgagtagctgtcagctccaggctgggattccaagtaccatcatctgtccgccccagctagggcagcagtctggggaaagccaaaacagctcaaagctttcaaaagccctattttcccctatgaactagggagaacctggctgtaaaagtgatcattttcaaaaacaaagaattaaaataatgaatcctcttgcagtttcagctttgcccagtcactgtcacaggtggcctttgaagatgaggcaagagataatagggtaactattcctagaaaaagacagtgatggtctgcagatttaaatccagagcttcttacaccaggtattgtgttttccaagcaagagctttgcagagcagctgaatggcccacaagatacattcttctcagaagccacaactgcttgcgtttttcctaatctttaggggatttttttaaatgcttatagaatttattctataccttgtttctgctcctgtttttctggtaccagcagggtgtagcattggatttggtcaaattaacttttaaataaagcccctaaattctactcctaatacccttaccaggatcatcccccaaaacacacactgtctatgcccaggctctcaagagagatgttccggaagcttattcatctacaaagggagcaagagcaagagaaattaagaagcttctttaaaactgcaaatcagtttgcacaaagaaagagcaggaaaataggaatgagtggccaggcttcagtgttagacaaagtctagacccaggagaaagaacatcaaacctacacactatgggtggaactttgtgggggttgaagaaaaggattataagccaggggctggctaatgcaggaggatcacttgagcccaagcattcaaaaccagcctggtcaacatagcgagacctgtcttgaaataaacaaacagccagcacagaaagacaaacttcacatgttctcacttagttgtgggagctgaaaattaaaataattgaactcgtggagacagagagtagaaggatggttaccagaggctgggacgggtaggtgggggtaagggggtagcaaggatggttacaaaaaaatacaaagaatgaaaaagatctagcatttgctagcacaacaggaggactatagtcaaatataatttaattgtacatttttaaataactaaaagagcataattggattgtttgtaacacaaacgataaatacttgaggtgacggatacccctgatgtgattattacacattgcacacttgtatcaaaatatttcatgtaacccataagtatatacacctactatgtacccacaacaattaaaaattaaaaaaaattaataaaggaaacaaaaatcggggggcttgcgggttcacaagagattatttgggagaaggcctagttcaaaatgaacactgaatgtttgcagattgaatcaataaatgcatgagtggctggctaagctagtgggcccatggcaagcccaggagagagaagacagggagcagaccaccagaagcttattcttatgcttctctagtctcagtcaaatttgggtcaaaaaaatagaggacacatctaggtaccttagggcccctttgtccagacctgtgcattggaacaatatgagaatcagcacctccccacctacatttcataataaagatcgtaggagttttctcaattgctaacagtcagttacagttggaactgcttgttctcctctttctccccttcttacaactgcacttgactagtcttatttattttttttctttaaaaagatcatataagctcctaggcctttctaagcttaaaaaagctgaaactcactaaggggaagagaactgtgaacatgctgcatgataacttccatatgaactagtaaaacttccctaaacatatggttgttatcatagatagcatcattgtttcagggagcacttactgaaaggctactacgtacctacagacctcatgttgatgcagaacaggtgcttgatcctaaacggtggtgacagttcacatagacagagagcactgggtgaagagtcaggaaatatgaattccagtcctggctcagacactaagtggctttaggaaataggcattccaagcagagaataacttgtgagccatcacagactgacaagaaaaagcatgtgtgagatcaagaaactataagcagcatggtgctcagtagaatcgctgggcaggagtggctaatacttattgagggctcagtaaatagttgttgaatgaacgaatgagggggaggaagatacagatcacagaggatcttatattcattctatgctaagaaacatgaatgtctcggccaggcatggtggctcatacctgtaatcccagcactttgggaggccaaggcaggtggatcacatgaggtcaggagtttgagagcagcctggacaacatggtgaaagccctctctactaaaaatacaaaaattagccaggcgtggtggcgggtgcctgtaatcccagctactcaggaggctgaggctgaagagtcgcttgaacccgggaggcagaggttgtagtgagcggagatcgcaccattgcactccagcctgggcaacaagagcggaactctgtctcaaaaaaagaaaagaaaagaaacatgaatgtctcttggaggcaatggagaaccactgaggacagaggactttattcagacttaggttgtagctaggggctgtgctacataaggagttaatttaggagaacaaggaattacacagaaagacccattaaggccggtcgtggtggctcaagcctgtaatcctagcactttgggaggtggacgcaggaggatcacttgaggccaggagttccagaccagcttggccaacatagcgaaatcccatctctactaaaaatacaacaaaaaattagccaggcgtggtggcacacgcctgtagtcccagctattcaggaggctgaggcaggaggatcgcttgaacccaggaggcagaggttgcagtgagctgagatagtgccactgcactccagcctgagtgacagagtgagactccatctcaaaaaaaaaaaaaaaaagaaaagaaaagaaagaaagaccggtgaagaagcaatgatcaaagagagggagaagagcaaatggcttggagaaaccagacctgaaacagacagcacttgctgggtgattagatgagggagataagtggaagaaaaattgaatcatgggcttttagggtaataaagttcttgatagtaacactagtttacatagaaagtgcataaagtgcaagtaactgataacttcggtttggaatgttaagtggaatatccatgtggaaataaaccagagctaacatttactgagcctttcccatacgccaaaagctgttttaagtcccctacagatgtgaacttgtgtaatcctgcaacagccccatgagataggtactattattagagtcccttttttagacaaggaaaacaaggtacagagagtttaagtaacttctcaaggtcacacagctggtcagtggcagagtcagattcaaactcggacaatcaactccaaatcccactttcttaacctctgtgtaaatgggtatttgccatatagtgagggcacaaagccatcactctacctcttcttggagaagtaaaaaacaaaaaataatcaaatcaaagtgatgatttacattttttaagcacacgaaatgcaagaattccaaccatcagattgtgaatgccattatttttggtgctgtaaaacatattaatagttaaatctaagtctacattttaatatacatctagtctccaaagcaaacaagatgtaatgtgatttgtaatatgcacttgtcaagtcctgctttatttatttatatatttatttatttatttatttattgagacagagtcttgctctgcacccaggctggagtgcagtggcaggagcttggctcactgcaacctctgcctcctgggctcaaacgatcctcccacctcagcctgccaaatagctgggatcacagatgcatgccaccacatcagctatttttttgtatttttagtagagacggggtctcgccatgttgcccaggctgatctcaaactcctgagctcaagtaatccgccagccttggcctcccaaagtgctgggattacaggcatgagccactgcgcccgaccctaaatcatgcttttttatataatctatttagagtaaattaagtagcatacgtcatttgtttaaggaaaagttaaagctggtgtttatatgcattataagtattattacagaacatattaagacatacttcaatataatctttaaaaacataattctcttaagttgattttttctttttttttgagacaaagtttcactcttgcccagtgaagcagcatgatcatagctcactacagcctcaacttcctgggcttaagcaatcctcctgcctcaggcacctgagtagctgggactataggtgcccatcatcatgtcaggctaattttgaaaaattttttttttttgagacggagtcttgctctgttgccccaggctggagtacagtggcgagatctcagctcactgcaacctctgcctcccagattcaagtgattctcctgcctcagcctcttgagtagcttggactacaggcgcctaccaccatacttggctaatttttttgtatttttagcagagatgaggtttcactatgttggccaggctagtctcaaactcctgacctcagttgatctgcccacctcggcctcccaaagtgttgggattacaggcgtgagccactgcaccaggccctaatttttttttttttcttttgtagagatgaggtctcgctatgttgcccaggctggtcttgaactcctgacctcaagcaatctctcaccttggcctcccaaagtgctacagttataggcatgagccactgcacctggcattaagttgatttttaaaaacctaaaataatttctttatttcctaactactttgcagaaataacataatgactttagttccttagaggggatcataacattatttattactgtaaaatagatttgaattttaaaagatcaggaactactgcttggcaccgaggtgtaatttctgccattttgagacatattccataacccagggatccccacaaacaactacgacaagaataaatatgagatcctttccattccagggtttgtggtagagggtttagctttgacttggaccccttactgagtgactaaccattacacagacagagcttgtgacctcatggacatgctcagctggtgagctattctgccaggagctcagtgctattttcatttggctttaatctttcctagatcaagacatagccttctttgaaaagccaggtttagtaagatatacacatgacgtattctcagaaatgaaagaaaacacttttagcttccttccctagttaccaaaactctagaacttactgtaaccctaatagcagccaaaaagaaggtcttttctcttgacccttggctgacccttcttccacttccacgaattttctccctctttctggctatggcataagttttgttccccttgagattcagcccttaacagaaataattcaggcagggtaacagaatgttctagagcactcagccatgactactgagcactcaaaatatagctacagtgacagagaaaggagattgtaattaatttaaactttaatttgaaaacttggaccagatttagttattgaagaacttctacataatttagttattggagaatttctgcatatgtttggaataactttgatatgtaaatctactttttcaactgtaaattttgtgaaacctaaattttataaaatctaattttatgaaattttatgaaatctaaatacagaccaagtatttccaatgaaaatttagtctccaaaccgagatgtgctatgtgttacatccacaccagatttcaaagacttagcacaaaaaaagtaactgtctcattaatagtttttatattgattacatgttgaaatgataatattttggctatattgggttaaaggaaatatattattaaaattaatctcacatggttctttttactttttaatgtggctattagaacactttaaataatatatggggctcacattatttctatcagatggtgatggtctacagcatgggtgatagtgtcacagagactaagctcccccgacttgctggctgtgtgactttaagccatcttcttaacctctttattattttattttattttatttttgagacagagtctcactctgtcgccctggctagagtgcagtggcacaatcttggctcactgcaacctctgcctcccgggttcaagcgattctcatgcctcagccacctgaatagttgggattacaagcatctgccaccatgcctggctaatttttgtatttttagtagagacggggtttcaccatgttgcccaggctggtctcgaactcctggcctcaggtgatccacccacctaggcctcccaaagtgctgggagtacaggtgtcagccaccgtgcctggtctacttagcctctttaaacttctgtttactcatctgcaaactgaagaaaatattggccgggcgtggtggctcactcctttaatcccaacactttgggagaccaaggcaggcggatcgcctgaggttaggagttcgagaccagcctgaccaacatggagaaaccccatctctattaaaaatacaaaattagctggtccagatggcgcatgcctgcaatcctagctactcgggaggctgaggcaggagaattgcttgaacctgggaggtggaggttgctgtgagccaagatcacgccattgcactccagccttggtaacaagagagagactccatctcaaaaaaaaaagaaagaaagaaaagaaaatattacaattttctgaataggcatacagtgaattttacatgagacagtgagcataaactgtgcctgacttatagtaaaatattctgcaaatattcacttttattatcattgttattattctctagcaatcatccagatgtttagcaaaagaatgcctcaaaataaatattagttccctatgggttgcctcttgtatctcatgactagataaattgtaacctcattttccaaaatgaaaaaaaagggacttgaggtcagatacaggtttttctcatatttgtcagttttttagtatttaaaaaatcactttttttagttgatgaaatgcttttggggggggggggattaaaataatgaaattacttaaaacccagacttccctgaaaaatctagggcatgagttttactcctaataaatagtgattctcaatatctcaaataatccaaacttagcaatccttcgtttagattcaattttggccaggtgtggaggctcatgcttgtgattccagcatttggggaggctgagacaggaggattgtttgaacccaggagttcgagaccagcctgggcaacatagtaagaccccatctctactaaaaataaaacattagctgggtgtggtgatgtatgcctgtggtcccagctattcagggggctgaggtgggaaaacagcttcagcctgggggtcatgccactgcactccagcctgagtgacagagggagaccctgtctcaataataataattagattcagttttgaagactaaagtttcattaatgtccacagtttttgcagcggaggggcagaattaaagagacttccaaataaatgggctgaatatacattagggacatctgctttgagaaaaatggagaagtacatttccctattccttctgcaaagtacaactgaaaatcatggaccttatatataaaggtggaaagaagaatgcagactactaggaatctcaggacccaaagaatgacatagcagtgaattccctgggtttctttattgcctcttatatcccaaactgtgctggagctggagaaggtagatgcacagaatgccaatggatacagacaaagaaagtccaaaacaagcctgatgtctctagccaaaggaccaggaaaagagaaggttagccaaacagcaagacagaaaacttttcgataataaccactctactccagctaaacatcatagaaaaactctgactccacctccacccatgccagcaaaggtaaaggagggagtctggacttccacttctgttaatggggcacccttccccttctccactgggatggtgtcagagtagctctagtggagataataagactttttccagtgctcaaaagtaacaaggctactccaatgcttgtggtatcagtggaggcaacatggggagccagaattcccacctacacccggcactaatgaggagccctttctgtcctgaggatgttaatggatgctgagtggggaacctggatttctaccacacctggcattaataaagaggtggctccctcaccaccagccagagtggtattagaagaagccagctaaaacagaaggcttaaataagatccagagtcccataacacaatacccaaatgtccaggttttgataaaaaaacattcatcatagtaagaacaagaaaaatcttaacttatctaaaaatataaccaataggtgccaacactgacatgacagagatactagaattatctaacaaatatttgtaaacagctattataaatatgcttcaattagccataataaacatatttaaacaaatgaaaaaaatagaaagtctcagcaaagaaatagaagatttaaagaagcaccaaatggaaatttggaactgaaaactacaacgatagaaattaaaaactcagcggacgagctcaacagcagaatggaggagacaatagaagtaaacagtgaacttgaagatagataactagaaattacccagtctgaacaacagaaagaaaatagataccccaccccccataaattaacagagcaataaggatctatagattattttaaacagtctaacattaatatcactggagtcccagaagaagagaagaaagaagatggagctgaaaaaagtatttgaagaaataatggctaaatatctcaagtttggcaaaagatgtaaacctagagatttaagaagctcaatgcacctcaacaagaaaaaccaaatgaaatccatgccaagacacatcatagtcaaacttgggaaaactaaagacagagaaaaaattattaaattaagtctcttccatgcttcatgaccaaaaagaaaaaaaaaagtaatgaaagcagtgaaagagaaataacaccttactcacaggagaaaacaattctaatgacaacagatttctcatcagaaatcatggaagccagaaggaagtggcacagtgtttttcaagtgctggaaggaaagaactatcaatccagaattctatatccagagaaaatatcttcaggaatgaagggaaaacttagacattctcacatgtaagaaaactaagataatttgtcatcatcagacataaactaaaagataggctaggctgggcacagtggctcacgcttttaatcccagtactttgggaggccaaggcgggcagatcatgaggtcaggagttcgagaccagcctggccaacatagtgaaaccccgtttctactaaaaatacaaaaaaattagccgggtgtggtggcacacgcctgtagtcccagctactcgggaggctgaggtgggagaactgcttgaacccgggaggcagaggttgcagtgacctgagaccatgccattgcactccagcctgggtgacagagtgagactccgtcacaaaaaaagagaaaaaaaaaaagtgctaaaggaagtttcctaaacagaaaaacaacaacaaaaaaatgataaaagcagtaatcttggaacatcaggaagaaacagtaaaattatgagtaaatataatggattcttcttctccacttaagtttcccagattcttttaaatagctaaagcaaacataacagtgatgtggttctaaatgcatatagatgggctatttaagatttatgggctgggcgcagtgtaataccagcactttgggataccagggtggatggatcgcttgagcccaggaatttaagaccagcctgggcaacatggcaaaaccccatctttactaaaaatacaaaaattagccaggcaccaggaatcatgcctgtaatcccagctactcaggggctgaggcaggaggatcacctgagccttgggaggttgaggctgcagtaagccatgattgcaccactgccctccaccctgggtgacagagtgagaccctgtctcaaaaaaaaaaaaaaaagaattataaatatggagagtaaaaagacataaggagaagtaaggtttctatgcttcacttaaactgctaaaatgtcaattccagtagacagtgataagttatgtatatataaccactaaaaatactatgcaaagatacacttaaacgcactaagttgtttttgttttttgttttttttttttttgagacagagtcacaccgtcgcccaggctggagtctagtggtgcgatctcagctcactgcaagctccgcctccctggttcacgccattctcctgcctcagcctcccgagtagctgggactacaggcacctgccaccatgcccggctaatttttttttgtatttttagtacagacggggttttactgtgttagccaggatggtctcaatctcctgacctcgtgatccgccggccttggcctcccaaagtgctgggattacaggtgtgagccaccacgctcggcctaaatgcactaagttttaataacccataggaagttagaaaaaaaacagaaacataaaactgagagaaaacaaaagatacaaaatacaaaaaataaaatgtcaggcacaagtcctatcacatcaataattatatccagtgtaaacgacctaacacaccaatgaaaagacagagatttgcagagtagacgaaaaaacatgacccaactatacatgtgtctacaagaaattccaattataattagataggtagattcaaagtaaacaaatagaaaaaatatatctcatctaaacattaatcaaaagaaagcaggagttgctatattaatatcaaatagagtagactactgagtaaagaaaattaccagagatggggcaaaacattccataatgataaaagggttagtccatccagaagacgtagcttcctaaatgtgtgtgcaacaaacaacagaactgcaaaatgtgaaacacaaactgatagaactgaaagaataaatagacaaatccacactaatagtcataaacttcaatgccttctctcaacaactgatagaacaagcagacagaaaattggcagggatgtagaagaagtcaggaatactttgtttgtttccttgagacagggtctcactctgtcacccaggctggagtgcagtggcatgatcacagctctctccagcctcgacctctcaggttcaagtgctcctcccacctcaacctcccttgtagctggaactacaggcacctgccaccacacctggctaatttatgttatcttattttttgtagagataggggcctcactatgttgtccaggctggtctcaaactgctgggctcaagcaatcctcctgccttggcctcccccagtgctgggattaaaggtgtgagccgccgctcccagcctgataatactattaaccaataggacctaatctacatttatagactattccacccaacaatagcagaaaacacattattttcaagcgcccatggaacacatcccaaaatagactatatcttgggccataaaaccaacatcaacaaatttagaggactaaaggctgggcgcagttgctcatgcctgtaatcccagcactttgggaggccaaggggagtgcagatcacttgagctcaggagttcaagaccagcctggccaacatggtgaaaccctgtctccactaaaaaaaattaaccaggcgtggtggcgggtccctgtaaccacagctactcaggaggctgagacagaagaatcgcttgaacctgggaggcagaggttgcagtgaaccgagatcgagccactgcactccagcctgggtgacaaagagagactctgtctcaaaaaaaaaaaaaaagtataaataaaactgccatatttaagaaaaatattgttgcaggttgggtttcctgggaaacagacttagagatggaggcttacacacaggaggtttattgggaagtgatcttgggattaacacctgtggagatatcaaagctgctgattcaggcagagggagaagttgggctgcaacgcagtcacagcaagggcttccgcccatctcctggggagcccttgagctaggatggtcttacagaaatatcccaaaataaagcaagggggctggacatttagacctcacatcatgatatgaagggaaatgaccttggacagctggcttctcatcactagggttgtcggggagagcaggaggagacaggtgtgagctgtcagccaatcagactgccggtttcagtcatgaagtgggagatctgggcagcccacccagtgcttattctaagtttgaatcacctactcattcactctcaccagggaaacctttatgtagacccaatagacagtaaaggctacctcctgaagaaagagcaggctgttagaaaaaaataatcatagctacaaaactttttcttaccagaggtaagatgacttgtcaccaccaaggtaaggcagcatcttatgctcagcacaggactgattccagcttccctgtcccacgtaaaggcagcccagcagtgaacctcatgccattgacccactcttctctctgccccttgccagcactgacgatatcttaccaaacactagtgactgacacatgaaatgcattccatcccagagagcctcctgaatgttaattttttcacgaacggacagggagaaaacttttatgtggaaatcgttgtgacagaaaaatggtctatggctgggtgtatactttcagcagagctcaaaggtcaaaccttcagtctgatcatacagttttcatgctttctgcctgctggagattcccagaaaaattttccaatagaaaaaagaaagacaaaaaaatcattagaaccagaaagaacatccgcccgtcatactcaatgttaaaaaaccatgtgactctgccgggcatggtggctcatgcctgtaatcccagcactttgggaggccaaggtgggtggatcgcctgaggtcaggagttcaagaccagcctggccaacatagtaaaaccctgcctctactaaaaatgcaaaaattagctggatgtggaggcaggtgtctgtaatcccagctactcaggaggctgaggcaggagaattgcttgaacctgggagacggaggtttcagtgagccgagactgtgccattgcactcactccagcctgggtgacaagaccgaaactcagtctcaaaaaaaaaaaagtgactatttaaacaaggaaactcattcttttgcccacttatggtatgatcatttaaaataacatttttaaaaatgtatagtataaacttgggggagggcgtggggagaaagaaggaaggctttcttctcagcactttccaaaagcagacagatgaaatatagacctagcactagaataatgacttcagatgaagtcctgtgaaagcaagttctatctgactgtctctccgtctgtctgatgtgacatcagtggtcaaaccctggaaatgatggctagagggcaaaatctattttaggtgttctctcaatccccttagcctcaccaacccacttgtcccaggtttatcaaatccatgctagaacctggccacactgctaagtctaaatctccaggaaaaataacgtttaaaaaagaaaagactgggccaggcccggtggctcacgcctgtaatcccaacactctgggaggccgaggcagacagatcacctaaggtcaggagtttgagaccagcctggccaacatggtgaaaccctgtctctactaaagatacgaaattagccaggtgtggtggcgggcacctgtaatcccagctactcaggaggctgaagcaggagaatcacttgaacctgggagacggaggttgcagtgacctgagatcgcacctttgcactctagcctgggcaaaaatagtgaaactccatctcaaaaataaataaaagacttaaatacagatgaaattcaaaggtaggggcagtaaacctacttagcgaataatcaagtttctgcatttccttttctctttggtatgagtgcaataatcttgtccccagtctacgggctcttctggtacttccaataaattccttccagggaccccacctaatcctttgtacatggtcccagttgtctgccttcctgaggtaaacgcattcctaaaacattctgtgtgaaggagatgttcatagtacaaataatacttttccactgactttaattctgattccctagtatttttatcatggcttctaatctatcttctggctacaagaagtgagtcatttgtaaagtgaagaatttattttaaagtgagcaatcataccacccattttctgttttcctccagagaggcatctaaaaatgactttccccttgtagtcccaaagttctcaaacctacactcacctctttgcccaaaacttccagcctcaactatgttaaggtctctctctgccttgcttagagccccaccgtcgctgtgatagttttctagagatgcccaacgaagtatcgcagagttgttaaagaacaggaatttatttttccacaggtctggaagctagaagtccaagatcaagctaacagcagggttggtgtcttctagggcctctctcctcagcttgcagatggttttctctctgtacctgtctatatccacatttcttcttgtaaggtcactggtcatattggattagggcctacccataattttattttaaccacttctttaaagaccctatttctaaatacagtcacattctggggccccctgccttaagggacaacatccaccacattggccggtatgctaaatggaagcattacatttctttgtgccaattgccataagaagtaaggccgaaagcaggagaagcatgtcttcattttctcaactcactactccaccgtctaggtccttgatttaaatgatttcatgacacaagtaggaacagaccctttgggcaactcagcagctaagccaacatcaccttaagcaaaatgttagacatgaaaatgtcacattacatggaaaacagcgttaagggaccacaactacaataaggaaaagactgtggttttttttctctcttatattgtttgtgtaactaggatgattcctgtacataatttattcgtatgcatatgtatccatatattatatataacatttattgagatccagccatgtgccaggcactgctctaaaagcattatgtgtactagctcacttaatcctcatgatagctccatgagatagatacttttatgatccccaaattatggacaaggtgctgcagcacagaagttaagccgctgcccaaggacacacagctggtaagtgttgcaggtgggatttggccctggaagtctggcttttgtatcttatgcatcagttagcagactattgcttattttgatcaagtcttttctatttctaatatgcaattaacatataaacaccattagttccattgaaaaacccactgcagagatttcagaaggggctgcaaacccctttgagcaggctcccatcaggctacctttcctgggtggtcagcagctgctttgctcctctgtgaactttttccttaatagcaaagtggcctcaagaagacctctggcctcaagaagctccccactcttgtactggcaattggcaatacagtgtacaaatgtacactgcttcaactggtcctagaaaacctgggaaccgatgcatccccacaaggaaatattagagttggggaccaggtgaaatcacagtcataccttcaggaccttccatatatacttgccttattcagcacgtactcagtactaagaacttaagttatttacacatattagctcactttagcctagaagaagcctacaagaagatattaatgttcatcattaagaacaatgtatataaaaatgtaaactgcaaaatgtgttaaaaatcttaagctttaataaactggagttaaaagagaaattgaattaaaccacactatccttactcaagttcaaaaccatatatattttcaaaaattattttctgtagagatgtggcctcactatgttgtccaggctagtttggaactcctgggctcaagcaattttcccatcccagcctcccaaagtgctgggattacaggcacaagccacctcagccagtccaaaaatatttttcttaaatcatactctcacaaaaacgttttgtctcactccacttccaaagtgactcatggaagccgtgaaaaccagaaccaataatagtaatgggattaaaaataaatagaatttattaaatatctactgtgtcccaaagtggcatgtgtttcttttcttcttttttttttttttttttttttttttgtagaaatggggtctcactatctttgcccaggctggtctggaactcttagtctcaagcaagcctcccgcctcagtctcccaatgcactgggattacaggcatgtgctgcccaacggtgtttcctggactcaaacttgctttgatgtctcaggtctgcatctacaaactactggatgttgagaaagtcctgtaactttcccatgcctcagtttcctcatctgtaagtgggatgacaaagatacctatcttgtaggcttgttgtgaggatgaattgagttagcttatgtaaaacgctcagaaaaacacatagcatgttgtaagaagacagaagtgcctgcggctatcatcaaaatctcacaaccttggtaatacacatttttacatctgaggaaaacatctgaggcttagacctaaacttgccgcaggtaactcattagaatgtggctggggcgggggacagtggtgaaggttccaacccaggtgtggcagattccagagcctgcggtctgaaccagcccctggtgacctttaccccgagagcggaagaaaggcaaacaggcggaagcccacagccgaggccatcgcgctgcgcatgatccgtggcaaccgtccttccttgacctttgcccactggaaaagccaatcccaagtcagcctggggtaaaggggcggggccttgtggttggcatagcaacagacatgggtcaaactcacctgggggttagggcggggttgtttgtcactaaggaatcattgctgaatgacactacagtggagaaccagagccccgggcttttctaaacaaacagccctggtcactgctgaattcaaagtgtactgccggggccgggcgcggtggctcacgcctgtaatcccaacactttgggaggctgaggcaggcggatcacgaggtcaggagatagagaccatcctggccaacatggtgaaaccgaaaccccgtctctactaaaaatacaaaaattagctgggcatgatggcgggcgcctgtaatcccagctactcaggaggctgaggcaggagaatcacttgaacccaggaagcggaggttacagtgagccgagatggtgccactgcactgcagcctgtcaacagagcaagacttgtctggaaaaaaaaaaaaatgcgcaccgccgggcccgcctccctcagcacccaatgctggtcggagccctcgggcaaacaaactacctcctgcatccgggaacttaccctccaggcggaaggaaagaatgcggggacagagacctgtcctgggagaagctccttaggagatgaaggagcaccgaaagatgcctgacgtttttacgactcctctttcatgtttgtgtcccatctcttctcagaagaattagccatgttttgtgaattccaggtgccatcttcaaaaacacccttggattctagccaatcaccaaaatggcagagacggccacctgagaccaattagaatatccacaccagtggaagagagctccagtggtaaatttcctagatgtacaactattgatttcatgatgtattgttccataaggtgactttaaaacaggacaaaagtcatgattcgtatctttgtttcatcttgtcgttaatattatatctggtaattttcttgaaaacataaggacttattttacaaatttgtatgctttcataagtacttcattgtaactttaatagtaaataaactttggctttattaaggtgtaggagagaaaaccctacgaacagaaataaaacaattgtgatgaatcattcattaatccctgggagaagcagagtgggcgtactgtgggcttaggctcactaagaaggacctggattcacatcctagctttgtccattgtatgtggccttgggcaggtctcataagccacactcctttgcaaaatgaagataacaatatctacttctgagagctgttttcagaggatgaaagtgcataataagtgccttatcttacacatggcccagtcttggctcaaaaatgttacttttctttcttgaatatccccacttcctcttgaacagcctcccccaaggcagttagttgctcatctttctccctaatccccagataatttgttctgagcagaataatttttatcccggtagcttagaacagtggccagcccacaacaagtacttggtgtctgtttatctggacttggttgtgctgtaatttatgtgctgactgagagctcccagggataggaaccacatcagctagcatctagcatagtacctagtacatagtgcctactacataggctatgctcagtaacatagttgtgttactatgcattgcactcctcatttttgcaaggtacacaaacatatctgtcttcagcagccaggcaggtgaattaagataagagcgataaagtccgtgacaaactggaggcattcccattcaactaaacaaaaaacacttttctggccaaacacaacaatctgtccacaggatttacccctctaccataaaactgccaccataaacaaagctttgtaattaacaagttcttttttttttttttttttttttttgggcagggtatcaatctgtctcccaggctggaaggcaggagtgaagtgaagtggcatgtggttcacagtagcttcaacctcctgggctcaagtgatactctcatctcagcctcccaagtagctgggaccacaatcacatgccaccatgctgggctaggttttttattttttgtagagatgaggttttgccatgttacccaggctggtcttgaactcctggcctcaagcgatcctcccactccagcctcccaaagtattgggattataggtgtgagccaccatgcccagcccacaattactttcttatatgttatctcatttgatacttgagcaattttctgaagaaagcgtttttgagttcattttacaggcatctgatagagaaactgaggctcaaatacagagatttatccaaatcaaactaagttaatagccagccagggatttgcattcatgtcttctaacatcgacccaggactcccgcttctctttacaccatatactgttctttatgtgccgctgtttttctctttatagtttttctaggacaaaaaccaagctccatcagaaggttaaacctgtgtcaggtttacagtccaatgaccgccgtgggtcataatccatctagagctctgagacaggtgcctttagaaacaatgccttctttgcaaccagaggagcgtgttttcctcgagtcatcagcatagagaggcctggcagcaaggtatgatgagcatgatgagtgggctgacaggaagaactctgcacccaaatggcaatgaggaagcaggctccttatatcaacgtgaagaatctttaaaggaacttgagtttgtaaagagagcaagaaaaacaagatagagtcttagcaactagaggaaacaagcatctcatttctgtaggccagtgttgtccaacagaaacaaaatgtgagctacatataactttaaattttctaaagagtaaaatttaaaaagtaaaaagaaacaaaagaaattaatttgaataatacattatatttaatctaatatatacaatatatttttaacatgtgaccaatataaaaattattaatgagctattttatttatttatttttgagacagagtctcactctgtcgcctaggctgtagtgcagtggctcaatcttggctcagtgcaaccttgcctcccgggttcaagtgattctcctgcctcagccacctgagtagctgggattaattagcatgtgccaccatgtccggctaatttttgtatttagtagagacagggtttcaccatgttggccaggctggttttgaactcctgacctcaaatgatctgccttcctcgacctaccaaagtgttgggattacaggcgtgagccactgcgcatgtaattctttttttaatttatatttcttttttttttttttttggacaaagcctttgacatccagtgtgcattttatatttacactcagtggcactggccatatttcaagtattcagtagcagctgggcacagtggctcacacctataatcccagcactttgggagactgaggtgggcggatcacctgaggtcaggagttcgagaccagcctggccaacgtcgtgaaaccttgtctctactacaaaaaaaacccaaaaaaattagccaggcatggtggcgggcacctgtaatcccagctactcgggaggctgaggcaggagaatcgcttgaacctggggcagagattgcattgagccaagatcgcgccactgcactccagcctgggcgacagagcgagactctgtcaaaaaaaaaaaaaaaaaaagaagtactcagtagccacatgtggctagtggctgccatcttggacagcacagatctaggccaaagaaattcctaaaggtctatatttctggcatagtaaaaatgagtgacatggctctcttcaaggccactgagaggtctcatttccaatcctgctagtccagtttgaagactgatcttttagggtcaacttcaaactttgccgccatttagagagcagccgtgtcaatttccagccagttgctctgcaaagccaatcagagcccattatgtttggctccctgtttttgccttgcaagagtgcagtcctcagcatgtcccctttcaaatacctattattctggtgctgtcttcagtggtgccatgactggcagtgattagggtgacattttttatgtgcctgagttcacagagcaaattacatagcgtgagtggcatggtgattaagtggctgtgtgtaaagactagaatcgctacatttgcatgtctctgaataatgagattcttatctccattatgtggcaatgaggtcgaaattgatagcgctattaactgtttacacagtaagcacaattttctattctctctttctctctcactggtttcaaagcagccaaaagctttgagccccccagcaaccctcccaaataagttttccataaaaagagatttccacaacccctcaataaattttctggctgccttccagagcccacagataatccaatccaccctcttggtttcacagggaagaagctgcagtgtagagaggtgagatttgtccaaggtcacacagaaagaaagagggctggaaaacagaggactccaacaatactcattccttctctgatttgtgtcctctggtgcccggctgcagctttggaataatgaagtcccaccttccagcctacatacatattgtgcattctggtcacacacccattttgctgctgaagagatgatgaaactggctgaaattataatttgattctccaaacacagagaccttttcagttgaccctagagatgagccctaactatactttgaatcaacaaatatcaattttcgcagcaatgaaataaatatatggagagatagttatagttacagtgggttataaaacagggcaagggaaagctgtgactatttatttggctctgctcctagcaatgaagtatttatccatcagctatgtggcagtgacattttttatatgaagggcaagtttgaattaataactaaagagaccgtttttaaaaatagatcatcagtgtagcaacccaaaaatgtatccaataaagtgcttcactagcaatattgcaaaacatgaggaggaaaaaaactctctccaattaaattctcactcaccagtgctttcgtggtggaacaaccacaacagcatgaaggttaactgccttggcataaaagaggagacggagtaacaggatttgtcaagtagatcgtggcatcagcttaacatttgtgggagttaaatgtatgcatgaacagttgtaatgctgagttccattaaaaaatatgatggtgaaatggcctggagtgaagcattattatttattatgaactaaaacggactatttgtttgtgatatatcttaaaagtactgagtgccttgaaatcactagaagggttcattacctctgtatcccatcaataaccaaaaatcttgtcctaggagtcaaaactgaaggagattccagatggcataaagcacaagaaaactggttcctatttagcagtgggtaaagaagttgtgaaatccttcaggactccacttaaactttgcggggttgaaagaggccctccctggaacccatagtctaaattacacttctttggtataagtcaccatatttctttttttttgagatggtgtttcactcttgttgcccaggctggagtgcaatggtgcaatcttggctcactgcaacctccgcctcccaggttcaagtgattctcctgccccagcctcctaagtagatgagattacaggcaagtgccaccatgcctggctaatgttgtatttttagtagcgacagagtttcaccatgttggtcaggctggtctccaactccagacctcaagtgatctgccctcctcggcctcccaaagtgctgggattacaggtgtgagccaccatgcccagcgaagtcacaatatttccacatgcgctgtttgatttattatatttgttacacgaaggtacttactacctgtcttctccacaaagtctgtgaactctagcaaggcaggtgcctatgcacctaacagcatattcatccattcaaaatgtacctacagagcacctactaagagttagccaacacaattctgccctcatatgtttacatccagatagggggacatagaccataaacaattaaacaagcgagttgatttgcttttttttttttttttaggcaaggtctcactctattggccaggctgaagtacagtggcatgaacatagttcagtgcaacctcaaatgcctgggctcaagcaattctcctgcctcagctttgcaaatacttgagactacagactcaccatcacacccagctgatttttttttttttagatggagtctcactctgtcgccaggctggagttcaatggcacgatctcggctcactgcaacctccacctcccggattcaagtgattctcctgcctcagcctcccaagcatctgggactacaagtgcttgccaccacacccagctaatttttgtgtttttagcagagacagggtttcaccatgttggccaggatggtcttgatctattgacctcgtgatctgcccgcctcggcctcccaaagtactggaattacaggtgtgagccaccatgcccagccacacccagctaatttttatatttttttgtagagacagggtctcactatgttgcccagactggtctcaaacttctggcttcaaacaatcctcctgccttggcctcccaaagcattagattacatttgtgggccaccacacctggcttgattttagataataatatgggagactgatcagagaaggtttccctgaggaaatgagattaaggaaacctgatactgaaagttctgggctggacatagcagctcacgcctgtaagcccagcattttgggagaccgaggtgggcagatcgcttgagctcaggagttcaagaccagcccaggcaacatggcgaaaccctgtctctactaaaaatacaaaaattagccaggtgtggtgttgcatgtctgtagtcccagctactcgggaggctgaggtgggaggatggcttgagcctggtaggcggaggttgtattgagctaagatcacaccgctgcactccagccttgacaacagagtgagaccccgtctcaaaaaataaaaataaaaataagttctggatagatatgagctgagaggagtgaaaaataaaaataaaagaaaaacaattttttaaaaagaagaaagttctgggtaaggggcattccaggcaaccagaagagcaggtggaaggaccccaaggtggaaataagtggctatggctggaacctagtgggtgaggagaagatgaagtcaaggaggcagattggggctggattatgtgcttggcacagagtaaacactcagtaaacatatgtttcatgaacaagtgagcccatatcagctataattgcaggcggaatgtaattcttgctaccctgggcaagactgcaggtgaccaaaatacaaaagtaaagcgtagatattaagtgttgtctccacaaaaataactacatgatgtatattgcgtttgttaattagctagatttaaccattccatagtgtatatacacttcaaaacatcatgctgtacacaaaaaatacatacaattttatctgtcaatttaaagaaatagtggttgttctagggtttacaatgttcatattttatgtatcatagtctcccttcaaagaatattacactactccacatgtagtttaagaaccttatgatagtatagttacaattcctccaccctttggtcttttaatcctcacaatacacttattgtatatttgtttacactgctaaatatcattgattggttctttaaaaatcctctgttaaaaaaaaaaaggctgggaacagtgtttctcatgtctgtaatccctgtaatcccagagttttgagaggctggggcaaaaggattgcttgagcccaggagttcgaggctgcagtgagctatgatcgcgccattgcactccagcctgggcaacagagataggctctgtctctgaaaaaaaaaaaaaaaaaaaaaaatagagagagagagagagaaaggtagaggctagaaacttgaaatttcaagagaaccacaacaggtaaataagataagtcctggggactcagagaaaatgaaaatgagatatttaaggcagcctataataaaccccaaattgctgcagaggaagtcagggcaagggagctaaatgcaggctgacatcatatggggcaggttcctgaaggcaggatgtgaactaggccttgaatcacacacaggaatttattgggcagaacaaataaggaaggtagggcactccaggaaaatcggtcttatcacattatcccaatggaactaccacatttatttctaggacgttatgtaaatccatactatgctcattacacagagggacaattgattatatgcatggagtatagaagttggatcaaatttattggccaggcaccgtggctcacgcctgtaatcccagcactttgggagactgaggcaggcgaatcaccatgtcaggagatcgagaccatcctggccaacatggtgaaaccccatctctactaaaaatacaaaaattagccgggcatggtggtgtgtgcctgtagtcccagctacttgggaggctgaggcaggagaattgcttggcccgggaggtggaggttgcagtgagcagagatcgtgcctctgctttccagcctggcgacagagcgagactctgtcaaaaaaaaaaagaagttggatcaaatttgttttaagttttaggcttaaattgtctcccttgaaattcatagactcctcatctagtggagaattgcctatcttcagctcatgcatagtgaaattgatgagttatggatctataagggatgttctaattctctcatttgctggaaactcagtagcctgctattcttgttgtaatggtttagttctttttagcactttgttaatcaaactgtgttggagattgtgccagggtgatccaacctcctattataaggtctgtgagacatgagtcacagcacaaccaagaggcctcaccagaaactagggtagcatccttgacaccaccgtttctctcatgacccccagtcaatctaaccagtgaagtgctatcaattctacctctcaagtaactctcaaatctgtcgtttttgctccttgcttaccacactgccttattcagccccttaacatttcttactaaatcccaccctttaatttccacctcacctccagctatttttaaacattcctttccaatccccataacctccctgtgactgcttgaacactcaccataatatacatacacacccttcacgatttgcctactctttcatccttgtcttacttcatgcctcccaaacagcccgagttcaagaaaacagccatttatggtttccccaaagccacatgctgctggtagtctccactcctttgtgcttgcaatttcctctgcctagaatttctttgcccagccctgtgtggtctcttttattcgtcctttaagactcagcttgggccaggcatggtggctcacgcctgtaatcccagcattttgggaggctgaggcaggtggatcacctgaggtcgagagtttgagagcagcctggccaatattgtgaaaccccaactctactaaaaatacaaaattagccaggcgtggtggtgcatgcctgcagtcacagctactctagaggctgatgcaggagaatcacttgaacctgggaggtggaggttgcagtgagtcgagatcatgccactgctctccagcctggacaacagagcaagattccatctgatttctataagcaagattaggggtttttcttaatttttttttttattttccgagacagtcttgctctactgcccaggctggagtgcagtggcatgatcttagctcactgcaacctccgcctcctgggttcacactgttctcctgcctcagcctcctgaatagctgggattacaggcgcccgccaccacgcccggctaatttttgtatttttagtacagacggggtttcaccatgttggccagactggtctcaaactcctgacctcatgatccacccacctcagcctcccaaagtgctgggattacaggcgtgagccactgtgcctggccaagattaggggtttttcttctgtaggttctgcagcatcctattttagcattcctacattgctgtaattaatactaggcatatccgtcccacctgacatgggtaggaaccatgtgccagccatatttttatccctttttttctctctctctcttttaagaggcaagaccttgctctgtcacccaggctggagtacagtggcataatcataactcactgcaggcttgaactcccatgctcaagggatcttcctgccttagccacctaagtagctagaactacaggtacgtaccaccacactcggctaatttttttatttttgtgtagagacaaagtctcactatgttcctcagacaggtctcaaactcctggtctcaagtggtcctcctgccttggcctcaaagaactctgggattacaggtgtgggtcaccctgcccagcctattcccattcacagtacaccatcagtaaatacttatcaaagtaatgaccaagtaaatgcatttttatatttttaggacactattatacatgcctagtccttacaactactactagaccagggaattattgttaacatcccaggaaagaaataaagttagagtacaggctgggtgcagtgacccacacctgtaatcccagcaatttgggaagctgaggcaggaggatcacttgaggctaggaattcgagaccagcctgggcaacatagggagacccctctctacaaaaaaatttaaaaattagctggacatcatggcgtgtgcctctggtcccagctattcggaaggctgaggtaggaggatcacttgatgctgggggtttgaggctgcagtgagccgtgatcatgccactacactacagtctggatgacagagcaagactccatctcaaaaaaaaaaaaaaattagagtacaaagaagccatcaaccccacttcccgctaagagactacaaacgctgagtttcatttggaacttttgccccttggtttatggggcacaaaagatggcctggctcccttaagccttctttggcagtgaatgaatggtcctgctcatgactatcccagctcctacagccactgaccaagaggcagttcctgacagccatctggacttacacctcactccgtgactcacctattcataagtgtctcgggaactttcctccgagtgtgtgtggtatagtaacactcaagagaacataattccgagcatgtgtcataaactaactagaacaaattcctccctttaattaattactttatttatttatttatttatttatttttgagacagagtctcactctgtcacccgggctggagtgcagtggcacaatctcggctcactgcaacctccacctcccaggttcaagcgattctcctgcctcagcctcccgagtagttgggattacaggggcccaccaccacgcctggctaatttttgtatttttagtagagataggattttaccatgttggtcaggctggtctcaaatacctaacttcgtgatccacctgcctcagcctcccaaagtgctgggattacaggcatgagccaccgcacccagacaatgggacacttttttttttttttgagacggagtttcactctcgttgcccaggctggagtgcaatggcacgatctcggctcactgcaacctctacctcccaggttcaagcgattctcctgcctcagcctccctagtagctgggattataggcatgtgccaccatgcccagctaattttgtatttttagtagaggcggggtttctgcatgttggtcaggtcggtcttgaactcctgacctcaggtgatccgcccaccttggccccccaaagtgctgagattacaggcatgagccaccacgtccggccaatgggacacttttaagacagtctcaaaagaatctctaagattttggccagactcagtggctcacgcctgtaatccctacactttgggaggccaaggcgggtggatgacctgaggtcaggagttcaagaccagcctagcctacatgacgaaaccctgtctctactaaaaatacaaaaaattaactgggtgcagtggcgtgcgcctgtaatcccagctacctgggaggctgaggcaggagaatcacctcaactcgggaggcggaggttgcagtgagctgagatcgtgccactgcactccagcctgggcaacaagagcaaaactccgtctcaaaaaaaaaaaagaatctataggatttcatcaaaaattgatgtccctgtgacatcttctctcccaacaaattaagaaggcccctagacttctctagctaaactaagaggctctaaggaccaagcacgaatgacctctgaagttttcctttctcactttcctagctctcagcccaaatactagttatcaaatggtacctgggtaactttcggagatattttttgtttgtttgtttgtttgtttgtttttgagatggagtctcgctctgtcgcccaggctggagtgcagtggcgctatctcggctcactgcaagctccgcctcccgggttcacgccattctcctgcctcagcctcccgagtagctgggactacaacaggtgcctgccaccacacccggctaattttttgtattttagtagagacggggtttcaccgtgttagcccaggatggtctcaatctcctgaccttgtgatccacctgcctcggcctcccaaagtactgggattacaggcatgagccaccgcgcccggcttttttttttttttttttttaactttcagagatatttaaagcttctaaagcaagactcttgacactgctctaagatgaacttaatcatgatgcactattaaaaacaatgtctgggtgtggtccagctttgggtttataaacatgctatctatttttcttcatatttttataagtaattctgcatcattgctaaaccatgcaaacgagcttttcatgattcttaatgagcagcctctcaatcacagcacaagacatccttcatgataacaaatgtggaaggaacttgtttccatcttgaatacagatctttcttctgtcctaaggatagaaagtggaaaatcagagaaacataccttgtgtaatgtcccatttattcttctttctgaaagagagaaggtaggaactacattagatgcattctgaggtttccaattcggcaataccaaacaaatgttacaggctaaattgtgtcacccaaaatccatatgttgaagtcctaaccccagtacttcagagtgtgacattatttggagatacggcctttaaacagttgatcaagttaaaatgacatccttcagggtgggtcataatccaaccttactgctgtccttataagaagagatcaggacccaaactggacacaaagggaagaccatgtgaggacacagccagatggtggcaagccaaggagaggggcctcagcggaaaccaggcctacggacaccttgaccttccattccagcctccacaaccatcagaaaataaatttctgttgttcaagctgacgagcctctggtatattgttatagcagcctgtggtatcttgttatggcagcctggcaaactaatacaaaaaatgatttttaaatgttagagcaattttacaatcctagtgcatgatgcattttgtttgtttgtttgggtttttgttttttgttttgttttgttttgttttattgaaatagggtctcattctgttgcccaggctggagtgcagtggcatgatttcagctcactgcaacctctgcctccccagctcaggcgatcctcttgcctcaagcctcttgaggagctgggactacaggtatgtgccaccatgctcagctactttttaaattttttgtagcgatgaggtctcactatattgcccaggccaatctcaaactcctaaactcaagcgatcctcctgcctctgcctcccaaaatgctgggattacagaagtgagcccagccatgatgtgttttatctgccattttggctaacaatgttttgactcaacatctataatacaaatattttaagtaaaataacaccattactaattaatttgggttaagaaataatttttggtgtgaatgccattaagccaatttaaatttttagtccattttctatggagaacaatgaaaccattttcagctttttccattttaggttttattcagccgcagtaactgtcactgaatcaatttttatgaacatacatttcattacaaagatatgattcatcaatgaatgttttgcccaactataattatatcaattgtggccttttataatctttctgctgcagttagtatttatattatatggaaaaatttatcaaatttttcaggtcaaatttaacaggcaaaattttactctttggtcatttttttaaaataatagttgtattgagacataattccctaaccataaagtttatccttttaaagtgtacagctaactggttttaagtatatacaaaggtttatgcacccatcaccactatcaatttccaggatattttcttttttctttttttatttttttttgagacagagtcttgctctgttgcccaggttggaatgcaatggcgtgatctcggctcactgcaaccttcacccgctgggttcaagcgattctcctgcctcagcctccggagtagctgggattacaggcacgcaccagcactcctggctaatttttgtatttttagtagagatggggtttcaccatattggccaggctggtcttgaactcctgacctcaagtgatccaccctccttggactcccaaagtgctgggattacaggcgtgagccactgcacctggccaaattccagaacattttcatcattcttaaaacatacttcccatttctccttccatgtctcctggcctctggcaactaccaatctactctctatggactcacctattctgggcattgcacattcagtcatgtgttacttaacaacagggataccttcagagaaatgtgtcgccgggtggtttttgttgttgtgtgaacctcataggtgcatttatacaaacctagaaggaatagtctactgcatacctaggctattgtaacacaatggtaagtatttgtgtatctaaacatatctaaacatagaaaagatatagtgaaaatggccggacatggtggcttacgcctgtaatcccagcagcttgggaggccaaggcaggtggatcgcttgaggccaggagttcaagaccagcctggccaacatggcaaaaccccgtctctactaaaaatacaaaaattagctgggcatggtggcacacacctgtaatcccagctactcagggggctgaggcaggaaaattgcttgaacctgggggtcggaggttgcagtgagccaagattgcgtcactgcactccagcctgggtgacagagcaagaccgtcacaaaaaaaaaaaaaaagaatttttaaaatattgatagatggttgaaaaactcaaaagaggcataatatttttgtaattcatgaaaattatgtaaaattcaaattcactaactataaataaggttatattggaacatcaccacactcagccacacctactcatctaggtaccatctattactgctttctcactgcagtgacagagttaagtagttgtgacagaaatcatttgagccacagagcctaaaatatttactagctggttctttacagaaaaaggtctatcatacggctgaaccaattcatctttatctttcagatcatatggtatgatgggcactaactgtccaaatagttggcagaaagagcaaatggaagctacccaaagtatgggtctcaggctgttgccagttgaactgttaggatcataatgagataaatacaaaaattgagagtaagccttagaaagttatagaaaattgacaaagtaattttatgtctatttgaatataatacttgaaaaatgaggtttaggccaggcatggtggctcacgcttataattccagcactttgggaggctgagacgggaggatctcttgagctcaggatttcgagaccagcctggataacatagtctctaccaaaaatacaaaaaatgaaccaggtatgatggcatgtacctgtagtcccagctactcaggaggctgaagtgagagaatggcttgagcctgggaggcagaggttgcaatgagctgagatcacgccattgcactccagcctgggtgacagagcaatatcctgtagaaaaagaaagacagaaagaaagaaagaaagaaagaaagaaagaaagaaagaaagaaagaaagaaagaaagagagagagagagagagagagagagagagagagagagagaaagaaagaaagaaaggaaggaagggagagagaaagaaaaagaaaaagaaagaaagaaagaaaaagaaagaaaaagaaagggaaaagtgaagtttctattttgtatgtctttgggagtttttaaatttcatctttctagccattgatttttagactaattgaatttttaagactgaccctttaatacagtttgagacacactgaaatagaagatcagtatctttagaatcaaagaagtggatctactaggacatgagcatgctgagggcaggtgcttcatctgccttgtgcacctgtttccccagcacctggtacactataataggtgctcaataaacactggaagaatgtacagatccaaaacaactcacttcttaactctagtatcattgtcaaggattatcattttctaggtttgtttttgtttctaatttattttcagacgcaatagatagcatagaagctagcagcaagcctgtgttcatatcccagcttatttaattaattaattcatttattttcaagatggagtttcgctcttcctgcccaggctggagtgcaagggcacaatctcggctcactgcaacctctgcctcccaggttcaagcaattctcctcctcaacttcccaagtagctgggattacaggcgcctgccaccacacctggctaatttttgtatttttagtagagacagggttttaccatgttggccaagctcatctcgaactcctgacctcaggtgagccgcctgcctgggcctcccaaagtgctgggattacaggcatgaaccaccgtgcccggcctgagtcctagccttttaaaacagtccctccaggttaagatcaccagatattttagcaaattgtaagatatctatttgcatatgatttttcatgaattcataaagtagttcttgtaatttttttttttaaacggagcctagcacgcccaggctggagtacagtggtgccatcacagctcattgcaacctcgacctcctctgctcaagcgattctaccatctcagcctcccgagtagctgggactacagtgtgagccaccacacctgactaatttttgtattttttggagagatagggtttcaccttgttgcccagactggttttcaactcctgggctcaagtgatccacctgccttggcctcccaaattgctgggattacaggcatgagccaccatactcagcccataaatttgatcaatacagtccaaagacctaacttcaggtatataaagtacagctcatgagttgatgcaagtaatgtgcagaagtttccattctgacatcctgcacacagttccaccccaatcccaaacaacctttacaaaatacaaaattttttcagagtgaatctccctaagtctgtggtagccctttcttaggaaggtccccaggcattgtgagggtggcagaaatactgagtggctgtccgaggaatgaccctctttattcttacatactagcacaatattcagggttactgcaagacatagcagaaccagaaaatgtctgtgtctccatgaatcttgctgccttgttgcctggctgtgttcttccttgagcctggaataaatcttttttttttttttttttgagatgggagtctcgctctgtctcccaggctggagtgcaatggcactatttcggctcactgcaacctccgcctcccaggttcaagcgattctcctgcctcagcctcccaaatagctgggaccacaggtgcacaccaccatgtctggctaatttttgtgtttttagtagagatggggtttcgccatgttggccaggctagtctccaactcctggcctcaagggatccgcccacctcagcctcccaaagtgctgggattacaggcttgagccactgcaagcctggaataaaccttcccccagtctctgcctactgagaactagacatccttcaagaacatctatgtcttcacctcacttatttatttatagtgtcacagtcactaaagttccaggaagtcacagaatcatagctatgaatgctagaaggaaccatagagagtcgaatccagggactgcaaactcaaaggcctatagtagctgcacaggttatttgatagaaagaagactggcaggtgggggctggggagaagagcaaagaatagagccatttagagagggcagatactcagctcaagtgggctgttgccaactggtacatgtggcccaatatgccagatttgttttaatatattttttaagtcgactattcaggttttcatgagttaccactctttattttaattgtggtaaaatatacataacataaaaacttaccatctaaggatttttatgtgtccagctgagaagtgttaaatacactcacattgctgtgcaacaataattccccctcttccccgccatccctggcatccaccattccattttctgtttctgattttaactattctaggtacctcataaaaaataaatcaggtcaggcacaatggctcatgcctgtaatcctagcagtttgagaggccggggtgggaggaccacttgagccgaggggtttgagaccagcttgggcaacacagcagaccgcatctctacaaaaaaatatattaataataaattaaaattgggtgtggtgtcatgtgcctatagtcctaactgctttggaggctaaggcaggaggatgacttgaggccaggatatcaaaggacatcaaagctgctgcagtgagccataatcttatcacagcactccagaagaaaggaagtggaatcatacagaatttgtctttttatgactggcttatttcactctatgtaatgtcctcaagactcattcatgttgtagcatgtgtctgaatttccttttttttttttttttttgagacagggtctcactctgtcacccaggctggagtgcgctggcacaatctcaactcactgcagcctcgacttctggggttttgacaatcctcccacctcagcctcccaagtagctgggaccataggtatgctccatcactcctggctaattttcatatttttggtagagacggtgttttgccatgttgcctaggttggtctccaactcctgacctcaattgatccacctgcctcagcctcccaaagtgctggagttacaggcatgagccaccatgcccagcctccatctttttaaggctgaataatattttattgtatatatagtccacatttttttccattcatccatcaatagactcttggttgcttctacctttggctatgtgaatgatgctgctaccagcatgagtatacaaataatgtatcttttttttttattttgagacagagtttcactcttattgcccaagatggagtgcaatggcacgatcttggctcacagcaacctccgcctcccaggttcaagcgattctcctgcctcagtctcccaagtagctgggattataggcatgcgccaccacacctagctaattttgtatttttagtagagacggggtttctccatgttggtcaggctggtctcaaactcccaacctcaggtgatccactcacctcagcctcccaaagtgctaggattgcagaagtgagccaccatgcctggcgaagtatacaaataatatatcttttgagttcctgctttcaattcttttgggcgtatatccagaagtggaattgttggatcatgtggtgattctatttttacttttttttaggaaccaccatactgttttccatagcagctgcaccatttcacattaatactaacagtacacagcattccaatttttccacatcctcaccagcatttgttgttttttgttcttttgataatacccatcctagtgggtatgaggcagtagtatctcactgtggttttgatttgtatttctctaatgattagtgatgtcaagcatattttgatgtgcttgttggccattttttaaattagattgttttactattgttgagtccttttttaaatgacgaacactagtttaaattttataaaaacaaaaacaaacaaaaaatggccaggtgcagtggctcacacctgtaatcctagcacttcgggaggctgaagtgggcagattgtttgagttcaggagtttgagaccagcctgagtgacatgggaaaacctcatctctacaaaaaaatacaaaaattagccaatttagtggcatgcgcctgtagtcccagctactcaggaggctgaggtgggaggatcacttgagcccaggaggcagaggttgcagtgagcagagatcgtgctactgcactccagcctgggttacagagcaagaccctgtctcaaacaacaacaaaaaacaaactaacaaaaaaaccgccgtaacaccatatggataaaatacatgatttcaggcagtatacggccggagacctccatttggtgacctcatctaggcccaacaaactcatcttccaaacagggaaaccaaagcctagatcataaagccaacagttgcacatggctatctgatatctgagccagcattagatctgaggtcctctagtgcacaaggcattgacacatttcttagaacactcaccagagccaacgcgtctgatttgtaaggagttgcaatttgctaaaaattcgtaactgggcttaatgacttgtgggtgaaagtgcaaaagtcaggcaaggcgcagtggctcgtgcctgtagtcccagcactttgggaagttgagtgggtggatcacttgagctcaggagtttgagaccagcctaggcaacatgatgaaaccccatctctaccaaaaatacaaaaaattagctggacatgatggcacatgcccataatcacagctactcaggatactgaggcaagaggatcacttgagctcaggaggtcgaggcttcagtgagccaagctggcgccactgccctccagcctgggagacagagagagaccctgtctaaagaaaaaaaaaaaaagaaagaaagaaagaaggaaagaaagtgcaaaaggcagcagcacaagacagagtcaggaactttttgaaaggaactctctctggcagctgcttcaatcttctttctctagaggtagtaagagggggctggagatctattcattatcttttaacaatggacaaagagaagcctgtctgctgcgttagtcattgcttggaggtccccgacttctgcttccactactgctctctacccccaaagtgacttctctttgatgctatttataaaatggaatgtgaccctccagctaggcagggctgggggcatggggcgggggggacatgagtgagatattaaagccgtatttctgcttgggtctggtatgtggcttctcaagagtacatgaggcaatgagaaactggaatgattgttatttagggtatagctctctagggaggaaaactgagcaactttcttgagaaggaatagtgaacatgtgaaggtgtccaatttagaaaaggggatgggcttcctctttctgggaaagactcacccctgacttgtggattactaaggaatggagtatttctgcctccaacttgctgtgcatcctaaagtgagatcctgtacttccttctacctcaatttctctcttcataatattgaggaaaagttacataaatgcagggtttcctgccttgctgactgtggcacttaattacactaaatagacataagtcgcatatccgtgccacctgccttgactggtgtcttctgctcaactggccccttgaccaacttcagctgcctttggtagttcaagaattgagagtttgaggagacataagagcaactgtaataaactgagggacctcattcaaactcatttgttgctaaagaccatcttaaaatttctggtcacctggagcaaaccatcagccagcaactcccagatctgatcatatttgatgtcgctgtgagaagtgccactccccacttccatcatggctggaggctaggaatgtgcaggggaatgtctaaaggggtagttgatatttgaaactgcatttgggggatctgggccgggcgcggtagctcacgcctgtaatcccagcactttgggaggccgaggtgggtggatcacgaggtcaggagttcgagaccagcctggccaacatggtgaaaccccgtctctactaaaaatacaaaaattagctgggcgtagaggcgcgcgcctgtaatcccagatactcgggaggctgaggcaggagaatcgcttgaacccaggaggcggaggttgcagtgagccgagattgcgccattgcactccagcctagcgatggggcgagactgtgtctcaaaaaaaaaaaaaaaagaaaaagagaaagaaaatgcatttgggggatcctcagaaaaagctactaattacacctaacggctggcaaccagctgtgttatccacattctagggttgagtatcatgacacaccatagtttaagaccatctgggctgggcacagtgcctcacgcctgttctcccagcactttgggaggccaaggcagaaggatcacttgagtctaggagctggagaccagcctgggcaatgtagggagattccagctctataaaaaaataaaaacaaattagctgggcatagtggcttatgcctgtagtcccagctactcgagaggtcgagatgagtttgaagaccagcctgagcaacagagtgagatcaagatgggatcataggctgtacctgtcatcgcaccacagcactccagcctaggcaacagagcaagaccctgtttcaagaaaaaaacaagaccatttgaatgatgccttttataccagggctggaacttgggatgctcagttgtctacttctttaacctccaaattccatagtataaactcaggagagtaggtttaacaaatgtttgacataggcagtaaatggcccagggtggagcaccacttattgaagaagtgtgcccaggtttgtgagtgcattaatatacattgcctgataacattatacactatctggatttagccaaaaatgaggctttattataatctcctataatccccttttcagggcaaaggccatgtcttactcattttggtattcccagcacgtataatagtataaggcctggcccagagtagagcctctcaacccctgattaactcctaatcatcctgcagttcattcactcaagtttgaatgctgattgagtacatatgtgtgcaaggcagtgtcgtgggaactgggggacagcagcacaggacagcgaggtccctccctaaggtcacttgcagcctacaggaacttcacctcatgcaggaaggttccctttccccccatccctcctggatgcgccctgaagaccctgcacctatcccaaaaccacacttactatacagcactataattacctgtatggatttcattagtacagggctgtgaattattaatccttggaacctcagagtctagaacgaagcacagttctctgtagatgctactcaaatgctcattaatcactgaatccacacctcccttctggcttccaagacaggaaaaggaggctcagagcggaatatgcaatgctgctctcttggcttattccttgtgctaaccagctgcttcgtaactgcccgcttactaacctggttgccccactagagtgtaagttccccaagattgagggcggtaccttatttaccattgtatcccaacatgcagcacaagcaggcgctccataaatgtttgttagatcactgaataaacaagtgaattatgaataaaatgaaagaggcttagatataaaaatgatgcccagttatacttataatgatagagccctaaagagtaaaataagactattctgtttttgtttttgtttttgagacagggtcttgctctgcagccaggctggagtgcagtggcacaatcatgactcatttcagcctcaatctcctgggctcaggtgatcctctcgtctcagcctcctgagtagctgggactacagacgcgcactaccacgcccagcaaattaatttttttggtagagatgggatctcactgtgtagcccaggctggtcttgaactgccgggcttgatcctcctgcctgtgcctcccaaatgctgggattacagacatgagccaccaaacccagtctattctgatatttctaacctgttattggagacccattaggtttgcttcttacttagaacaaaacctaaccaaccaggcacgatggctcacacctgtaatcccagcactttgggaggccaaggcgggcagatcacctgaggtcgggagttcgagaccagcctgaccaacatggagaaaccccatctctactaaaaatgcaaaattagcctggcgtggtgatacatacctgtaatcccagctactccggaggctgaggcaggagaatcgcttgaacccgggaggcagaggttgcagtgagctgagatggcgccattgcactccagcctgggcaacaggagcaaaattccatctcagaaaaaacagacacacaaaacagcctaacccaagatagatagaaatctgtcaacagttgaactattatggtttctattatcggatcatgcaatgaaaacactttaacccttcttcacttaaccaactcactcaattaatataggtctctgtttcctctctaaaacacactgacctgtcaccagacacccactgaagggatgccgcgggaagggtcttgatttgcatgtctgagtgcttctgttcctatctgctgaactgtatgctttccagttccagtggagattgtgcccactcccattgatgtccattgttattatcattttacaatttaattaaatattacataagtgctgaaataggaatgcaaaacaagagttgttatttttgtaaaaattaagttgaatgttttggggaaagttgatagaataaatcattaaaaatattgtcatacaggtgcaagctaatcaactctaaaagtttagggcagaaaagcctactaagattctgccctcaaaaccagaaaatgtaactcggacacggtggctcatgcctgtaatcccagcactttgggaggtcaaggtgggcagatcacttgaggtcaggagttcaagaccggcctggccaacatggcaaaacaccatctctactaaaaatacaaaaattagctgggcatggtggtgggcacctttaatcctacctactcgggaggctgaagtgggagagtcacgtgaacctgagaggcagaggttgcagtgagctccagcctaggtgataaagtgagactcagtctcaaaaaaaaaaaaataaacaaataaaataaattttttaaaattaggaaatgtggataatattttatgaaaatagtttgtgcaaaaaaagacagagtagaacctgaatcagcaggtccgtcttgaaaggaaaagccttgaggtctaaaccaaaaatagacaaatgaatctatagtatatgctgtgaactgtataaaaatatttaaggcttataggtatcatatcatatcttttttttttttttttttttggtctcactctgtcacccaggctggagtgcagtggcacaatatcagctcactgcaacctccacatcctgtgcccaagtgatcctcccaccacagcctcccaagtagctgggactacaggcatgcaccaccatgcccagctaattgtatgtgtgtgtgtgtagagatgggggtttcaccatgttgttcaggctggtcttgaacttctggactaaaacaatcctccagcctggcctcccaaagtgctgcaattacaggcatgagccactgtgcccggcctgtcatatcattctttatgattataaacacttccagagtttttttcagtttactaatttactggttcctggtctatggatctggcagattttctactgtacattggattattcaaaagctctatctgaaaatggtatctctccaggaaggtccctgtaattccatcctcctggcccgctaccctactaattagagtgatatgggatggccatagctacgtttccatcttgccgttttctctaacgtcacgtcctgaataaggtaggagagtctaaccaactgtaaggcatttagatatccatcatcataatctttctaaaaggaaattttactttaacattatagtgaaaagaagaaactcttttctgaaacagaagccctctctggagagcttattttcagaatggtaaaatggggaactaactttagttaagtatcttctgagagcagatgctttcatatctaattttctgtaatctttgcaaacattctgtgagttcaaaatcactggccccattttatagatgaggaaactgagctccagggaggttaagcaaggtcacacacaggcagtaccagagaggtggcatgtgacccattgtgagccaatatacttcccaagtcaccaaattacatctgatgatttgccccaaatgtgacatcccagtttttttcagaagtaaagtagtatggtggctacgtattatgtttcttaagttccagctacttcaaagggattgcccttgtttcattattggaatgtgtccaaactgagcagctcccctgccctccttcgacactggctgaggatggatgcagaggctctataaaaagcccgaggatggatgcagaggctctataaaaagccctttgctacatgctatgctatgctatgctatgctatgctatgctatgctatgctatgctatgctatgctatgctatgctatgctatgctatgctatgctatgctccagttattctagaaattctccaggctatcccctacccctctactttcaactctgtctctttctctgtccctctttgtcctttctctctctgttatgggttagtttctccccaaaagatattgaaatcctgtgactatgaccttatttggaaataggtccttgcaaatgatcatgttaaaatgttaaaatgggtcctggccaggtatggtggctcatgcctataatcccagcaccttgggaggccgaggttgatggatcacttgaggtcaagagtttgagaccagcctggccaacatgatgaaacgccatctctactaaaaatacacaaattagccaggcacggtggcacacgcctgtaatcctagctactcgggaggctgaggtaagaggacagcttgagcctgggaagcagaggttgcagtgagccaagatcgcgccattgcactccagcctgggtgacagagtgagaccctgtttcaaagagatagacaagagggaagatgatgtcaggacacagggaaggaggatgccacctacaagccaaagataccagaagccaggatggaagcaaggaagggattctccctcacagcccttagaaggaaccaacctctgcagacacctcaattttgtactttttttttttttttggtgacggggtctcgctctattgcccaggctggagtgcactggtgcgatcttggctcactgcaacctccacctcctgggttcaagcgattctcctgcctcagcctcccgagtagctgggattacaggcatgcaccgccaggccctgctaattttttgtatttttaatagagacagggtttcaccatgttggccaggctggttttgaactcctgaactcaagtgatccgcccgcctcggcatcccaaagtgttaggattacaggcgtgagctaccgcgcccagccagggaagagcactttaatgaatttaatttccttgggaatccccaaatttaattgtgcccttatcagtaatgttcattttgttaatgtaaaagaaatatatacaccctgcagaaaatatagaaattagaggaactatgaagagtaaaaggccaggcgaggtggctcacacgtgcaatcccagaactttgggaggccaaggcaggcagatcatctgaggtcaggagttcaagaccagcctggccaacatggcaaaaccctgtctctactaaaaatacaaaaattagctaggtgtggtggcacacgcctataagcgcagttactcgggaagctgaagtaggagaatcgcttgaacccagggctcataggttgtagtgagctgggatcacaccactgtactccagcctgggctacagagtgagacttcatctcaaaaagaaataaaataaaataaaataaaataagagagtaaaatttaatgacagtaaatcaatcatgtagcgagaactattgtgaatattctggagtatttccttcttgtcttttcttctatgagcacacacacacacacacatacacacacataaattcatatactcagcaccctctgcagtgtctgaaacatctgtgtgctcaataaagttcaaagaataaatgaatgaagaaaattttatttttacacatagtcaaacttacgtacagtaggaaattcatttttaaaaatcttactcaacacattatgtgtatttttctatgtattatatagatttttaaggcattttttatgaaagcataagtgctatagaataatgctgacctaaacgaacatctagtacataaccctacatttgtatctctgaagattcccttagcctaaattctttttttttttttttttttttttttggtgagatggagatttactcttgttgcctaggctggagtgcaatggcacgatctcggctcacagcaacctcctcctcccaggttcaagtgattctcctgtctcagcctcccgagtagctgggattacaggcatatgctaccatgcccggctaattttgtatttttagtagagatgggatttcaccgtgttgcccaggctgatctcgaactcctgacctcaggtgatccgcccgcctctgcctcccaaagtgctgggattacaggcatgagccactgcgcccggccaacccttaggctaaattcttagccatgaaattaataggcgaaaaagaataaactatttaaggtccttggtgtcattcagcgttcacaaacgtcccgaattgaagtgatacttcacatgaaaacccaagcaagcctttgcaagctccctggcagcccataggcacagattctccatctgtggggtgatcctcttatatagactgtagctccattatcccctcagaccagggataaccctccttctccagcatctttaggtcatccctggaatgacctgagctggattaagctccagctcagctgccctggtcctccacaaaggctcaaaggagagatcgaacttttggtgttacattccatttatttatttatttatttatttatcaatcaatttatttttctttttgagatgaagtcttgctctgttgcccaggctggagtacaatagcgtgatctcagctcactgcaacctccgcctcccgggttcaaccgattgtcctgcctcagcctcccgagtagctaggactacaggcgctcaccaccacgcccaactaatctttgtatttttagtagaaatgaggtttcatcatgttggccaggctggtcttgaactcctgaccagtgatccacctgatcaggtgatccacctgcctcagcctcccaaagtgttaggattataggcataagccactgtgcccggccttgcattccatttaattctcacttcagcatgtctttaatatctttctactttctctagccctatctattccaaagaaattctgtgtcacgagctatttctttttttattagtttttttttcatattgtgtgcagtgtgagatggaatgtaagtgggtggctttgtccttccttgaaacataacttgtgccaaaaataacatcatttgaattgtgtgtctttggtaacaacatgacatatgccaccgcaagtacattcatccaatatgtgcatgttacagggctatgcactgcgaagtcttgtttgcttgttttttgagatgggagtttcactctgtcgcccaggctggagtacagtgtcgcgatctcggctcactgcaacctccacctcccgggttcacgccattctcctgcctcagcctccttagtagctgggactacaggcatccgccaccatgcctggctaatttttgtgtttttagtagagacagggtttcaccatattaaccaggctggtctcaaactcctgaccttgtggtctgcctgcctcggcctcccaaagtgctgggattacaggcatgagccaccgtgcccagcttgtttgttttttaataactaaaactctgcctttcagaattcagattcaccatataacatcttcacccaaatgttactcccctggaagcctttcctgaccatcttttttccatttgcaacgccctttcctcctatgcttaattcttttcatagcagttatcaccacctcatctactatatattttactcatttgtcttgctaactatttttctcacccactagaagcataaccatgacagagccattcattcattcattcactgtgtatgtagtgaacacctacaggtgcccaggaatgtgttaagcatgagagtacggctgctttccagcagcttacaattagaaataccaaacagctaaacaaagatcagagtgtaatcttttttttttttttttttttttttgacacagggtcttgttctgttgcccaggctggaatgcagtggcacaatctcggctcactgcagcttcaacctttcaagctcaagtgatcctcccacctcagcctcccaaatagatgggaccacagggatgcgtcactacacccggctaattgtttatttttagtagagaggaagtctcactatgttgcccaggatggtcttgaactcctgggctcaagggatccgcccaccttggcctcccaaagtgctgggattacaggtgtgagccactgcgcctggcctcagagtgtaatctttcaacactaaaataagtggggcaggacaagttaggtttccagaggaagagaagagctcagactgtctcaaatgagggtcaagctataggaagtaggtgagagttaaaggcaggtcagaacttgatggaggaatttgaggtagaaacatttggctcatcccataagcagggcagatttgtgagcaggagaatggcatgataaaaatgatttatttagattaagccacagtggctcacacctgtaatcccagcgctttggaaggccgaggcaagcagatcaatggaggccaggagtttgagaccagcctggccaacatgatgaaaacccatctctactaaaaatacacaaattagccgggtgtggtggcacgctcctgcaatcccagctacttagtaggttgaggcaggagaatcgcttgaacccgggaggtggaggttgcagtgagctgaaattgcaccactgcactctagcctgggcaacagagcaaaactctgtctcaaaaaaaaaacaaacaaacaaacaaaaaagagaatgggtgaaactctagttcgagagtcaatttggccctgggatggggagacactaaaggaaggtgataaataagaatggacaaagagggtggaagctagcactcagtcaaaacacattcacctcaaagcaggcaattctcaaaataagatgtttaagatcatcaaccattaaagagggcctcgttagtgggttacaggagactgagttttgctgcctgaattgggagagagggagtgagagatacaaaaaagcagagggtaaagtcagctcggttattctatgctaagttaaacccatttaaagagcccagatgaagaggaaaaaaaaaaaatgagaggaggggaaaaaatgagaatcgctattttagacaaatcccatatgggttatactcttaatttacttaagccagatggctaggctggggaccgactaatttattaccatcctgccattcagagccagagccttccttaggttcctaagcaactctgagggggaaatgtcagattgcatgaaatttcctgattaggtcacatgacccaagcacagcccactgaaatgattcgaatcctccaaatcgcatattccagatcacagctgtcagctcggccctctcctgcttatggcagatgcacgggccttcccctctttgcaggcagtatggtggcagttctaggaataagaaacaccaaaataaaggctgggggaggactgacaaaaaaaaactttagaatttggcatttcagattctccctttgtaccatgtacatcccaaaattttctataaaagaaggaaagtagcaaagtatttttaaaaggagcatttaaactactgtggcaattaagcagcaatctctgagtcagcaaatcccatccagcaaactgagtaacatttgagataacatgagaggattaaaaaagtagggacactagccgggtgcagcggctgaggctggtaatctcaccactttgagaggctgaggaaggaggattgcttgagcccaggagtttgagaccagcctgggcaatatggcaaaaccctatctctacaaaaaatacaaaaaattagctaggcattgtggtgtgcacctgtagtcctagctactcaggaggctgaggtagaaggatcatttgagcccaggacgttgaggctgcagtgagccaagatcacaccactgcactccagcctggccaacatagtgatacaccatctctactaaaactacaaaaattagctgggtgtggtggcagccgcctgtaatcccagctactcaggaggctgaggcaggaaaaccggttgaacccgggaggcagacgttgcagtgagccaagatcgtgccattgctctccagcctgggcagcaagagcaaaacatcttctcaacaaaaaattaaattaaaaaattgggaaaaaataagcagctaggctggtttatgatctgaagaggaaagcataatgatataacaaaagcaacaatgaacatgttttaagatggagtcattatgtaacaagccatgtagaaactattgttacccgcattttgtattatggatgagaaaactgaggatttctaaaagacttaagttaggtctcaccgctagtaagtaccactgttaggggccaattctattcattcgtcagagaataagaaaatgattggccagaaaggtgaagggcaggccgggcatggtggctcacacctgtaatcctagcactttgggaggctgaggttggtagatcacctgaggtcaggagttcaagaccagcctgatcaacatgatgaaaccccgtctctactaaaaatacaaaaattagccggacgtggtggtgggcacctgtaatcccagctactcaggaggctgaagcagaagaatcgcttgggcccgggaggcgaaggttgcagtgagtcaagatcacgccactgcactccagcctgggcaactctgtctcaaaaaaaaaaaaaaaaaaaaaaaaagcgaagggcagcaggctgcaaatgccaaaatgagagcataactagtggttcctggggcctgtctatgagcagaggtggctagaaagctaacagaacagtgactgccaaatgcggaatggagcatgtgccaaattcaacggggattgaatcctggaacagaaaaaggatattagtgaaatctgaataaagtctggggtttagttaatagtagtgtaccaatgttggcttcttggttgtgacaaatgtaccattgtcatgtgagatgtgggtaagggacacaggggaactctctgtactctcctgcaacttttctgtaaatctaaaattattctaaaattaaaagttttaaataaatttaaatgaaattaaaagtttatttttaaattatttaagagaagagagtattggtgacatgtttacaaatattcttcagaagagtaacattttaaatggcaatggcgagggtaacgctgcatttttgtagccagtcatatttcttggcagacaagatgactaatgacaatcacaaggactaacattactgaatgcctataatatttcagcttccgccctaaggatgttacatgcatgcccatagcatcttcaagattattttcccaatttacagatgagaaaagttcttagaatagtgcctggaatctggcaggtgctcaaaaattagatcttttttgtttttttaacagaggctaagaaatgtacccagcttttgaacaagagtcacaattcaagtccaaactctaaaaggtttttttttttccttgtgatggagtctcacctgtcacacaggctggagtgcaatgacatgatctcagctccctgcaacctctgcctcctgggttcaagcgattctccagcctcagcctcctgagtagctggaactacaggcgcccaccaccacgcccagctagcttttacatttatattttttagtagagatggggtttcaccaggttggccaggctggtctcaatctcctgacctcaagtgatccgcccacctcgtcctcccaaagtcctgggattacaagtgtgagccaccgcgcccagtcccttcaaggcttttaaatctcagccttgccacttactaactctatgaccttgggcaagtttcaaagccaaaacaaagctaactgatatcacagaatggattttaaaagtatgttgaaagttgcatagtatcaacctaaatttctaaacagacaaattatttatagaatatttcaaaattgtcaaattgaataactggaaaataatcaggctgtatcgttctgcattgaaatcaataaaaatagggctcaaaataacagttctgaagaatccttgggcacacctctggatgtaagaaccaaacaagagacaactaaggaaattgttaactcctggtaactaccagagcctcaaggaaaaacgtgttttcagctctcctctggggtcaaatgactatagctcactgggccagacaggatccatgatgagattttctcaagaggggaaggtggtaagggcaaattataaagatacaccttctggctgggtgcagtggctcacacctgtaatcccaacactttgggaggccaagggaggcagatcacttgaggtcaggagttcaaaaccagcctggccaacatggtgaaaccccatctctactaaacaatatataaatataaaaattagccaggcatggtggcatacgcctgtgatcccagctactcaggaggctgaggcgggagaatctcttgaacccgggaggcagaggttgcagtgagccgagatcatgccactgcactccagcctgcgcaacagaacatgactttgcctcaaaaagtaaaataaaataaagataggccttctgatgactgacgctcagtcatctcactgacgctcagtcatctctactaaaaaataaaaaataaaaaatctctcgtagttcatgagcatgatgattgtgttcacacgcatgtgtgaaacgtaccaccacaaatcttattacaacgttggtacattacctgcctggcatgaaaaaaaaaaaaaaagagtgagagagaaatccctgagtcacacctctgttcacacatctgttcattttaaactagatcttggcctcaactgttacagcaaaagggaggtcacagcagaaaaactaaagttttttttggcttccaggtaggcagaaatccagattcaaccaatataaagactattgagggagggtttcaagaactaacttcagaggcctaccacatcattaaccgtacccatccctgccaacctaggtacaaagatgggggtgctgaaatccaattcataccttgctgatacaaagctgcttagagcctgagaaggctgaagccctcttccaatacatctgcccagacctccagccattctaattaacataaaagcaagaaacatgcctcacccttccccatccccataccccactaaaatgtgacacccttgcacatcttgatccaaaatagattgcccaaacaataacaaaaccctaagcctagagtcacatatttattttttttaacaaatacttgttcagcccctgccaagaccagcttggtcggggagaccctaacccagcagcactagaggaattaaagacacatacacagaaatatagaggtgtaaagtgggaaatcaggggtctcacagccttcagagctgagagccccgaacagagatttacccacatatttattaacagcaaaccagtcattagcattgtttctatagatattcgattaactaaaagtatcccttatgggaaatgggattaactataagtatcccttatgggaaacgaagggacaggcctaattaaaggaataggttgggctagttaactgcagcaggagcatgtccttaaggcacagatcgcttgtgctattgtctgtggcttaagaatgcctttaagcagttttccgccctgggcgggccaggtattccttgccctcattctggtaaacccacaaccttccagcgcgggcattatggccatcatgaacatgtcacagtgctgcagagattttgtttatggccagttttggggccagtttatggccagattttggggggcttgtccccaacaagcccctactctgtgccctggcccattttcttctccctggatccctgggctgcctttaatctccctattccacccttgcttgccctgcaggtctccagttcataatctatttactgttccttctccagggccccaccttctggtgtgcagatccgccatcccttttctccagcatggattattgttctatactcctctctgccctaggctttacctctttcctcctggcttaatttcatcacccttaatctcttcactgttcagcccttcttgcagctctttcccagtctcctgccactaatgtctgatctcaaccaaccacacaacagcccctgaatacagcaaatggggctgaaagaacgtaattcatttgcctgtgctaatcccacaagcaagtggtcccattcaacaaattctgtaaatcagtaatggtaacaataatagctggcacttgaaattgagctgatggacaggttgcagttattagtaatgaagtctaaggattgactttgggtgtgagtggcatgaggcatggaagggtgcaaggccatttgaagaggggaagcctaagaacactaagactagataccatattgaaaaaaatcatctgtagggataaaacaatcatcaaggatgacagaaaccacgtgggtgagaggaagcttgaaggaatgagggcgtgtgtgggaaggaggaggcgttagaggacagcaacacggtggggtagagtttgatgatgtgacagtcggaggtggtagtgggagctacagagtgggagggaaaatggcctggacgcaggaacgagaacactcaccccatttgcaggcctgtggtctgaggagtgtgggagagaaaacggccatccacagcaaggggagcaatgtgctcaagagaaccaggtctagcaagcaggcaaagagagcattcagataagtgaggaagtgaggtttttgaaagaatacagctgaggtccctgtggaagagttgcagaagttggggagtgggccggtgcagtggctgacgcctgtaatgccagcactttgggaggccgaggaaggtggatcaaatgaggtcaggagttcgagaccagcctggccaacatagtgaaaccacgcctctactaaaaatgcaaaaattggacaggtgtggtggtgcgcacctgtagtcccagctactcgggagactgaagcaggagaatcatttgaacgtgggaggtggaggttgcagtgagctgagatcatgccactgcactctagcatgggtgagagagcaagactttgtctcaaaaaaataaaaattaaaaaagttttttttaaaaagaagttggagaagggtaagacatgggatcagaaaaggggatatccaaggccatgtggatatcagagtctaaaggatgagcgatgacctgggagactgggctgacataaacagggaggaacaggaatgacatgaggggattagtcccaggatcccagagcagattgcagtggcacagctgtgagtgcggggggcaggatagtaagggttgtcaggaacatgaggagttcttgcccactgcaaattaataatctgttgggggagccccatatacatgacagaaccatacatcccagatgcctttgaaaattgcagatatggaaacctacaggagagcgacccaaatccaacagggagggtcataaaaaacttcgagggagagagagagaataacggaattccataaaatgattgcaaccactagaaaaaaaaattttttttttttgagatggagtctcactctgtctcccaggctggagtgcagtggcatgatcttggctcactgcaacctccacctcccggtttcaagcgattctcctgcttcagcctcccaagtagctgggactgcaggcatgtgccactaaacctggctaattttttttgtatttgtagtagagacagggtttcaccatattggccaggctgctcttggactcctgacctcgtgatccaccggcctcggcctcccaaagtgctgagatttcaggcgtgagccaccacgcccagctggaaaataattgagatgcttctcctatggcaatgagtctttgtataaatgaaccataagttgaaaaaagttgtataatattttatattcacattatttgaatagtctttggtcttgccagagtgaaatgtattgcatttggctagagaactttgcaagatttacacagcacaaggtgagtatattacctttaatgtaagttgtaaaattctaaatagatgtaggttagagattttctaagattctaattctttccctatccctttattacctgaaatctctgaaattacctccagtatttggggtgatggctagagatagaaaattaaattgatggaaccttccctgactcccttatctaaattagctaaactacctttatgtcaaaatgtgttgattgcctgaatgtatctcatataatcctcataacaaccagcaaggtaataatttctattttataaacaagaaatctaatgttcagagagccaagataagttgctcccacagctaatgaacagctgaagagggactcatgattgtctgctaactgccctttcctgtagaccataatgcaatcacattttcagcgttgttaaaatgcaaaaaaaaaaaaaaaaaaaaaaaaagctattgtgttgtccacgctagatggtaattcgcttacctcttctagtagtttcaagggcgaatactagttgattagaccttgaagccttttatacggtcattgataacataaaacaaattaaaatagaatatggaagaatccccctagggaattcttaagattacaagctagttttccaagaagaaattggcttgtgtttagtagaagcaatagattagagacagactgatagacttggacagccagacagtccaaatgggaccactcattatatcataaccagacaggtagtgttgaaagcgggctcaatctacagagcatcctcatttcatttcattttattttgaggcagagtctcactctgtcacccagactggaatgcagtggtgcagtcatggctcactgcagcctcaacctcctgggctcaagcgatcctcccaccacagcctcccaagtagctggccctcatttttaaaaacagacaaaaaaggcatctgtcaacccacatagatggactactattcaaatgtagagcatttactcatcttaaatctgtggctggttgcagtggctcacacctgtaatcccagcacatagggaggctgtggcaggaagatcgcccaggagttcaagaccaacctgagcaacaaagtgagacaccaactctatagaacataaaaaaatcagccaggcatggtagtacactcctgcagtcccagctactcaggaggctgaggtgggaggattgctttggcccatgaagtcgaggctgcagtgagtggtgattataccactgcacttctagggcaacactttctcaaaaagtgagaccctggccaggcgcggtggctcacgcctgtaatcccagcactttgggagaccgaggtgggcggatcacgaggtcgggagattgagaccatcctggctaacatggtgaaaccccgtctctactaaaaatacagaaaaattagccgggcatggtggcgggcatctgtagtcccagctactggggaggctgaggcaggagaatggcgtgaaccgggaggcagagcttgcagtgagccgaatcgtgccactgcactccagcctgggcgacagagtaagactccatctcaaaaaaaaaaaaaaaaaaaaaagtgagaccctttctcaaaaaaaagagaaaaaaggaaaagaaaagaaaaagaaatggatttagattcaggatcagaatcctgggtttaccattattagctgtgcaaccttgggttacttaaccttgggttcctcattaccttacctataaattgggtataatattggcactcacctcacaggggtgctgtaagaattaaatggattaatgtttgtaaagttcttagcataggcctggctcatagtaaacctttcataaatgttcactattataattatccctggttcttagacttttttttttcttttttcttgagacaggctcttgctatgttgcccaggctggtcttaaatgcctgggctcaagcaatactcctgcctctcggcctcccaatgtgctgggattacaggtttgagccacctcacctagctggttcttagactttcaaacttccaaaatcagtgtttaaaagaagaattaggagatcaatatgggtttgtcttctttgcttttttgttttttttagcttttcccaaatcaaaacagtttttaaaagccagtattttctataataaccaatatttcatagaaaaaaataatattttaataacacaaaatttaggcagaagataatgtcaaaataaatgacttctattattacatttagctttgagagaaacttaaaattttttgttttagagacggggtctcattctgtcatccagggtggagtgcagtggtacaatcctagctcactgcagccttgaactccagggctcaagcgatcccctagcgtcagcctcccacgtcgcagggactagaggccgtgccactacacgtggtaatgagagacattttttatgttatacatatttttctcagttctccttggaatagtaagcatattttttgttcactgtatttgaggacgacttagtcatattttccaacacccttacatgtatagtttttactaattagtagttaaatgtttttaacttttaaaaaactaatcatagactatagacagtagtgtttgtaaactgtgaatgaaagaccaggatcataaggtcagttactggctttgcacattgcaaatagacaaaaaaagaaatatttttctgtaagacactggaaaaaaataaaagtggagttaaaacctattctttggacaagaaacttggcattcctacttttactgtgatagaggagtccctaaaaacagttgaagtgaagatgaaattcccaagcacccatgtgccaactcatttgtggaagagcaaagaatctaattaactcgaagcaagacctgaaaggggacagaatgctcaggaaaaccacatgaactgtccaaactattgattgagcaatttgcaatcatttctagtttaaaaacaaatagtttgggtaaatgaatgaatattcctattgcattattgctattgcattacttcttgcaaagttttccaaggaatttcctagttgtcaggcatatatatatacacatgcccagccttttttttttgttgggggagggggttcctagccactagaccatcagggaggaatcttaagaattattattttagaagactagcagtcacttttctttcttttactagttatacatctagcaaggccatattagttacaagcacacataaagttatataccaggatcttggaatattcattttaccaaaaaaagtcagtaaagtcagttgtgctgctacagttttcgtattttccacagattccaatgagccaacacaagttctactaataaaatccacacaaaataaaatgcagtcagtggaaacactatatgtacattgtagtcatttatactaagactgttgaatacaatactccagagtaaaatgatctcaataacagctatgaggcttctttttttttttaagagatggagtttccctacgtttcctaagttggacttgaactcctggactcaagagatctgcctgacatggcctcccaaaatgctgggattacaggcatgagccattgtgctgggcctgtgaggctatttttaaagtctgaatcttaatgtctaggttggatgatattaaatccccatttactcattcattagctcttctgagagagatttttctctcttagaaccagttttcttttttctttttttgagacggagtctcactctgtcgcccaggctggagtgcagtggcgcgatcttggctcactgcaacctctacctcctgggttcaagcaattctctgcctcagcctcatgagtagctgagattactggcacccaccaccatgcctggctaatttttgtatttttagtaaagacagggtttcatcatattggccaggctggtctcaaactcctgacctcaagtgatctgcctgcctcggcctcccaaagtgctgggattacaggtgtaaaccaccgtgcccggactgattctatatattcctgattgtgttgttgataacaacaataatagcagctactacatattgggtatttcctatgtttcaggcaattatttcagtgctttatgttaattttttacaataaccctacaaaatagacagtgtttgcaaatctccactttacaaatgagcaaacagaaactgaaaggttaaataactagctaaaggccacacagtaagtagtgaagctgggtttcagaccctgaactgtctataactcctgaacctgaattctaccctacggcctacatgcttatggaatctctaaatggctctatggacattcgaaagaagaactcatcaaagtgctctctcctttttactaacttctattataataaacatattactaacatttactagaacaattataaatttttaaatcttaagagttttaggtctcaaagggacctttgaggtatttaatcaatgcccacaattctacaaataaggaactgagctatctcaagttcaactgagctacaactaaaacaccaacgattctcttaaaaatgttagacaatggctgggtgcggtggctcatgcttgtaatcccagcactttgggaggccgaggcaggcggatcatgaggtcaggagatcgagactatcctggctaacacggtgaaaccccatctctactaaaaatacaaaaaattagccaggcgtggtggcgggtgcctgtagtcccagctagttgggaggctgaggcaggagaatggggtgaacccgggaggcagagcttgcagtgagccgagatggtgccactgcactccagcctgggcgacagagattccatcttaaaaaaaaaaaaaaaaagttacacaatatagacctcattgtatgtatacatgttgttgatgataactacagtttgaaattaaatgaccatgtactaggaagatggtatcagcctagccaaggatttgacacaaaagactggaatgttttcaaaccttacttagtaactttgttgctggactacaaggccaaaagcaagtggctgcttggacactggctattcagctctcctttaatctttcttaaaatatcaaagatatgtttattttaaagatgtcttcagtggatgcatttttatttaaaaacctggtcatccaaaactgaatttacttttcccctaaagcaaaagcaaaacctttctagaagtaattgaaaataaaagcattgcctaaaaaacaaacactattcaaaaatcaagattatacaataaggccattggctaaaaataacagagacagaaagttcagcttgtggttttttacattgtttattttttatcctcctatccttaataggatcagtttttttccatgaacagtttattgatcatttggtaagtttgttttttttaaataaaagaccattttttccactgtaaaatgagaaaataaaattttcctcagaagaaaaaatgtacaacttcattaataacctgagtgataacagattaaaatgagataccatgttataaacaatgaaattgactgagatcaaagactccccccaccccaccccaattcgcaatgttggtcatggtgtgagaaaacaagcttatatggtgttttgataatattaagaaataaactaaggcagtctttctagaggtcatttagcaaaatcccttaaaaagtgcatttttggctgggtgcagtggctcacacctgtaatcccagcactttgggaggctgaggtggatagatcacctgaggtcaggagttcgagaccagcctggccaacaaggtgaaaccctgtctctactgaaaatacaaaaattagccttagccaggtgtggtggcacgtgcctctaatctcagctactccggaggccgaggcaggagaatcgcttgaacccaggaaatggaggttgcaatgagccgagatcactgcactccagcctgggtgacagagtgaaattccatctcaaaggaaaaaaaaaagtgcattttttggacatagcaatttcacttctacgaatgtaaactacaaaaacaattaagctttatgtgcaaaggcttacctataatgatattaataacagggttatttgtaataagatggaaggaaggaaggttagagggggagggagagaataaaggaaatcagaatttccatcaataggaattggttaaataaacaaatgtggtacagtgcatgcatcaaaagcagtattatttttccattgaaagtgatgctgtggataaatattattgaaatgggaactgttcacataggttactagatttaaaaaacagattacaaaactctatgtaactgtatgtttctatttatatgaaggtcaagatcaggcaaagccaatctgcagtgatagaaatctaaacaatggtgcagggaaactgggtagagcagaggctgatttggaaagaagtaaaggaactttctggagtgatggaaatgctctaagatgatattcttgccatatggcttgtgggggggtgggaagcacagagtaggtggacatttgtcagaattcatcaaaatggtcagttagcatctatatatttcatttcatgtgagtgatacctcaattttaataagaaacaaaatcctcaaatgtacaacatgatcttaagtttataataaaaacaacggtttctatttgtacagacagaaaaggatttggagactgtcttagtccattctgtgctactataacagaatatcacagactgggtaatttacaataaacagaaatgtattggctcacagttctgccagtatctggcaaagacctttttgctgcatcataacacagcaaaaggcatcacatggcagaaaagtgatagagaacgggtgtggggagagagagggagaatgagcaagacagcaagaggagaccaaactcatccttttataagggacccactcatgcaataatgtaataatggctttaatctgtttgtgatggatccacccccatgactaaattcctccattaggccccatcaccatcaagtttctaacccgtggactttggggaacacatttaaactatagcagaaaggatttagaggtagtgggattatgggcatttttaaactcttttttttccccacttgtctcaacaaatgttgtaataatttaatcataacaattaaacacaaaatgcaaatgtatccaaatgtgtttcagtgagcctctcttgctcttaatctgaatatttcctaacaccgcattaaagggtactgtgaagattacccagtgcatcaccgacttgcttgaaattccttggaaggataccaatggcgtcccaccccttgtggaggtctttcaccataggcacttccggccatttgttttactctttcaaacagctcaaaatgccaaaattaaatcaagaattttatcatttggaggcatgcttgaagtagattttatttctggtgcccaaacccctctcaggtccagagtaaaaagcttcaaattcctgaaggtaatgcaaatactttatgggctgagaagtagctgtttctttgcatgtgtcctgccaagcttctaagaatggttttgccattagttccaaacccacaagcagcctggtctgagctccaccacctccagcaggcttattacagataagtcagctggtcttcatgtgacagagaagccttctgtgccaggtgtgctcacagccaagactgggtgtctgccacctcatgctgatggcagctcatgttcacatgcagcccacagatctcagcacaggctgctgggtggttaacgatgcaggcacaattacctcctgacaataatagtgcaaacaactatgggcagttggttgaaggatgggagagaggaggaatagtaaaaagcagatgaaacgtcattacacttctctaaactcctgcaggatgcagcccagcatcgtggctcacatctgttataccagcactttggggggccaaggtgggcggatcacttgaggtcagaagtttgagaccagcctgggcaacatggcaaaaccccatctctactaaaaatacaaaaattagccagtcatggtggcgtgggcctgtaatcccagctactcgggaggctgaggtggaagaatagtttgaacccgggaggcagaggttgcagtgagccaagatcgtgccactgcactccagcctaggtgacagagcgagacttcatctcaaaataataataataataataataataataataataataataataaactcctgcaggatggatacaaattgagaactgaagtaggtgggaataagtgagaactgaaatctagttttcccttgggatatagccaaagaaactaatggatgaacagtgccaaaagaaactcacctccaacaacctggcctggatctggtgcagagaggaagacatatgtccacggatctgtatctctagtctactggatagctagacaaaaacgtcccacagggccatcacaattacctggtctaacatccctgaactgaactcaacatcccttccttgcctccaacctgctatgtcttttgcaaagacgtataacaaccagtgtataacacaggctgctgggtgtataataaccagtgacccctttacaagagcgagaacttagaagccctttagacctcctccttcttcatcttccacatatgattagttccagttcctagttaggacactatcatcctaatatctttctgactagcccttccttcttgttgtgctgccaactgtcacaaaatctaatttccacctcactgcctgaatgatctgtctacactgcaaatctgatcatgcctctggcctatgccagtctttccacagttctccattatctacctagcatattcttgagaagatctcaaatgccttcactaccaggcactcaaatgtgtgaagccatggggtttaatatggccaagaaggaagttgtatggacctggagaagatctgtcctacctgaagttattcaaatcaaaaattattttaaaacagctgcactggcctgggaaaactttctgaggtcactttgatactcttggtctacaatagagtcaaattccttagcctgtgatgtagctgaagcctgcttctctagcttgtcttcacctattttcaattaagcagcctgcattttcctgaaggttctctttcacacagtgatgcctttgaacatgatcttttctgcttgggtccgtctccttctttccccatcttgcctagaaacttatgtcaagacctcatctgccagcctttgtggagccccgggaagagttataccctggacatgcatctgttattgttgttctttccaagcttgcaaatatttattttccttctctgcaagtagtacttagggggcctgtcttataatggcacaaattgtatgttacaaaataaacggcaaaggctagagacagttttcctccccaacattttaaataagattgagaaattattgtttacatcacaaaatgtcatttaaaaaaaattcagagtgtcctttaggagctaatagagattttatgaggacctccaaatgtgccctgtgtccctagctagccttcatcaataaacctgtattgaatgtgatagtacaacaatcctaggccagaaaaactgcttcaggccttgatcaggttcccaaaatattagaggtgatattaatcattatcataaaattttagttgttcagaaaaaaaaaagaaaaaagaaatggtcacatgctccagtgcatttttaaaaatcacttaaagaaataaaagagaactcaactccactcccacaactgggtcacaagctccattggctaaggtagttgagttcccagccacatgaaatagttctatttctcagaacttgtccaaaagacctctcctgcctgcagagatagaagtaaggaaaagagaatctttcctacgcctttaagtttgacctgcctcatttttttttcccctccctttctgtccattgatttaggccatcaaggaactgtagaagtagaataggaagtgggaaagggaagagatagtgaaggatgaaggggtgggccaatcgtggggggctttcaagggatctatgtctatagtggctgaggttaaatgaagttaaccacaaagctagagtcacctcaccacttcctactttgtagactaataggctgagctctggtttaacttaaacttgagtggtctggagtgaactcattcgttctacaccagttcctcacagaatattatatattttttatcattattattgagattttacgtgtttttattctttccttttttttttttttttttctgagacagggtcttgctcaggtgccgggactagagtgtagtggcgtgatcatggcacactgtagccctgacctcccagggtcaagcagtcctccagcctcagcctcccaagcagttgggactataagtgcacaccacaacacccagctaattttttttttttgaagagatggggttttgccatgttacccaggctggtttcgaactcctgagttcaaataatctgcctgccttggcctcccaaagtgctgggattactggcgcaagccaccacgcctgactgtttttattcttattaaccaatctgaaagcaatttacttaatgtctggctgaacacacacacacacagacgatattctaatacaaatgaacatgcacatgacatgattttgagaaatacaggaaagcataaggaaaaaaatctatagttaacccaaaaataaaaattattaactattttgtcaattctgctattaagatctttatatagttgggactgtattgtattcacaacttttttttttttttttttttttgagacagaatctcactcactctgtcactcaggctggagtgcagtggcacaaccaggctcactgcctcctgggttcaagggatcctcccacgtcagcctccagagtagctgggactacaggcatatgccaccatgcccacataatttttgtatgtttttttagagatgggttttgggtttggccacgttgctccaggtgatacaacctttaatacttagaaatctaactttgtaacaagctcttgccttgcttttagaaactatgtaagcattgttatttatagctacatagaactccttgaagtgtatatattgtaatttatataaccatttttcttttttcttttctttttttttttttttttgagacagagtcttgctctgtcgcccaggctggagtgcagtggcatgatcttggctcactgcaaggtccgcctcctgggttcatgccattctcctgcctcagcctcctgagtagctgggaccacaggcgcccgccaccatgcccggctaattttttatatttttagtagagacggggtttcaccatgttagccaggatggtctcaatctcctgaccttgtgatccgcctgcctcggcctcccaaagtgctgggattacaggcgtaagccaccatgcccggcctacttatatgaccatttttctactactaggcatttagtttttaactaaacatattttggaataataatatggatttcgaccttttaaaagctctcactaccagcaatgagaaaataagacctctttaaagaaggtataggcagcagtagtttaaaagtattttagtcattggtttccttcagccaagaaaaacaggtacaatatcactgaattatggacaaaagcaggaaataccctgaaattttcccaagaataatatatttcttaaacacatgctgatgtgaaggttggacttgttctaggaaggctttaggaaagaaaggagtcttgaataggagaataaatatacaagaggtggtataaagacatgatgttgggggtaagagaaaaaacatggcaaatgtcgtgaggtgaagaactcaggctcttaacgtggtgcctggcagagttcctctgccatcattgcctttgatggtgactggattctggtaagcttaccacaaatccttaaattctaggcagaacacttgcttaaacaaagaatttaaacaaccatttgctaacggtaatctcctgcctactctaagtgtcttttcaccaaatcgttcctctttttctatgctatttagactttgccagcattagagtgggcagccagatgttatttcacagaattcacacggctggaatcgctgctgtgagaattcttttaaagggatgtagaacttatagtcttcctaaagccccatgtccctgaacttttgtagcaatctggggaagatagaatgctgcattattatattacatttgattttcatttaaatcaattcttttcttagaaagttatctaaaaattttgattcattctacgttttgcccaatatgtttcccattatttatcacagtgtgtcttcacaacaccctgagagatgggtaggccagatgttgctacttccattttcttcaaagagaagaaaaccgatgaagagactgaaggcattgccaccagaacccaggtgtctcatctttttggcccagggtgtgttcctctgacacattaaactgtcaccgtggctttgacagatggcattggcagagagtccgtagagacatgggttgtgtctctgctattggatatctcagggaagttttatacttcagtttttcaaacctgccataaaccctgagtatttctttaagcacatatcaaagtagtctatcttaaagtacctccaagtttttaccagatttggattttttaatttttaatttatttcattttatctgacacagagtctcactctgtcacccaggctggagtgcagtggcaccatctcggctcactgcaaacttcgcctcctgggttcaagcaattcttctgcctcagcctcccaagtagctgggactacaggcgcgtgcctccacacccacgtaatttttgtatttttttttagtagatacggggtttcgccacgtcggccaggctggtctcaaaatcctgacctcaggtgatccacccgcctcagcctcccaaagtgctgggattagaggcgtcacccactgcgcttggcctttttttttttttttgagacagaatcttgctctgtcacccagtggcatgatgttggctcactgcagcctcctgggttcaagaaattctcctgcctcagtgccccaaatagctgggactacaggcatgcgccaccacgcccgactaattttttgtatttttagtagagacggtgtttcaccgtgttagccaggatggtctcaatctcctgacctcgtgatccaccctcctcggcctcccaaagtgctgggattacagacgtgagccaccgcacccaaccagaacaatgcttctttaaaaatgactaaaaatacaaagggctggatgtggtggctcatacctgtaatcccagcactttgggaggccaagacaggaggactgcttgagcccaggagtttgataccagcctgggcaacatgacaaaaccctgtttctacaaaaaatacaaaaattagccaggcatgatggtgtgggtctgtaatcccagttacttgggaggcttaggtgggaggatggatagagcccacgaggttgagactgcagtgagctgtgatcacactactgtactccagcctgggcaacagagtgagaccctatctcaaaaaatataaataaatgaataaataaataaaaatttaaaaaaattatatagataattttttcaagctgagccttatataaaatgcatttctgtatgtaggtctccctttgtaaataatatgacttttctataaacctataatataaaagactcttggagaacatacaacagaaaaaggacatgtccactctatatcatacttgaaagtattattgattttctttttaagatagaaaggaaaagtcatattaaaagctacttttggctgggcactgtggctcacgcctataatcccaacactttgggaggccgaggcgggcggatcatgaggtcaagagattgagaccatcctggccaatatggtgaaacgtcatctctactaaaaacacaaaaattagctgggcgtggtggcgcacacctgctactcgggaggctgaggcgggagaatcgcttgaacccaggagacagaggttgcagtgagccaagattgcgccattgcactccagcctggtgacaaagcgagacccggtttcaaaaaaaaaaaaaaaagctactttcacttgggatgtgtgtgtgcacacatgtgttattgttgtcgaagagcagtttccaagaaccctcaactagcctatgaacgtggctgcaagttgacacttgacaatactcagttcaagactatacctgatactgccgcactcccttatattatttcctgttttcccaaaagatagcaagtgtcttgaggttaataactgtctttatttctgttatgtccctcatagtgtttcccatcatatctgtgttgaaatgaacattcatgtgatgttccaggagacccagtcccactaacttatccagtctttgaaataaattgctcttattctctgaactgtaaaattgaatgttaatattactattttttggaatatcttgactctacaataatctacatttgtatgatatggttgcaagcattactatcatgtgaaaaagaatagtttttttgtgcttattccctaaaaattttgaagctttggatataattttatcaatatagtaagtctgtgtgcgcgcgctctctctctctctctctggctcactcccaccttctcttgccttccctcaccctccctccctttccttacctctctccctcacctctccctctctcctacctctcttcctttctccctctctccttcacctctccctctctcctacctctcttcctttctccctctctccttctctccctgtctttccctctccctctccttcctctctccctctcttcttctgtccccttctccttctccttctgccataaaatgaaaaataaaaaaagtagtgaataagagtaagtaaataatagaaaagcaagagcccatcaccccctgaatctcttgtagattgtttttaaggtatgaggaaacctcttaggtttctaggtttctcttaatttctcccattagaattcaactgaccagcattaacattaaaacagagatcttgagactgacaaaacagactcttctagtagaagataccaaatctcaacctgactgtatatactgactgtagtatagcatcacatgacaaatagcaaggccttaaagaaatccaagtattttaccccaaaatacatttctttgacatattttggaatggccctgcaaagctgtctcttgtggggaaaatctacattctgtagaaaatctcctttcctttccaaatcttttcttcatccaggagagattatctgtccccctaaaatgtataaaatcaagctgcaaccaaccaccttgggtacctgttctcaggacctcttgaggctgtcttaagccttagtcactcatatttggctcagaataaacctcttcaaatatgttacagtgtttgaatcttttcattgacaatttcaaaaggttcatgatctttcagaggccccttatttatttatttatttatttatttatttatttatttaatttttactgaaaaagcatctggccatgttgcccaggctggtctcaaacttctgggttcaagtgatcctcccccatcagcttcccaaagtgctggcattacaggtgtgagccactgtgcccagactaaaactattttttaacatcatttattaatgaatttatttttgagacagggtcacactctgtcacccaggctggagtgcagtggcacaattacagctcactgcagcctcgacttcccaggctcaagagatcctcctgcctcagcctcccaattagctgagactataggcacatgacaccatgtcaagctaattttttgtatttttttgtagagatggggtttcaccatgttgtcccacctggtcttgaattcctgggctcaaacaatacactccacctgcctggcctcccaagtgttggagttacaggggtgagccactgtgcccagccctcagagaccccttttgagggatttctgctggtagtaacctacagcattttttatttttattttattttattttattttttgagaccaagtcttgctctgtcacccaggctggggtgcagtggtatgatcttggatcttggcttactgcaacctccacttctcgagttcaagcaattctcattcctcagcctcccgagcagctgggactacagttgtctgccaccacacctgactaatttttgtatttttagtagagaaggtgtttcaccatgttggtcagactggtctcgaattcctgacctcaagtgatccgcccacctcggcttcccaaagtgctggaattacaggcgtgagccactgtgcctggtgatagtattttttaaaactacaaaaaaacaatgtacatatgtttcagaaaatcctcaaattgtgtttttcttctgctctgacacaacagtcataaatacagaagacttctgtgaccaaatattggggcttctcctcaccaccaattctgcagtagataccagctgggtgtcctcgaattcaattctggggttatctacccagagatactgtgagatcccacagttgagggctcagcccctaaggctggaccccatcccccaccagtcacaaggtcaggcctctggaacttctgactgaccagcttcaagttggggtttccatgaccctctctttgggttcgattaatttgctgggggcagatcacagaattcagggaaacacttacgtttactggtttattatgaaggatattagaaaggatacagacaaagagatgccgggagcagtgcccagggaaggagcacagagcttccgcgccctctctgggtacaccaccctctaagaacctccctgtgttcagctatctggaagctctctgaacccagtgtgtttacggaatcttcatagtgttagcattccttcccccagggtatggggcggaaccctctctggaatgagggtcttaggaatcacaatcggaaaggtggagaaagattacagtcctaccttggagcaggtgaaaggagggagaagttcaaagagtttctgtttcctgaggttggccaggcccaacatagcaacaaaatgactgtaacataatctaggatttttttttatacctgccagtgaagatgttcctttcagttttggggggtttttgttgttgttgttcttgttgttgttgtttgtttgtttttttgagacggagtctccctctgtcacccaggctggagtgcagtggcacgatctcggctcactgcaacctccacctcctgggttcaggcaattctcctgcctcagcctcccgagtagctgggattacaggcgcccgccaccaggcccagctaatttttgtatttttagtagagatgggtttcaccgtgttggccaggttgatctggaactcctgacctcaggtgatccacccgcctctgcctcccagagtgctgggattacaggcgtgaaccactgcgcgtggctgtcctttcagcttttagatagaagggagaaagaggtcaactcagatatccagaaccaaactaatgaagttatattgttcttttctatttctgatcaaatacgtttctaaacagccattccaggctctaatataacaagtataacacaacttgtattctagcagtgtggggattcatgtccatgtctacaaaacattcttcctctccccaattttcctaatggcttacaacttaatattttaaacacttatagaaaatttcaaaaaatgcaaaaaaataaaaaataaaaataatgcaaccatatctcaactatgacaataatcaactaatggccaatctagcttccttcacactcctactcattttccttgcccccaacaacctagatttttctccatcatagtactgcagctgcaaatatttttgtacatatgcttaaaagataaggactccttttttgaacatcatcacactgccccaaaagcaacaatagatgcttaatatcatcacatattcagtgttcacattccctaattgtccttataaatgtcctcttaaaaatctttgcttgcctattgggaaaaattagtcatattaaaaaattgtttgaaagtttgttgtttggggctgggtgtggtggctcacacctgtaatcccagcactttgggaggctgaggcaggagaatcacttgaacctgggaggcagaggttgcggtgagccgagatcatgccattgcactccagcctgggtaacacagtgagactctgtctcaaaaaaaaaaaggtgtgtttgaatctgcatcaaaacaaggtcccaggtgggcatagtggctcacacctgtaatcccagaactttgggaggctgaggcaggaggaccactagagcccaggagtttgagaccagcttgggcaacatggcgaaaccccatctctaccaaaaatacaaaaattagccaggcatgctggtgcatgcctgtagtcccagctacctggaggctgagatggaaggatcgcttgagcctgggaggcaaaggttgcagtgaggcatgatcaagactattgctccatccagcctgggcaacagagtgagaccctgtctcaaaaacaaacacacaagggcagggtgtagtggctcacgcttgtaatctcaacactttgggaggccgaggtgggtggatcacctgaggtcaggagttcgagaccagcctggccaacatggtgaaacccccatctctactaaaaaaaataaaaaataaattagccaggcatggtggtgggcacctgtaatcccagctactcaggaggctgaggcaggagaatcgcttgaacccaggagctggaggttgcagagagctgagatcgcaccattgcactccagcctgggcaacaagagtgaaactccgtctcagacaaacaaacaaacaaacaaacctccaaaaaaccaatgtcaatttattgtgataattaacatgtctcttatgggcaacattgtccttttttagcctttgccctcaaataaaaaaattgttatgtagcaaaaacaaccatttccagatgatgcaagagttcaaaatgctggcctgaagaagtctatgaaaatgtcaagtcatgcctttgcgaggagataactacttggcatatacctttccctgaatgataaagaaggaaagaaaaaatgtacttccagtaaacatattcattagccacagagagctgcatataaacatgatgcttggaaaacaaatgctctgcagtaaatgggaattgagaaaataggtaataagttgcaaatctgaaaatcatttctttatttcaatgtaaggtaagtttataaacagtcagaccaaaaggtctgcttttaaagttttgcaaatgctggtcagattgattagtccttttttgaatttttttttttttttttgagacggagtctcgctctgtcgcccaggctggagtgcagttttttaatcctaaagctttttaatttaaggctttttaattttcagtttgcttactccattcttttgtaaaagaaaaaaatcactttagattaaatgaaattgtaattaaggcttctacttccatttctcaccttacgagcttatcttctggatcccccacttaaaaaacaaagttcccttttcatttaaaaattaaagaaactcctgggttagtacttaacacaaacaaactaataattaccatgtaatagaagcaacaggacaagctcacagtaatattacaatgcaggaggtaaaaacttgggcaacatagaaagaaggctccgtttcttagtctgtaaatggggacaataaatagctgcctcataaggctgatgctgggatcagtcaaatgagatcatgcaaagcacccagcactggctaacactcaataaaaaaatagccattatgatcattaggaagatataggaagagacttttgtcattgtcacagtttaatcttgaaaaggaacttactgtatggtagcattctgagtcagttacaagagaaagtaacaagtgacctgcattgctgaggatcctgcctcctccaagctaccctgctacattgttaaaacaccctgggggagaaaagtatcctattcagccaatgttaaactgtttccttttctgaaagttagaaatagatgaaaatagcataagaaataactctgtatatagtaagttctgggtaagacaatattgtggtaagtgaactaaacaaagattaatctgaaattggactctgatccccaagtgaaccagccagtgtagcccagtccttactggacctgaggaggaaaaacaagcctgtgtctatctcaagcgtgatctggctagatatgatctaaactttgaaaagtgcctaagcatgtttcagatgcatattatgtgttaaatactaagcagggagctctgagctggggcagtgcaccctgatgctgaggaactgacataggaaaatgaacacctagcattgtaatttggccttttgctatttatttatttatttatttatttattttgagacggagtctctctctgtggcccaggttagagtgcagtggtgcaatctcggctcactgcaacctccggctcctggttcgagcgattctcctgcttcagcctcctcagtacctgggattccaggcacacgcccccacgcccagctgatttttgtatttttagtagagatggggtttcaccatgttggccaggctggtctcgaactcctgacctgaggtgatccacctgcctcggcctcccaaattgctgagattacaggcatgagccaccacgcccagcctattctctcattttagtcagacaagttttcttttctgttagatctctccccaataattgcaaaaaccaaccaaataaataagtatgggagagaggtggttatttatattatgaaagcattcttcagtttaattcattgcagaatctaagatcctttcctccacagtgttaaaatccatagccctctcaattactcttccacgctttgaggaaaaggaagacagggaggagagatctccaatggaaatttccttgttaataacatcttatgtttctctaaatgttttacagtttcaaagcactttcagactcactctggtatgttagttaagccttgtgcaagataccataaatcatattatactcaattaagaggtgagaaaagacaaggctcagaggtgaagcaaatataaatagtagtaattagttttatatatatatataactaatatatataacattcatatatatatatatatatatatagagagagagagagagagagagagagagagagagagagagagggcgcaattggtacatgtgagacctgaagccaagatttttaaactaagtccagtggccaagaagctgaagcaagtagctcacactcactgccttggtgttgctgtttttcctcccttccgtgatttggttctaagcatcttcccttttttttctcagttaattctgattcatgacttccctcatgtaattaataaatgggaaagacttgagtgaacaaatattcagccaactagtatttattgagcaacaactagaaaccagaactttgaagggttttaaacaaaggaaatggaatctctttgtcatttaaaaggccacaataaaacaaataaaagtaaaaaataaaaaagaccatagtgaggagggtgcagtggctcacgcctgtaatcccagcacgttgggaggctgaggtgggcagatcgcctgagctcaggagttcgagaccagcctgggcaacatggtgaaactccacctctactaaaaaaatccacaaattaaccaggcatggtggcatgcaactgtggtggttacaggtactcaggaggctgaggccggagaatcccttgagcctgggaaatggaggctgcagtgagctgaaacagcaccattgcactctagcctgtgcaaccaagccaggattaataactttattgatgtgaaccaattatccaaaaataataatcacatattagccatagcggactccccagctagatgttttctgcctgtgtttgtaaatcctggacatagttaaatttcaagtgccttcaataagaaatcaatggcttggaaaacatctctgcgcagtcttgataagatttctaattgtggtgaagcctcattccttaaattatttattcaacactaacccattctacaaacttacatctgctgggctctgggagtaacaagatgagttagatgcagcagtcccaaatctaaaggaggttggagactagaaagaccagtgcctgctctgagctctccagtggtccccagcctctcagtcaggcctcacaggcccctctgccagaggcggaaccagcttgcctccgctctgcagccacactggccttttctttcatttctgagaactctcctcactccctcccactttgggctctgcagaaatcccagttccctttgccttgaaagctcttggtcaatttagctcctcctccttcagccctcagctcctgccttgctgccccaataatctttttctgactgcagatctggtcaaatctttgtctgaaaccttagagcccattacatttgtagttttacgtgtacacgtgtgatcatttaatatttgacggtgtgctctcaggtgcctacgctcctggagaggcaggggctgactggttttgttagatgccagtgcctgacacacaataggccctcaaggggtgaaaaaccaaccaaccaagtcaggacccaagcaacctgggcctctgtggaagggcagaatggcctgagtttgggtttctcgagctaccttaagatcaggcctcctggctcctatcttagcccttctaacactctgaagtgtagaggttgtttgttccaagtccccaaggtactgtaagctcccagatagcagaaatcccattatattttagtgctgtggccccagcatccagctgcgctgttacttagcatgagatccacatgaaaaccatttcgcaactattagccattgccagtattaatactttccggaaggtggcacaaagtgggggatgttatagacagcttcaaagaaacgtttaagctagagttgactctttaaataatacaagccatccccaaccaaagattaaaaatttaaatacaaaaaaaaaaaaaggaaatttgcctaccccccatttgtgaaaacaaagaaaaaaaaaacagttaacgtcttaacttttctaggccttcactctcgcctctccccgcgctacaagggcgaattctggacgtatctacacagtcaccgcggagtctgcaatcgccgcgacgtcccctggcatttcttggccaggctgcaactttggtgacggtgtatgtagttacatcccctgtagtgcagctggtatttagggtcctcattggcaaagttgagggtataagcagggagggaggggaccttggcttctttccattcactggcatgttttcggggcacggtcatcccacgctgggctccagcgccagtcccaaggcctcgccgaactccagcccgggagtgcgcgcggccccgcccaccgggcggccgaggtcccgcccctacctcccccgccacacctacccacccaccccattgcaatggtctctgcacgcaggcgcagtggcgcgcgggggaggcggggcgcatgtgggcttcatttaaacagagcagagggggcggcgcgcggtcgccgcggtgctgctgctcagtgggagcgggtcttcgcaactgtctccgcgtggcgcgcgcctctagccgcccttcccctggcggctacggccggagggagcggaggcgagcgggagtcgggctccatggagagcggcggacaactgggcagaggcggagctttcatctcggcaccctggttccagtgacccgcgctagcgtcccgtcccgcccgcgtcggagcggccgccggccccgggactgaccggcctcgccgcacctcccgcaccgactagcgctcccgggcgctcctgcgcccgactcgccctcgcccccactccccggcggggtggcggcggccgggcccccacggcggcggccggagcagcagcagcagcagcaggagcccgcctctatgatgaagttcaagcccaaccagacgcggacctacgaccgcgagggcttcaagaagcgggcggcgtgcctgtgcttccggagcgagcaggaggacgaggtagggcgcccggcgccgcacgctgccctccggggcgccggggtctagggcccgggtgcttcccctcgctccccgcccctgcgcaggctgcggggctgggagggattagcccccttcctccctccctcctttcctccctcactcctttcctccctcacttcttccttcctttctctgggctgatagatgagacaaagggggctcgcccagccccagtttctccatctgggcactcgagaaggcgcctggtccccgggaaggtcccgggccgcgtaagtctcgcctagcgggagtcaccatcttaacgtgcgaattgagttgaaagccggataaacctcgagtgctcagcgagaggagggtggaaatggcgtgagtgttgcagcagagcccttgtgcctcttttacatattttccttccatgttacagccgtttgcggtctcggattcgatctaagcatgtttgtggagtaacagacagtcctcgtgcttggaattgagtctagtcttggcaattcttgtgggtccatgaacccgcaagctgttggcataattatgcctcatttttaaaacggccttcccttcttaaagttttctgactgcagaaaaatggttagtgaaaaatgtggaataatgccaaaagggagacgatggactagagatgggcaaagctgccattttcagacagtaatctccagctctcagcttatgtataaagggttctttgctgtctggcttgacatctggaaaggagtagcctttctcgttctcagagcagtcgttcttggataatttacccatctgcattgggctgagaatgagacccttggggtttccctggagagcgatttttacttaattcagtagtatttatttaaaatggctaactgttgaagtttgcttagggcaatagtagccttttggtattgccactcttaagataaattacataggtgaaaaaaattaacattctgagttctgctttcataaccaaccgtgtataaaatactaggctaaggctggagatgggaatttaatggcttccttactgctagtccctgtagttgtgatgaatatgacacagaatacactcagtggcttagttcttgttatgttaacgaaaagttctcgaaatttgcccttcaaacccttgttttgcctttatttttttttgaaaagaaaccaagccctttaaatgggttgctctgtgctcactcataacctttacgtattagacttgaatcccaaacgagtgtgcagagaaatacggccccagcctttgagatgggtctgcttaggagagctagaaactgcaaagggaaaggttattaacttttacaaaatgaacaagtcaacaagcattaagtgtgttctgtaaaaaagataaagccttagcggaaaggggccatgttgaggcaaagtagtaaactttaaatataaaagaaatgatagccaaaagggatcaagatagatcaaggatcttgtctggtttcctcaatattgtgtaatgatattcttaattgagtgcttacaatgtgccaggcgctgccagaagaaaacttgttatacatttaatccttttaacactgggaggtagtgaagttactcccattttataggtgaggagacagttgcagagcataagtaccttcccaaatgacacaattaggaagtggtagagtcaggattcagggtccagtccttactcctgatgttgggctctgtttgttgagtgagtgagatttttgtgaggctaagtttggaagcctatctgaaagtggtgactgaagtgttgccataatgtgaacttggaattcaggctttgtaaaaatactagactctaggggaaaatatgagtgatggaaattgaaatgatgatctctattgtgcttatggtaaagcaaagactgatagaagctttaggaattactttagcaataaaaataaatgattatttttatgcttggatattatttctactgaaataaatactaaattcatagcctctagttgagtcaagagacccgtgtcattaggtaaggtgaagtagggagcaagttttggagaatgtattagaaaaatccattgtataaaactttgtaaatctgataacctgtaggttgagaattgaagagagtgagtcatcttgttagaggatatgatctgagggaagactctagaattctccttaagtgaaatgcacagccaattttaacatctggtttagctcttcagaattttcatttctgtgattgtgtgtagttgaggctttatctattacatgattattacagaataaactctgttagctttcctggagattctattgtttctctatgaatttgccttcactctgttgaaattgcattgccagacttcccaggacagtctagaaaaccagcttgagcccacctctctagttaataggtgagaaatgtttccctctactggatgaaaaacacctagatcctggttagaagatttaaatgtatgttttgtttgaggatgaaatgtttatatagagtacaaatggaagtaaaagagtaattgcaatttgaccccaaaaaagctacgtggcgctcccatctggctgttcctgtactgaagttctcagtaagtttctactttaaaacagattgttctaggaaagaaggttgttctaagagcagagttattcttttaaggtggctttatatattaaatattttccattttatctttttctgttctgtagggtaaataagtattagtatttgtttaggaagaaattaggtagcagaagtaacctatcccaaggtcacagaagctggcagatccttttgagctctggtcctttgtttctaaatgttttgtttatttgacctacctccccagctagttatttctgtggggaagcaccctcagttttggccgctgggcttctagacaggcccacagctaattgccctgtagagtagctgggtactgtgcttgtacagtgaaagatgacaatgcttttacaaataggtaatcagaaatggattctgttgaatgtatttgcatatatgatagtttaaaaggggatgaagagatgaggtcttagctcctaagaatcattctgtagggaaaggttggacaagggatcaatggaaagggaaataaagtaagggaaaagtgcggtcgggtattctggggttcagatccaatgtgagtcatttggagttggatgtgggtgactgggagaggagggaccaggcgtcccaaatagagcaagacttggggctgtgatagatttggctgcagcttagggatagcatagaatcagtaatagttgaaaaatttgcaacacttcaaatgtaaggttgagaagttgctacgcaagaacaaagttttgttttgaacttagttttgaacaaagaacattgagatagtagatgtgttcaagcttgagagtgatctggcagcaaaataggtttagactgctaaggggagaagtagaatgacttgatcctgtgtgaaatccagacatagttgcaagagaggcattaacaaatcagtctgaaggactaaccactacaggccaggcaggtggctcatgcctgtcatcccagcactttgggaggcggaggtgggcagatcacctgaagtcaagtgtttgagaccagcctggccaacatggcgaaaccctgtctctaccaaaaatacaaaatacaaaaagcagccgggcgtggtggcatgtgcctgtaatcccagctactcaggaggctgaggcatgagaatcccttgaacctgggaggtggaggctgcagtgagccgagatcatgccattgcactccagcctgggcaacagagcaagaccctgcctgcaaaaaaaaaaaaaaaaacaacaaaaaaaaccactactcttccataggacttgctgccctaattagcttttaagctctatgagccaggggctgtcttctacagatggtctgctataatgctgaatatatattcctgaaaaatcttgagctgtacaaaatcatgcagtaaagctttggtgggaaaggtcaagtctgaaaacctaaaaccagagctccgatgagcaacaatactaattcaaaatattactagagttaaatctcaactagcatttttatacttagaatcaacagtcagtccacccttttcacacatactctggggctcatagttcttcagagttaagtccttgaaggtatttctttcaaatggagaccactttcatcaaaaataagtactatccaaaggtagccttttttttttttttttttttgagacagagtctcgctctgtcctccaggctggagtgcagtggcgcgatgtcagcttactgcaagctccgccttccaggttcacgccattctcaagtagctgggactacaggcagccgccaccatacctggctaattttttgtatttttagtagagaaggggtttcactgtgttagccaggatggtcttgatctcctgaccttgtgatttacccacctcagcctcccaaagtgctgggattacaggcatgagccactgcacccggcttggaagccttttttaaacacagggaagtgtcaccaacttcttcatctgtgcctccagctctcccagaaggtttcccgtcattaaaccaggcattaacgtagaatttgcattggattttttttttttttcttagggtcttggtatagctcaagcttttctctaattgaaaaaaagcttataccccgtcactttaaaacattgacctgctaggtaaaaaatccatggtcaacctgatttacaacattattgataatacttatctaccaatcccatataagttggagctaaacatagtttagaagaaagaactgttatttctggtctactctgcctctggtccaaaaagaagtactaattttcttaatagtaggtagctgtttagcatgtatcaaaccattttcataacctatgttcttttaaaatgtctatgtgcatagtgggtgtttctaataacacggctggcctaattttggctaaattttggttaagtgtagtagaattaggttaacgtagtttcaaccattcatgataccctgatttatgataatttggaaagaaagaatagcaacctcgaaacagtttctgagtaggccaggtgcagtggctcacgcctgtaatcccagccctttgggaggccaaggtgggtggatcacctgaggtcaggggttcaagaccagcctgggcaacatggcaaaacctcgtctctactaaaaatacaataattagccaggcgtggtggtgtgtgcctgtagtgctggctactccggaggctgaggtaggagaatcccttgaacccaggaggcggggctttcagtgagctgagattgcgccactgcactccagcctgggcgacagagcgagacagcgtctcagaaacagcaacaacaacaaacagtttctgaatagctacaattttcataataaacctcttcattcttaggggtcacttgaggttctctggatggctcctccgctccccttcccgggaacagaagtggtatctatagtggttggagttcctagagccaagccatgacaattgcatctttaagggtaaaagctgaaacacaaatgggaattcgaggcccaaggacctacagcctctgaaggcataaatgcattacatagcccttgaacagcacccttttatacatcaccagcgaggaggacccgtcaggtgataaagggtatagattctataaaatagatcaggggtgcccaagcttttttttttttctcgctctgtcaccaggctggagtgcagtggtgcaatctcagctcactgcaaactctgcctcctggattcaagcgattctcctgcctcagcctcccgagtagctgagactacaggcgtgtgctaccacgcccagctaattttttgtatttttagtagagacggcgtttcactatgttggccaggatggtcttgatctcctgacctcgtgatctgcccacctcagcctctcaaagtgctgggattacaggcgtgagccaccgtgcctggcctggggtgtccgatcttttagcttcactgggcctcattggaagaattgtcttgggccacacataaaatacactaacattaatgatagctggtaagctaaaaaagtaataattgcaaaaatattttataatattttaagaaagtttacaaatttgtgtttggctgcattcaaaaccatcttggactgcatgcagtccacgggccacaggttgagcaggcttgcaatagatcattctaattcatagacttttatccaataagatttagggttggtttcctgttgactactgtcaatacactattcttttttttttaagagtctcactctgtcacccaggctggagtgcagaggcgtgacctcagctcactgcaacctccgcctcccaggttcaagccattctcctgcctcagccttccaagtagctgggattacaggcacatgccatcacgcctggctaatttttgtatttttagttgaattttgtatttaaattttagttaagttttgtatttttagtcaccatgttggccaagctggtctcttactcctgacctcggcctcccaaagtgctgggattacaggcgtgagccaccatggccggccaatacactattcttaaagtgataaatgcttttctccaaatgcttaaaaccttaggtatctaggaaaagacaaaataactcttcagcagtgccaggtgagtggtgtttttttctggtaattatctaatacatgggaagagggagtaagatttagtagagtagtaggaagaaagaatgcttatgcgaagataggttgaatagagtaggaagagatgtcttcacttttcaccacactaatagcgttggctttggggtctgagtgtgctccaggtctggctctgcaacctggtagaatgagtagcctccttttcgtaaatctttcatatagtcacagctctgatttatctggaaggttgaatgcatcttccttcatctctgtcatcgctaatgtaacagaccagtatcttgatggatacagaaaatctagtctactcagagaagggaatttcaaacctatgaatgaccatgtgtggctctgtcaactgttggtgtgtctttgtagaatgagcttttataacccatctttagagcattaattagcatgctaactatactagtagctttgggggtgtgatagaaatgtgtagatggctgttgtgtgcgtttagagtgagtgttgaagaataatgcattgtgatagggttctagagattgagattcttccacttttgtaggaggggcttaggagcagctgcctattatttgaaatcaatattattgcaagaaaagcaaccattatggttatgttgctatgattcagcaaatggcgcccccaaaacaagccaaaaaaaaaccttacaataaattgtgctgaaatttgattttagatttctgcatgtatagattttatatatatatatatagtaaatctttttatatatatatatatatatatatatatatacataattttttttttctttttgagatagaatctcacttctgttagccaggctggagtgcagtggcacaatcatggctcactgcagccttgacttcccaggctcagatgattctcccacctcagccccccgagtagcttggactacaggtacatgccaccatgcctggctaatttattgagttttttgtagagacagggtcttcctatgttgcctaggctggtcttgagctcctagactcagtccgcctgccttggcttcccaaagcaccgggattacgggtgtgagccattgtgcctggcctatagaagatattaatagttcaggctgggcacagtggctcacacctgtaatctcagcactttgggaggccgaggtgggtggatcatttgaggtcaggagttcaaaaccagcctggccaacatggtgaaactcagtctccactaaaaatacaaaaaaaatgagccgagcatggtggtgtgtacctgtaatcccagctactcaggaggcttacgcacgagaattgcttgaacccaggaggcaaaggttgcagtgagccgagatcacgccattgcactccaacctgggtgacagagtgagaccctgtttcaaaaaaaaaaaagaagctattaatagttgagttttcccacagagttttagtagaaaagatataatgaagctgaaaaatgtgagtatgtaactagtaaaaacacggactgctcagaactagtatctccaaaatttatgtaagaaacaaaatttccattattgactatactagatattttcatcattctcaaatttttgtggaacacttaaaatttgtattagcagatatgtcaaatcttttgtctaggttggaaaactcttaactggaagaacatagctaaatctttgataatgaaagtacaccttcttattaattttggcctctggaaaacaatactgaatgaactctgatttttttttattattattatttttgagacagtctcactgtgttgcccaggctggaatgcagttgcgctatctcagctcactgcaaaccgcctcctggattcaagtgattctcctgcctcagcctcccgagtagctgggattacaggcgtgcaccaccatgcccagctactttttatgtttttggtagagatgaggtttcaccatgttggccaggctggtcttgaactcctgacctcaagtgatcctcctgcctcggcctcccaaagtgctgggattacaggtatgagccactgcacccggctagactgttttatttgcatgctctttacaaaacgtgttttttcaagctgaattgctttagtagttccataaaaatgtagtccagaaaaatctacattgatgattttcattttcaacagattccaagtgaattcaacagaaaagctgtaattcttgagttcctgatagttctggagtgacagtactccactacggtgcaactcctcaccaccatccccagtttctcttttataatctcaggctttttaacttggtgaaatgtttttctggaaagagaaatggtcatatagcactgaacaatagagcaggtgtggcggttcttaggaaacactgagttatgttttcatcttaatctcaaccccttgcctaaaaagttgttagtgtcctctgttgtctgcctaattaaaatataaacatgctccaatgtgataccaactttttttcatctgtactggtctagatctagtgctggggaccgcttccaagtgcatgacagaccccaggtgatcacaggatggcctagctatcacactagttggccttaagttaaaagacttttcactgttattggggttgggggcaggcaggggactgttttaattgtccttctctctactaatgctgttcatatttttccaccctggcagacatacgccatcatccagtctattctcttatctggagtgtatccctcagttcttgctcactcttagtcactgccttctccccaccaccacccccccagatgtggccttgccctcatttgaacactcaaatgaactattcaagatgagtaggcaagtacttaatgaaacagacagactttcaaatctgtcaccatgacatctgtgtgagacctcttttcataagctagttgtttagatggccagtcatttctatatcacagatattaagtacccatttaaagcgatcattttatggaaagataatttgaagttattggtctgaccaaatttattcttcctgagatgtcaagggactcttggatgataagttactggattaggctaaatcgtttgtccacaatttataatgatatagatttatatagatgtatgtgttcttgcagtttttagacacaaaatattgagcattctatgtgactgtattccaaccccacctccaagaatataagctctttgagggaaagatgtatattcagtatcttttcatcacatacaattcttgttgagtatcacacaattagtagataaggaacaaaatcagcaacttctttctccacagtgcttctctttaaggtggagaacttgtgctgaattgtcactttttgacaggagtcagtctgttctctgtccttctagaggctgaagattgtaaagacaaaagtgaatggatttagtttggataccatgtgcatgatgcttctttcctgctagcccattttcatgattctgattttctttcgaaaagcattttaaagtggtaaggttttgcatgaaaatttaagtggataaataactaacagttacatattttacctgttctgaaaaggatataccattaattggctgtagatgtccaatatgtgacccttgagatgagcacttgaaatatgactggactaaggaattgaattttaaattttatttaatcttaaatttagccatatgatgctagtggtgactgtgttagctgtagaccctcaaaagcatgaaaggttcaaaagtagcagagtttaggacagactggaattaattggcagatcaagggcccagaggagcccaattctatctgcaggtttgtcaatttagatgagtagacaagtgcttaatgaaacatgctggattttaaaactaccatcaccaaaagttggatattagcacatctgccttaagctagtagtttagatgtgaatcatttctggaccatagataattactcatttaaatttatcggccttttttttgaaagatacatttggctgggtgtggtggctcatgcctgtaatcccagcagtttgagaggctgaggcgggcagatcacctgaggtctggagttcaagaccagcctgaccagcatggagaaaccccgtctctactaaaaatacaaaattagctgggcgtggtggcgcatgtctgtaatcccagctacttgggaggctgaggcaggagaatcgcttgaaccggggaggcggaggttgcagtgagccgagattcttatatcataaattactggattgtgctaaatcacttatcaaatttatatactattttcatgaggctttctaaaaagtaatttatgaaagagagatgttgagacacaagggttccatattactcatttttggaagaaaagtttagtcatgctgatgtcttgtagatgcaggattggttttaaatctgaagcatagaccgggcgcggtggctgacacctgtaaccccagcactttgggaggccgaggcaggtggatcacgaggtcaggagttcaagaccagcctggccaagatggtgaaaccccatctctactaaaagtaccaaaatgagctgggcatggtggtgggagcctgtaatcccagctactcgggaggctgagggagggaattgcttgaaccaaggaggcggaggttgcagtgagccgagattgcaccactagactcaagtctgaatgacagagcgagactctgtctcaaaaaaaaaaaaatctgaagcataaaatgtttcttcagaaaagcagacacatcttatactaatggtttttcaacattattaatctcctgtaatttagctctgtcttggagaactggaaacatcatagtcaatgacctagatacatgagactttgcatttcatttattcaggactgcaacattttgaatatggatgattttgaactccctatttactatttactaagtgatgatgtacttttcaggcggctagccacctgcgttatgtcccattattaacgtaatccaggaagttgcttagagagcatagaattgtgtaacaagaatttcatctaggcaatagaaaccagtttattcctaacccaaacctagtgaccagaaaaagaggcctgtaactctgcagtccggaccagtagttgctgtttacttttccagtgatgcgagacaaactcttaacatttttatttaacttaaaaactaacattcacttgccagtcttgatagagggccagtgcctttggttgccatagatcctctgtaagcctccaattttgaataaaatacaaaggttttgaaatctgatttgtagtttctctgttgaaagtagaatttgaacttagagacccttgcatgcacttttggatttttaattttctttttctaattttctataaagtctcatctgggtataatttgataatgtaataaccccccctccctttttttgagacagtctcattctgtcgcccaggctggagtgcagtggcatgatcacagctcactgtaacctcgacctcctgggctcaggtgatcccttccaccacagcctcctgagtagctggtattatgggcacatgtcaccatgcatggctgatttctgtatttttttgtagagggagttttgctgtgttgcccaggctgttctcacacctgcccgccttggcctcccaaagtgctgggatgggattacaggcgtgagccaccatgcctggcctggaatgctgcttttctaagaggaggttctatgcctaaatagatactctcttttaactcagcattttgggggcttgagagaagggtgggagttgctgaattgtcagcttgaaactttccagtttggaaaagttcctggtaacttagtcaaatgagagaggactcctgtgctggctgagaactcttaaaggccagcagctcctggcagcagggagggagcagggcagatagaagtgctggcatgcatttaaaagaaaaaaaaatcagtcatggctcttgcctgtaatcccagttgggaggccaaggtgagaagatcacttgagcccatggttttgagacctgtctaggcaacatggcaagaccccacctctacaaaataatacgaaaatcagactgggcatggtggcttactcctgtaatcccagcactttgggaggccaaggcaggcagatcacttgaagtcaggagtttgagatcagtctggccaacgtggcgaaaccccatctctactcaaaatacaaaaattagctggtcttggtgggaggtgcctgtaatcccagctactttggaggctgaggtgggagaatcacttgaacccgggaggcagaggttgctgtgagccaagaccatgccactgccctccagcctggatgataggacgagactccatttcaaaaaaaaaaaaaagtacaaaaattagccaggcctggtggtgggtgcctgtactcccaactgctcgggaagctggagtgagaggatcacttgagcccgggaagtgaaggctgcagtcagcagagattgtgtcactgcactccaacgtggatgtccaagtgagaccctgtcttagttatcatcatcatctctatgcacactgggaattaaacttcgtgataaaccctatgtgttttcgagggagaactgtttaaatttacttgaaggtagtatactaagataattttgtggacacttttgttcaaattgacttatttatttttattttttatttttttgagacagagtctcactccattgcccaggctgaagtgcagtggtgcagtctcggctcactgcaaccttcgcttcctgaattcaagcaattcttgtgcctcagcctcctgagtagctgggactacaggaatgtgctaccacacccagctaatttttgtatttttagtagagatagggtttcaccatgttggccaggttggtcttgaacccctgacctcagatgtccacccacttcagcctcccaaagtgctgggattataggcatgagccaccacgctcaccttgagttgattttaacttaagtgaagttcaacctaagctagcccacaaatattcctttgtttcccccccccccttttttttttcctttttttgagacagaatctagctctgttgcccaggctggagtgtagtggcatgatctcggctcactgcaacctccgcctcccaggttcaagtgattctcctgccacagcctcctaagtagctgggattacaggtgccttccaccacgcccggctaattttttgtatttttagtagagatggggtttcaccatgttggccaggctggtcttgaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttcccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatctgcccacctcagcctcccaaagtgctaggattacaggcatgagccactgcgcccggccagatattcatttaaaagatgggtatgtaatacctgttacctgttaaataaaatctaggatacttgtctaaggtaatagggtatttttgtaacaatttgtagatttcagtcttttttttttttttttttccccgagatggagtcttgctctgttgcccaggctggagtgcagtggtgcaatctctgctcactgctcactgcaacctccgcctcccaggttcaagtgattctcatgcctcagtctcccgattagctgggattacaggcatgcaccaccacacctggctaatttttgtatttttagtaaagacggggtttcaccatgttttgtccaggctggtgtggaactcctgacctcaggtgatcgcccacctcggcctcctaaagtgctgggattatagatgtgagccaccacgcccggccacatttcaatcttaatgctattcttggtaaggggtccatagacttccaaattaagggccagacaaacattttaagttttgagggccacacagtctctgtcacaactgctttgactctgctgttgcatcattaaaacaaccagacaatatgtaaaaatgagtaagtgactcgattctaataattccatctgtggacactgaaatttgaatttcacataattttaaaatgtaaaaatacttctggctcacagactgtacaggtggtgagctgcagactgccagtcctgttctagatcataaatgatagctgcctgttagaagaatgaagtgacttttgcctatgtatgcaggtttaaaatgtgaaggatgcttcttgccacctaatcataacagtaacaagcactctgtatcaagaatcgtctttatgtgcatttccctatttctttctcacacatctgttatcttcttagtattcttattttttaggtgaggaaacaaggtaacctacctatggtcatttccttaaatttggaatattccataactaaataaacttatgtgaccatagacctcagtgcatacaactctggctaataagccaagtttctgttttttgtttttttgagatggagtctctgtcacccatgctggagtatggtggcacgatctcagttcattgcaacctccacctcctgggttcaagcgattctcctgcttcagcctcccaagtagctgggactataggcgcccgccaccatgcctggctaatttttttagtagagacggggtttggggtttcaccatgttagccaggatgatctcgatctcctgacctcttgatccgcccgcctcggcctcccagagtgctgggattacaggcgtgagccaccgcgcccagccaagtttctgtttttatcctttgttattatccaataatttgagagttttaccaccagtagtttatttcattagataaggtgatttggtagtgtgaccatgttaatgttaattctgatttcagaaagatggtgtttaacaaaggttgtcaattgcatttttgtggtgtaatgcgtaccccctaattttaattaaattttaaaatattttaatctagaatagagttataaccttgcagaggtttgagaatgttgtttatatacgaagtgcttctcaggctggaagtatacagttatggttcaccttacaggtgctgctggtgagtagcagccggtacccagaccagtggattgtcccaggaggaggaatggaacccgaggaggaacctggcggtgctgccgtgagggaagtttatgaggaggtgagatgttctttcacacaaattctgtttcggagttttaaaaacaaggccctttgctacataacactaagacagcgagacgggtccaggagtgctttttgcctgatgcaactttatttttaattttaatttttttttttattttttgagatggagtctcgctctgttgccaggcctggagtacagtggagcgatcttggctcactgccacctccgcctcccaggttcaagtgattctccagcttcagcctcccgagtagctgggattacaggcacgtgccaccgcgtctggctaatttttgtatttttagtagagacagggtttcaccatgttggccagactggtctcaaacccctgacctcaggtgatccgccagcctcagcctcccaaagtgctgggattacaggcgtgagccactacacctggccttaatttttgtatttttagtagggacagggtttcaccatgttggccaggctggtctcgaactcctgacctcaagtgatccttctgcctcggcctcccaaagtgctgggattacagacatgagccacagcgcccagccagaaatactaatttttgatcagtccttgccgctgatgaagtaaatgacaataaaaacttcacagaagcaggaagatagtgagttggtatggggaggggtattgtatttaattagatttaagtaaatagccagagtgtaacttgtatttatatacattttgttataaaaaggtaaacattttatatttcatctttttttaataggctggagtcaaaggaaaactaggcagacttctgggcatatttgaggtgagttaaaaagtaatcttcactttgctgataatagaattaatgatttcttcctaaccaaccaaataatgtggcagcagcctgaaccagacatttctctcagactagcagtaggcagtcagtccaggattaggtagggagggaagtaaaagccactttttcatatgccaccacttttatttatttatttttaattaattttttttaagacagagtctcgctctgtcgccaggctggagttcagtggtgcaatcttggcttactacaacctctgcctcccagattcaagcaattctcctgcctcgtcctcccaagtagttgggactacaggcacgcgccaccacgcccagctaagttttgtatttttaatagagatggggtttcaccatgttggccaggatggtctccatctcttgacctagtgatccgcccacctcggcctcccaaagtgctgggattacaggcgtgagccactgtgcccggctgccatcacttttatatagcattattatggtagtgattacttctgtttgaaaatacagtggagctgatactgaaatgtttatcttaatccactgtagactgtttagggtatagatcttttaggaggtacaatatttttagtatgacctaagagcttaggtctcatgtgttttatctggaaatgtccccattgcccttagcaaatattatatgatacacctagtgacttaaaggattgtacgaagatataaatctcaggtacatagaacagatgctaaaagaatagaattctctttcatatattctcttattactgaaggcagaatagaattttcagggagggaatttgaatgtgataggcagtctctggaagccagggagaaaggaggtccagatgtatcttcatccaagattcagacctagatacacagtataccagaaacatggtcactttccttttttcagggtgctgtttataggttagtacagcctttatagtagaaccatataaattttatttttaagccttaggaattcagaaaaaatcccgattttgtagcacttggtagaattgatgatgacttttaccggaatacagtaattaagagtaaagttggccgggcgtggtggctcatgcctgtaatcccagaactttgggttggccaaggcaggaggatcactaggtcaggaattcaagaccagcttggccaatatggtgaaaccctgtctctactaaaaatacaaaaattagccgggcatggtgacgcacgcctgtagtcccagctacttgggaggctgaggcagaatggcttgaacccgggaggtggaggttgcagagcggcactccatctcaaaaaacaaagagaaaagtcgttcaagtagaattcagtcttttccagaattcagcagttgcttcacccagttaaatagcaccatctcctggttaaactgaaaaacatactgaggtttttacaaataacacatttgtcaatatgctgacaaggtgtttgaagaaaatgtctcacattataaataaagcttaaataatatgggaaggtaacagtattaagtgctttacaaatactgtttaacagcacacgtcaatcaaaaaatacctttccccttagaaaatataagggaaaattggattgccctgcccattcatcccagtgatttttgtgaatttgtgaatatagcataataaatgtactgatttgtgagacatagaaataaaacaactgattcttaaaaataatgaatgatgtgttaattgacagttgcctctaatttattgttgtttttattccttctcagatataaaaagataatccttcccagctgtaaaaacccactgttttgagtagatttttcaggttgtttgtggccaaaatcaggacaattatctaaagtcgtggactatggcaaagaaggctaactttaatcaggatgaaggaaggccaacttgtttaatttttaacccagaaacaagctcagttgcctgttttatttaatttatgttttttttttttagatggggtatcattctgtcatccaggctttagtgcagtggcatgatctgggctcatcgccacgtccgcctcctgggctcaagcgatccttcacttcagcctcccaagtagctgaattacaggcatacaaccacgcccggctaatattttcgtatttttagtagagacggggtttcaccatgttggacaggctgggctcgaactcctgacctcaagtgatctgcccgccttggcctcccaaagtactgggattacagacgtgagcttctgctccaggccatgggctattctttatgtgcaccttgataggcctgcaggaggagtgcttaaaggaactggtgctgtttgctcttacaaaggtcctaaaggaagcagttttccatgtcattgaaaggttgtcaggattagccccagggaagaggggataggataaaaactatgggaatgcaggtctattattttaataagattgcattcaactcttaagattttctttatgaaaataacatcagataggccaggtaaggtggctcacacctgtaatcccagcactttgggaggccgaggtgggtggatcatgaggtcagggtttaagaccatcctgaccaacatggtgaaaccccgtctgtactaaaaatacaaaaattagccaggcgtggtggcgtgcacctgtaattccagctactcgggaggctgaggcaggagaatcacttgaacctgggaggcagagattgtgggggagctgagatcacgccactgtactcctgggcaacaaagcgagactccctgtctcaaaaaaaaaaaaaaaaaaaaagaaaagaacatcagatatatagaaataagtgtttaaagtttagtactggaggctgggtcctcatacctgtaagctcagtttttgggaaggccaaagcaggaggttcccttgagggcaggagtggaccagcctgggcaacatctccagacttctacaaaaaaagtagtattgagagccaatttcaccaccagtaatgatgaagctctagttctagtcttctgtttaacttttaaatgttttgtcttatataaagtcacttttgtgttggactgtacaactgaatatacttgcctgtgctgggaaatacgctatgctaatcagcagtatgccagactaatttttttcccttggaaaatgtgtccatggctagctcctgtagattaaaatgcatttctttttatattcaagcagaaccaagaccgaaagcacagaacatatgtttatgttctaacagtcactgaaatattagaagattgggaagattctgttaatattggtaagttcccttttgttatctgaatactctgttctaacagaagattgggaagattctgttaatataggtaagttcccttttgttatctgaatactctttgcttatattcctgtgtccagtttccatcctagatttttttttttttggtcacttttcatttagagcagggaagataattcaaatgtagagatgcatattcatcttaattattccccaacatattgttgtctaagtcatttatcggggagtaagtggacattacttatatggcttactttttaaaatggactgtcttgtaaccaatgtcattcttttctctaggaaggaagagagagtggttcaaagtagaagatgctatcaaagttctccagtgtcataaacctgtacatgcagagtatctggaaaagctaaagctgggttgttccccagccaatggaaattctacagtcccttcccttccggataataatgccttgtttgtaaccgctgcacagacctctgggttgccatctagtgtaagatagagagaactgggtaggcctctcccaccatgtgcagtctcatggggagaggcttctttcgtttcctcgtcaaacatctgattgacgcttgcaaactgtctgaatttgccatgcaaggttttcaaacaatttgcatgtttttcagatgctttcaaatctttttttaaaaaaatagtgtaaaatattttaataagccaaagccatgtggaatttttgtttagatgccttaactgtgccacaccccacaaccccctatattattttggttgtctatttctcacagcatattttcagttttttgtccatttgacatcagtctgtggtttattttgtcatcagattacttgtgggtatacctaccccaaaattgttttctcattcacagcattagcatattcagcaaatccatctgtggtgggaattaaaaatattattggtattaaagaaatccattcaccccaaaacttgttttacaggattacaattttaattcaaaatttccagatttgggctatttctgtatgatccaataacttattttgtcacagggcttaatttgccatttttggggatttgtcgactcattttgtctgaattttcacaactggtattatgtcactagctacctgatacggctatttcccttataactcaatagtaccttaacacaaagtataactctgtagagttggtgaatattttagggaaatattagcaaaatgcatgtagtaaagacatcttatgaaaactgtattcatggaatttgatttagcatgctcagttgccagttcccattatcgatactctttctttgcagaataccttagaaccgttatttccctcagtgtagattgctcttaaaatgtattcagttatttagtggcccccacaggagtggagtcttgaaatctaattctaaatgccagtcagtgatgatcgcatcacagttgagtgaaatggccttcctgttcagctgttagagactgaagattgttagggcaccttagaatgtctcatcttttctaggttgtcaacaggtactatttgtcacataactaactttcgaggcactggaacatacctgaactaagaattaaatcttttactttatactcacttaaaatcaagaatcccatctaaaacacataggtaccttatctgaaactcttgcacttccccaaccagggcagaaatgaggtgggagaagtttgactaaaatgagggatgggggaaagtaaaagatgtttttttttttttgagactcgctttgtcacccaggctggagtgcaatggcacaatctcaactcaccgcaacctccgcctcccgggttcaagcgattctcctgcctcagcctcccgagtagttgggattacaggcgcctgcctccatgcctggctaattttgtatttttagtagagacagggtttcttcatgttggtcaggctggtctcaaactcctaacctcgtgatccgcctgcctcgacctcccaaagtgctgggattacaggcatgagccaccatgcccagccaaagatcatttttttatatagacttcagccctttgtaaatattgtaactggggagtatagagtagaaaaaaagtatagttaaaacatttgttctacaaattaacctttaaaaatataattactgctaaaaatagagtgctgttacacttaaggaaaattagtgccattttggaaatgagatcttgtgccataaatacagctgaactgaatataaatgttcacaaattaatgctgtcaaaggaatgagtaaagcagaaaaacttttaaccagcaacatttcaagtacgtagtgtgatcaaacatgatcatccagaatttttatatttttttctttgtacagaggttacatattctgggtgttcttttataaaggaaacattttaaatcccacaaattgacactttctatcttcaatggactaagatttttttggtcagtaatctctgaaatttccttaaattatatacttaacatagcagagaaactggattgtttttgtatataagactgcttccacctgaaatgctgtcataagtactgggggggtgggggagtgcccatcttgtacatgatattcttagaggtaataaggtaatgatgcatgaatttattttataaactcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatccttaagtcctgttcaagtgtcacttcattttttattaggggtttcttagttggagggcatgagaaacttggccctttccaatgttgtcttcacattggagtataagaattctctataggactctttaatttttttttttttttggtagagatggggtcttgctgtgttgcccaggctggtctcaaactcctaggcttaagcagtcctccagcctcagccttctcaaagtgctaggatgattggcatgagccacctcgtctggcctgcaggtctttttaagcatttgctgttcaataataagcatcttctttatgcctagtatttgtgataagagcacaaaacaattttctaatctcaaagagcttatattctagtggggtagagataagtgatttatcttggtgtagttttggcttttttgtttgtttttttgagacagcatctcacactgtcgcccaggctggagtgcagtggtgcaatctcagcttactgtaacctccgcctgccaggttcaagcgattctcctgcctcatcctcccgaggagctgggatcacaggcgcctgccaccacgcccggctaatttttttgtatttttagtagagacggggtttcaccatattggccaggctggtctcaaactcctgacctcgtgatccgcctgcctcggcctccctaagtgctgggattatgggcgtgaaccaccgcacctggcctatcttggtgtttttacatccttcagtatttttcaaggttttacagcttttttatctatagacttataccatcttcaaaagcaatacaattttatttgtagacgtgatttcccccaccaaatgcacattttatggagctctaggacaaaagtcaggatgaaaagtaatctatcgctggtgctactttaataccttcctgactggtgccactggctaaattctagcagtacgatgagagggccattaaggcctatcttagcaagcaagacattatagcaaagacctaaacactcaaaggttcaacgtcttctagccagggaactattctctaattcttccaccttgatatgatttcagcaaattctgataacccggtattactcttaatgcatttttgtaacatttgacaaacatctcccaatatgtagactcccactctcctgatgctaatcagtatcagacaatggaagtaaattttcctgcttttctcaacttttcctcaaattcatgttagtgaagtactttcatttggccatcattatttatcaaccttaagaaacatgcctattgacgaagtaaatatactaggaattcaacgtatctacgggaatgtggacaaagacatataccaagacaaggcactagagtgaaaagccattaaaataaaatgctcagcagcaaaggatttgtaatggttaacttgcaatatatccatatggtgtaatattacagtcattagaaatgacatttgcgtaaggatctgagtggaaactgatacagcctgtcggagagctactgagtagtattttatcacagctgcatacataccctttcacccaacagttccactcctgggagtctagtcaacaaatggacaagttgcacaaccaagctatggtcaaatatgtgtgttgtaggatttatgaaactggtaccaatttaatattcaaatgtgattaagtcatggcaatctatttactggatactttgtggttaccaaagagctatgtgctgccacagggagtcctttcaatagtgattgaaaaaggcagaacactactagacagaactacctgttttatgcatgtattggcatacactgaaaaagcttagtcacttaaaatgaggttgtacagattgtagattttgtttttaaacgcctgtatggtttaaaaaatgttttgggaaatagacatgagcagggcagagaactacaacctacaggccaaaccccaccccactgcctgtttgtacggccaacaagtttaaaatttttttaatgttttaggtttttttttttttaaaaaaaatactatgcccatttgtttacaaatcgtctgtgggtgctttctcactacaatggcagaattcagtagttgagacagacctatggtccacaaaggccgaaatatttactgttttaggagaaaaaaacaacatgaattgtaataacttggacttacttggttgctcagtcctgatgtgtcctgttaaaacctaagagaaacagcaccaagttcaatctagtgcaatcagcctatcacatctaagctgcttttgccagatctgatatctactcccgaccttaagccaggagactttgtaaacttactaggttataataaaacttaagaactatcgatatttactaatctacatcatggaactatttcaaaagcagtcatatggtaagatggatcaggagtctttaaaaataaaactgagaaagaaaaatcatgtgatcaattcagtagtagagacagaggttggtatcaagtctatgttcatacacttaccagtgccacccagcagggccatacaagacacatgaaatgagatcagctcaagggtgacaagatgaaactgggagagggccggggagacccgaactcttaatattggattccacacaagaggaaaaattttagtccagctcccagcatggcagctaatggcaagttagtaccataaagccaactcttggaatatacctgacttccacgataaaatggagatgagtgcaggggtgagtgtatagttaagaaaacaaacaatatattactagtccaggtggtagatgacagatttttattatttacacttctctcaaattattacattcagcatgttttgctttttatgttatttaaagtataaaccctcatataattccctaagatgggtggcatgccaagtagctaaatgaaatatcatcccagcccaaaagtacttattcgaatgaaatattacatttttcttaaataaagcaataaattaggtaccctattatcatggtattttcttttttggccagcttttctagataaggttgtattgctactgcaactaacaaaaaagatgtggcagggctgggcacggtggctcacgcctgtaatcccagcactttgggaggccgaggcgggcagatcacgaggtcaggagatggagaccatcctggcccaacatggtgaaaccccgtctctactaaaaatacaaaaaattagccaggtgtggtggcaggtgtctgtagtcccagctcctcaggaggctgaggcaggagaatcgcttgaacgcgggaggcagaacctgcagtgagccaagatcatgccacagcactccagcctaaactacagagctagaaagtggctagagcagccaaaaaaaaaaaaaaaaaaaaaaaaaaaaaaggttcctgaaccattcaacagaaaaatgaggcctattcctatcatttcctcgatccaatttagttccacttaggtcactgtgtttataatgtcttttaggacagatttccttccccattctccatcaaacaaccatagcacctgtgacttttatctgttggtttgtatttaatcttatttttaagtgcttctttgaaattgttttacaagtacattcttggtctagagtaaggttctatatagttggccctccatatccatgggttccacttccgtggattcaaacaaccagacaaaatattccaaaaaacattgtgtctgtagtcaacatgtatatttttgtcattattccttaaacaatagtgtaactatttacatagcacttacattataataggtattataagtaatctaaatattaacataagcgggaggatttgtgtagattgtatgcatatacaacatcattttattccagagacttgagcatctgcgaatttggatatccaaaggaagtcctagaaccagttcccgacaaataccaagagatgactttactttagacctaagatcttgctagacagcctttgagaggatgaaggataactagagcagaagcaaatcgcagcgaagtagactacaacaatcaagtcaaaaaacataaagctcctatcaacacctcaagattttagaaaagcctcttaacgggcaattttcttttaaataaagactgggtcccactatgttagccaggctggtcacaaactcctggactcaagtgatcctcctgccttggcctcctaaagtgctgggattacaggcatgagccactgtgcccggcctgggcagtcgattttcaggaagccacttaatgttcagattcttttcttctctcccaggactttgcagatgctgctgttccctctgcctggagatgttcatctggcctgaatccaaaagtctgtccaagttacttctcttttccatgacagagttacaactatttgtctgtcccccttccccattagagtatatggtccccaaaggaaagccccatgccattcactcaccacctaatcatccccaacaactagtgggcaaacatgaaacacttttgttgaataatgtgtttcctttagcccagggattacaaagtcaaaggcttacaagggggaaggactagcaggtgtgctcggaggggactctagccaactggagagtaactggtgagaagacaatgacatgctcttagggtgtctgctactcagatcctctcagttaagtcccgtgcacaaaggtgggtcaggtctactgttgccagatcttcagatcattcaaaagttacccgaattctggattttcatgcaaatctcccaatttttaaaaatgttggcatcaaattcagaatgttttaaccagccacactgtgtgggccagggaaaacaggcccaaaggccaggtgaagctgcagttttcaactgctgccttggcctctcccagagccccttaagtcctaagaaggctcagtcaacacactggcactcgtttcatcccactggttgagaaagcaagtcttagcaaagtaatgggggagtcttaccaaaactgcaaaggaaaaaaatatgataccatgaaattagaaattcactgcatttgaaatgaaaatgacttatttctgtacttctataactcacaaatttagcagacatcatttagacatttttgtagtgcaacagatttaaatctggaatttcatggtttgtaaatcactatgtgatactagctataaccatgagcaatattacgggcagtaaatgttgatttctatttcgtttcttgaagttttgtgtggttcatttttaaagtgagattcaatttccttagctatagtcaaatgtaccctttaaacagcccaagaattgttataaatgacagctgctatcagttttcaaattttacaatattagggttgttaactatttcattctgaattaagctaacatttgttaccaagcaatgcatttatttggaaggataccagttaccagtcatcaaaagcttttgtatgttgaaaatgtaattttaatagttaattcttcatcttacataggagcacaataaaatacaccacaatctgaagaaactccagaattacgagaataagagtgaagaaaattcaaatgggctacaatatccattaccttaaactgcaagagacaaggttgcaacccgaaggttaacatttatgtatttatgactggctacatttatgacttaaaaataacaagaatcaggaattagatatggagagaggtgggaaagaacagttttgtgaggggaggaattcgtcaataaagaagaaaaattactgaattccaaattaaagaataaaacgagctcccacagcaaatactggagggatgaaagcaagaatcattaactgaggacttgatactctcaaagggataaacctttctgatgacacacaagctagatagttgagatctgctcatcaggtttataaggaagactcacaaatgcctcagcaaatcccaaatgatcagatcagtgtttcttaacacacatgaaaggttacagatgaaattttcagataagaaccaagaaaaatgtcataacccaaattttaggcaaaaatgtggcacaactgtgaaagtcctacatgtcagtcacaactgctatctttgctgtgactttcctgtacagtaatttttaaacattgtggcaagacaccaatgatcatctaatcagacaacacaaacacatttatttcaaattcctagaaggttaaaaaaaggtcagatactgatgctttatgcatgctcagggccagtttataaatactccattcagtactatcttaacacaaatctgcatcagtgaaaagaaactggcaaaatccacctcttgccattcaatttgtcagatggtgaagaccaagaaagaatgttccatcagtttcaattttaaaatacgattgtcaaattgggaaaatgaaataaacacagtaaaataaactgtacaaaggcaaagtagaataacaaaaaatattttactaaaacataagatttacagaagtttccagacaagccatacaaaatggtcacaagctttttttgaaggggggaatctacacttgacagcaatgttattagtgagggctgtgatgtttgtttaatgttcccattttggttccaacaatcaagcttgtccatctacagcgtctaaataaagttagacttggctagagcatattctaaagacctggttagctgcttttaaccaatgcaattagatcaccaaaaaagggggaaaggagcccataaaattaaactacctcccccctcaaaaataaaataaaataaaataaaataaaaacacccacacccctgcagctaacctgacaactaccttcattcacagtgctttatacttaaaccaggatgggggaaatgaataaaagcagggaggggccactgcttttaaacgtttcacaacaatccagatgatacttctagcctctgctcatgctttatgacagtgaatcaggacaagacatagatttgctaatgtgcatttaatcaccaaaggactgaagatgtctgggcttttttattctgtaatgtttctaagactgtgtccattaaatgcaaacaaagaggaggaagtcttggcagaacaggagaagtgatgcacacttgatgatcgtatcaatttaaatattattcatggcatatagcctagtccatgctctagctgtagacagaaacaaacatacgattattattttacttagttcaatatgttactttccaaactataaatggcaaacaaccactattaattatggaaatgtcatgctgtaatctgttaaattcacgcctttttctataaattggatcagggctgaaagattttgtaaatgtccaattaccaaaacactacaataaaattaagaagttctagaaaattcaagaggatgaatcaagttgtccatttctagatacacaattctccccactaattttcttaaaatctgtagcagaagcttcttgactccaaattccgtagccataaacagctgaatactttaatcaaatgggttacaaaaacagttcaagttttccagtattctttacatataactagataaatggtatgcactcagtatttgttaaaccaggtgtagttacaagagactccaagatctttcaattacaggttgtctttatatttggggggtcccatagcaagccattttgttaagacgtatttacatactataagcaggatctcacttattatacttttttctatttcttttccttgccaagagctttagaaaagtttaagtggtaatacaaatttgtaaaagtggaagtggtgtgaaggagaatgaatattagatacctgtttctatggcttgggcttcgttggtcttccactgctccgctacatcatttgctaatggatcatctggattgggagcacttaacaaggcctggatcgatagcagaactgtgcggatctgcagtgctggggaccacttatctatgaaggcaacaggcccagtatgataaagcatgaaaaaaacaggcccagaactgcttcacttccctcccacagacctctctgatctttgtataatgtttacattctaaacatggaatgcttaagagaaaaaggagaaagcttaataatagcatatgctgataaagataacacttacctttcaaaatatctaaacatattcttcccaacttgtctacattaggatgataaattttggtcatgaaacgtactttaggggctgccattgggtattcttctggaaggaatagttcaagtttaaaagtccctccctcaaagggggaatcctgagggccagcaatgaccacatgaaaataacgggcgttgctctcatctggttcggctttgatgccaggaactggttctgccagcaaacgctgggtttcctatgacagaaaaacaaacacatttgtgaaacaaatgtcattttgctagacaccaaaagtaaaattagaaagttcatctcttagaactacgcataatagaacagctccaatctcccaacagatttagcttataaaatgcaaaattcaaaaaaataccatttaaataattacaaccagctgaatgaaactgcaagcgaatactaatgatgttatcatacattttggctacaaatgtctacaaatatgttaataaaattagcttaataaaactgattttttactcaagtaaaataaagtaacattaggattacataagtaaggcaacttgctctaaactcaaccaaaaccaagctatttaaaaagtaaaattagcttttttggtggttttttttggcttgtttgtttgtttttgagacaagatctcactttgtcactcacgctggagtgcagtggcaagatcttggctcactgcagcctcgacctccctgggcccaggtgatcctcccaactcggcctcctgagtagctgggattacaggtgtgcgccaccacacctagctaatttttgtatttttagtagagacggtatcaccctgttggccaggctggtcttgaactcctggcctcaagtgatttgctcgccttggcttcccaaagtgctgagattacaggtatgggccaacacactcggccaaaaattagtttttaaacccactgaaaacctcccctctgaaaaatgtaacggactaaagaaaggagataagaagaggcccaggtacctgaacaggactaaagaaatatatttaacaatgctgattactctaaaattgacaattaacttcagaggaacccttaatactcccaacaatcataccattagttctctttttcatcattctccctctcccctaaataattgtattattattatttctcttctctcttcaaacctccagcatctccatccccatcctcacttgtggctgatgtcctgcttcctatttcatgacaagttagatacttccatcagttcccactgtagcatttggacatttccctgcatctgcacccatacactctggtttttctcctgtatagatgaaatgtcacgtactcttggctagggccaatcggtcttgagcactagatcttactgatctctgaaatgtttgttcttcggtaccataaagaaatagcacttgaacataaatttaatttatttagtaaagccatttttacttcctgcagaaagggtacactcgccaggagttttgccacaagagtatactgaacaaaggagacagggtcatttataacctgacgcgtccaccctactgctgtgtccggtttccactggctggaacgggatctcacattctgtatttgtcctgactggctagcaacttagaactttttaaaagaggtaaaggtagaggggaacaaaggaaggaggaagtaacttgtggaatgctgagaaaggtaaaaacacttttaaataaggaagaggaacaggctatgacctaatgcttgcttggaccagtataagcatgccagggcaaatatttaggctaaattgtgggagctaagaacataaagtatattgatttctttattatggctagcaaatatttaagaatgtttgcacaggtcttcgaataaattttgcttctaagagaagttactatttattcctaattagatggggaggaaagtctttgaagaggaacctctactttgcttgtctccaatttctctcctcctcttctgtcttgaacataccctccaatcaagctgtagttatcgctaacttgtttgttaaggtcaccaatgatttccacaaggttaaatcaaatgtccagtgcttaatctttatcttacctaaatgcgacatcttatccagctggtctccttcctctttgcaaagctttatctaacttcctataaacattctcatggctctcttcctccttgtctggcagcagcttcctttagtttccttgttggtttcttctatctcccaacatcgcaacactgaaatgcactggggctctattctagggcttcctctctgtttatacatttccacagtgatctcatgtaatgcaatgaatttaaatactaaacacactctataagctgaagcctcccctaattcatatctagcccagacctctcccctcatcgtgcctcttgcctctataactacctgcttgatatacactcttgaatgtctaataagcatcccaaacttaacatgacctccctatccccaacctttgctcctcccataaagtcttccccacatcagttactggcaaacccatctttccaaatgatccaccttttccttcatatgccacacacatctagcctgattggcaaattggttttttttatacttcaaattctactcatgattggactgtttctcaccattccactgctacacctctgatccaagcaaccatcagctctgacctggcatactacaacagcctcctaacctgttcttcctgcttctgacctcactacctccctcgcaggtctattatccacagaccctttaaaagtcatagtcctgagccgggtgcggtggctcacgcctgtaatcccagcactttgggaggccgaggcgggtggatcacctcaggtcaggagttcgagaccagcctgatcaacatggagaaatcccatctctactaaaaatacaaaatcagccgggcatggtggcacgtgcctgtaatcccagctactcgggaggctgaggcaggagaatcatttgaagccaggaggcggaggttgcagtgagctgagatcgtgccattgcactccagcctgggtgacagggcgagactccatctcaaaaaaagtctgggcatggtggctcacacctgtaatcccagcattttgggaggccgaggcgggtggatcggctcaggtcaggagttcgagaccagcctgatcaacatggagaaatcccacctctactaaaaatataaaattagctaggcatggtggcgcatgcctgtaatcccagctacttgggaggctgaggcaggagaatcgcttgaaccccggaggtggaggttgcggtgagccccgatcatgccattgctctccagcctaggcaaaagagcgaagctccgtctcaaaaaaaaaaaaaaaaaaaaaaagtcatagtccttgtaatgggcccccaaaagacgctctatatgatgccctcactccacctacctctctgacttatcttcagctgttctctctccatcccctaaccttctctgttccagacaaaaattagcttccttgtagttcttcaacgtgccaggcatccgctcacctcaagggctttgtacttcctcttcctccccaagatatccatatggcttgctccctcagctcctaagatcttcatgttttctcagtgaagccatcataactgaaattgcaaaccccattcaaccctaccctgcacactccctatccccactccctggctttatctccacagcactactaacaaatctcatttctacttattttgttcagaatttaagctccatgagaggatggatttgagtctattttatggactgctatatcctcagcatttggaacactgcctggcacaatagatattcaattaatatttactgaattctgaatctatttgatgttatgaaaagagggaaataaacgatcagaatttcatcgttaacatcattaaggcagggttattttcaaggcaggatgtgcacattatggaaggaaaacaaaaggagccactcaggtatggggaaaaatagtctaacttctacttatatttatttttaaccagaaaaatgttcatatttaaataagcttttaggtatgaaaaacaataaatgagaacattttatttacactgccttcacctaaaaaaaaatacatcataaactgtttcattccacaagctacagggcatacgttaaaaacaacaacaacaaataacttctctctcagcacagtaatatactgaaatagtcataagatgtaaatacaaatcaaatgcttccccaaaatgtgttaattaaacccatggccattttaggtaatgtctctggtattttaagactagttttttgttttgatcatggcgatgtaagagcaagtgagaaactgacatgttctttaggttcaaactaaaacatttttagagtattaaaaagctcaagaggcaataatgaagcctctgaccttgggaagtcctttaacatgtgaccagaacaaaagaggctggtcttcattttttaggaaaaaagttaagatattagggatgaatagcaggagtagaaaaatgagaaaataactggatggtaaaattccttgaattctgggctctcctcacctccatcctttaattttaccccaggtcttcatgtttttagaaagccataaattgggtgactggaaaaaaaagaaagccagggcccaagagtcccaatccaccactcaccagttacacaaagtagtagcagctctgtatctactataaaaagctacagaaaggcctccaaaagcgtatcccaaaatagcttcaaaatcactctcaatacacagtggcagagataggtatggcatttactttctcatcttcagttcaccctcaaaatcagatattctttgtaaagaatgtacatattaagcacatcatgtgacctgatcaagcctagatttaattggaacacattctaaaataagctttcgtgtgtagaaaacattttgaaatagtccttataatatatgctgctctcaagttctaatggactgacacaaaaacatgcataattatttcactaaactgttggtttccctaacaaacccacagcataaactgtgggaggggaaaaaaggaataaaatccaaactaaatgaaacaagtctgaaatggcagcatctgaaaaagtctcaaccacagaaactgatgtcaacttttttcctaaaaaggcaaaaactggctaggaaataaaatctttccggccactattcaacacatgactaactaaaataccttctggttttacactattctttggtggaaagacagagtacagtatgatttctttaagtgaagaagtaaagggctaaaattcctactgtttcacttatctatctttttttttttttttgagacaagtctcgctctcttgcccaggctgcagtgcagtggcacgatcttggctcactgcaacctctgcctcctgggtccaagtgagcacctggctaatttttgtatttttagcagagacagggtttcaccatgttagccaggcaggtctcgaactcctgacttaaagtgatctgcccgcctcagcctcccaaagtgctgggattgtaagcgtgaggcaccacgcccggccttatctatcttttggcacaaataatttacattgcaggtgggatgccatggttcacacctgtaatccctgcactttgggaggctgaggcaggcaggggaatcacttgaggctaggagttccagaccaagctgggcaagcatagtgagaccccatcactaccaaaaaaaaaaaaaaaaaaaagttgacaaatgagatcacataggaaggccatagttgtttacagaaaaacagaataacccttaaatgaattttgtgattctattatgtttaaaagcagtccaaggattgaatcccaaacagaagtgagtttagggccatgcataatagaaagcactgtagactatgttcaggaaattagttaatgtagactatgttcaggaagttagttactaaaatagacaggtaagttggtaaaggaatagggtatggatttaaatgtccacaaaattaagtctaaaggaaggtatctcatcttatagaacgcatacaatagttaatgctacaaatatttttaaaaggaatcaaatatcacatcaaattgatctaattatcaacagatctactgggtcttgaagagcaaaccctagactcacactactgtaaactatactgtagttagtcaattataacaactgacattctgtcaacctatctctattaaccaggactcttatttttaagttgaaaaataatttgtgctcagtacgaagcaatgacaggtcttagatgctcttctgcaaggcaatgattggagtatgtacagtaaaattttggggtaataaacagtattcttagaaaaagtgctaatttgtgtgtgagaaaagttggtccagttagtaactatctatatcccagtgcatcctgtctacagtgattaggttttttagaatattctctgaaacacaaaattgcaatatatgaccagtaatatcaactgtagatcttttagctcatctcaaacaagagctgtctgataactcagtaactgccaatttcattactgaaaaataagtgttaaaaaactgagtgatgcttcaatgatacctactctgtaaactccaacctgtcactacatctttaagcgattctaaaatattaacaaacagggttctggacaaagttgtgtgttatagaaaaaaaatttaaataaagaaaaaaattatgaaaaatttgtaagataaaacaaacgggctccttttttgggatcactaataaagcaagtcaattcttcattatgtacacaactgtaagttacttatgagaatctgcaagttcaccctctatatatataagtgggcatttttatttatcactttttttgtagagatgggtttctctatgttgcccaggctggtctcctgcctcaagcaatcttcccgccctggcctcccaaagcaatgggatgacagacgtgagccaccacacttggcccaataagtgagcatttaaaaaatgttaccaccagcctgggcaacatagcaagaccccatctctgcaaaccaaaaaactaaaaaaattagctgggcatgctggcatatgactatagtcctagcgtacttgggaggttgaggtgggagtactgcctgagcccaggagttcaaggttacagttagctgtgatcataccactgcaccccagcctgggcgatagtgagaccttgtctcttaaaaacaaaacaaaacaaaacaaaaagttaattatcatcaatggacattttcaagtgcataccccttgcttcattttatctgtaagccctgtgaattttactacatgattttgtataacataacattcttagaaacatataatgtctcattatagtaaaactgactgcctattttctagctgggattagaaatagaaccaaagttttgctcaagctccccattacactacttccttacaaatcataaggccacctagagatacactaagataaaaatggctgatgagtacttttctccacagcactgctatccaacagaaatataatacaagccacgtaagtatttaaaaattttctagtagccaaataaaaaagtaaaaagaaacaagtaaaattaattttaatatattttatctaaaaatgtattcaaaatattatttcaacatgaaatcagtatgaaattaatgatgtattttatcttttatcatagccttcaatgcccactgtgcaaattacacttgtagcacatgttaatttaaactagtcatatttcaactactcaacagccacatggaatgattagtggctcccaaattagtctggagagtgaaacacaagacaatcatgttataatgttactgcctggtcattatgaataatttaatttatttcatataataggtaaaattttgtacagaaactttaaagcatcactattttcccctcaaaaaattctatacaaaaagtaatgtcaggccgggcgtggtgtctcatgcctataatcccagcactttgggaggccgaggcgggcagatcacctgaggtcaggagttcgagaccaacatggagaaaccctgtctctactaaaaatataaaattagccaggcctcgtgctgcatgcctgtaatcccagctactcgggaggctgaggcaggagaatcacttgaacctgggagacggaggttgcagtgagccgagatcgtgccactgcacttcagcctgggcaacaagagtgaaactccgtctcaaaaaaaaaaaaaagtaatgtcagaacatttgacatcactaataacagaaatgcatgtaacaacagttgctgtttgctacactcacaagattgtgtttgaaaaaaatttatggcaatttcaaaacacattaaatgaacaaaaattaattcaaacaagctaactgaatgatgaagtaaagagttcactgaggaactattttaatttttacagtacacactaccccctagtggacataagacatcatctacttatttcaccacctttcctttgcaaatgaaaaaactgatgctcttaaaagttactgtacccaagtttgctaagctttttaaacttacattatatgatcactccttgctttggtaaaaccaaaccaaagttagcacctacctaaacacgtccttgaaaaagacctatagattccaacagtaaataaaatgaaaatagcttaagaaaactaataaaagcaaaccaagcaaagctaagacaattttgtattccctttctgctttcacctcttgtgcctatcttgctcctaaccacttagactcccccagataagctaactgggtccatgagaatttcctgaaaatgcctatcctaaagtcaaatggagaataatgattctcaagacacacccctcccttgttctttcttttcccttctactcccacatatttaaatctcaaaatttcttaggtggcagattcagagaaggaaaaacggaagaaaaatctatttctaagattctgcgtaccaaagactaaatctcagagtactttagaccagagtattccttttttgggaaaagctttatttatgggttgataggtaacaaataggtaagtactctctattccacttgaagtaataatgaacagatggggccagatgacttgggctagaaatctctacatcctaattttttccctcaaacctagaccagatcaatatttctgtgaagctcagtgaaaaggaatggagacttgggagctggagggacttctgaaagtcaaagtatatataatctgagatacatcagaatgtatctcaggtctgaattagtctaaaagtttctcccttgtacttccagtttcctgttcattaccacctctccacttactgtaactacgcacaataactgctggtttacttctcagaccctaaactatttgaagagaggaaccccagctagtaaatggtggtaaattctaaataaatgcttgcttggtgaacgaacatctgcaatgcttaggtaccacccagagctgatgaggaatactgtatctgctgtgttcattggtaaattccatctcaggaacagcatttaagattattccaatcactgacaatgacaatggacaaaaatcagaataatcctactaacaaattgtcccaccaagaagaaaaactgttaagctgaattcctttatttcttgtctatcttgcctccccaattcttctgcccactaaacacatcaggttgtattatagtctgtgtatattttcctccccaccagtctgtaagccccataaaagcagggaccacatgcaattatcaagcactgtcccagatatacagagaatcaataaaagaaaatctcgggtaacagttaagaacaaactatgccaaatactgacttaagtgctacatatgtattagctcatttaatcctcatactcattttacaactgagaaacaaagagtaatcgaccaaagctagtgaatgacagagtgaagattcaaatccaagctgctgggctctattcagtctggtttcaggatgtgtttcttaatctttttctttcttttttttttgggggggctggggggacagattctcactctgtcacccaggctggagtgcagtgatacaatctcagctcactgcaagctccacctcccgggttcacaccattctcctgcctcagcctccagagtagctgggactacaggcacccaccacctcgcccagctaaattttttgtatttttagtagagacggagtttcaccgtgttagccaggatggtctcgatctcctgacctcgtgatctgccgggcccggcccatgtttcctaatcttgatggtatacaataaagacaattaactacataagcagtaaatgtctaatgtttggcagggacagtaaacagcacgggagttaaaagggctattttcaacccttcataatcgtgaagtggtgcttcatgaaaaaggtaaatttaagccataatgtcataaatttttttttctttttgaactggtaaccagaaaagtatagtcttattaagataaaaataggaaaaaaactgatttgattgaaaaattggtatatactattttgacttggaattatcagatggtaaaccattttgcctatctttgatagtgcatgagatcaacatgctctaaaatgtttcgtgactttgaaatataaatttacttacaaatgtttactcattgctattttgttcatggcattgtggtattaaataactggaaggaagagtaaaacttcttggcatccagcagtttatttcattgtgagtagtcaaggtcttaaggtacaggaggtgtgagttaggatactattaatatatgaagagcagaaccagattacagggctattatgttcttgtttatttctaaagacatttttaaagttttctggaaagattaaaaacctcgtctccatcttttttccctctttgttttttcaaagatttccaaatattggcatcacagctaaagatggtgtcaactattccttcataaaacactcatgaagttcttggtggtaaaaatgtcctttgaatattcagcactataattagtagactcgtggcagtcaagcatctccattttctatggttcctgatttgatgaatgacataacacttcattgcctgaacttttcttagcaccagctcaaaaaataaaaataagactttagtgatttaaataatgtagctgtctatcttaatgaactctgttatctcaggaatgatttgacagagatgtctcagaatgctgaatgaaaagaaaggacctagcttagtaacacagttcattgggactgctgtgtgccatggtcctcgaggcactattaacaaacctattgcatattttaggttctgggagtgggtatataacttagtaggtgaggtaggaaatgttcttctgtattcatcttgaattaaaattagggaaattttttaaaagcctgttttatgtggtgaacactaaaataataagatttattagcaaaaaccagtgaacttggtttttttctttgatccagcttttatgtaaaaaatgatgtagattgtgggttttttctttcataaaattttacttgtttttttcaagttggtaattcatttcaggcccttatgtgtaattttagtcatttgtctatgttaactattaaacaatgttaaaaattcccccactcattcatatgttcctttagctcccactctttagtataatgttggagctgggagataagaaaattgtaaaaattttaagtaacttgtagaaaaagaaaaacttacccgtggtcacacaaaaggactgcctggaagcatttagggcaaaatgaggttggtagtatgcatccagcacttcttgcgcatcacaagcaaagaaataacccattctggagagaactgcagtagttaccactaagacagcagcagagttctagtggtagcattctgcgcttgacatcaataatcacaccgcacacactgtagaatgtgttgcacacagtgtgagcactgaaatcatcgtgatgtgattctgaagtttgttcctggctccctcttttctttggccctcctgaagaatgtgtgaggtaactaataactcttaatatcatttctgcttaaactagccaaagctggcttctgttggttgctaaaatgaagtctaaactcaataggaaaggaagtgaagaaaaggttaagagttagcagaccaaggcaggagggggttgggggctggtaaatacgttaagaagctaaataactctttgggattaaatgaagtcaaaagaggagagcatacaagtcaaccaatctctttatcaaagaacttctacttaaaaccttttagaggaggagctaatttcacattagacagttaaattcaactaagcagcctggtgtacctagcgtggggagggggaagaggctcaagagttagcacatctgaatttaattccaattttaattgtaccaatgtgatatgtgaccacagacaaatcatttacctctccagccttctaaaatgtcccttgaacatttaaaaggttctctatagcaccaaaattgtctgaatactttattattattagaatgagttgaatcttattgctatatgcttctttctactggaaggtccccttttgtaataacattctttaggcctataattactgttttagtcttccctgctgaaggagaaggatattatgaactgtcatcctggtatttatgccaacgttcaatatctaaataaagagaaaatttgttgctaagggcacctgcttttttcccaagtttttttcacttgctcattaaagaaatacataaaattaatctaaataaaattagccattctcctaataaccaaaatccaattaacattctagaatgttttttgttgttgttgttctgataaagacaaaagcccttaaaaacagtttaatatgtttacattttttcactcctgtgtcactgcagccactttcctcaaggctagttgatttacagacaaatcaatattctttaaaaaccatacggcataaacaggtacttttcctggcctacaagctagtgactatactagtatagctaccatgtatttacttactcgaccctttttcttcaggttacttctggtttcaaatgcagcaatcacaacaaaatttaatgcctgaggactccataataggtaaggcaagacaagaacagatggaagcagagcagttgaacttttcagcgaagcaaacaaaaaaacaagttacatttcgctcagatttgcattctcaatccaattgtaccagtaacacaattttgtataaaatccaaaccatcaggaaagaaaaattaaaacagtctttcacactctgcatactaactctgagataaattaggaaacatgaaagcatgcagatattggagggttgtctcccacacagtaagcatcctctctcagggctaaccataccgcacagcttcaggagaggaccattcgtatgacagtctgcataaatggcgcctcttgaagttatacagtgaaatactttggattaaaaaataaaacttcaatttagcagttgcaaagatcaactttattattacctaacccatggaaaatggattacacatatgataattttaatgaaatcaaaatgttatttacccaaaacatcccattttgctatccactgtcggtaaatgagcattcattgtgctttcacaaaatctatgcctcacttcagagagttatatttaatgttatctattttgtgaaacaaatacataaatgaactttgtttcgtttatgaaacgaacaaaccattttcccacacactaggaagacattcaatctttttatgtttatggtgaagcagcatctttgcaaagtcagaaaacagtaataaccaacactacataaggctcagtattacgttagggtctgttctttacattctaatccttccaattaccatagagctagattagtatattaagcagataaagaagcagagaggtcaaatgaggttgcccaagctaatatttggcagagctagaaatcaaactcaagagtctggcctcagattctttgttcctgccatacataaacatacatttcatattccctaaatcagtgttttgctctagagaattaggaagtaaggctctctgagccataaaacattattttagtcatgaaaagcagcatttctaccatcttgaaagtcaattgtcaattaagaggtcagcaaaagactacagtaggaatgaaccttctgtaagccatcccttacacactttgctaccttactgtctctccaactaaactagttcctagagatcaaggcctgtgtctaacatttgcagacccaatgttggacaccagtgtgtcttgcatttcttactggttaatgaacagatcaactgcagaactacctgagaccaaccccacagagtaaggaaaaccactgactgggttaaaaggaaattcaagaacttccaaaaatagtaggcctagccaagcagtgactgcaaagagcaggagtatgcagaaaaaaagacttgcaagactccaaaccgaatctttacaaactatttcacacgtctgtccaaaagccttagctttgacactattcctacaggtcatacacttaaatggaccaattacgaagcaccagagataccagccttatcacttcttttgcccctctaggcagcttcaacaatctaataagcattttcctcaatttaaaaaagtgatcattgcctcaataatcacgagttgacatattaaagatgattctttcccctacctcaaggttttgggaagaatctgaaatgaaacagcttggttagggactttaatatttcacagattatcaattaggtctgaaatttgaacagtcttaagagatccagctggagtaaataactcagcagattttttactcttctgtgatttcagattatctcgtcctgcactactaagccagaagaggaaatgatccagacaactcagattttaatgtaactgaaataagcacaaacttacacactagggctgatgtattacaatagagtacgatggacaataatactgggtcaaattcatccacttcatgtggacagcttgagtctccgaaagaatgcgacaatacattcaaagaacataaatgctggaatcagttcttgctagcaacacgagccagcaatgttattatgtgaaactgcatccaaaaaaaaaaaaaaaaaagctacaaagtcataaaaatagccctgagaataactaatttgaatagtgtaagtaaacagttttcttgaggaaggaaatcgggtggctggaacacaggtaggagacaccctgcaagtcaaacaagcttaatcaaaacaagagctaaaaaaaccctataaaacccctaatctgacaagtctgaagtcaagccacatactgccacatctcaagggcttcttacccatccctatctatcctgggctgggccaggccaggcagttttctaaaaaatctctgccttaggaaactagtaagtcagatataaagtcaatcaatgtctctcactttccttctacacttttgtgattctggaggtaggactctgccaggggctcctagtttaagtctgcagataagggagtgttaagggaaaactgcgagagacgacagtgctgtctcccctctcatgggtgcatcagcagatttttttttttttaagctcatcggctatcattagtgttagtgtattttatgtgtggcctaagacaattctttttttttttcttttgtcgcccagactggagtgcagtggcacgatctcggctcactgcagcctctgcttcccaggttgaagcaattctcccacctcagcctcccaagtagctgggattacaggcgtgtgccaccacacccagctaatttttgtatttttagtagagacagggtttcaccatgttggccaggctggtctcgagctcctgacctcaagggattggcccgcctcagcctcccaaagggctgggattacaggcgtgagccaccatgcccagccatgagacaattcttattccactgtggcccagggaagccaaaaggttggaaatccctgttctaaagcaatgcaggcttcacatgtgactagttttatgagagccaatacagattacctatctcctaaaaattctaccttgcttcccttcagcactatcactttttaaaaggttttatttagaaaacacttcaggtaaaatatttacaaaggaatgaagtactaatacatgctacaatatacatgaaccttgaaaacatgctaaatgaaagaagccagaaagaaaaggccacatattgtataattccatttatatgaagtgtgtacaataggaaaatccatagaattggaaagcagataaatggttgccaggggttgaaggtagagtgactgctaatgagcacagggtttttctttttggggtgacaaaaatcttctggaattagcaagtgatgatgttgtactactttgtgaatacatgaaaaaaccactaaactgtacactttgagtgggtgaattttatggtatgagaattatacctcaaaaaaataaatgaagcatttgagttttccttcaatattcagtgagattttggaatcttaccgatgaattagagattggaatagtaaaagtaagtgaagggaaaataaatatctattacttgactatttagtatataacatattcacagcatgttaacagagttttcagttttttgagataggatcttgctctgtcgcccaggctagagtatagtgacacaatcttggctcactgccgcctcaacctcccaggctcaagtgatcctcccatttcaccctcccaactagtagctgggactacagacatgtgccaccacacctggctaatttttgtatttttttgtagacatggggcttcttcatgttgcccaggcttttctcaaattcttgggctcaagcaatctacttgcttcagcctcccaaagtgctgggatcacagacatgagccaccgcacccagccaacagaaattttagtaatgaatatatattcatggactacacttctgaagaaaagaaacttcaagttaaaagattacttttgaagctaagtatctgtgatccaagcatagacatgctgactcaagttacacagtcttagttcaaatatctcctgggtctggtatgtcgacattctactcccccttttctacttatgcttcaaaattcagctcaaatatcatcctctaaaaacctttccctaaaccaaccttgagggttttccaggccagtctgtcacttctttggtgttcccattgatgcctttgtattcaatatacaaagcagtgctagctgtatgattttacttttgtctcccattctacccatctttgcattgaagccaagcacacatatgaccagtgtttctgcaaagtgtacactaaaatcataagcagctcttaaaacaacaaaaatatgttgggctggcaatgttaaatttacaaacttccccagataattccaatgtataaccatgaactaagtactcagactagaaacaagtgttcagagaaaatagcccatagattcttgtcttggcatccttgccaatacatcagcagccctgccaattaaactaggagaagaaataggcaaggtctggccaagtacttctctaagcacagtcagtgctggcccctgaacagaacttgcagcacttttagtttaacccttacctgaaccacaacaataaagacagggtcctggacagtgcactttatttgaaaaagtgtaggccaggcgcggtggctcatgcctgtaatcccagcacttttggaggctgaggcgggcggatcacgaggtcaggagttcaagatcagcctgaccaacatggtgaaaccccgtctctactaaaaataccaaaattagctgggtgtggtggtgcacgcctgtagtcccagctactcaggaggctgaggaagtagagctgcttgaacccaggaggcggaggttgcagtgagccaagatcacaccattgcactccagcctgggcgacagagggagactctgtctcaaaaaaaaaaaaagaaagaaagaaaacacaaaactcaacttgatatataaatgaatgcaagataactctaacatatttttagacttactgagaaaaaaaattctcgtttaaaattagtctgattcagtggtactttaaatacagtcatgcgctgtatgagtttcagtcaatgatcaactgcacaaaagacagtggtcccacaacattataatggaactgaaaaattcctattgcctagtatttactatactatacttttattgattattttagagtgtattccttctgcttgttaaaaaaaaaaaaaaaagttgactgtaaaacaggttcaggcaggtccttcaggaggtattccagaaggcactgttgtcacaggagatgacagctccatgtgtgttactgcccctgaagaccttcgagtaggacaagaggagctggaagacagtgatactgctgatcctgaataggcctaatatgtgtgtgtatgtcttagtttttcacaaaaaagtttttttaaaaaagattgtaagagaaaaaagcttataggatataaagaaaatatatttttgcacagctgtatgatgtgtgttttaagctaaatgttaatacaaaaaaatcaaaagtttaaaaatataagtttataaaataaaaaagttacagtaagccaaggcttattattgaagaaacattttaaaaaattttttggtgtagcctaagtgtacaatgcttataaagtctatcgtagtgtacagtaatgtcctagcccttcaaatccactcaccactcactcacccagggcaacttccagtcctgcaagcttccttcatggttaagtgccctatacaggtataccattttttatcttttataccagatttttactgtacctttcctattttgatacacacatacttaccactgcattacaactgcctacagtattaagtacagtaacatattaaacaggtttgtagcctaggatcaacagactatacaacatagcctaggtgtgtagcatgctacactatctaggtttgtataaatatactctatgatgttcacacaatgatgaaattgcctatggtgcatttctcagaaagtaactccatcgttaagtgattcaagactgtatattttgccggtaagaaagagcagcaaagagtcccttctcaccagaaccacaaaattcctcaaatccaggactggctgggtggggagggggaggaaaagaatatgccatccagaccagaggcattccatcttaaagtgaactatgttactaaacagggtctcatgtttgtaggaaagcctctaattaaattacaataaagagacttctgattaaaaaaaaccaagaaaagcggcaggctcagtggctcacgcctgtaatcccaacactgtgggaggctgagacaggaggatcacttgagcccaggagttcaaaaccagcctgagcaacatagggagaccctgtctctatgtaatatatattatatatgtatatatattttatattgtacataatatatattttatatatatataaaaaatttttttaaattagttggggatggtagtgcatgcctgtgatcccagctactcgggatgctgaggctgcagtgagccatgatcatgcctgggcaacacagtgagaccctatcttaaaaaaaaaaacacagccaagcgcagtggctcatgcctgtaatcccagcactttgggaggccaaggcgggcgaatcacaaggtcaggagttcgagaccagcctggccaacatggtgaaaccccgtctctactaaaaatacaaaaattagccgggtgtggtggcgggcacctgtaatcccagctactcggaaggctgaggcaggagaatcgcttgaacctgggaggcagagattgcagtgagccgagatcgtgccattgcactcccagcctgggcaacaagagcaaaactccgtctcaaaaaaagccaaccaaccaaccaaacaaacaaaacacaacccaaaacaagtaagctaagcacttagatcctgttcttaaacatgtttccacttcatgtgtccaaatgatacagtataaaaatacatgcactgccagttattatctaggaatagacatgttcttcagtatccacagtctacagaatcagaccacctgggttcaaatcatagctctagaaactaataagtccctctgtgcaggttcccatagctataaaataggaatgatactaatatccacacatcataaaactgcaattagaattaagtaaattaatgcacgtaacatgcttagaacagtgcctggtacacgatgccaatgaaagatgtctatttttacataataaaaactatatgaccaacctcacttcaggaacagctgccacactgcatgctagtgaatagttcacagactaaatatgaatttcataattagaaacactttgtttgcctaacaattcttgatgccaactctttgaacacagtcattaaacagtaataattatttttgatgagaccctgattctattatccatcacatactatatttctagatgatgccatgctttctgtctctccttccagctttcatatctgctgccccatgtgccaaaaactcactcacactccctccttctcttggcccagcaaactcttactcttcaagtttaaaaacacttcctcggctgggcgcggtggctcctgcctgtaatcccagcactctgggaggctgaggcgggcggatcacgaggtcaggagtttgagaccagcctgaccaacatggtgaaaccctgtctctactaaaaataccaaaattagccgggtgtggtggcgtgcacctgtaatcccagctactcaggaggctgaggcaggagaattgcttgaacccgggaggcagaggttgcagtgagccaagtcacgtcactgcattccagcctgggccacagaaatttgtttcatgactgtgttttccattacacagggatgcctttcttgttcacctggcttactggtaaatgcatattatgcattcaatgaatgtccaattaattgaactgaaaaaaaatctcatgaatggataataaagagacacgcaaatcacaaggttacagaaaactgaaatttggccttgggatcggcctatgttactaaaaccactttgtccctgcctcatagtaagatggtaatctagttgtctttaagagtcacaaaaaaaaaaaaacaaaacaaaacagctacttactaacattttcccgagtataagctataatcttaagaaagttacagagcaataaaaaaatcaccaatggtttcatgatataaatttgttagttctttctagtgtttccttaactacaatgccttcaatccctagaactgtaaagactttcaaaatataaattcatttgcccaaaattaaccaaactgacagagacataatgtgaaggtattgaaaactaaaaaaaaaattgaaaatctaaagacaacatagccagttgttttaatgcaaaatatgtcaaccttagattctgaaaccagtatctaaaattactttaaattacagtagaatcctaattattcagaagcatctcagttactggccaattcaaaaccaaaaatgtctgtgcctaagtactcaagaaattttagaatagcttcattcaggtttttttttttttttgagacggagtcttgctctgttgcccaggctggagtgcagtggggtgatctccgctcactgcaagctctgctgctcccgggttcacaccattctcctgcctcagcctcccgactagctgggactacaggcacccaccaccacgcccagctaatttttttgtatttttagtagagacggggtttcaccatgttagccaggatggtctcgatctcctgaccttgtgatcctcctgcctcggcctcccaaagtgctgggattacaggcgtgagccaccgcgcctggccaggatttttaaaaaatataaaatgcccccaatggtgtcatgtagcccttgaaagaatgaataataatgaagtatttctgttgattctgagggctcttaaccaattatccagttcttccaaccacacagtcatgtttctgccacaaaagaccctagggccatcaatcacttcacttgggaagaaattttaaaagctgctaagattttagctgaagttaaaagattccctattatttaattgcctaattggtatatccacattcattccttcatatattacatttgcaaagaaaatttcaactctaatgaaacaacagtccaactcgtttttcgcatacacacataagaattcttttccttgatataatattattacataaactatgcctctcatatttattttgtttttagaaagcagcactgtataagatacgaatttggcacctaaatcagaactctgattactataattgtaatgtcaaaagcccctgctggatgctgctgtcctcatttccttgtttctagtatttatttctatagcacatatgcatccatagttcattataacagaaaacataatgtgtgttcagaatccatacaacttgaatctgtagcatattttcttcttaaatccatttacacaggtaaactatcctataaggtatagggaaaaaagaagaagaaccgaattgtacatcaggaatctggtcatccaacttctttggcctacaaattcctcaccagagaaagaaaaggatagaacagatgttctctaatgtgtaaaactctggtggctcactcccgtagtcccagcactttaggaggccgaggtgggtggatcacgaggtcaggagattgaaaccatcctggccaacatggtgaaacccgtctctactaaaaataaaaaaaaattagctgggtgtggtggcgcgtgcctgtaattccagctactcgggaggctgaggcaggagaatcgcttgaacctgggaggtggagattgcagttagccgagttcgtgccactgcactccagcctggcgacagagcgagactccgtctcaacaaaaaaaaactctggttttaagagtggtcattaacacgtgtggaaaaaattccaaacttgagcaaagcaaatgcataacatttccagtcacagtcatttagcacagtgaatactaaagtacttgataatttgacaaaacttaatttcacttgtgcaggagttgatcaatctggactaaaggaactgcttgacacagaggagcttaaaaaagaatactgaactgactgctatttttaacttactttcagttatgctcacatttcataatcaaaacattagatagtatattaaaacagtatctttagagcctgaaagtttaatcactatcaaaagcagttcaaggattcttaacatggagcacatggagacctagggaatccacaaataaacttggcaagaatctgaatccccagaagtcatacgttaaaaaaaatagctttttttcctaggaagaggtcagaaaattcttaagtgagacaactgaaagaactaaagaaccactgttcctagtcaaattttttacaagttttttcttaaattccaaaggtgattttaattacaacttataacaaatctgtcttcatcataatgagtttgtatttatttatttatttatttatttatttaagagacagggtcttgcctctattacccaggctggggtgcagtggtgccactaatagctcactgcagccccggcctcctggattcaagggatcttcctgcctcagtcttctgttaggattactgcatgaaccaccatacctggctaagtttccctgcccccacctggaggtacatatatttctgaaacatcatggtaacttttccatgcctttttttaattggaagaaaacattatcagacaagtattttcagagcttaaaacaacagataggacaggcgcggtgactcacacctgtagttccagcactttgggaggccgaggtgggcagatcaccaaaggtcaggagttcgagaccagcctgaccaacatggtgaaaccctgcctctactaaaaatacaaaaatcagctgggcgtggtggcatacacctgtaatcccagctactagggaggctgaggcaggagaattgcttgaacccagggggcagaggttgcagttagccgagatcacgccattgcactccagcctgggcaacaaaagcaaaacttcatctcaaaataagaaaaaaaaaatgttcaaggcagagagtaaagctactccagtggctgaggcaggagaactgcttgaacctgggaggcagaggttgtagtaagccgagattgtgccattgcactccaggctgggcaacaaagcaagactcccgtctcaaataaataaaaggtgagttttctaaatcacttttcttacaaaaaaaaataccttatgcactagaatacctatcaaatgagtggcttttaaacagtaacaggaaaaaatgtgtgtacttcaaaaaatcctattaaaaaagtaaactcaagtctcaatgtaaaatcagactgtatctgatttttaagaatttgaggctaaatcacaccaaatagaagagtaaatttttccactgcacttcagcctgggtgacagagaccctgtttcaaaaaattaattaaatgtattttcttaagtaaatttttaagcaccatagacaagggaccagtggggaagggagacataaagtaaattctgcgaaagactggtaaaattctaattccagcaggttgactcactaggttttaatcaaataagtcaacccctagggtaagttaactactttttcccaagactgtattttatcattttcattattatcattattactattttgagacagggtttcactctgtcgcccaggctggagtgcagtggcgcgatctaggctcactgcagcctcaacttcctgggccaaaccaatcctcccacctgtctcctgagtagctgggactacagatgtgtgccacaacacctggctaattttcattttatctttttgtagagacaaggtctcattatgttgtacagcccagtcttgaaaccttgggctcaggggatcctcccgcctcagcctcccaaagtactgagattataggcatgagccacagtgctcagccctcatgattaattctgaaaagaccattaaaggaatgtcagtcactgtatcaacgtaacatgtaaagctgaaacagatttggttttgaccaaggccataactatagatctcacttatcggttcccgaaagtgattctcctttatgacaggattatgcagaacctctcatttgagggacattttaggtacctcctaacctttatgactttaagctttaactgctcacttttttttttttggtggagatggagatctcactatgttcctcaggctggtctcaactcctggcttcaagcaatccttgggcctcagtctcccaaagagctgttattacaggtgtgaaccaccatgcccagcttcagtcacttttattggctaaaagagctttggtccagaagataaggcagaaaaacgaaactaaagattctagcttaaaacagaactactaagactcaatatcactcacacttgtgcaaaatgccatacatacaaaacttcgttacagcattttttatatagcacaatttaggaaacattctgaaagttatgaataagcaattagttacaataaagtctaggccaggcacggtggttcatgcctgttaaccctagcactttgggaggccgaggtggaagaatcacttgagcctaggagctcgagaacagcctaggcaacatggcaagaccccatctctactgaaaaagtattaaatttccaatatttgaaaaaataaaataaagtctaaccataaggttccattaaacagccctttgagaaaaaaaaaagagccaaagcagaacactatgatgcatgtctgtaatcccagatactggaggctgaaggtagagatcacctgatattaggaattcgaggctgtatgtatatagtgtactatgatcacgcctgtgaaaagccactgcactccagcctgggcaacaaagcagcagtctgtctcttaaaaaaaaaaaaaagtcaacttgaagatacataggtggttagaggggaagagaagggaatcaaggtatttgcatgagaaggagaagacgcctaacttatagcagaaagttgctctggtcttcttgtaaggatacacaataaaaatagtggttgaagtcgggtgcagtggctcacacctgtaatcctagcactttgggaggctgaggcaggtggatcacttgagaagaggagtttgagaccagcatggccaacatggtgaaaccccatctctactaaaaattagccaggtgtggtggcacatgcctgcagtctcagctacttaagagactgaggcaggagaatcacttgaacctgggaggtggagtttgcagtgagccaaaattgcaccactgcactccagcctgggcaacagggggagactccgtctcaacaaacaaacaaacaaacaaaaacagtggttttctaagcaggggaactggaatgctgaaggacagatgagggattctctacgtatccttcagagcctttcaaatgtgctctatgtgtgcatttcctagttaataaaaaaagatacataagcagagtaggcacacaaaaaagaaataatgtaaaagattgatgtcctttttaagtgagcttatgggtggaaaacgagactagctttaacttttagctcagacattggttcagacagaatataccaaggagtaacaatgtcaaattattgctcattgagattaaggctcatctattcagttagtctattaatatttcagtatctactatgtgccaaggattggtctaggcacgaatgagcaatgcccgggatatccaagagtccctaacttcatgaaggtttaatggggaatagagagaaataaacagtaaataacataacttcgaacagtaataagcacttatacagaagaaagggagataggaggataaaattgtgggggaggaaaaagggaaactggtttatacgggacaggttaggtagagggtatgacatatgagctaagaacggaacaactggacaaagcaagcaatgcaacaaactggaggaaagtcctgtgactggaataagctcaaccacttattgttcagggtacagcaaagcaacagtgtggctacagtggagtgacccagagagagaagtgcagatgcgctcagaagtaggcatcccaaatgaatgcagggccttatagctaaggggtgggggggaaggcaagattctaatgtaagtgtgatggagaacctctacagtttttagcaggggagtaacatggtctatattttaagaagataacactagctgctgctccaaagtaggctaatacaggaggccaggcagtaaatgatggaagtgaacagaggtttgaaagacaggggggaaagtgtctgatttagtacatatattgaaagcagaacctacagaatttgctactggattagatacaggaatctaaatgagatagcaactgggtgaatagtagtccagaaaatcatcttgtatttgtagttagtcattttacagtaacaagagacaggggaatgttacactaatcaagatccaaattctgcctcttaccagctttaccttaggaaagtcatttaagtcagtttctagactgcaaaatatattgtctagttcacaaaaatgtctgtaagaatcaaatggttaagaaatctacaaatgtaaatagtgatcattataagttagaaagcatcatattaacagtcatgcaaatcaagccaccttattttaacattttcattagatgagaatgctaacactgatgttatatcaacactaaatttcatcctttgaaagtcaaaggtcaggcggggcacagtggctcacgcctgtgatcccagcactgtgggaggctgaaatgggtggattgtgtgaggtcaagagtttgagaccagcctgggcaacatggcgaaaccccgtccctacaaaaattagctgggtgtggtggcatgcaccttgcagtcccagctattgaagaggcttaagtgggaggatcatctaagaccaggagatcaaggctgtggtaagccatgatcctgccactgcactgcagcctgggagcggagtgagacgagtctcaagaaaagaaaacagaaagaaaagaagaaagtcaaagatcacccagaaataaaacaaattaacagtccaatcaacaaagtcatgtccctattgcctcaggacaataccgttacccccatccaccacacagaagtttgtatagtgattgacagaaaagaggcaacttttaaaaataaattctgattttttttaaagcattgtcactgattatggaacaacctacataacacaagcatggacacttttaaaaatctagtcttttagtcttctgtttaaggattagagaaaaccatccttttaagctataaatgacactaaactagtaagataaaacccaaatcaaggtgtcattcattagatagatgttgtcaacaagataccgtaaaattaagattatatatcacagtatgagttactgtcttagtttcaacagcaaaatgtaaatgcccagtgtaaattactgtgtgccaaatggattgaatcatgaggacttcaacttattgccttaaaccatttctgtaaatttataaacaaggttccacagaatttattttttcatccaaggctttcatattactgggcatatcttcataatcaaaaatagaaaaatgcgtgttaaatgtttagttcactatgtatttcagagaattatcatgaatgtcaacttgcattatgtacttagtcaataacctaagtaacaacgaaaacaaggatatttgatgtatggctctatcactccctattcatttttcaactggggcctcaataaacatgacctttggggaccatgtgactgcattataactaaaaccacgttgtacggacctgccaatacatatgacaattaaaactccttggacagaatcctagataaatccacacacaacaaatttcggactatgaagattcacattattagactccagtgctccctgacaatctgttctacttctctcatttctaagaatttctaccatacaaaaacgtcttatttctctacatcagcacccttaggtcagtgacatctccctcatctcagatatatttaaatgcaattggatgaagcagtatacagtacatcatcctcgaagcctaacaggtcttccacttagtatgcatctccccacagatttcacaagaatgagcaagattaacatacacgttcaccaggttatatcaagcaaaatgatgctgcaattgagtcactttaactggcgcatttagtcacataaatgtgcaactaatttccttcataaaaaccgacacaaaaatttaaggtttagttgttgtgatgacaaggaatatctcacgtctgaagacttgtcgatatttccttaagactttacaaaatcaaagaatcgaaaatgtcatggttccatacatacttgtcaaaacacagtattcataaacagccaattaataattaaaacgcacaaaattgaggggcaaaagatttcacgagatcccccacagaggccaaggtaggaagatctctgaagccaggagttttggaagccgcctgggcactatagcgaggcctcatatctacgaaaaagagaggagaggagagaagaggagagagaaagagaatcccccataactgcggccctcccccagccttgtgttaaaactatttcctcggaacagctctgaaagagtttgccaaccagagtaaaatcacttcgcagagataaacgagcggaaacgtattcagaagagagagatcgcggaagcaagggcagcggggcgcggggcccccacgtcccgggacccaggcagccgcggcaaccaggggcgagcatgtgctgaccgcggcaggacgcgcgggcctcccagagccacttcccggggcgcagggccccgcccggcctgaccctcccggttcattcattctgcacccgcggttgccgcacctccgcggccccgtcggggcggagaagaggggcttggctgccgagggaccttgtcgggccacaatccccaccaggcgcccgagccccgccgcgattcccgcgcgcccgcggcctccggcgggggggtggtctcagaagctatggaggcccgcgcccaagcccagagacccccagccttgccgccccaccctccgccggggcgtgggacagcactccctggcccgccgggcagccgcctggaagccccgggtccccgctgtccggctgccccgccgcggccggaagtctccccggcgccccctcctcagcacccgacttccctcgccgccgcggccaacccctctccgcgccgcctcgggcctcccagagcgggccgcgggccgaaggaggcgagaggccgcgctgcctgcccagctgagccgacgagagcagagcgaagagctggaggccggcctgggcggttaccttgatgatcctgcggggcagcccggccatcttgtcagaacccgagttcggcctctggtctcgtctccggctcctctcgcctcacgcacgagtggaagtcccgggctccacttccgggggacgttgccgcgcccgtcgccgcagccgccgccgaggcccctcgggaaatgtagtccctgctcgggcgcgggctcgggcacgggcgggcttccctccgacctggccccctcccccgtgcgccccgccccaaccgctgccggggatggcggaagtgacgctctgttgcggggcagggacttgggacaggccgcgaggggaggcgcggggctctggcgctcgtggccgagcctgcccgcgacggtggtacggcacgacccgcgcgcgactgcgcgcgcgtctctcttaaccgtggccacgcccgcgccggtggacgacgtaacagaggcctggcctacgacgtatcccattcattcattcacgcgttcgttctttcagctcacgcgttcgttctttcagctcagcctgcattgcgcgcgttccctgctggctctgcagtgaacgactgaggtggggctcatcgtcttgctccttcctcaaagggagggcaagaccgaaactcggtggcaaagctctgactgggggtctctccagttactcacacgctgttgggggagttttgatgtttaaattgtataaatcggacctctgacacgcccctaggcccagggtaggctgaaggaaaagggtttggagcgagttggaggcgggaagaatggttctgaacgcctagacctaaaggttgagactcagaattgttaacaggacgaatgaccaaggagaggtttaaagaacccagagtaatccgtaaagcagagattacctatagagtgcgaggtcctatgagagaattagagtgggggtgcccgaaaattgaattgttggggaagcgttttatcctgatgacggatggtttgctgtgtgatggactgtttgcaagcactttacttcatcttcacagcaatcgtgaggaggtgttgtttccattttacaaatgaggcttagatagttaaccttttccaaggagctgttttgtccccaggcagatccgccaagacctggcccttaactacttaaccacagtgtttcctagcacactaacagacagtagatggtgaataaatgaagacaagactgaccgtgccttccaggaacttagattccaatggagaagagagaccagtaaacaattagttacaatccaatgtgttaagggctgtctgtaatacaggttcctccaaggtgctattttagcagagaggcattaactgcttgagaactcagggaagccttcttaaataagtgaagtcctcaatgatgagtaagaacctacctgaccttgtagggaagagtatgccaagcataggaaatggcctgtgaaatggcattgagctatgagagagaaaaaatagtgcactaaagaaactggaactctgaatacaagaaacctactaagaacaataagaaatattttgtgctggcacgatgctaaatggttaataaatttaatacatcattcaattatgaaacagatgaagtagtctctattattaacagaacgttttagatgagaagccaaggttcagaggtaataatgagaatttcaaataaccagaagtctgcaataggtggttctgtgactagaagaatctgcaaaagtaaatgaaactggacaaagatacttttcagaatattttatagaggacccaggataattcatgctggtaggcagaaaggcagagtgctattgtgttgggagtgtgtaggtctgcagtctgggcagggcttggcaggaaggcacactctgcttgtgctgcatcagcctgtgcaaccagaagattggcttccatgatggttcacaaggcgggcaagttggtgctggctgttagtttcactccaagtgggcctctccctggggcatcttgggcttccccattgcatggtggctgggctccaagagtaagtgttctagcaagctgaaatggacactaaatcgccttttttgacccagccgtggaaatcacatggcctcgtggaagtcaaatggcatcacaataaccataatccatcagtcaatcagccacaaaactcaccctgtctcaaggggcagggaacatggacaccacctcttgaaaggggagctgcaagactctaggaactagcagcatatatgtgatggaaagtatggttgtggccaattttgggaaagaaactgccacatgtacaatatttgtcagagtatgcttaccagccacccgccttggaatcatctagggcactgttttttgttttgttttgttttgttttaaaaaaagcattcctgcagctggagcccttcccccagggattctaattctctaggtcagtgctgagacctgggaatctgcatttaaacatcaggggtaattttgatggatactaacacttgaagacaaaaaattctgaacaaacgagaacaaaaaaaacaataagcaaaacaaaaagaggtgccaggtgctttttttttttatgtttttgagacagagtctctcactgtcacccaagctggagtgcagtgacatgatctcggctcactgcaacctctccctctgagattcaagcagttcttctgcctcagcctccagagtagctgagattacaggcgtgtgccactgccccctgctaatttttgtatttttagtagagatggagtttcaccatgttggctaagctggtcttcaattcctggcctcaagtgatcctcctgcctcggccttccaaaattctgggattacaggtgtgagtcactccacctggcctccttttgtctatcttctattagaacagacaataagtatcatttaggttaagagtgagagctctggagcccccagtcggggtttgaaaacacactttgcttaatttctctgtcctttgttttcttcacctattaaatatacttaccttcatgtggttgttgggaagtttaaatgatgtaatttgtataaggtacttagaacagtacacagcacttagcaatcacttattttttgtaatttgatagaaccatgtgtagttttctttaggaaaccagatttttaaaacttgatagtataaccttgtttggtagagattgctttgatggcataaaattctctgagagtattaacactttaacatatacatttttcctgtctctccaaattgttttttctgttttcttcccctcttgaggacagctcgcactaaactcatctggaaacgaaaatctgaacttccgattcatataaatcctgtggaacaggatatactctagaagaacaggttgtcacagggctgagatacggttctcaaattagagggctagttaagaatcctatttactctaatacagagatagacaacaaaacagtggttacctggagcaggttgtggggtggagtgatggagaatcagagatgtagatcagagggtacaaagtagcagatatttaggacaagtctagagagttaatgtacatgagaacaagcctagagagctaatgtatatgagagctataggtaataagtttacgctatgtatgagattcatgctaaataagtagattttagctactgttgtcacaaaaacataggtaactatgtgagacgatggatatgttaatttgcttcacaatagtaacctatttactattgatacgacatattccataacatcatgttgtataccttcaatataaacaataaaataattttatttggccacgcacagtagctcacccctataactccagcactttgggaggctgaggcaggtggatcactcaaggtcaggagttggagaccagcctgaccaacacggtgaaaccctgtctctactaaaaatacaaaattagctgggtgtggtggtgcatgcatgtaatctcagctacttgggagactgagacaggagaatcgcttaaacctgggaggcagagtttgcagttagccgagatggcaccattgcactccagcctggacaacaagagctaaactaggcctcaaaaaataaataaaataaaataaaatgttttgaggcaaggtctcacttgttgcccagtctggagtgcagtggtgcaaacatggcttactgcagcctcagcctcaacctcctgggctcaagtgggcctcagcctcctgagaagctgggactacagatgcacaccaccatgcccggctaatttttaaattttttagaaacagggtttcaccatgttgcctaggatggtctcgaactcctgggcttaagcgacccctcccacctcagcctcctgaagtgctggattacaagcatgagccaccattcctggccaaaacttatttttaaaaatcctacttactatacccataaaatatggataaaataggatatctaaaaaactgactgatcatgtacctcataaatatatatacctactatgtacccacaaaacatttttttaacaaactaactggattccttcagaggtgggatattgagcagctagagaacaaatgtaaaagggaggctttttactgtgtactcttatactttttgaattacgaaccacgtgaatgttttacctattcaaaatgtgaaatatgtattcagttcacaaatttcaatagactgctcaagaggtattcaaagctctaacagtgctgatcaggaattatataatacactcaaaactcagcaaaaagatgctggtccaggtccatggtactgaataaatgatgacagtggccagatagcttcactaagctgagcagtgctagccataactcttttttttttttttttttaagagacagggtcttgctctgttgccccagactgaagtgcagtggtgcaatcataattcaatgtagtttccaacttctccccactcagcctccaccatgcctgggtaatttttaatttttttgtagagactgggtctggctatgttgtgcaggctggtctcaagctcgtggcctcgagaaattctcctgcctctgcctcccaaaatgctggacttacaggtgtgagccaccatgtctggcccagaactcttttttctttccttttttctttttttttcttttttgagacagagtctctcgctttgttgcccaggctggagtgcagtggtgcgatcacagctcactgcaagctccgcctctcgggttcaagcaattctcctgcctcagccttctgagtagctgggactacaggcgctcatcaccacactcggctaatttttgtattttttagtatagacgggatttcaccatgttggtcaggctggtctcgaactcatgacctcaggtgatccacccacctcagcctcccaaaatgctgagattacagacatgagccaccacgcccagaccagaactcttagctaattagtctttttttggttctttgtcaggccgcactcttctccttgtttttttccagtctctgctccttctgggactcaaagtgcaagtgcctttgcattatcttacaggggacaagcaaataagaatgaatgctatgttggaggcattagaggagtcccattgtatgagaaactcttactcccccaaacaatattttactgccccttgctgcttcctcattacccacccccaaatattccaggttttctactttggtcttgtaatggcagagacctaagtactatttaccctataggcaataacttaggacatatgtgcctgatcttctcagagtcagggatcttctctgtcttggttacctctgtatcctgggcccaagtgcagggactgctacatatatgctctcaaaaaatacttgtcaagggaataaatcagtcggtgcaggctgaatataaacacctgtttgagaatggttgccatagattcatgatccgtaagtgaacacttagagaaagcacaggatgtttatgtcaatctctaaacctttcaacttgactttctggagagcaacagagtttttctacaaactaatgctttgcagaaaaagaatagagtagttcagtttggaaaatggtatatcagtcacctttaatagaggtcctatttcaattcatatacaattgtcatcaggcagaagtatttgtttgcaagttcccttattgtttcttgcagcgtagggaaactgtttcgtgggtgatcaagacagtagaatctgtgagaggaaggttcatgaacactgactcaaacaggcagtaggtggggtgggggtgtgggaagaaaagactgctcactgattttaaaaaaggaagaaaaattgcatggtggcttatattcatgccttcatcataagacattgagcacttacaaactcttaaccagcacaagaccagcctgtaagaaggacctaagtgggatcttccagggtcataggcagtccctaaggagtgctgtctcacatggaagaccctgggaaacatgagacccaggagaatcagagtaatacacctttgctttgtttagtgttttatgctttacaaagtgtttgtgaatgttatctcacctagtgacagctttaagtacctttaagtgcatgcaccactagagtgattttgtaggatccatcattgattctgcaatgttcctataaaagtaaatggagccgggtgaggtggctcatggctgtaatcccagcactttggaggccgaggtgggcggatcacttgaggtcaggagttcgagaccagcctggtcaacatggtgaaccccatgtgtactaaaaatacaaaaaaaaaaaaaaattagctgggcatagtaagtagtacgtgcctgtaatcccagctacttgggaggctgaggcaggagaatcgcttgaacccaggaggtggaggttgcagtgagccgagattgtgccattgcactccagcctaggtgacagagcaagactctgtctcaaataaataaataaataaataaaagtggatggaggagggtgttccacacgtatattcgtctcctttgtctgggccagttcccagtggaaacaggactccagaggttggtaactcaagacatttggccagaagcctggctggaacaggaactctgcaaagcagggctcacttctccgcctgtgtgtcaccctttcaggttcccaggagaactgtttgctttccacgtccctgggcttcagtcacttcgtaactctgccagtgattgcatactcagcccctacccagcctaaactgttctcccacttcctcccacctggtgtgccccacccaagtttctttttaattcactcccatcacctttcttcctccttcaccatcacctgtctgtctcaagtctgattgatttctcccatgtttctctattatgtcacttgctatctgcaaaaaaaaaaaaaaaaaaaaaaaaaattcatctgcttctagtatgattagaaatgtttttgaaattgttatttttcttctaagtgcattgatttgggatccgatataccctggaacagatgttttcaaactttagactgcttgctcacctcagagactagttgaacatactagtgaaggggccctgcccaaggtcttctgagttcaagtcatagtccccatgtctctgtggttttaacaagctccctaggggctactgaagagtctgaagcttgagagtcaatgtcatataatgtgatcttttcaagaaaagcaaaacagttgcaacaggaaccttgacttataatttacttactcctgcttttctaaactcttctgacccaatacctatatctttcctcctgcctgttcaaattcttttggtccaagtgtgagatatttcagatggttgaattttaagttggccccaggtgttcagtattccagattgttgggttttgggtgttcagtattgttcacctctttccactcctgaattttttttttcttttgagacagagtctcgctctgtcgcccaggctggagtgcattggtgcgatctcagctcactgcaccctccacctccccagttcaagcaattctcctgcctcagcctcccgagtagctgggactacaggtgcgcaccaccacgcccagctaatttttgtattttcagtagagacggggtttcaccatgttggccaagatggtcttgatctcctgacctcgtgatctgcccaccttggcctcccaaagtgctgggattacaggcgtgagccaccatacctggctttccactcctgaaattataaccagttgaaaaacacaacagacagaaattaaaatattgctttcattattagtaaatctgattggagaatatagctctaaatcagcagtcagttgggcttactaatgttcccccactagccccataattgcaattatagctacgtagtcacttagcacagctagacaactgcaagctccttaacccaagacagcaaatgggaatgcatgaggccagaggcagggacaaaaaaaaaaaaaaaataggagagagaaaaaatgggaggagggaaagataaaaggctgagcagactgagttcattagtatgaaattcaccaatcagaaaacttattcctcttgtaatcacaaaatcacaaaaccacttgactttttcttttttttttttttttttttttttttggagaaggagtctcgctctgtctcccaggctggagtgcagtggcgcagtctcagctcactgcaagctccgcctcccggggtcacgccattctcctgcctcagcctcccgagtagctgggactgcaggcgcccgccaccacgcctggctaattttttgtatttttagtagagatggggtttcaccatgttagccagcatggtcttgacctcctaacctcctgatccgcccgtctcagcctcccaaagtgctgggattacaggcgtgagccactgcgcccggccccgactttttcttatgcttctgcttacttcttgttgttgttgttgttaatagagatgctgttgtaacatccctattaacaacaacaacaaaaagtaagcagtagcataagaaagatgttatgtgttcaagaccaggctagacaacatgttgttaatagagaacatgttgcctcacctggtcttgaactcctggccttaagtgatcctcccgcctctgccacccaaagtgctggaattataggcatgagccaccacgccaggccccgactgcttactttctatgacaactccctgaaagcaaccccagatcacaacctgggcaatctcttcattgttttgaacgtcctataatgggtcatacttgcactccctctaacaccataattttcacatctggttgccttttcacaagtggttctccaccccatctgcctgatggtttcttgccctcctccatgaatgttatatgtaaaatgtttatttaaaaacagaatgcttgttccttggtaccacaaggaaaaattagcattcagacaaaaattctctcaacgaggcaattttactttctgcagaaagggtgctcctcgcagatggaacaatggtgacagcacatctgaacaaaggagggaagcaatttttattccttatgcagcttgtccttgctactgtgtcctgtctccattggctggagccagacctcacagtctaaactgcacccgattggtaacagcttaaaaacttttaaaaataggtaaaagcaatggagaacagaggaaaagaggaagttgcttaccaaaggacttagaaaagtaataatattcccaaataaggaaggggcataggctgcgagctgggacatgcctgtgagcacgtccagcacaaatatcttggttaaagtacaaggacatagaaagtactatgtgcctgtgagcatgtctaacagctacataggatagggcttaacagagagttatttgcacaaagcaaggaggcttaaaggaagttagtctttaaaagaaattattatttctaacacttatgatttattctttaacaagaagggaaactttgaagaggaaactttttactttctacagtgaagttttctccatgttctccaaaacaccttgttcatcatgttctaacaacagtcacttgtaataatctgtttacctgtctccttcaccacattgtgcacccctttaaggcagggaacaccatattcttctttgttatgtgttcagcagtaacataatggctgcacacattctctccttcctgccttcactcattctctgcctatgatgtattatactagaccatctataggaactttttttttttttttttttgagacagggtctcactctgctgcccaggctggagcgcagtggtgtcatcatggttcactgcaaccccgacttcctgggttcaaactatcctcccatctgagcctcctgaatagctgaaaccataggcacataccaccatgactggctaatttttgtattttttttttttttttgagccaccagccaccacacctggtttaggaactaaattttttttaaattttttttttaaagatagagatggggtcttgctttgttgcccaggctggtctcgaactcctaagctcaagcgatcctctggccttggcctcccaaagtgctgggttcacaggcataagccaccatgcctggtctaggaagtaaatttttttttaatgaacaaggtaggaaaggtaggatctctgatcttgaatttgcatttttttttctttttttttttgagatggagttttgcttttgttgcccaggctggagtgcgatagtgcgatcgcggctcactgcaacctccgcctcccaggctcaagcaattctcctgccttagcctcccaagtagctgggattataggcatgtgccaccacacctggctaattttgtatttttagtagagatggggttgcaccatgttggtcaggctggtctgaaactcctgacctcaggtgatccactcacctcagcctcccaaagtgctgggattacaggcatgagccaccacacctggcttgagcttacattctaataggggaaacagacattaaaaactaatacaatttgatgtgacaagtttttaaactgagatatagaagatgcaatgaggagtatatagaagacagagagaaggcttcttcatccatccaacatttatcccaggctcggtggctcacacctgtaaccccagcactttgggaggccaaggcaggtggatcacctaagttcaggagttcgagaccagcctgaccaacatagtgaaaccccatttctactaaaaatacaaaaattagtcaggcgtggtggcaggcatctgtaatcccagctactcaggaggctgagacaggagaattgcttgactccaggagggggaggttgcagtaagctgagatcatgccattgtactctggcttaggtgacagagtgagactctgtctcaaaaaaacaaaacaaaacaaaaacatttatttggttagcgcccactaagtgccagacactatattagactctgcaagtaaaattatgagcaaaatcagatgaagaactactcttatggggccaggcacggtggctcacacctgtaatcccagcaccttgggaggccgagacgggtgaattactttaagtcaggagttcaagaccagtctggccaacagagtgaaaccccatctctacttaaaatacaaaaacgagctggccacgtccctgtaatcccagctactcaggaggctgaggcacgagaatcgcttgaacccgggaggcagaggttgcaggaaaaaaaactacccttatgggcttacggggaatggaaacataatgttaatagaattgtcaccgagtaagtgcaaaatattatgttagtcagggttcttggttacaggcatggaaactgactcaggctgacttaaacagaaaaggaattcactgggaggacatggggtggttcacacgatcacaggaaaggctgcagaccaggctcaaaaaacttaccggcattcctcctcccaagttttcttttttctttttttcctttgtttggagacaggttcttgctctgtcacccaggctggaatgcagtggtaagatcatagctcattgaaccctcaagctcctgggcttaagcaatcctgcaacctcagcttcagcctcctgagtagctgggactacagatgcaccaccacagccggctaatttttctttttctttttgtacagatggcacctcgctatgctacccaggctagtatctaactcctggcctcaaacaatcctctcgcttggacctccaaagtgttggtattacaggcatgaaccaccatcccagccacctccccagttttccattggactcttctcctctgccctcttctaggtataactttcctaaatccagaatctttgggatttgtatttccatttccaactggggtaggctgttagatatgggagtctgaggtctaattgtgctttatgctgattttcaaatattccatcacttttcagccccctcatccctcctgccttcctaaatacttgatgccaccaattcctgagccttggtgcaacttgcatgcttgactttgctctaccaagtcaggtattccagtttctgtcggcttccatttttgttctcattgttgtttggatgtgatttttgagagatgagggcaaaaacaactttgagttgatgtattttgttgtctttgaggcacaagattattcacataattttttttttgagatgggggtctcactctgtcacccaggctggagtgcagtggcacagtctcggctcactgcaacctctgcctcccaggttcccagtttgaaacgattctcctgcctcagcctcctgactagctgggattacaggcacctgccaccatgccaggctgatttttgtattttttagtagagatggggtttcaccatgttggccaggctggtctggaactcccaacctcaaatgatccacctcccttggcctcccaaagtgctgggattataggcatgagccactgtgcctgctctaatttttatatttttagtagagatggggtttcaccatgttggccaggctggtcttgaacttttgacctcaggtgatctgcctgcctcggcctcccaaagtgctgggattacaggtgtgagccaccatgcctggtcatttacagatttttaaaaaattaacattaaattgattgaagtaacagtaaagtgtagtttttcctcaagtcttcaagtttgatttatagttcttattattcttttttttttttaatttaagttctggtatatatgtgtagaacgcgcaggtttgttacataggaatacatgtgccgtggtggtttgcagcacctatcaactggtcatctgggttttaaaccccacatgcattaggtatttttcctaatgctctccctccccttgccccccacccccgacaggccccggtgtgtgatgttcccctctctgtgtccatgtgttctcaatgtccagctcccacttatgagtgagaacatgaggtgtttggttttctgttcctgtgttagtttgctgagaatgatggcttccagcttcatctatgtacctgcaaaggacatgaactcattctttttgatgactgcaatagttcttattattctatttatagactagcagctaaaataatacttgagtaagttaaatacatttaaatattaattttttttcttttttctaagacagggtctcaccatgttgcctaggctggtcatgaactcctgggctcaagtgatcctcctgtgtcagcctcccaatatgctgggattataggcatgagtcaccatgcctggccatttaaacatttaaaattgcactcataaatctagcgtatatgattttcttttccagcccttcaattttctgactgataaatattctcaagtactaaaataattctcataaattaaaaaaatctaaatatggcaactcacctatgaaatactctaatagtgcttccaaacctaatacaattttttacaccctccaacatagacttataagtctaaattggctacctaaagataaatttttaaaatttatttaaaatttaatttagttttagattcaaggagtacatgtgtatgcctgctacatgactgtatttcacactggtggggatggattggggttctagtgtatcccttatccaaatagtgaacatcgtacctgataggtaatttttcaaccctagtccccctgcaaacttcctccctttgggtgtctattatttccatctttatgtccatgtatgccattgtcaagctaccacttctaagtgagagcacatggtatttgatttcctgtttctgaattagatcacttagaataatagcctccagccctatccacgttgctgcaaaggacatgatttcattcttttttatggctgcatagtgttccatgagatatctatctatctatctatctatctatctatctatctacctatctcacattttctttatgcagccaactgttggtgggcacttaggttggtttcatgactttgctattgtgactagtgctgtgataaacgtatgagtgcaattgtcctttttaatataatgatttctaaggaaatcatttttttgaaaaattgggatcacaaattacagaagacacaaaggacctgggaacatgttaaagtttgccccaaggatgcactcagcaaagtccagactgtgagaatcttttcagggcaaacaacccggtttatttgacaaataaatgcaaggaaaaaaaaaagagagagagagaggaattgaggaggaacgtgtaaattaaagaaacttaaaagtgatctcaaacagttaaaatgcatgcatctaatttggattctgattcaaacaagcaaagcaaattcaaaatatgacatttatgaaccatctggaaagctgtatattcactggatattcgagaatgttaaataatccttgtcaatttttaaaaattgtataatgacatatggttatgttagaagaaaggagttcttacctattagtgtttcttactaagatagttatagatgaaattgcaggctacgtgtgattcgcttcaaaataatataggagaaggtacaatgtgggagtacagatgaaataaaattggccatgagttatcattgttgaagctgaatgagaggtacctagtggtttattgtactattctttctaattttttatatgtttgaaattttctgtaataagaagtctttaaaaattagaatcataggtcaggcacggtggctcatacctgtactttcagcatttgaggagaataaggtgggaggatggcttgagcccaggagtttgagacaagcctgagcaacatggtgagacccccccatctctacattaaaaaaaaaatagctgggcatggtggcacacctgtagttccagctacttgggaggctgaggtggggggatcacttgagtccaggatgtcaaggctgcagtgagccgtgatagtactactgccctccagcctgggtgacagagtgagaccccatgtaagaaaaaaattagaattacaaagataaactaataggccacaaggtgaatataatacattctaaggacttacatatagaatacatgcacacaaatcacatatatagtaatatatgatgtgtatatatgtacataccatatatatgatgtgtacacacatatacacacacagacaaatatacacacatatatatatctgtaatgaaataaaccagatccacctacagtgctattttccagtatacacacacaccatacacacacacacacacacacacacatacacgcatgtctacatcacagattggcatctgcaggggtagagggcagtcttgtgtcttatgagactgggcccttaacccatgggaggtgggaagaatggagaggtcagggtaattattactctgggttactccttcaaggtcacctcaggctggctatgcccttcagttgaaggttacttcccctctcaaggtagctgctgcaggactctctttttctgggctctgataactgctccctctctttgtaccttcaggcctggaggggcatgaaggaacagccagttttactaagcccaaattcttcttctactactactactgctactactattactactactacctgtgattctgtgattccctacatacaactcacacttctgtgaagatactttctgtaaacaaaccctcctgaaaccatcccgatttgagtaagtcatctgttctcttctgggaccctaacagatataccaacctttttgtttttatttttgtttagacagagtctccctctattgcccaggctggagtgcagtggcatgatcttggctcattgcaacctccacttcctggattcaagtgattcttctgcttcagcctcccaagtagctgggactacaggtgtgtgccaccacacccagctaatttttgtatttttagtagagatgggattttgccatgttggccaggctggtctcgaactcctgatctcaggtgatctacccacctcagcctcccaaagtgctgaaattacaggcatgagccactgcgcctggccattattgttcattttagaccagatttattttttcatttttagttacatttattagattattcctggtagtcaaaagggatggcttttatttcttttcttaatgcctaagaaataagttatctccttggtatagattttcacaaataattattagacaagattttgttaagcatctataagatatgattatggttagcattgattgagtgcttactacctgcgaggtactttgctaagctttttgctcactttctgttatttattccactcaacaattctatagattacaggtgtgagccaccgcacccagccagaaaacatattatcttacttttacaaaggataaactgagactcaaaaatattaagtagttaaattaccccaaataacatagttaagaagcaaggggagattcaaatttaggcagctagattctcagactccatttcttaacctctacactctactgcctacctaacattatgctggacctccaggagctataaagaaataattaagatggtcctggctaggcacagtgactcatgcctgtaatccaagcactttgagaggctgaggtgggtggatcacttgaggccaggagttcgagaccagcctgggcaacatgacgaaactcagtctttacaaaaaataacaaaaaattagccgggggtagtggtttgtgcctgtagtcccagtcactagggaggctgaggcgggaggattgcttaagcatgggaagcagaggttgcagcgagctgagatcacaccaatgcattccagcctgggtgacagcacaggaccctgtctcgaaaatgaaaataaataaataaataaataaataaataaataaataaatttctatttaaaaaaagaaataagatggtcctacacatggggagccctttaagatgttaaggatagagaagatattaagtgtaaaactcattttgaatggtcataagaaaacttttgaaggaaaagcagtttataactcgtgatctgtattgtactcagtagaatagaggaccttatatttttatcagtactaatcctttatagatatttttcttgaattatttctgatttgaattattttgattctgtcatttcagataggattagtttccactgttagtaaaagacaaagtattaggttgttgcacagcagcctaatactttgtcttttactaacagagcagcagtttgtcttcacagattatatggcaaattcaattcacttcctcaggaaagcctctcctgtcctgagtacactagtcagatgttcctgatatgtgctccatgacatccctttcctctgagacactcaacataattgtcataaaataattaatcccatcattatatatttaatatctgtcacgctctgactatataatctgtgaagactgctgctctggtgtctggcaaaaattggtgcaattacttttgcactaacttttgccattactgtaaatggcaaaaactgcaattactataacagcagattaaacaagataaaagtctacttctctcttttgtaaaaatctgtagtaggaagtctcaggaaccttgtctacaaagccatcaaaaatccagactctttccagctgactgctccgtcattccaaggtcaaggccatcctgggattctacaataatgatcattaaatccacatgccaagaggaaggatgaagtagggagcaaagagggtgcatactagttggctttaaggaagtcacatgaccacacctaggattgcaagggaagctgaaaaatgtaaatttttttttttttttttttgagacaggctctcggtctgtcatctgggctggagtgcagtggcacaatcttggctcactgcaacgtctgcctcgcaggttcaggtggttctcgtgcctcagcctcctgagtagctgggattacaggcacatgccaccgtgccaggctagttttttgtaaaaaaaaaaaaaaaaagtgtgaattttataattgtgagtaaccatatacccctgaattaggggttctgttaatacagagaaagaggagaaacctctgttagaggatagcttgcagtttctgctatagatttctcagtttctggtgggaacatttatccctatgatttaaggtataacatttatcttaacaaggcaaagcaaacacttcttaaagagaatacttagtgtttactagaaaaacagggtcttgaattttggttaagtttgaaataatgtggtctcctagaaagctttatttgttaatttttttttaggccagtcaagtgaagcagcgggagtggagaaggaacaaagaaatctgtaactggttatgatcaatgagttgtaaacaccgctgcacttgaaccagccagtttttggctgtcaggaataacattaaaataaatctgcctttgccatcagcctcattgcttttgctagcaccctatattctagtcacacaggcctcatttatttatttatttagagacagggtcttgctatgcttcccaggctggtctcgaactcctggcctcaagtgatcctcctgcctcaccacgcccccagccctaccaccagttgctgggattataggctgagctactacaccgtctcttttgtttcttaaaagaatcatactacttcctattttagcgccttcacactggctgttccctccggccctcttcctctacctaacttctactcttccttcacgtttctgcttaaattcgcttcctcaggaaagcctttcctgtcctgagcacactagtcagatgttcctggtatgtgctccatgacatccctttcctctgagaaacagtcatacaataattaatcccatcagtatatatttagtatctgtcaccctctcatgatataatctgtgaagacaaactgctgctctggtgtctggtacatataataggtcctcaataaatatttattagataagtaaatgaattagaataaattaaaaatctaggagttgcaggaaagcacctaataatgaattaactttaaaatgaaaaatatcatcttgagaggctgaggaaggagaatcgcttgagcccaggagtttgagtccaggctggacaaaacaacaagatcccatctcagaaaaaaagatgaaagctatattgtaaggatttctctctctctctttttttttctctttctttttttgagacagggtcttgctatgtcacccaagctggagtgcagtggcgcaaccatgactcactgcagcttcaaccttctgggctcaagtgatcctcccacgtcagcctcctgagtaggtgggactagaggcatatgccatcacacctggctaatttttttaatttttgtagaaacaggggcctcactatgtcacccaggctggtctcaaactcctgggctcaagtaattctcctgccttggcctcccaaagtgctgggattacaggtgtgagccaccatgcccagacttcatttttttttttttgagacggagtctcaccctgttgcccaggctggagtgcaatggcacaatctcggctcactgcaacctccacctcccggcttcaaatgattctcctgcctcagcctcccgaggagctgggattacaggcaccgaccaccacgcccagctaattttgtatttttagtagagacggggtttcaccatgttggccagtctggtcttgaactcctgacctcatgatctgcctgccttgggctcccaaagtgctgggattacaggcatgagccactgcacctggccccagacttcatttttaaaaagcaaaattaaaaattttttgtacagatggggtctcactatgtggcctaggctggtcttaaactcctgggctcaatatatcctcctgccttggcctctgatagtgctgggattacaggcatgagccaccatacccaatgtaaagatctttaataatcaaaataaccctttaagtcctgatgatctctaggaggcttgtggttctacactgacaattttagggtgttcacaggaaaaaatatgtgcatacgtgtatatgtatatttatatatgcatattaacagtaataggagaaaacctaaaaataatgtgtttgtgtgaaagaaagggagattgaaggagaatcgggctatctagttcctatctcagctccacttgccatagaactttagaatagtacacataatgtgctcaataaatgctagctattatcataatatagatataagaagagagctgggtgctgtggctcaagcctgtaatcccaattactcaggaggatgaggcagaaggattgcctgaggccaggagtttgagaccaacctgggcactatagcaagaccctgtctcaaagaaaaaaaagaaaagaaatgtaaagtgaaaagttatatatcaaaatgttagcagtgattatctcttgggttttgtttttaaaatctgcattcatttttttaaaatatgttttatttgttgttgagatgggatcttgctgtgttgctcaggctggttttgaactcattggctcagtcaatcctcctcactcagtctcttgagtagccgggattacaggtgcactccacagcacctagtctaatctatattttgtattttgaaataagcatggctcagcctagcacagtggttaagttcacgagcactggtaatagtagttcctgggttcaaagcacagtaacttgtgtgactttgaacaagttgttcaaacctctctgtgcctctgttacttctgtttgtaaaatgacagtaacaataattgtttaagtgtttagaaagttcattccttttttttttttttttcttgagacagagttttactctgtcgcccaggctggagtgcagtggtgtgatctcggttcactgcaacctctgcctcccaggtacaagtgattcttctgcctcagcctactgagtagctggaattacaggcgtgtgccaccacgcccggctaatttttgtatttttagtagagacggggtttcaccatgttggtcaggctggtctggaactcctgaccttgtgatccgcctgccttggcctcccaaagtgttgagattataggtgtgagccactgtgcccagccagaaagatcattcctaatagtttggtcataagattgctctggagtctttgctctctgattgatacaaagaatgacttttttttctgggaagttacagaagaaaaggcaatcctcttttaaatggaagccatttgatgccaattccaaagttctagaattttgtctgtttgtcattttactagcatgaatttaaagcatttgtagctgagcacagtggctcatgcctataatcccagcactttgggagggtgaagtgtgcggatcacttgaggtgggcggatcacttgaggtcaggagatcgagaccagtctggccaacatggtgaaactccgtctctactaaaaatacaaaaattagctgcgcattgtggtgggcacctgtaatcccagctactcaggaggctgaggcaggagaatcactcgtacccaggaggtggaggttgcagtgagccgagatcacatcactgtactccagcctgggtgacagagcaagactccgtcttaaaaaaataaataaataaaataaaataaagcacttttatgtaggccaatataagttatttgctggtatttcaagtttgtatttttggaaattatactttttaagttgctagcactgacctcttaagttaggaacactttgtgacatggcctctcttaactactcttacatcacagtatttgttttccttctacctttctcactgccactcctgggaggcccttgctaaaggttatcctcctccatctgatttctaagccttcgaattccctggggccagcttctaggccctttatctttttttttctatacctagtccaacctctactctccaaacacacctcttcaagtacctgccttttgttttttgtttttttggagatggggctctcactctgttactcaggctggagtgcagtggcatgaccatagctcactgcagcctcaacctccagggctcaaacgatcctcctacctcagcctccttagtagctgggatcacaggtgtgcatcatcaaccttactaattctgtttattttttgtagagacaaggcctcactcactatattgcccaggctgctgacttgttttgtatctccactggagtgtctcagagccatctcaaactcaacaactcccaaacggaagtatgcatttccaccatcatcagactccccaaacctgttcctctttcagtcttccttgtcttatgaagggcaccactgtcaactagtcatcaaagcatcacctgaagtatcttcctccctctcaatcaatccatcagcaagttaagtcatcacttccaatttcaaaatacatctggactcttcctgtctctccatctccactgccaccaccctccatcacatgatttcttgactgcagtactgcagtagcttccttgctagacttgcctgcggtcttgccactctccaaaccactcctcccagggcagccagagtaaccttttaaaaatggaaatcaaattatgtcacttctttcatgtaaaaatctcaagagacagggctcactctgtcacccaggctggagtgcacggcacgatcatagcttactaccgccttgacctcctgggctcaagcaatcctcccacttcagcctcccattcccagggtaactaggactacaggcacacagcaccacctactctatttaatctctacatatgtcctgtgtcctaactccatgttaacccctccaaggcttatgaagcccaacatgacctggctccaaatctcatctcctgccgctctcatccacactatccaccctactccagtatatggtaagctatttccaccacattaaacctttgtgtaagttgttccctcactcagcctaaacctgtctctcccctctcttcccccaaaaatgttggtttcttttctggtctcagctttgtgagaccttccttggtcccactaagtgagtctccctgttggggactggtcccactctgctcacagccatcaagacttgacctctggaattatctttgatccattcttcttacactttacgcagggaatgttcaaccagtccagttgactgctcattcaaatctgtttctcctctctgtcccttcctattgcacagtccagaaagacatcatgggtggctttggaggatggacacgactggaaaggacacagatgggccctctgtgggcttctataagagcaaagattagcctcctgatattccgtgggaaatgaggagacacactacacagcccgtatttagttttctttactatgtgatgtgtgttcacttactttcaatactagtcacttcaggaatatggttcttaacttgttgaggggtttatcaattccctggaatacataataaaagctatagattatttcttagaaaaatatacaaaagcaaaattttgcaaatcatgggagaagggaatttccaggcgaccgcttctgctttaccagccaatcatctactgtcttggatacttgcagcgttatctagtcttttcattcattcagcaaacacttcctggagacctataatgagaccaagcacagtctgagatgctgggtttgcatacagtgaagaacaagatagacatatgtctctgtcttcaaggagcttacattatccagcataagagacattaaacgaggttgggtgtggtggctcacgcctgtaatccagccctttgagaggccgaggtgggcatatcacctgaggtaaggagttcgagatcagccgggcaaacatggcgaaaccccatctctactaaaaatacagaaattagctgggcgtggtggtggccacctgtaatcccagctaattaggaagctgaggcaggagaatcgcttgaagctgagaggcggaggttgcagtgagctgagatcatgccactgcactccggcctgggcgatagagcaagactccgtctcaaaaaaaaaaaaaaaaagaaagagacattcaacgagcaaacaaataatcaatataaagtcaggtaatggtaaatattctgaaggaaaataaagcggggcatggaataagggtgggtgaggctattttaatggtgtggtcctttctaagatgatatttgagaaagacctgtaaggtcatgagaagaggtcagagaagcacattgctggcaatgggaacagagagtgcaaaggcccagaggtctttccttcctcctaagatggaaagcgaggtccaagattctgcatatttacttcctcccataataggtagccagcacagttctgagggcacagtgccaggttttcagagtggaggttctcttcaggttctgatttcaaacgtccaaatcctagcctccacatttcagggcttctctggaatgtctcttcccctgggaaactttaactcatctactaaagagcaatctacgatttctctgaatattaacataatttttttaaaaagtacttataggtttgcatggtggctcatgcctgtaattccagcactttgggacgccgaggcaggaggattgcttgagacaagcctgggcaacataccgagacctcgtctctacaaaaatattaaaaaattagctgggtgtggtggtgtgcgcctgtagtaccagctactcaggaggctgaggtgggaggctctcttgggcccaggaggtagaggctgcagtgagccgtgagggagccattgcactccagtctgggtgacagaatgagactgcctcacaaaaaaaaaaaaaaaaaaaagcttgttactttctaagggtatgtgtttggggcagtgattttgtttttctgggcaccttagtaacactgcggccacgcttccccaactaaaggtaaaagtccatagcaacaatcctccctttctctctgcacccgggccgctttcccgcggagactacatttcccagaatgccccgcgggctgggacggcgcgcgcagcgctgtttcgtgggaccaggattgaaacaagatggcgggttcgtggtgagaagccgtcaaggtaaccgcttccctctactcctcctgtcgaggacttcctcgaaactgggcagtcccacagtgttggtcggcagttgtagaggtctcccgcctgtcgttcccggcagggcgaggttgcctgcatccccagcctttgtccttcctgcagaagagccggcatgtggctgcgcgtttcttatagcgccccctttgttccctggcggacgcccgtggggaggtgatgcagcttgtggctctagggactcctttaggtcgaagagttctggtgctcttggtagcctgttcctcaaacctctgaccctcagaggctctgtagcttttgttttggggttgaattccgggctgagggacttgatctctgaaatgatcttcctggggtgaataatctgactcccagcagggcgtgcttttctctgggcttcggacagaggggacctaatttcccccaagatgttttattcgtggtcagaagtcatgggtttacgtcccacgcatgtattaagcagcgatatactgagcaagtaatcgattgacctctctgagcctttgttcttaatctgaaatggagatgctgcttcacacacttgtgaaagtcagagcacatattgtatatgaaagtgggttgtaaactaaaaagcacacctatgagctcagggttaacggtgttaatgtactggcagtgcaaggtatcagtgtgagtggtttagactagcaaataagagggcctgtgtcctaattctcttttatcactattggggggaagggcacggatactcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgcatgtgtgcatatgcataaatgcagaggtaaaaggtctggaccaaacagtggttatctgtgtagcccactcttgggatttggctgagggcaggagtaagggactggtcaagggtaactttctcttgttcgattacatgtattacttttttagtatttctctcttttttttttttttaacggagtctggctctgtcgcccaggctggagtgcagtggcgtgattacttttttagtatttcttaaaatgtgcgaataaagggtaaattcacagtcccatcttccaaagataatcattgttaatattttggtggattgtcattgtgttttttctatgtacctagccatttttaaaaaaatgaaatgtaatttctgcctttcttttctaaagaactgtatatagttagtattttctcgaaagcttgttaatacatgtttgacagtcaaagcatggacccaaataagtaaatagagtattaaagtcttttttctcagccaactgtgctttctttttccttttcctgtctgtaaacagagtttatagctcttataaacagctcttataggaagctttccatttctaaagtagacatgtatagaaggcaacagtaggtttgcctttttatattaaactatgtgagccaactttttatttttattttttattttagattcgggcgtacatgtgcaggtttgttacgtggatgtattacatatactgaggtttgggcttcaactgaacccgtcacccaaatagtgaacatagtacccaataggtagtttttcaactcttccctccatccctccattctgttttgagtccccagtgtttattgttcccatctttgtgtccatatgtacccaatgtttacctcctacttgtaagttagaacatgtagtatttggctgtttttgcattaattcacttaggataatggcctccagctgcatctgtgttgctgtaaaggacatgattttatttgttttaatgtctgtgtaataatccatggtatgcatatacaccacatattcttccagtccaccattgatgggcttgtttccatgtcttcgctattgtgaatagtgctctgataaacatgcaagtgcagctgactttttaaatacaactctgcttgaccttgacctttgtctcttctttcttatttcctatttaccaccatttgtaattgaaagtttgcttattgaattagggagaaaagagctatttgaagaatggagtataagtaaagtaataaataggcaatttgttatgcttgagacgaggaaaatattttactcagtaaacacctttgttgaatagaatgctcaaaagtttgccagatcctactctattttattttattttattttttgagactggatcttgctcccaggctggagtgcagaggcatgatcttggcacactgcaacttctgcctcccaggttcaagtgattctcctgcctcagcctcccgagtagctgggattataggcacctaccaccaggcctggttaatatttgtatttttagtagaggtaaagtttcaccatgttggccaggctggtctcgaactcccaaccttaaatgatcctcctgccttggcctcccgaagtgctgagattacaggtgtgagccattgcgcctggcctaatttttgtatttttagcaggggaggggtttcaccatgttggccaaaactggtctcaaactcctgacctcaagtgatctgcccacctcagcctccgagagtgctgggattataggcatgagccaccgcacctggccaccaaatcctgctcttataggaagctttccatccctgcttccttgcttgccccactctcccattttttagggccctaaacatagaaacatttattacattatattcaaagtaaaatcaacttagaattcagtaaatagaacaggacattgcttaagagactttggatataaaccaaaataagtcacaacaaaactgcaatcagcttttgattatctaggagcatttttgttgttgagaattgggagaaagacccttactcttacttcttagattcctctttgccttgcaggaacccagctcctaggctaatgagaagtcacatccaatcagtttttacatagactatgttttgaaacaattagtcctcacacaggcccatcagaaaaccagttaatgtgtccctgaataattgaaaattatttatatatctttttccccactggatttcccactaagtttgtactggatctaattcattttggtgtccctggggcctctcattcatgataggagatctatcagtgtttgttcaagtaatctgaatggtttagagttaactctcaaaatatctagttaactaagaattaggttaccctagaaaatcattccattatcagttatcctaatactcagtgacctaacttcttatatccgaaaagtcccttatactgcaaagttcctgttgctactattattgaaagtaaagggctgggcagggtggctcacacctgtaataccagcactttggcaggctgaagcaggctctgaagtttgagaccaggctgggcaacataggaaacctcatttctacaaaagttacaaaaattagctgggcgaggtggtacacgcctgtggtcccaggagggagccagcttactcaggaggctgaggtaggaagattgcttgagcccaggagttcgaggctgtgattgtgccattgtactccagcctgggagacagagtgagaccctgtctcaaaaataaaaaattaaaattaaagaaagtttcattactgttattattgatgtttaataaaaaagggaaggacagtaagattggaggcaaagcgaaatcatgattaaggaagaaagttcagtgagcaaaaataaaaagccttccttatattctagaaggaatattttaaaatttcccaaatggtcagtcagcccgggagtgtagaacacttcacagttttcaaagcatgttaagccatttgatccttataacagctttgattttggtagcccatgtagtattatcctctttatgaaggtaaagaaacttgagttctgtggccctcataagttcacccagggtcacatatttggtaaacaaaaactgtgaccaaaatctggatctcccaccttactttgtcctgtatactttctactgtacttccttttctgtagcaaggtaaaatactgagcatttgaagatgggacaacttttagctttcatagctctttcaaaatgcaattaaatatatatatgtaacaagaataactcataaattacagaaattattgttaattgaaattcttttggcacattgagcttaattgctgttaactttggcattggtcctaattatatatttagagcttctgctacttctatatccagaattacttccattggtaaaatatcaggtaatgaatgtttccttatttttttttcaaggtgaagtctcactctgttgcccaggctggagtgcagtggtgcagtcttggcccactgcagcttcgacctccctgggctcaggtgatcctgctatctcagtctcccaagtaagcaagactacagatgtgtactaccatgtctggttatttatttatttatttatttttgagatggagtttcactcttgttgcccaggctggagtgcaatggcatgatcttggcccactgcaacctccgcctcccagattcaagtgattttcctgcctcagcctcccaagtagctgggattataggcatgtaccaccatgcccggctaattttgtatttttagtagagatggggttccaccatgttgatcaggctggtctcgatctcctgacctcaggtgatctacccacctcagcctcccaaagtgctgggattacagacgtgagccactacgcttggcctatgttttgtatttctttgtagagatggagttttgccatgttgcccaggctggtcttgaactcctgggttcaagtgatccacctgcctcagcctcccaaagttctggtattacaggcgtgagccaccatgcccagtccttatgaatttttcaaacatcagttatgcagaaacatttgagaggcagttcggcaatcactttttaatgtgtaggcactataggggacacagtaatgaacaaggtacagttcctggccttaaggaacttatttagacttgtaggtgaaacagacatctagcaacactaagaatgcccagaatatgaggcagaatgtgataagtgtgtcatgagggcacaaacaaatgtctgtgtaaacacagagtagaaattttactgagtttcttgttaactaaaatactgttgtcttgagttttcttgtctgcatatttcagaacacttaattctgtcacccagtcatgtttctttcagtgaaaatgtatatcatctagttggtttatattcagagatacaaaattgtttttttttaatttatattttttattattaatttttttttaatagagatggggtctcactatatgacccaactatgttgcccaggctggtcttgaactgctggatcaagcgatcctgctgccttggcctcgcaaagcgctgagattacaggagtgagccaccacaccccaccagttttaatttttttagaaacgattttgctctgttgcccaggctagaattcagtggcacaatcatagttcattgcagcctcaccctcctaggttcaagtgatccttcagcttcagccacctgagtagctgggattataggtgcatgccaccatgcccagttaatttttaaaaatagtttttaaagataatatctcactgtgttgcccaggctggtctcaaactcctggccttgagcagtgttggcctcccaaagtgttgagattacaggcgtgagctaccatgcctagctttataaacttcttttaatattaacccaatccatgcataattaggaaggtcccagtgatgtcaaacaagaaaataaaatatggccaggtgcagtggctcacactggtaatcccagcactttgggaggccaaggcgggctgggctgatcacccaaggtcaggagttcaggaccagcctggccaatatagtgaaaccctgtctctaccaaaaatacaaaaattagccggacatggtgggcgcctgtaatctcagctactcgagggactgaggtaggagaattgcttgaacatgggaggcggaggttgcaatgagctgagatagacaactctttcttctgtgaagaaccttgggggcagggagagtaaaaaggatttcatggaagaagagtgtttgacctttttttttttgagatgaagtctcactctcgcccaggctggagtgcaatggcacgatcttgtctcacggcaacttctgcctcccgggttcaagtgattctcctgtcttagcctcccgagtagctgggattacaggcatgcaccaccacacccggctaattttttgtatttttaatagagagggggtttcaccatgttggccaggctggtcttgaactcctgacctcaagtgatccacctgccctggcctcccaaagtgctgggattacaggcatgagccactgcgcctggcgaatatttgacttttaaggatgaggggtatttgaacaaaatggggctggaattccatactgaggacatggtaaaggcatggagatagggaaggcaggataggttacagttctatatcacaggaacaagaggctctgttgagactttgattcttggcattgaccaaggtgcattcaaaacttgcttttaactatattgagctacttttaaatttttttctttatattaaaagaatacccttttttgaacataggagaatctttcacaagcttttaaaaaagcagtttatagctgagcacggtggctcacacctgtaatcccagcactttgggaggccgaggcaggtggatcacgaggtcaggagatcgagaccatcctggctaacacggcgaaccccgtctctactaaaaatacaaaaaaattagccaggcgtggtgggggcctgtagtcccagctacttgggaggctgaggcaggagaatggcgtgaacctgggaggcggagcttgcagtgagcagagatcgcaccactgcactccagcctgggagacagagcaagactccgtctcaaaaacaaaacaaaacaacaacaacaaaaaaagaaaaacaattttggctcttgaatttgcaggtattctaaaaaaggaaaatatgctttaaaatgtaagcattttgattaagaaaagttaattttaaacaaatcatttcatatttcatcacttcaccaccaccaccccccctttataaactatgcaccttggaaaacccaaatactttatttttatttatttttttgagacagagtttcgctcttgcacaggctggagtgcaatagcatgatctcagctcactgcaaactccgcctcctgggttcgagcaattctcctgcctcagtctcccgagtagctgaccacgcctggctaattttgtatttttagtagagacaaagtttcaccatgttagtcaggctggtctcgaactccttgacctcaggtgatctgcccaccttggcctcccaaagtgttgggattacaggcgtgagccactgtgcctggccccagatacttcaagttctttcttggaaaggctggagtacccaaacacttttattttttttcttacctggagtccttgcgccttttactcactctgctagaaacattgttttcatctcttatcaatccttacttattttctcattcttcagagcaccttggacatcatctccactgaaaaggctttcttgaacctgcacaatttgtttggtagcctttctgtgtggcccatctttgccaatgtttaccattcctaacagtgcttatcctctatgttgtaattgtttgtctgtctctctcacaagcagactatacccttttgagggtagggactgagtcttgtttgttgttgaatccctagcccctagcacaggcctgtttcatactaaacagtaatgttggttgaatgagtaaaactagctttaaatttatggagaaaatatgctcaaattaaccaaatctgttttactgtttggggtttttgcagatggagctttatattgtgtttgtcataaatctacgtattctcctctaccagatgactataattggtatgtattaaaattcaattgaagaaataatagtcttagctatagctgaaatgatttaattttatttcttgttttgatgtctgatgctttcttttctcattattctttccttaattttgtttttaaaaattattttaatgattttatttacccagtatctgggcttataaacattttaaataaaaatcattgtcattgtgtttcattgaatatttaatttgttataagacagacatgctgtttagaactgctatcttttcttcctgaagcatgctttagctttttggaaaagttaattagtttttatagggttcatatctattagcttaagccattattatcttttcttttgtttgatattgaataatcctaaattatacatacttaatttagccaccatttatttggtacttattcaatttagtcactatgataagaactaggaataacatatgacattgtcttttttctctgcagcagagtctgatatgcagaaactgcaacctattttcttaatctatgttgtttttattacaaattataataaaaatattttttcttctctcttgacactagttttatttttattttgttttcgagatggggtcttgttctctcgctcaggctggagagcagtggtgtgatcttggctcactgcaacctgagatggggtcttgttctgtcacccaggctggagagcagtggtgtgatcttggctcactgcaacctccacctcctgtgttcaggagattctccagcctcagcctcctgagtagctgagactacaggcgcatgccaccatgcctggctaatttttgtatttttagtagagatggggtttcaccatgttagccaggctggtctcaaactcctgacctcaggtaatctgcccacctgggcctcccaaaatgctggaattacaggcatgaggcactgcacctgaccttttatttttgtgagacagagactcactttgtcacccaggctggaatgcagtggcacaatctcagctcactgcagcctcaacttctgaggttcaagtaatcctcttgcctcagccccccaagtagctgggactataggtgtgtgccaccacacccagctaattgtgtattttttgtagaaacggggtttcaccatgttgcccaggctggtcttaaactcctgagctcaagcaatctgcctccctcggcctcccagcgtacaaggattacaggtgtgagccatcatggttggccttttatttttgagacagggtctcgctttgtcacccagactggagtgcagtggcgctatgtcagctcattgcagcctcaacctcccaggttcaagctgtcctcctgcctcagtctgcccaagtaactggaactacaggtgtgtgccaccacacctggctaatttttttttattttttgtagagacaggatttttccatgttacccaggctggtctcaaactcctgagctcaagtgatccgccttggcctcccaaagtataaggattacagatgtgagctaccacgcctggccttgatactagttttaattgtacatctaatgagtactataatagcgatgaaattggaataggtaacagtttttgaacctggaaagactgagtcatataagtgttttgcattatataaaactatcttctcgtgaagaaatcgtttgacagattaaatgttcattgtagccatgttatggtattcaatcttgaaaccacggtgaaacaatctaatgcctattctttgttagctacaaatgtattttgttgtggtatttaagctgacatattctgtgggatggtcttcatttgtgtcctgtgttatgggtaccaggtttgccaatccagtgatgtagtatcttcagcaatttgtgattaattttagcttttatttatttatttatttatttatttatttatttttttgagatggagtctcattcttttgcccaggctggagtgcagtggcgtgatcttgacttccttcagcctctgcctcctgggttcaagtgattctcctgcctcagcctcctgagtagctgggactacaggtgtgtgccaccacacctggctaatatttgtatttttagtagagacggggttttgccaggctggtcttgaactcctgacctcaagcaatctgcccaccttggccttacaaagtgctgggattacaggcatgagccaccacgctgggcccagaatgattattaggccgggcactaattttagctttaggctggagtgcccactgcactccagcctgggtgacatagtgagagtccatctcaaaaaaaaaaaaaaaggtaatcattttgccttgaatacagtataactttatttctaaaacattcttttttttagcaacgtagagcttgctctgacttctgatggcaggacaatagtatgctaccacccttctgtggacattccatatgaacacacaaaagtatgtatgagaaaatttcttgcagtttttaatttgctgttagaaatgtttgcacttctttatagtatccaaaaagaagggagtcatctgattttctttgttttagattttcttttggctttttaattttactattttgatttttctcttatttatttttcatctgctttctttacagtcttttttcagaatacaaaatgaaccatttaaacacaattatggcatcagttttctggtctaaaaaatttggtagatttctggttaaggatcaaatacatctagtataaaattataaaatgcattatcccatgctaccccatattataatctagacaattatgagaaagttgtattttagagtgctgggattacagctacttttttactattggttctgacagtttttttttttttttaacatttggtgaatttctttatttttatgttttaatgggccaacataggtatatattttgaatggcccagttagatttttttccctattttttaaaaagccaagtactagatagaagaggattttgtattgtttttaatataatttatttttagtttgacccaagtctttttattgttttgtatttgaaatgctttttcctatttctttaagcctccttctactaggtaatgtttgatttgctttttttttgagacagggtctcactctgtcacccaggcaggagtgcagtggcgtgatccggctcactgcagcctccacctcctgggttcaagctattctcctgtctcagcctcccgagtacctgggactacaggcacctgccaccacgcccggctaatttttgtatttttagtagagacggtgtttcaccatgttgcccaggctgatctcgaactcctaagcttaggtgatccgcctgcctcggcctcccaaagcgctgggattacaggcatgagccaccgtgcccggccttgatttgctttttgaggagaaaattagatggtttaagtcatcacatgatgtatttagtggtacttattttgaaaaatcatcattagggtcagggtgccggttgatttgacaaataatttcttttctttttttttttttgagactgagtctcactctgttgcccaggctggagtgcaatggcgcgatctcggctcacagcagcctctgcctcctgggttcaagcgattctcctgtctcagcctcccaagtagctgggactacaggcgtgcactaccacacccggctaatttttgtatttttagtagagacagggtttcaccatgttgggcagtatggtctcgatctcttgacctcatgatccgcctgcctcagcctcccaaagcgctgggattacaggtatgagccaccgcgcccgacaaataatttctgtattcctttttaaactcaccattttgtctccctgctttgttaggaaacaaaagccaggtatcataggtactaattcagtgcctcttttttatcacttatttgggcaacgtttagaaaaataggcctacatcactgagttttggcctataaaccctccaggtcacactatgttgtgcctttgtccattgttattttgttaaatatcttcggtttatttgctgtgttttagcaattatactaagaatgccaggtcatttcatagcatccagactcttatccccaaatggctctttatatctctgaatctgaccctcctcaactgtcaaaactttcccactgtacttgtagaacttactacccttggcaaaatctcttacaatcttagcctattccagaatgttgccttcaccttttgactctaatagaaacctgcctgtaccctggagacgttacttccccagcagttcttttaagtagttgctgttttctctcgcatactcttttaccactgggtctaaagatggggaaggtatctctgtagctcttcactgtcaaatctagatcatttctcttccttcctaacaatttctagctttgtagcttgtatcattaaactgcatcatttactatctttttttgttgctgttatctaccaactgccaggttatttctcctcctccaccactctgcacttccttgaatattctaagcttgctgtcacactttctccaatactgttttaccctcattcttttacttcaatatccatgtaggtgatctaataccatggtgtctcacttcttgatctctctctacatcagctacccacttccatgggaggattccctatgattccctagagatattctaattaccagtaattgctactcctccttcccagtctaaattttaagaaatccaatagttaactaccagtccctcttggtctcccagctccaagaattattcattccctctttgtaacctacatcgattgatccaaccactttttcacagtccctcatgtatctcacacattctcactccctacttaacccagcacagactgatatcatggtttatcattatcatcattcctctgtacacatgaccacctcccctgcatcctctttctttgttgtgtttcctttgttttgacaattatcttctctgccacatcatcaatattcatctctctagtttaggtaagtaatcactcctacaagttttcaagtaatcaccccactgccaccatactgaccacaactccagctgttcttcagctgtattaggtgagctctccactcagagcttttgtatttcctgcttccgttgcctggaatgcttttacttcatagtttactctctttccttaaggtctttttccttatttgttatcttgtgtggccttccttggctactgcatttaaagttgtacctctgctcctgcactccttgttgtcctttgatttacttttctcaacagcatttatcatttctagcatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaagttgttccttcctcttcatgcttaagggttttttgttttagggctaagagacattcacatcagaaagcatggaaagtttttgtttgtcaagcaataaattgtagattgggctgcaaaataagaaacactcttgagaacatgttactattagtagaataatagtaacatgggctcaagcaatcctcccactttagcctcatgagtagcttggactataggcacacaccaccatgcccagctaattttttaaatttttgtagagacagggtctcactatgttgtccaaactgatcttgaattcctggactcaagcagtcctctcaccttggcttcccaaagtgccgggcttacaagcatgagccactgtaccttgcccaatctggttctttttttttttttgagacagagtctcactctgtcaaccaggctagaatgcagtggtgtgatcttgtctcattgcaacctccatgcctccccaggttcaagcgattcttatgcctcagccacccaaatagctgggattacaggcactcgtgaccacgcctggctaatttttgtattttcagtggagagggggtttcgccatgttggccaggctggtctctaactcctggcctcaagtgatctgcctgccttggcctcccaaagtgctgggattaccaggcatgagccaccacacctggccccattctggtttttgtgacaaggatctggcttgtctccctttctacttttcactgatatctttgttactttgcatttctgtagtacagtcatgcattgcttactgatggggatatgttctgagaaatgcattgttaggcaatttcattgttacgtgaacatcatagagtgtcacttacgcaaacctagatggtgtagcctactacacacccagactttatggtatagcctattgctcccaggctgcaaacgtatacagcatattactgtagtgaatactataggcaattgtaacacaatggtcaatatttatgtatctaaacgtatttaaacatagaaaaggcacaataaaaatgtgctataaaagataaaatgtaatatacctgtatagggtacttaaccaaaaatggagcttataggactggaagttgccctgggtgagtcagtgagtgtaaaggcctagtacattactgtacactgctgtatactttataaacaaacactgtatgcttaggctacaccaaatttttaaaaaaatatttttctttctttaataataaattaaccttaggttactgtcacttttaaacttaataaacttaaaaaaaatttaatacttttttactcttttgtaataacacttagcttaaaatatcgtgtacagctatacaaaaatattttctttatatccttattctataagcttttttgtattaaaatttttgtttgcactttttaaactttttttgtgagaactaagacacaaacacagtctaggcccacacagggtcaggatgatcaatattactgtcttctacctccacattttgtcccactggaaggtcttcaggtacagtaacatgcctggagctgtcatctcctatgataacagtgtcttcttctggaatacctcctgaggggcttgcctgaggctgttttacaattgacttttttttaacaagtaggagtacgctctaaaataatgataaaaagtatatagtatagtaaatgcataaaccagttgcctagtcatttattattatttttattatttaattattttggttgagacggggtctcactacatgttactctggctggttttgaactcctgagctcaagcctcacaaagtgctggaattacagccatgagccactgtagcctgccgttatttattattattatcaagtattatgtgctatacataattgtatgtgctatacttttatacagctggcagtgcagttggtttgtttacattggcaccaccacaaacatgtaagcaatgcattgcactatggcgttctgcaccatcactaggtgacaggaatttttttagcttcatgataatcttatggtaccactgtagtatacactgtccttcatcactgtacattgttgactaaaacattgttatttcaggcagaatcttgccctgtcacccagggtggaatgcggtggcatgatcttggctcactgaaacctctgcctactgggttcaaacgattcttctgcctcagcctcccgagtagctgaggttacaggcatgcaccacaacacctggctaattttttgtattttcagtagagacagagtttcaacatgttggccaggctggtcatgaactcttgacctcatgtgatccgctcaccatggcctcccaaagtgctgggattacaggcatgagtcactgcgcccggcctcaaaacattcttatgcagcccatgactttacttaattgtgccacctccattgctttttaaaaaacacacacacacacacacatatatatatatatatatatatatatatatatatatatatatatatataaacagagatggggggtcttaccatggtgcctaggctggtctcaacctcctaggctcaagcattcctttgccactttgaccttcctaagtgctgggattacaggtgtgagccactgcacgtggcccacattgcctttttttttttttttaattgacacagggtctgtctgtgtcaccaagactggaatgcagtggcgtgatcttggctcactgcagcctcagcttcccaggcttaagtgatcctcccatttcagcctcctgagtagccgggactgcaggtgtgagctaccatgcctggctaattttttgtattttttgtagagacagcgtctccaactcctgagctcaaagtgatctgcctgtctcagtctcccaaagtgctaggattaacacatgtgagccaccgcacctggccacattgccttttaaagaggtcttgtttcatgtgcataaactagatataaatatatgctataatatttaatacagtggtagaatgtagttgtcactaatagcgtatgaatgtaaagaaaatatgtttgaattgtttcttactggttgtaaattcagattttcattgtattataatacatacatattgttattttaaagcaaggcagtgttacaatcttgttacatatatattattattgaatatgttactttcattatgatagcgttatatagtattgaatgttacaatctttgttacataccttaatatcacttaatatttaaaatataggtaacttgaccctccaagatagtgattccttttgttttccgttttgttttgttttgagacagggtctcactcttgctcaggcaggagggtactgtgcagtcatggctcactgcagccttgaactcctgggctcaaaagatcatcctgcctcagaccccaagtagctgggactgcagccatgcaccaccacacctggctaatttattttttgtttttaaattttttgtagagatgaggtttttaaattttttgtagagatgttgcccaggctggtctcaaactcctgggctcaagtggttctgccaccttgacctctgaaagtgctgggattacagatgtgagccacatagctggccaagacactgattcttaaagtctttagtgagtcactattactggtggaatatgttgtatatcattcatgtgtgttgaggagataagatttttagtaatcattaactttgggggaaagctatttaaattacaataaagcactgtttggtggcattttagtcacctgaaatgaaaatgttgaaaatttttctgcttccattggatgtaagaaatgtcattttctttcttttttctttttgagacagtcttgctctttcgcccaggctggagtgcaatggtgcaatcttggctcactgcaacctctgcctcctgggctacagcgattctccttcctcagcctcctgagtagctgggattacaggtgtgcgctaccgcaccaagctaatttttaagtagagatggggtttcaccatgttggccaggctagtcttgaactcctgacctcaggtgatccacctgccttggcctcccaaagtgctgggattacaggcgtgagccaccgcacccggccaaaaaatgtcattttcaatgaaaagtttttaattatttctcatcttaatgatataaaaggtaaatggtaaacttttaagttaaaaaataataataggcataatttatacctttgagaaacagaaactaaagtaataagtactttattactgcagaaaataagaacattaaatgagggctttctttttttcttttttttttatttgtagtagagacacggtctcgctgtgttgcccaggctggtcttgaactcttgaactgaagtgatcctcccaccttggcctcccaaagtgctggaattacaggcatgagccaccacacccggcctttctatttttctttctcttttttgagacagggtttcactctgtcacccaggctggagcacagtagtgtgatcacaggtagcctcgacctcctggtctcaagtgatcctcccacttcagcctcttgagtagctgggactgcaggtgcatgccatcacacctagatagtttttaaattttttttgtctgaccatgttgtccaagctggtcccatgctttggaactcctgggctcaagtgattctcctgccttggtttcccaaagtgctgggattacaggcatgagccactcactgcacctggcctaaataagaactttattattggaaaagaaacctaaaatttgctgtgagaagaaaaatatttctgactaatgaataatgcactaagtgaaactttgttttgataacttatttgcccaccctaaagtactatagtgaattactgaatatggtaattgttttattgtgatctcaaacaaatgctggctaacattcccacatcttcatgatgtttgttactgattattttgtagcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatctcgctctgtcacccaggctggagtgcagtgccacaatctcagctcactgcagcctcaacctccagtgctcaagtgatcttcgcactttagccttccgagtagctagtactacaggcatgtgccaccacacctggctaattttgttctttttttttttttttgagacaaagagtcttgctctgtcacccaggctggagtgcagtggcgagatctcgtttcactgcaacctccacctcccaggttcaagcgattctcctgcctcagcctcctgagtagctgggactacaggcgcatgccactatgcccagctaattttttgtattttcattagaggcggggttttaccgtgttagccaggatggtctcgaactcctgaccttgtgatccacccaccttggcctcccaaagtgctgggattacaggcgtgagccaccgagcctggctcttttttcttcttttgtagaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaaccagagctttcagtgaattttgtaagagttcttgaaaatttttacattctatgatgtattcatttaatatgttgtttttgttcattttcctgttaagtaattgattgtgtcttcagccctttatcaatttctttatcatattttgagttatcgaaaaaaacattggggtacagaaaatgattgggcagcgtatgttgttctcagttcccttggaaactgtaattgccctgatgtttgcaaatactcacattttccatcgattcttacctgccatttgactctggcattaattagttttcctctttttgatttttttcttttgtatctatcttcttccataccaaactataagatgtttttgttgtttatatttgaacaaacttttttttcttttttttttttgtgagaaggaggtctcattatgttacccaggctgatcttgaactcgtgggctcaagcaatcctccttcctcagcctcctaagtagctgggattacaggcacactctgccacgcccagctagtttgaacaaaactttgttcttagttgtttaactcagtaactagcactggctggcatatttatggcagggtacatttatagaattaatgaatatacatttatcaagtggctctaagtgctggttagtgtaaaacataatccccagttacaaattgtttatagtcaaggagggaagatagtagagtaaataaacggttaaatcaagtgtgatagagccttgaaggagggttaggagttaacccatggagaatgaggggtaaacttcacagatagaggaaacagcatttcggataaagtgtgtgggggaaattactaataggttgggttatggcacccagaatattaatttattataacaaaacatagcccatcatttcctgtcttaagaagcccctttcttaataatctctataataaaagtgatttttttgtatcattttcccaaggaaaaatattgattttttgggggggcaggcaacatagtctttcaattcctgcttctcttttgtatctccttccttgatttttccttcttattttattttatttatttatttattgagacatagtcttgctctgtcacctaggctggagtgcagtggtgtgatctcagctcactgcaacttccgcctcccaggttcgagtgattctcctgcctcagcctcccaagtaactgggactacaagcatgttgccaccatacctggctaattttttgtatttttagtagagacaaggtttcgccatgttggccaggctggtctcgaactcctgacctcaggtgatctgccccacttggcctcccaaagtgctgggattacaggcgtgagccactgctcccggccttccttcttatttaatacccactttgtttatgcatgctatctggatttttctctatatttttaattgtaaggttaggatatgtgcaaacaaattaggaaaccatctcatagccctgtgccttaaatcattaaatctcattatattctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcagagaaaccccagagactagtttatgtgtataaagagaaattttatctgtaggccttgtccttgtagatgtatcatcttgctgaattttaaatatgcctatgtgtcatcacttatcattcaacacatatttatttgatatctacatatgtattttggattaatgtgagtcattttcaagtgttggtttctggatgtcagtggccatttctttctttttgtctgtctatctgtccatctgtccattcatccattgattcattcattcattctcagcttgttttccctagtcagaccatttcattttaaacctcatttaatatatagaaggatgatttactaaatatttcacagttcttaagttacagcagtcaaaagaatgggactcattatgaatttaataactgggggtatataacttcttcttaaataagtttttattaaaaggtataaaacacattttatttttatttttattttttatttttctgagacagagtcttgctgtgtcgcccaggctggagtgcagtggtgccatctcggctcactgcaacctccgcctcccggattcaagcgattctagtgcctcagcctcccaagtaactgggactacaggtgcacatcaccatgcctggctgttttttgtatttttagtagagacggggtttcaccatgttggccaggctggtctcaaactccagacttcaagtgatcccactgccttgggctcccaaagtgctgggattacaggtgtgagccaccatgcctggccaaaacacacatttttaaaaagtatttttaaactatgcagaagtatttaaaatataaaatagaagtgttctctatttctgtgttctccatagggaattgggtataatatgaggtaggactattcatagaggtagaggttaacctacctagatgttgaacatcttttcatgtgcttattggccattcatatgtttgggttttggtttttgtttgttttcagttaagtatctgtagaaatattttgcctattttttaaaaagcaaattggttgtcttattaaggtataaaacttagagaccaaagtgctatatgagctatatgctttgtaaatttttttatctaagcttgcctttcactatgtatatatgtatgtatgtattttaatagatgctgtcttagatgtggtttcctaggagaccctaagataaggattttttttttgttgttttatttcaatttttagcttcagagggtacacaagggtatattgtgtgatgctgaggtttggagtatgattgaacccatcacccaggcagtgaggtagtgcccaataggtagttcttcagctttctctcacctctttccctcctgtctgttgtccccagtgttttttgtttccatctttgtgtccgtgtgtacccagtgtttggctcccacttacacgtgagaacgtgtggtatttggttttctgtttctgtgttaattcgcttaggataatggcttccagctgcatctgtgctgctgcaaaggacatgattttgttctttttttatgtctgtatagtattccatggtgtatgtgtaccacattttctttatccagttcaccattgacaggcacctggattgattccatgtctttgctgttgtgagtagtgctacagtgaacatacaattacatgtgtctttttggtggaacagtttctattcctttgggtatttacctagtaatgggattggtgggtcgaatgggagttctgtttttagttctttgagaaatctccaaattgctttccacagtggctgaactaatttacattcccaccaatagtatgtaagcatttgcttttctttgcagccttgccaacatttattatttttatctatttttaataatagccattctaactagtatcagctggtatcacactgtgatttttttaaatttgcatttctctgatgattagtgatgttgagcattttttcatatgtttgttggctgcttgtatgtcttcttttgagaagtgtctgttcatgttccctagcccactttttaatggaattacttatttttgcttgttgatttaagttccttacagattctggttctagaaggggtttgggaagtcattaacctcttgaaattatttgtaaaaattttgaataggtgtttttctgggcagtggattcaaaacttttatcagactctcaatgaagtatgagaccttcagaatgctaagaactgtccattaaaagtgtcattcagcatacactgttcaattatatttactactcaagactgaaaatgtttgagactctgatagccctaaactgaacaaagtcaagttctaaaatatgctcaataaatgtcaaatagcatttacacatatcttatcatgcatgaattttaatgtgcactacaatcactagccaaaagcaagcaccttaattttacgatgaccttattctatcatccagattgggaaccttgcagacactattaattaatacaagagttaaattgagattgctcctggcaaaccaagttatattgttacacttcttagattacacaatgactcagtgacatctggaacactggtctacagctcttaacccagaaaactttacctcctggttcatactaagctaggtaatcaaatctgtttcctactgatggaagtagctaatttttgttgtctccatgggaaaatattaaagtagtttcttaaataaagtggtactattattcatgcatttgtaagattgccctatatttcagaaatttagaattattttctcctgcctgcctgcctgcctgcctccctcccccgaccccctctctttttctctcctcctttctttcttagagtcacggtcttgctctaacacccaggatggagtgtaatgacacaatcatagctcactgcaccctcaagctcctgggctcaagtgatcctcccatctcagtcttctgagtaggtaggactacaggcatgcaccaccatgcccagctaatttttaaaaatcgtgggggctgggcacagtggctcatccctgtaattccagcactctggtaggccaaggtgggcagatcagttgagcccaggagttcgagaccagcctgggcaacatggtgaaaccacatctctacaaaaaatttaaaaagtagccaggcatggtggtatgcatctgtagtcccagctactcaggaggctgaggcaggagaatctcttgaacctgggaggcgaaggttgtagtgagccgagatcaggtcactgcattccagtttgggtgacagggcaagaccctgtctcaaaaaaaaaaaaaaaaaaaaaaaaagttattatgagaatcagaatcatttatccattttaaaatgtgtgagcacctactatgtgtagatcctaatgattctgtagtacacaaaacaagataaaaatcccgactttcatggatcttacattccaatacaggagataggaaaataagatgaataagctggtcagggaagccttcattgagtaaaaacctgaaggaagtaagagagctagctttactgatactgtgagaaagagtgttctatgcagacaaacagcaagtataaaagccctgagatggaaggaaggacatgttcaaaagcaaaaaagaggccatgtagccagaatacatgaacaaggaaaagacagtagggcatgagagcagagaggtaatgcaggaccaaatcatgtaggtagttgtaggcctagagtgtttctgagtgagataggaagctgtttgaggattttcaacagaaaaattacaagaaccaagggaagtgttaacagtaggttactctggctgctacgctacaaacagactgcagcaaagcaaaggaagcagctgggagaccagttaggaagttatttcaacaaaacaggcaagaatgatgatttggactaggatagcggcagagggaatggtgacaaatggtcaaatctagatacattttggagatagagctaacaagattcgctaatagaccagatgttgggtatgagacagagagaggagtcaagagtggtaccaaggtttttggcccaagcacctagaagaatagaactggcattaactgagagagcaggctgcaggagaagctggtttgtggaggaccatcagaagcacagttagacacataccaagttaaggatacctactacacatgtcaagtaggcagttggatatgtaagtctagaggtcaagggacaggtcttgaccacagatggatttggaagtcatcatcacacagatggtatttaatgccatgggactggacgagattcctgtcctagagaatggaacagaaaagtggagcagtccaaggactgattcttggggcactccaaaatctagagacaagggagatgaaagggaagcaccaagataaatcaagatagtatattaactttagatatgtaaaaagaatttcaaccgttactaaggtcgaattaatgagaaaagtaacagacacaccatcaggaactctagagatatagtgatacaggggtccccagagaaactccgaccagcttgtgcactgggaaaatggggtggagcttcgtgaagttcacgctgtttgcagggaaaaggagcctggcctctgtgatctggtgtggtaacctggggattcaatctgtgagatgtgggcctgttaacaggaacctctcttgctttgctgagttttttccttttcacccaataaaccctgtccttcctcacccttcaaattgtctgtgagcctaattttttgtggttgtgtgtctttagctgacctaagaaaaaagtcctacaataataatattgctcaaatgatgtgttctaggaagattatattagaaggaatactttatgacttgattttttttcatgtcaactaaggaagactaaagactcagcctcctaagtagctgggactacagaagcatactaccatacctggctgatttttttgttgttgtttgtattttttggagagatagggtttgccatgttgcccatgctggtctccaactgctgggctcaagcaatctgtccaccttggcctcccaaagtgctgggattacaagcttgtaatcctggcccacacatttaatagtaaacacttcagattttcagacatgagataatctaatcaacgatacttattagccactggcctattcagcattgattctttagagtcatacaacttacactcccagttcacccaccttgggtgaggccaataattagactcaggtagcttcaagactgaatgaagtggggcaacacttctggatcattaaggatctgctgaccttgattaagaatctgataatgaggaacatcttaacccacctgtgacccacctagataaaatggataaacccatgtaacctggtagctgaactctggaaataaaacttccaagaatcactgggaaatttaccagtgcatcctcaaaacttccataaagtatggtttcaaagaggaactgaacaccttaaagaagctgtgaagacaattaggtgagatagtattccatcagacaatcatttaatacccatacattgtattaaggatactgtgttagaattattgtggaaaattacacaacagatgtttgggttttttgtttttgtttttgtttgacacggagtcttgctttgtcacctaggctggagcgcagttgcacaatctcagctaactgcagccaccacctcctgagttcaagcaattctcctgcctcagcctcccgagtacctgggattacaggcagttaccacaacacccggctaatttttgtatttttagtaaaggcagggtttcgccatgttggccaggctggtcttgaactcctgacctcaagcgatccacccacctcgggctcccaaagtgctaagattacaagcatgagccaccacgcccagacaacatccttaacaaagagaaaatactccagagaagatttaaccaaaaaaagtcacctaaaaatgtaaatataacattaatagatacctaataaactataattatatgcagttgtgctaagagggacagtagatattcaaagtgaatataaaaaagtaaaatgtcatgaagaaagtaagataagagcaaatagcagaggaagagtaaaagtgctgaaaactgagggataaagcatttgaaatagcttgatgttgaaatgagatggggcactgaggtcagattaggtaaaaaaaaaaaaaaaaaaaaaaggcaagctccaactatatgctgcctataagaaatccactttaaaaataaagacagccaggttaaaagtaatacagaaatgacaaaggtgacatcacaaccaatcccagagaaatacaacagattctcagagactattttttttgggggggtttgggggcgggtggggacggagttctgctcttgtcccccagcctggagtgcaatggcacaatctaggctcactgtaacctccgtctcccaggtacaagtgattcctcagagactattattaggaacacttcaagcacacaactagaaaatctagaggcaatggacaaattcctgaaaacatacaacctcgcatgtttgaatcaggaagaaactgaaaccctgaacagatgaataatgaattctgaaactgaatcagtaataaaaaaacaacaaccaaaaagctctggaccagacagatccacagctgaattctaccagatgtgcaaagagccagtaccaatcctactgatactattcccccaacaacaacaacaaaaaatcgaggaggaaggactcctccccaactcattctacaaaaacggcatcatcctgatacccaaatctgacagagacataacagaaaaacaaaactatgggccagtatccctgataaacatggatgctaaaatcctcaacaaaatacgagcaaaccaaatctagcagcacatcaaaaaattaattcaccatgatcaagcaggctttctgcctgagatgcaaggctgattcaagatacgcaaataaataaatgtgatacatcatataaacagaattaaaaacaaaaaacatatgatcatttcagtaaacacagaaaaaaactttcaataaaatccaacatcctttcatgatgaaaatcctcaacaaactaggcattgagggaacatactccaaaataataagagccatttatgacaaacccacagccaacatactgaacaagcaaaagctgagatcatttcctttaagaacagaaacaagacaaggatgcccactcacactactcctattcaacatagtactggggaagtcctagccagagcaatcaggcaagaaaaaaaaaaaaggcgtccactcaggaaaagaaaaagtcaaataatctctcttcactggttcttgtaatttttctgttgaaaatcctcaaacagcttcctatctcactcagaaacactctaggcctacaactacctacatgatttggtcctgcattacctctctgctctcatgccctactgtcttttccttgttcatgtattctggctacatggcctcttttttgcttttgaacatgtccttccttccatctcagggcttttatacttgctgtttgtctgcatagaacactctttctcacagtatcagtaaagctagctctcttacttccttcaggtttttactcaatgaaggcttccctgaccagcttattcatcttattttcctatctcctgtattggaatgtaagatccatgaaagtcgggatttttatcttgttttgtgtactacagaatcattaggatctacacatagtaggtgctcacacattttaaaatggataaatgattctgattctcataataactttttttttttttttttttttttttgagacagggtcttgccctgtcacccaaactggaatgcagtgacctgatctcggctcactacaaccttcgcctcccaggttcaagagattctcctgcctcagcctcctgagtagctgggactacagatgcataccaccatgcctggctactttttaaattttttgtagagatgtggtttcaccatgttgcccaggctggtctcgaactcctgggctcaactgatctgcccaccttggcctaccagagtgctggaattacagggatgagccactgtgcccagcccccacgatttttaaaaattagctgggcatggtggtgcatgcctgtagtcctacctactcagaagactgagatgggaggatcacttgagcccaggagcttgagggtgcagtgagctatgattgtgtcattacactccatcctgggtgttagagcaagaccgtgactctaagaaagaaaggaggagagaaaaagagagggggtcgggggagggaggcaggcaggcaggcaggcaggagaaaataattctaaatttctgaaatatagggcaatcttacaaatgcatgaataatagtaccactttatttaagaaactactttaatattttcccatggagacaacaaaaattagctacttccatcagtaggaaacagatttgattacctagcttagtatgaaccaggaggtaaagttttctgggttaagagctgtagaccagtgttccagatgtcactgagtcattgtgtaatctaagaagtgtaacaatataacttggtttgccaggagcaatctcaatttaactcttgtattaattaatagtgtctgcaaggttcccaatctggatgatagaataaggtcatcgtaaaattaaggtgcttgcttttggctagtgattgtagtgcacattaaaattcatgcatgataagatatgtgtaaatgctatttgacatttattgagcatattttagaacttgactttgttcaatttagggctatcagagtctcaaacattttcagtcttgagtagtaaatataattgaacagtgtatgctgaatgacacttttaatggatagttcttagcattctgaaggtctcatacttcattgagagtctgataaaagttttgaatccactgcccagagaaacacctattcaaaatttttacaaataatttcaagaggttaatgacttcccaaactccttctagaaccactattctgatgaccgttctccctgctttgagagaatgcctttcagagacactattgtactagtacaaccttgattatctggtatgtcaatggaaccttttagaaaaaaacagaattttctgtatgccaacataagtacatgtagaaatgtttatgcagatggtattttactgtgtgtattttttgacagcttactgttccatgttagtatagacagctgtacttcgttcatttcaacttaattcctgtattttgcaaattttcaaaaataaaatcagtgtatcaggaagttgcccatatgaaacctgaagcaaaaaaatgctttagatatcttaatcacaacaactaaagatcacagggtacatgtcttaccatttatagtataaaactgaatttccacattagcaaaagattgaaaacaaaaattaacttgtgaccaacttgccaaaatctgacctgaaggaaatttttgaacgtaactcatcacaaaaacacatgtactctgtgcagaaatgtttcttaaatcagtaaagaaaataaggaaatgcagaggagcaaaaagaattctccatggtgaaatcactcaaaaactatcactgctgacaatgcatttcatttctctatatctatacataagttttgttagtttgcctatttttacatggttatcatcatactgtatatgtaaattttctcctgtgttcttccttaatattttaactactttttctatattcctttgggacagagtgctagaagaggaattactaggtcaaaaattatgaatatttcttgatacatcttatcatactgcttttcaaaagtattttgaagtaaaagtttatacttttaaccagtcgggtctcatactgctaatttcaccacacctgtgcttggattgggcattatgatttttaacatgtttgtgatctcaaaaacaaaaggttcctcactgttctgatttgcagtccctccattttgcatgacattacacatttttccacagacatattactagttttattttatattaaaacatgattttgcatttatagagacctccatttagaggacaatagccccttgtaaataaaacttttaacagaacacgttcatgttcacgatgtggtgtttctttatgttttggaagcctaaatctcaccagatgtgatatttcttcactactaagacaaaaaaccattagtttttatcagaatcagtcatctgggttaccatgttgaaattatcctcaagatatgaaagaaaactatttcaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataacctctgcacttcagcctgggcaataaagcaagacccagtctctagaaaaaaaaaatgattaggtaaagaaaagaaaacaaattttcacaatgggagaatgtggcttattactaagaaatggctgatacgtagtttcattgattttttaaaaaaatagttccaatagcaaaataatcatagaagttagatttttatcaggaataatttttattaaaatcatcttattccaagtattttcttcttttcaaggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagcacatagtccgtgatcaccagcatcacctgccctctgttcctcccccgtcccccagggataagaacctgttatccaccatcagtaacattttatgaaagatctacttatttgtctgttttgcagacattttaaaattcgtaaagtgggatgcttctttaatttaaatacatttagcttcatgaaaaactcactacacagttcttgttcaagcattattgggaaaccaccagagggcactctcacccagggcttaatttgaacatctcgcccaaaagtgacttttaaaagcacttaattagcagagaatttggatgttcattagttgagaatgactagtagaataaatggtaatagtgaaattaagtgctggaatattctgagtagaccaatagcaaaaactgatttttttttttttttaaagaaaaggtcttgctgtgtcgcccaggatggagtgcagtggcacaatcacattgcactgcaacctcaatatcctgggctcaagcaatcctcccaccgcagcctcccgaattgctgagactacacatgtgtgctaccatgcctggctaattgttttaattttttttatagagacggggtttcgccatgttgcccaggctggtcttgaactcctgggctcaaagcgatccacccaccttggcctccaaaagtatgggattacaggtgtgagccactgtgcccagccttattttttttttttaagataatattgttaacattttgtatttctctgcataaatatatttcaaaaataaaaatagagctcataatatatgctgttttgtaatgcttttttcacttaataggaattttttccgtatcattaagtactctgatttaatgggtgcatattattctataatctggcttgtcataatttaattaactccctgctgttagacaaaatcattgtttctgttccatcttgtgaataatgctgttattaacatcctggtggattattaccattttctttttttattttttttttaaatttatttcttcttttttttttcttataatctcatcagaagctggcaagatcattactgttttcttagatttgtttctgtaagtgcaatcgttgaatcaccatgtccggcatccatgtttatgtacatttttaaagtcagtggtttaaactgtatactttttgggttttggagatggaggtttgctctgcccaagctggaatgcaatggcgcgatcttggctcactgcagcctccacctcccgggttcaagtgattctcctgcctcagcctccttaagtagttgggattacaagtgtgcaccaccatactcaggtaattttgcatttttagtagagacagggtttcaccatgttggtcaggctggtctcgaactcctgacctcaagtgtccacacaccttggcctcccaaagtgctgggtgggattataggtgtgagcctccatgcctggcctaaactgcatactcctaacatcagtatatagaaatattttctctttagttctattaaaattttaaaaaatctttatcaatttagtaggcaaagactggaaaatgttttaatttgatcagccactttaatgtatgtctcatttcaaagcatataaagtatacaagtttcaggtcctagcttaaacctataagaggccttattatgggcttatttcctttgcagccctttaccataatgtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaatttttaagaaaaaaagatataatgtgccatcattttggatggttctgggcacttcaggtaaacccttactcaaagaatactttttcagtttcaatgtgtatttttaaaatttccagaagatgagttgaatatcagcccacaaacactggtagtaagcaaactattttatttgctaaaggcataaataaatgtctcctttgcttttaggcaaagggaatgcttcttcagatttttttttttccccagaagttcaaaataacttgctcatagtcttcccaaaataattttcaaacattctaacaccaaagaaagatactcccaattgagctcagccatcagcctcctactattttttaatgtgctgtttaaccttgtgaatgtgagaatattttgaatgcactgggaaggaatactcaggaacaatatgtaatgtgctttctagttttgcacaaaggcattcattttgatttagtaacaacctcatacttacatagcatatccttctgcagaaatgcttcacagccatgactgcttgaattcttgtcatgttgcttgtaaatgagctcctgtttttagatggagaaatggaggcagagtctcacaattacatgtgagaatagcaagtagaaccttatgattacttctgagtcttttttttttttttttttttgagatggagtttcacttttgtcacccaggctggagtgcagtacagtggccagtggcatgatctcagcccactgcaacctccgcctcataggctcaagcaattctcctgcctcagcctcccgagtagctgggattatgagcgtgcaccagcatgcctggctgattttttgtattttcagtagagatggggtttcaccacgttggccaggctggtcttgaactcctgacctcaggtgatctgcccaccttggccccccaaaatactgggattacaagggtgagccactgtgcccagcctcttctgagtcttcaattcagcaagaatgtctcttttttttttttttttttttttgggacagagtcttgctcttgttgccttggctggagtgtagtggcacattctcagctcactgcaacctccacctcccgggttcaagcgattctcctgcctcagcttcccaagtagctgggactataggcatgcaacaccatgtccggctaattttttgtatttagtagagatggggtttctccatgttggtcaggctggtctcaaactcctgacctcaggtgatccacctgctttcgcctcctgaagtgctgggattacaggcatgagccaccacgcccggccaagaatgtcttttctttataatgttgtctctaagcatgtaatcttttcggcaaattttattaagcacctatagagttcaagccactgtgggttcaaagatagccctcattcctgattgacaaagtatcttgctatgaccatcccttctttcccctctagtcaaaattagtctcttcttcactcataatgcaaagtacattggattactattatgccacttacttgaataattgtcttgatgagtaatatatgtagtcagtaacatggttaagtgtggcaatttggattgatcccattggacttttcaattgctgcatccaggtgtaattaccataagagcatagaagatagaatcgtaaagctgaaagacatcttaaagatgatttttggggactgatttggaaacagatccaaagacactaattgacttgcccaagatcacagattgtggcagaaccaaccaatgtcttttttaaacattaaggacatcttatatgtatatttatgcatatacatactgatgaaatgtgcctttagcaatagatgtgtccagtgatgtactaatgaagatttaacaactggttctaacttgtaatgtttgccagtttccatgactgggtcttacaagttgttgtgcactgactccatcattccactggatgtgcccctgaaatcatatatttactactaaaaccattagattgtttccttgttccagttatgcattcagagacactccaccttattttctgattacatttgcagggagaaataactccttacttgtcagtttcagccttcacttttagtttctttttcttttcctttttccaacccagtataccttagaaactttcagtttcttttaaggatttaataacttgcttataagtgtttaaaatgacttaatgggttctatcttttaagggaactttggatgaatccttgaatatcagttatctattgccaattaacaaatcaccccaaagctcattggcttaaaacaacaatctttcattagtttgcgttcttccaggtaattcttatagtctggatccagctcagcttatcttggctggacttgcccatgcagctgaggtcactagttgggttgttgaggctggctagtcctagatggtgtcactcatatgtctggtattgagtgactgtcacctggggcattagggggactgtgtctctcatcatccagcaagctaggcctggattcttcacatggctttaggatttcaagagtatgagattggggctgggcatgatgactcacacctgtaatcccagcactttgggaggccaaggttgggggatttcttgagcccaggagttcaagaccagcctgggcaacatagtgagagcccatctgtaaaaaaaaaaattttttgagatggagtttcgcccttgttgcccaggctggagtgcaatggcgcaatctcagcccaccagaacctttgcctcttgggttcaagcgattctcctgcctcagtctcctgagtagctgagattacaggcatgagccaccacgcccagctaattttgtatttttagtagagatgggtttctccgtgttggtcaggctggtcttgaattccccacctcaggtgatctgcctgcctcagcctcccaaagtgctgggattacaggtgtgagccaccacgcctggtcttctacaaaaaaattttaaaaaattagctgggggtggggagggtggggtggtgctgcatgcctgtagtcccagctatttgggaggctgagatgggaggattgcttgagcccatgagattgaggctgtagtgagccatgattgtgccactgcactctaggctgggcaacagaacaagcacctgtatcaaaacaaacaaaaaagtgcaagattggaagcttcgaggcttcttgaggcctagtctcagaactggcacaatatcacttcataaggctatctcagattcaagggagtaagaggagagatgctacctattaaaaggagaagcagcaaatactatggccattctcttcacaatagttgtcaccaaaacgtaatcgatttgtttatgggtttacattgtcatgtctccacaggacaatgcacatggtatgtttgtcagaacccagttggagttttgtttcccagcatccaaaggaaatccctaactttcattttttcttcccgtaagcagccccgaacacttacttataagccatctctacctgaattagcaatcatggataagctcaataactgatcatttccttatcagtttaaaccatatatattttaacactgtctctttttcacacacactagttagctaagaatgagctggggggctgggcgtggtagttcacacctgtaatcccagcactttaggaggcggaggtgggcggatcacttgaggtcaggagtttgagaccagcctagctaacatggtgaaaccccgtctctactaaaaatgcaaaaattagctgggtgtggtggcaggcatctgtaatcctagctactcaggaggctgaggcaggagaatcccttgaacccaggaggcagaggttgcagtgggccaagatcacaccactgcactccagtctgggtgataaaacgagattccgtctcaaaaaaaaaaaaaaaactgccaaaacgctttttgcaaagtggttgtaccattttatattctcaccaccatgaatgaaagttccaattgctatattcttgccctcatttgataatatttttagttttagccattctaatggatatatagtaataatttgatggttttaatttgcatttctctgatgatcaataacattaagttttgattcaggtacttgttgggcactcatatctttggtgaaatatctgttcaaatcatttgctcttttttttttcttagcacttaaaaaagactttttgccaggcacagtggcacatgcctgtagacctagctactcaggaggctaagacaggaggatcacttgagtccagaagttctgggttgtagtgagctatgtcaatcaggtgtttgcactaagttcagcataaatgtagtgacctcctgggtcactgggacccagagttgcctaaggagcgtcagaagtggagcaggtcaaaactcctgtgctgatcagtagtgggatcacacctgtgaatagccactgcactgcagcctgggcaacatagtgagatcctcatctcctgaaaaaaaaaaaaaactttagtttttaaaagtagttttaggttctgagcaaaattgagaggagggtacagaaataacttatatatcctcagtgctcccctcccccatgcctccctcatcaccatcccccagcagagtggcacattggttacaattgataaacctacactgacacatcattatcacccaaagcctattgtttccattagggttcactcttggtgctgtacaatctatgggtttgaacaaaggtacaatgacatgtatccatctttatagtcatgcagagtctacactgtcctaaaaacccttggctctgcctcttcgtcgtgtcctccccactgacccccggctaccactggtcttttcactgtctccgtaagtttttcctttttcagaacgccatatagttggaatcataaagtatatatagccttttcacattggtttctttcactggataatatgcatttgtttcctctatgtcttttcacagtttgatagctcatttctttttagcatcgagtaatactccattgtctgggtgtacaacagtttatccattcacctgctgaaggacatcttggttgattgcttccaagttttggcaattatgaataaaattgctatagatatccatgtgtaggtttttgtgtccatttaagctttcaactcctttgggtaaataccaaagagcacaattgttggattgaatgctaagagaatgtttcgttttgtaaaaaaccaccaaactgtcctacagagaggctgtaccattttgcattcccaccagcagtgaataagggttcctattgctcaacatccctgtcagcacttggtgttagtgttctgaattttggccattctaaaaggtgtgtagtggtgtctcacttgttttgtgtttttctctgctcagacagctcatccacatcacatttattttaatttgcatttccctgataatatgtgatatggaacatctatttactcattattttttcttcttatgattgaagttataatatttctttaaatattttggataaatcttttgtcagatatatgcactggaaatatttttatgggggaccagtgttaagattagatctgtttaaagagaaaggagagaaagtttcaggcagggaatgcaatcgatgtgaaggtttggggtaatttgtttcatttatctttaacaccatgttatggatggcaaaataacttcactggctttttttatcaagaaaagacttaccttttctgaatgcaacagtattagtaaacctaatggtgacaataaaagcgattctgaataaatgaaaaccaatagattgttctagttttactcataaatataattcttcatatactgagttcagttttttagccataaatgaagacatgggaaaaccataacatgttatttgctgagaagttctggcaaatgaagcaataaaataatcaaaactaaatcaacatttaaatacagaacataaagagataaatccaaaaccagaagatctctttgaaagaaaaacctaagtaattaaaaaactgaaagcacagatattcattatttcacaaataaacgttaatgctttttagacatctttaagcaactttagattgctaaaactaaaaaatgcaattaagacaataatcttatatatagacaataattgtcttaataataatcagcatcaaagattcttagaaatgttgggagactgtgtggcaaagaaagtacttcaattaccagttaccaacacacaacaatttgaaatatccaggaagatcaacccatagaacaaagaaagctaataaattaccttttcttgcaattggtttgatgtaccattaatatatagatattactaatatggcaattagtttatatgctatttgaatatgatagtaatatgaaggaagattctcttttttccacttcattgccaacaaacagctaactctaaacaacagtaaagtgtggaataaattactttgttaattaatgtggtttgaagctttgtaggaatccaattggatggatagcagcagtggtaagagaacattccggaataattacctaaattaaggagcttgccctagaatgtaaatcaacctactatatctttttatttgaaaaagtcttggtagaaaaagcatatcaactgaactgtacagtgtgttcagtgacttagtaaagaacataacttgtgtaaaggctaatgcaataagtttgagattgttctctttatgtaatagtttggaaaacaaacaactgtgattacatttagagatatgatgattatctagagggaaagttctgttgagcatatttgaacatttaattattgctgcaagaagccagtttggtcccagctttataaagatatacattgggctgggtgcggtggctcatgcctgtaatcccagcactttgggaggccgaggcaggcggatcacctgaggtcagaggttcgagaccagcctggccaacatggtgaaaccccatctctactaaaaatacaaaaattagctgggcgtggtggcacacacctgtattccttgctactcgggaggctaaggcaggagaatcgcttgaacccaggaagcagaggttgcagtgagccaagattgtgccactgcacaccagcctggataaaaagagtgaaactctgcctcaaaataaaataataaaatgaaataaagatataaattggccagctagagttacctgaagttactatcttcaattatctgaagacagttctgatagcttcagaattctttcatacaaggcaggaatgcaacttgttttttaatggcagataaaatcaaagagcaaaagcaaaaggtagaagcttgaaagaccagagttgctacagattgttattacatgttccataatttaacaattgtcattgaagttggtgattgtcttgatattgcacatctgtaagaagtaatcaaactattgtgaatttgatagaatgctttaagttttattttccaacaaaagaatgtctacatacggcaaattcatagatctggaatccatttatgtcatcaaaagaggatttaaatttaattgtaagcttatatgatacattgttctaactggcaactaatgaaggattaaaaatgaattttgaaaataccacaccacttgcttcattttggataaaagttaaaagtgaatattctgagtatgctgaaattagtttaaaaacttttttttcccattccgaccattatccctttgtaaatctggtttcatcttatgaataatattttttaaaaaccatggaaacagtttagatatacatcaatccatgaaagtagtagtattgtcaatctaccctggattacatattttaacgagaaagaaaccagctcatttgtgacatttagaattttttttttttttttttttttttgagagagagggtctcattcattttattgcccaggctggagtgcagtggtgcaatcgtagctcactgtaaccttgaacttctgggctcaagcaatcctctcacctcagcctgcagctggagcttcaggtgtctgccatcacgcctggcaaatttattttttgtagagaccaagtctccttgtgttacccaggttggtatcaaactcctggtctcaagtgatcctcccatctcggcccccacaagtgttgagatgacaggtgtgagccaccttgcttgacctaaaaacttttgaatattaatatgcattgtgtttattcaaagtatatctaatggtctaataaacagaatcactacttcaattataatcttcagttataattgaagaatgacaaaaagttgagttatagaaattatattaatcttaaattcacattttcagtgaaagtttttaaataattttttctctttccgttttatgtgtgttccaattctatttattgaaatttaattttatatccattaacataattaaaaattggggcttttaaaaaatgtttttcattctactaatttcattttataatttataaaagtactagaccacaatggattaaagaactatcctttcatcacagatagttcaatgactcctgtttttttttagaccgagtcttgctctgtcaccccagctggagtgcagtggtgtgatcttggctcactgcaacctccgtctcccaggttcaagcaagtctcctgcctcagccttccgagtagctgggactacaggtgcccaccaccacacccggctaatttttgtatttttagtagagacggggtttcaccatgttggtcaggctggtcttgaactcctgacctcatgatctgcctgcctcggcctcccaaagtgctaggattacaggcgtgagccaccatgcccagccaactcctgttttatagtgtactttctggaatattattcagctttctcttgaattcttttagtaactaggagttcactacgtttccatggacctaactccaataatgattggacagttttctccctctgctttttctttctttctttcttttttttttttttttttttgagatggcgtctcctctgtcaatctcggttcattgcaacctccacctcccaagctcaagcgattcttgtgcctcagcctcctgagtagctgggattacaggcacccaccaccacacctggctaatttttttttttggtagagacagggtttcaccatgttgaccaggctggtcttgaactcccgacctcaggtgatctggctgccttggcctcccaaagtgctgacattacaggcatgagccactgcacctggccattattggacagttttaatggaaagtgtttccttatattgagtggaaatcagtctgcttatggtttataatcctcagacttgattctccccctgaatctatatgaaataaatttactcctatttgaaaatatttgtcatattccttcttatttttctttaagctttattttttcttattatccatatgacatgtttccagaactctcccttatcctgattgtcctcctttagacacatgcttttaatgatatatttcttaaaatgtattacccaggacaacatatttttttttactgtggacagtatacttttacgaatggtgccaataatgcattacattttttagcagtcatgtcatcctcttgatttgcattgagtcatcatttcttaagagggaatcaggatatcaaaatagtctccaaactcagctgattccttctgcagatacactctccacccttcttgattccttttcgggagaaaagaaaaaagtttattttcattgctaacctcactgatttttaattttaccatttaaatgttagtaacagctggtaatgtaaccaaagaagatttttggcaggggatgatgcattcagagccttcactctggctacagggagaccatggaggatgggctggaacggaagcacgatggactcctgggcacaccgttaagtgactgatggagtcattcagctgacaaatgataatggcctggattaaggaaggagaagaggggaccaagaaatgccagagatacataggaagtaaaaattaataggccttggcaactattttttttttttttttttgagacagagacttgctgtgttgcccaggctggagtgcagtggggtgatctcggctcactgcaacctctgcctcctggattcaagcaattttcgtgcctcaacctcctgagtagctgggactacaggtgtgcatcaccattcccaggtaatttttgtatttttagtatagatggagtttcgccattctggccaggctggtctcgagctcctgacctcaagtgattcgcccgcgtcggcctcccaaagggctgggattacagacatcagccactgcacctgggttggcaactaatttacacggaatggcagagagtgattaatgaaaaagcggggagaaaagctgctcttgacatctgaaagctgacttggcattcacagctaggctatgttattttcctattgggcataagtctcacagaataccaacattaaacaagatgactctgaaaccttaataaagtgagaaaaaacaagtccactttgtaattttgtctaagcacaggcaaaaagagggtcatggtgccatccagaaaataccaaaaatcaccctctctcagctaaaatgagcaactgctactttaccagtgacagctttgtcccagctctagtctgccttccctatagagaagatgtattgagataatcatgaaattctccttctttctgatagtatccaatctggagcaaacccgtttccttagaccctctcccaatcccaaattctatactaggttcttctaaacactctcatactgagacaccccatggttccctatgttgtgtgttcttctttgctgcaatgagtaataaactcaacttgtttaactagaggtgtgttcctggtggtctctggttaaagagcattgatgttaagaataatttcagagtttcttgcttggacagtcaggtgtgagtagtgccagtaatagaaataaagaatactggagaagaagaaaatgtcttcagtttttaacaggttacctttgagatattagtaggttactccaagtggagatatccaagaagtaattggatggatttatgactctggagctcaagagagatgtctgtgctgaatctatctatcagtcatccatgtacctacctacctacctgtagctacacataatatactcagaaatgtacatatttgagagcttttttttttttaaggcaggatctcactcttgctcaggctggagtgcagtggctcaatctggcctcactgcagccttgacctcctgggcccaagaaatcctcctacctcagcctcccaagtagctgggactacaggtacataccaccacacctcgctaatttttgtgtttttagtagagacggggtttcaccatgttgcccaggctggtttcgaacccctgggctcaagcgatctgcctgcctcgacctcccaaagtgttgggattacaggtgtgagccgctgtgcctggcccattgtgtgtataatagctgaagctgtaggattggcaaagagcccccagagaaggaaaacaatgagaaaagaaaagggctgaggacacggcagcaaggaatatcccatatacttatgggatgagcagaaaatgagatacagaaaatgagaaaagactcttagaaggagctgtcatgaggaaagataatcagaagcagaagaccagatgttagaggagagagtttcaaggaggatgagattagtagtttaataggctgctaaaaagtcaagtaagataaagtgcccttcaagctatttgatatatatccccatcatttttcgagcacctctgttttttggcacaataagatgttcaggctcctcttatactttcctgtcctagccctggaatcagccatttctctaaggagtcctgtatccttttagtggaaactggtatctagaaaccaagatctggtgtagtattcctttcaagaagcttgtctgtgaagggttatggctgtatgatcacacgtgggactggaagtacagaggggatacctggctcaggtaaagatgaacaaaacattgctgggcatggtggctcatgcctgtactcccagcactttgggaggccaaggtgggaggattgcttcagcccaggtgtttgagaccagcctgggcaagagagagagaccttgtctctacaaaaaataaagtagccaggcatggtggcaggcatctgtagtcccagctactcaggaggccaaggtgggaggatcccttcagcctgggaggttgaggttgctgtgacccgtgagtgtgccactacactcagccagggcaacagagtgaaaccctgtctcaaaaaaaaaaaacaaaaaaccgcaaagcagagatagtatgatcagaactgaagcttaaggccaggcctagtggctcacgcctataatctcaacactttgggaggccgaattggatcacctgaggtcatgagttcaagaccagcctggccgacatggtgaaaccccttctctactaaaaatataaaacttagcctggcatggtggtgcacgcctctaatcccagctactcggaaggctgaggcacgagaatcgcttgagcctgggaggcgaaggttgcagtgagccaagattgtgccactgcactccagcctgggcaacagagtgagattctgcctcaaaaacaacaacaaactgaagcttaaggtcagaagcaggtttgaagatgatttgaccttgagtcccagatagcgaatagagctcctaaggttgggattcattttttaagaaatgtgggtgaagctctgcttctcaatagacatgaagtgatctcagctgaggaaagaggccatctgcccaggctgggcaccaagcaaaacctgaaaccacctttgaaatgtttgggaaagctacctgtgccaagaattttatcctggtgtaaaagctttgtataaacaaagcaattataactttgtttattaaagtgagaattattattattgttattatttttcttttgagaccgagtctcgctctgtcgcccaggctggagggcagtggtgcaatctcagctcactgcaggctccgccccccgggttcacgccattctcctgcctcagcctcatgagtagctgggactacaggcgcccgccacctcacccggctaattttttgtatttttagtagagacggggtttcaccatgttagccaggatggtctcgatctcctgacctcgtgatcagcccgcctcggcctcccaaagtgctgggattgcaggcgtgagccactgtgcccggccgagaattatttttattgactttaatatttttcattattaaggaaataatggaatgttttagttccattatttgaattaaaatcttccaaagaagattgaagctgtacttcaatcttgatcccaacttgatcccaaccttttttgttctggaaaatgcccattttcttactgcaaatgcatctcaaggggattccctcctcctggccatagtagattggactcgaggtgagtaactatattaagtagggctgacccatttatggtgttttgtttcttggtaagcacatgactcacactaggccagtgagggtcatttctcaggatttgaaaaaccagagctggcgcaagaggcttattcgttttctaggaccaacagagacgggggacattaggtttgtttgtggcgtagttcctaggaagaagccagtgcaagagaaacaagagatgaagagagaagattccaggctgtgtctgaatctctgattcctggtctgtgagccccgggtgtgctcttgccatctcagaatcacgtgaacctctcttccaacacagattccttttggcctctgctagtttgactttgcgtttcaaccacatttcaccaaaaaagagagaccttgctcataaagtgacttcaaataaacttggttttaatttacattgtcaaaagctaacctccttttgataagtatctccagtatcccacctaaaatgccaagaaataaagtgaccacaaatggctgatgtgtttttcctaataaaagcagcaattgttcaaaataatttttttctatctatacctaatattagaacatttatgcaggcaaccccccaaggatctctttcttgtgaatcacattagtctaaattgtatttccacttctctccttcctatcacatgattgcattgaatgtatattatcacttcattcaaatactttcttctctaaagcaacaagaagtaaatcatttgtaagaaaaagtacatatacattcttattttcttcccttaagttacatataatttcccagatgcctactcaaacttatagtatctctaaccacgacttattttaataggttggactgtccctatttgctcttttagatttccaggtccttaaggttaagcagaaaccctaatccttgtgtttatccaggcaaatgctaatttcaaagacagctatctaatctggttagcggttttgttctttgaaaataatcctgggtttgcttataatagcagggttaatcattgtaccgatagtttttggtttgtttttgtttttgttttgtctataccttcatagagaatcagtctcctattttgttctgggattcacccgttccccatttccagtctgagatctcagtggtactctgaccccctgcattaggaatagagtcatggcccagggccaagaaaacctgcacatgtgttcctgaagtgggcacatgacctaaaccagtacaattaggggacatttccagactttcatgaatgccaccaacagataagttttttctctctgctggacatgaccttgagggactatgaggctggcatttctgcagccatcttatgatcatgaaaagattatctgagaatgaagtcagcccaaaaggcttctgagagatggagaaaaggaaaacaggtcctaattatttgctaattacctaagccaaaaaagagacttttttgctaaaactcattcaaatggatctttgttacttacaaccaaaatattcttaactgatattatacttatcatgtgaaattaaattgagtaagaagaaaaagtgggtaaatacatgtgtatctgatttttttaaaaaagaataagatctgagaaatgaatgaaaactcagaatctattggccgtatcagcttatacctatatgtttgccacaattatttatctggaaagagaaacaaggctctgagcattttcttctaagacattcagtcagtgtcttgggacatccagagttggagagatttaacccagtcccttacaatctctatggcaacaatctactgcaataaaacagttgttctgaatagtgaccttgagatgcactaaagccagtcgtcagaaaaagatgcatagtcttacagaattttagatcacctactgcttagtaatgccattttcaacagtatagattgaaatacatatgtagggctgaaactttaaataactgaaagattaaatatatgaaaacaatggtttttccaatgccttcctttcttgatgaaaatcccttctttataaaaactactacacaagagagtttttaccatggctgggccttcttaggtcttggagaacatagaaaactaataaacactacctctctttccccatcctataactcctatgctaggactggaagataaacaaatctttttattttttgaagtaatctttaagaaatgtgatacattttctttcaaattacccagaaggaagcatatggagtagaaaatggaagaaatttacaattagcagattcatctgaattctatccctgtccataactggaagaactactagatgtagttctaagttagacgtagggtaagccccactggggtatggcccagatctgtcttaattcattggcatacaaccaatgccaagcacagtgtctggcacatatactaggtgctcaataaattttctttaaataaactcatatatggactttgcatgagtttcttatcctttcttagtgaggttaactgctgcaacaaccaccaaaaccgcagtgccttgatacagtaaatgtttacttctcacctttgttacagtctaactctggccagtgaatggggagaaatgtgtatgctccacagtgccattcagggatacagcctccttccaagtggtagtggtggcttccccattccttggggccgtgggctcctcttctggattgagggcacccagccagctggcaaggaagaaagaatgtggaaaacagaggatcatgcgctagctttcaatggccagccctggggggggggactcaaatcacttccactcacatcccattggtcagaacaaagttttatgcaagctcaccgctgcaactgcaagacagctgggaactatgctctagcggtgtgccgtggaagaagagaaactcaaacactggtgaatgttagcttgcttggcttcactctctgagccccatattcttttgaaagtggaattaataattgctatttgccagcactttatgaagattaaatgaggcaataaatgtggaagcacttgataaagtgccaattaaatcttagctataaatattcctgggtaatttgcttggttacattacctctgcacatcatctgtgaaatgtgtaggctgaaatgtactctaggagtcctttccagctctaaaatgcttagattctgtgtttcttttaaactttcagcaagtgtctttgaaattttgtcgaccctttaggatcctacatgtgattctacaagctaaccctcttgccctcaaatcctctttcattgctataattttgcccgtgatctttttgagacataacctgactctgttttatctcattttaattctgttatttccaactatagattaaaggtaatctttgccttcctattacattagccagtttcagtctgttagatttcttttttcttttttcttttttttttttttgagacagtctcactctgtagaccaggctggagtgcagtggtatgatactggttcactgcaacctctgcctcctgggttcaagcgattcttgtacctcagcctccgaatagctaggattataggggtgcactaccatgcctggctaattttttttgtatttttagtagagacagggtttcaccgtgttggccaggttggtctcaaactcctgacctcaagtgatctgcctgccttggcctcccaaagtgctgggattataagggtgagccactgtgcccagcctggtctgctagatttcttaatttcagaaggaaattgtagctgtgaggaaaagaacccaaggagatatttgacagatttgaaatattaaaaacaaatatgattaatcctgccttgaaagagtctatataatagaggtttggttcaatctgtctttttttcctgtggcttccttagttgtcttaccccagcttcccagccttttttctccagctaaatgcccctgtccattgacagctgttttgaatggttcctggggagtcagccaggtgaagtctgaaatcttctatattaaattcaggcgaggggctgacattcattaacgctcaagggtatactggctcctaggtcattcacataaaggagagaaactggtctatccacttccattctagccctttctaatctttctctagaccaaaatcagggtgctctttttgcggtgcaaatctggtgtcatttctgtgctttcaacactttagcatgtgtatttaactttttaaaaactttttgatatagacaaataataaaatgcacagatcttcagtacagtttgatgagttttgatatacctgtgaaaccaccaccctaaacaagataatagactataccatcatctcagaaagttcccttgctccccatttcctgccatttcaccctcttcttacctgctacccaaagaggaaaccagtttctgatttttgtcaccatagatttgttttgtctatttttggatttcatacagtcatacaacatagacttttttgtgtcaggttaattttactgcacataatctttctgaaattttcctgtggtggcgtgtgatcagtagtctgtttaatttatttatttatatggagttttgctgttgttgcctaggctggaatgcagtggcgcaagctcaccacaacctccgcctcctgggttcaagtgattctcctggctcagccttccgagtagctgagattacaggcatgtgccaccaagcccggctaattttgtatttttagtggagatgggggtttctccatgttggtcaggctggtctcgaactcctaacctcaggtgatccacccaccttggtctcccaaaatgctgggattacaggtgtgagctattgcgcctggctaagtctattccttttaaatgctgagtgtggatgctctatatgaatatatagctttttttttttttttgagacagagtcttgctgtgacacccaggctggagtgcagtggcatggtctaggctcactgcaacctcctcgtcttgggttcaagtgaattatcctgcccccagcctccttagtagctgggacaacaggcacgtgtcaccatgcctggctaattttgtatttttagtagagatggggtttcaccatattggcaggctggtctcaaattcctgacctcaggcgatccacccacctcagtctcccaaggtgctgggatttcaggggtgagccactatgcccagcctatggcaatttatttatccactctcctgttgattgacatttgggttggttctagcttggagctattttaagcctgctatgaatatttgtcttcaagtcctttgtggatatgagttttcgtttctctcaggtaaatactcaccaaatcatagggcctttgatagtctaaagacccattgtttttaggatgaagactcaaacctaaggccccacatggtcctgaccacttctctggaggcgtcctgcacacttgccccttcccttaactctgaatttcagcctctatgtatatgttcttccctctgcccagaacatgcttccctccctctcttcctgttaaccttgactcatccttcagatctaaacgctggcaacattaaggtaaagccccttatcataggcattcccagctctgtgtgcttgatgtcctagcacttaccaagactgtggctttatattgacatgtatgagtatttgtttaatgtttgcttctcgtgcaacagcaagcgtcactagggcagatgttgtgtttgttttattcacgcagtgcctagcctagcttctggcacatactaatcactcaacaaaccattgtgggatgcatgaatgatgactgccctataccccatggcgaatttttttctctactttggtgaagtctcatttggtcacccagagaagaaaccctctgtgccctcatcatggattttttcatgacctggacacagcaagaggggaaaagacgaggcaatcagttacgttcaggctacctggcttccaggaaagagaaaagcttaaacttcaatcttgatcattcttgtcctaaaccattatgtaaaccaaattcctgctaaacgggcttccaatccaaataagacaacaaggcaacacagttagcaaatatttcaccttgaaggaggccaagagatttgctcctggtattttttccccttggtttgtcttctggaacaaccgggtactgggggcattctcaagatggcactgcgtttcttagaaagtgggactgtttcttggtagaagttgttccagacgctgggtgcaatggcgcacgcctgtaatcccagcactttgggaggccgaggcaggtggatcacctgaggtcaggagtttgagaccagcctggccaacatggtgaaacccagtctctactaaaactacaaaaaaaactagccaggtgtggtggcgggtgcctgtaatcccagctactccggaggttgaggcaggagaatcacgtgaaccccagaggcagaggttgcagtgagtcgagaatgtgccattgtatccagcctgggcgataagagtaaaactccgtctcaaaaaaaaaaaaaaaaaaaaaaagaaaagaaaaattaggggccataatgttcttccatcaataaaatttgtttcccacgtggaaatgcacaaccatggggcatttttactgtctgagtggccacatgggggtgctgagtcgaaaggcacatttaacaacgtgttgttactgtgagcaaggctattcggggatgcgttttgctatgcatccccccaaaatcccaatacatgcagtaataaagatgattaatataatcttacataccttcacatgactctgtctttttcatggggaatttcctccccaggtgggcgttttgtctgtctcgaatgataataatgagtagacaagtgtatggatactgtctcttctttagatgttttgcctttgcaaaaagagtgcaaatcgaagtgatcctacagatgagctgtaagtgttaaagaaaacaacattagtttgtatcaccaccagactacttttattgccaccagaaaatgaaagtgttttaggaaacagcaaagccctataaaaggaatagaatgatgtccgccagtcttgaaatagggatgggtgattcttgaagaggatttgaggaagtcaaaggtgataatacacgttagaaagttgtggggggtacaggtgatggattgctttttatttaaaaatatttattattattcttttgtacttgatcttagccaaaaggccgaggagcaattattattattttttgagacagggactcgctctgtcactcaggctggtgtgcagtggtgctcactgcaacctcaacctcccaggctcaaaggatcctcctgcttcagcctcctgagtgcgtgccactgtgcctggctattttttttatttttttgtagagatggtgtcccactgtgttgcccaggttggcctcaaactcctgggtttaagctatcctcctgactcaacctcctaaagtgctggcattacaggcgtgagccactgcacccggcctggattgcttttataattaaaacagaaaatgatttaaaaatctagcagagaaatgaaggttaacataaaataacaacaacaacaacatagatgatattaacactcctggaaaagcattgaatggaagaaggaaagatgaaaacaactccttctcctcccccaaaataaacaacaaaaaacttgatcttgaatatgggtccatggaagaaactctccttcaggacattttagatggaaatagagtccatatgcagtaatgggtgtgctttcatctaaaatgagcttctgttaataatagttctagagcactttgtgtgtgctaaaatttttttctgagattttggtttgaggatctttcctaatttaagagaattttattcgttcactgttttgttaggtgaagagttggaaatatttctgtctcattaaacagcctcgattcaaagacagaccacctgcctgatttcctactctagtcctctaaaataaagacaggcaactgtgggcattcctgaaaattgtttgccttgtccattcaagctcatttttaaagaatgactcacggccaatctgcactccagcctttgatacttaagagtgtgtgtgtgtgtatgtgtgtgtgtgtgtgtgtacgcagaggaatggtggagagaggtataaaaagaaaatgaacaaagaagtgtgggttagaagccatactctgagctaagggctgcacttaattggaaattaggggccaacctacaagtacaatgctataaaactaagatcaggacaaagccatcaaagtccaagattactctgggggatagagacatgagtctgaagcaaatgacattgtgcctcagtgtgtgggcagacctagctttgaggagactggggaaatgttataattttggaaaccctcttgaataaagaatacaattttaggtacaaatacagatgctcctcaacttagatggaattgcatcctgatatacctaccataaattgaaaatatcctaagtcagaaatatagccaggtatggtggctcatgcctgtaatcccagcattttgagaggccaaggtgggaggattgcttgagcccaggagttctagatcagcctgggcaacataatgagaccctgtctctacaaaaaaatttaaaaattagccaagcatggtggcacatgcctgtagtcctagctacttgggagatggaggggggaggatcgcttgagcctgggaagtagagactgcagtgagctatgatggcatgatggcactccagcctgggcaacaaagtgagaccctgtctctaaaaaaaaaaaaaaaagagggaacaaaaaggaaatgcacctaacctactgaatatcatagctcagcccagcctaccttaactgtgctcaggacacttacatgagcctacagttggacaaaatcatcaaacacaagcgtgttttataataaagtgtagaacatctcatgtaacgtactgaatacagtacattgtagagtacagtatcagttgtttaccctcctgatctcatggctggctggcagctgtggttgataccactgttcagcatcttgagagtactattgaatattgctagcccaggaaaagatcccaattcaaaatgccaagtatgatttctactgagtgtgtaccacttttgcaccattgtaaagtcaaaaaatcataagttggggaccatctgtacaataacaagacgacatggcagtgattactaaacacatacacacatccactacacccgacttcgcgtatccccaagccagattccatagtgtccaggggcactccagagttctctgacacgaggaagattgtgatggaagaaaagtcagagagaaaggacttatttgttaaaatgcatgatcaggtgcagtggctcatgtctgtaatcccagcactttgggaggcagaggtaggtggatcacctgaggtcaggagttaaaataaaggccaggcgcagaggctcatgcctgtaatactagtactttgggaggctgaggtgggcagattgcctgagctcaggagttcaagagcagcctgggcaacatggtaaaaccccatctcaactaaaatacacacacacacacacacacacacacacaaaacagccaggcgtggcagtgggcacctgtagtcccaactacccaggaggcggaggcaggagaatcacttgaaccgggaggtggaggttgcagtgagctgagatcacaccactgcactccagcctgggtgacagagcaagactccatctcaaaaaaaaaaaaaaaaaaaaaaagagaaaaaaaaaagaattttatttttatttctcaaaaggtatacgcactttccattttgatactgtcaaaatgccctcagaaaagttgatgtctgtaggcccacaatggtacacaagtgtcctcttattccttaacaaaactgagtgagattcttttttaatccctgtaaacctgctgggtaaaaaatagcttattgtcaatcatacttgctatttttattattagcttgatggctaattttatgtgtccatttggctaggctctggtacccagtttttggtcaaacaccagtctagacgttgctgtgatggtatctttttagatgcgacttaaatttaggctgggtacggtggatcatgcctgtaatcccagcactttgggaggcctaggggagaggatcccttgagcccagaagttgaagaccagcctgggcgacatgacaaaaccttgtctctacaaaaaaaaggaaagaaaagaaaattagccaggcttggtgatgtgtacctgtagtcccagctacttgggaggctgaggtgggaggatcaattgcaccttggaggttgagtctgcagtgagccataactgtgctactgcattccggtctgggcaacacaatgagaccctgtctcgaacaaaacaaaacaatatttaaatcagtagactttgagtaaagcagattacctccataatatgggtaggttttgtgctccttatgagaatctaatacctgatgatctgaggtggaacagtttcatcccgaaaccatcccccccgacccctggtctatagaaaaattgtctttcatgaaactggcccctggtgcccaaaaggctggggacccctgtcctagaagaactcatgttggcattaagagtgtatccgccatcatccatgtgtcctccacctgagggatgcccttttgctcctccactaccttttcttccacatctcagacatcttggagggcctctgtttctcgaaggagatggtggtctccacctaacaccactttcaaaagatggttcgttggcttgctctacttgaattgcttttccatccaaagactttcccttcatatcgttggcagcattcttagcatctgcagggctctcaaaagtaatcaatgcaaagtctctggacttgattttcccatccttcatcaaaagaacttctgctatgtggccatatttcccaaatactgcttaaagagccttttcattaggttctgtattaaggccacctatgaacagcttgccaggtggatctgcttccacaattttgctccttttccagattttctgagatctcacctttatgcttccctgggtgatcattagctaaactaatctaaatgtctctttatatataattacacatgcacacatacatatacatacacacacacacacccatcctatgggttctgcttctctggagaaccttgtctaatacaattagtgaggttacctaggtcaaatgtttattggtatctgtatttcatttcatcttattcccttcccccttccctttcctcctttcctcttcctcctcctttccctctctttctttttgttctttgcccagatctttttttagatcctctgtgtgaacaggggtcccccaaagtgaggggctctggcctatgttccctaatttgctgggagtgaaaagcctttttgactagggacttgtactaccagtgagattgtgcaaataaatacattaaataaataaagctaagtaatggagaaggctgcttagttatgggaacttactttcaaaaccatttcctccttcatttatcagttaacagctgaatgcagaatttcctgttgtttctttttttttttcctttccttcatagcaagtgatatcatcacagctacctagaagaacgatttcccacagtgacggaggttccgtgatgtcattgggattacaaaagccaggaaagaaatttgctatcggtatttgttgccagaaattacgaagcaaattaatttcaaactttctgggaaagaaacccttcagtgaaagtaaacatttaagaaattattattatacaaggaaattctgtccttaatctgccagagagagaatgcctgcaacctcaaggtactaaataaacaggcctggtataagagagagttctattttggggatatttagtgggctaagtatctgtgccagcggtccccaacctttttggcaccagggacctatatcatggaagatcatttttccacagactggggttggggatggtttggggatgaaattgtttcacctcagatcatcacacattagattttcataaggagcgggcaacctagatccctcacatgttcagttcacaatagggttcgtgctcccgtgagaatgtagtggcgccactgatctgataggaagccatgctcaggtggtaatgatcgctcaccggccgctcaattcctgctgtgtggtctggtttctagcaggccatggacgggtactggtccacagccggggggttgggggcccctgatctgtgccaaaacgctaactatcttcagattggctaggctggtaactggactatttttcaagcaaccagacctgtcctgatgaagctttgaagtgtctcgctttctctatcctaggtcagatctcctgaacacggtctcccttccctttaatggaagtagaggtgctaggtttctgtgactgctgtaacaaattaccacaaaccggtggcccaaaaccccggaaatttattgtctcacagttctgaggccaaaagtccaaactcaaggcgtcggcaggactggcttcctctgcagggtgcagggagagtccgttccacgtctggctcctgtcttctggaggctgccgccatccttggcgttccttagctcataggcgcatccctctgatctctacctccatctgcacagccccttctccatgtgtcttctcccttctcttcaagttttttttttttcttttcttttcttttttttttttgagtcagggtgctctgttgcccaggctggagtgcagtggccctatcatggcttactgtagccttgacttccaaggctcagacaatcctcctgcctcagccccccaagtagctaggaccacaggcatgtgccacaacgcctggctgaattttcaatttttagtagagattgggggtctcactatgttacccaggctcattttgaactcctgggctaaagcaatcctcctgccttggcctcccaaagtgctggggttacaggtgtgagctactatgcctggtcatgtctcttttatggtgatacttaccactggatttagggcccactctaaccaggatgttaggtcatattctcaggtgaaaggtgttagggcatggacatatctttttatgtctttttatgccacaatttaacccactgcagtggatgagggtttatgaccgcctggccccatcttctcccggaggtgatggtgactcttgagagctgactctttcaagtggtggcatgtgaaatcttcacaggttcattcattcattactgtaatgggctgaattgtgttctcctgctgctctcaaagtcatatcttgaagtcctaactcaacacccagtacctcagaatgtgactgtatttagaggtggggtctgtattagtccatttttatgctgctgataaagacatacctaagactgggtaatttataaagaaaaagaggtttaatggactcacagttccacatggctggggaaggcctcacaatcacggaggaaggcgaaaggcacatcttacatcacagcagacaagacagaatcagaaccaagtgaaaggggttcccccttataaaaccaccagatctcgtgagacttattcaataccatgagaacagtatgggggaaactccccccatgattcaagtatctcccatggggcctgtctcacaacaggtgggaattatgggagctacaattcaagatgagatttgggtggggacacagctgagccatatcagggtctttaaattggtattaaggttaaatgaggtcattggggtgggccctgatgcaacatgactggtgtccttataagaaggggagatgaggacacgggagaaggcagccatctgcaaaccaaggagagagaactcagaagaaatcaatgctgccaacaactcgatctcagacttctagcctccgggactatgacaaagtatttttctgttgttgaagccactcaatctgtggtactttgttatagcagcccttgggaactagtgcagttactaagaacccactctctgccacatcttccacaaggcagaggcacatcctctgggactggctgtgagtctggagatagttaccattttagtccagatagttagcccaccaagtacccccagagaaggactatttgtctcttactaacatctcactgatatggtttattattctaaagatttgggtgtaaacaagagtttattatgtcttcaaatataaaaagctacagtaaacagctgatttttgaaagtataatgaggaagatgccatagaaactgtgaaagaggtcagtgaaactagaggagtccacctgggcttagatgatgtgatgtttaagctgggatcaaaaatgaataaatcacaggtgaacgaggaggaacgttccagtcagggaaaagtaaaagtctaaagaaagcctgagcaacatggtgaaacctgtctctaggaaaaataaaaaaaagtagctgggtgtggtggcgcacctgttgttccagccactcaggaggctgaagtgggaggattgtttaagaccgggaggtggggagtgcactgagctgtgattgcaccactgcactccatcctgggtgacagagtgagacccagtctcaaaaaaaaaaagtctaaagcagaaaaatattcgaaaaactggagaaagctggggagataggctgggccatactgtgaaaggacaatgagaagaccccaaagtgttttgggcagggatgttcttattggaaagatcactctgactgcagcgtggacccagagttagataggagaagactagaaccaggagactcagttaggaggccgtcccaggggtctgcaaagggggatggtggatggggtgagagattgagtgcagatagagagaaatggaaggattagatatttaggaagttgaagaaaacacatttcctcattagttcagtgtagaagggttgaggaggaggaaggagttaagtatgatttggataatttgatgggtaatgagtcatttactttggggaatattggggatgcttatggggaaagggattatatttatcaggacttccatgattgcaagtgacagaaactgaattcaaataatttaaggatataggactgatgtgaagaaacagagctactctacccgcttcatttctctctttttaaaattttcacttctcttggtgtgttggcctcattctttcctattgcagacttgcttcctccaggcaatggagagaaggtggtattgttgcaacttgacatttacgtcttcctagctcagggactccagagagagagcttttttctcccagcatcttagtttgaatttcactgtgcaaggtttagccccacccaattttaacctttctgaaatcggaagcgtcttttaatagatgtcatcttccttttttgttgttccaattggcagtattatttcttagtgatggataaaataacagtgtttcttactgtaatggagtcttagatgtaatgaaatccgtataaaattttagagaagggctctgactggtttggtgtgtgtcattgattgccactgggccaatcatggtgacccaagagataggggagtagatgatcagtactgggatacaggcccatccctgtggccagtgccatagggtgctatgattgaaaatcccatctgaactacacttagtagggagtggcagttgctgcaaataacagaaatactgctgggaacacatgaagcttgtcaggcccaaaaacatgatgaagagtgcttgagaaaacagtgagttcaatgtagactggtggctaaactggctggtgagatactgtattagtctgttctcgcactgccataaagaacaacctgagactgggttatttatttatttagagacagagtctcactctatcactgaggctggagtgcagtggcacaatcttggctcactgcagcctccaccactcgggttcaagcaattcttgtgtctcagcctccagagcagctgggactacaggcgtgcgccaccatgcccagctaatttttgtatttttagtagagacagggtctcaccatgttgaccaggctggtcttgaactcctgacctcaggtgatccacccacctcggcctcccaaagtgctgagatgacaggcatgagccaccgcacccagccgagactgggtactttataaagaaaaagaggtttaattgactcatggtccccaggatgtacaggaagcatggctggggaggcctcaggaagcttacaatcatggtggaaggtgaaggagaagcaggcatgtctttcatggccagagaaggaggaggagatagagaaaggggaggtgctacacactttttttttgtttttgtttgtttgtttgtttgtttttttgagacagagtctcagtctatcgccaggctggagtgcagtggcgcgatctcggctcactgcaagctccgacaccctggttcaagcaattctcctgcttcagcttcccaagtagctgggaatacaggcacacacccagctaatttttgtatttttagtagagacggcgtttcaccatgttggcctggctggtctcgaactcctgacctcaggtgatccacctgcctcggcctcccaaaatgctggcattacaggcatgagtcactgcgcccgactgctacacacttttataaacaaccagaccttgtgagaacttactcatgggaacagcaagggggaaatctgccctcatgattcaatcacctcccatcaggccccccttccaatgttgagtattagaattcgatatgagatttggacagggacacagacccaaatcatatcagatacccaaatgatgatgtcccctgcccattaaatttggcagcaaatttgtcaccttcaacttcactgagagcattttcaatagagtgcagggcaggaggccagctaaagggagttgaggaatgaatgagaattgaggaaaatgagatagggtggtcagaagccaaagagaattaaggtttgtttggggacattctctgcattgaggacagaattgctcatgcagcccttcaggatccaaggcaatgccctagagcagtagttctcaaagaccatcaggagccaccacctgggatttactagaaaagcaaattttcgggacccacccaagacctactgagttagaaactccaaggtagggtcctgtgatctgcattttaacaagcactccaggtgatttggatgcaggctaagtttgagaactagggccttagaagcctacagcaacaggcttttatggagctgaactatgatattatctgtctcagggaggcaaatgtgtgttgttaacatgtttacttcagctgggcttgctggaagcaaagaatctggtttgagttggggctaaggggggtaagggcacagatttctataaagcaatcaaatgagaaaaaggactgttgccttcccagggcaggatccctgctgtatgaaatccacctatttgggtttttcaagcagatgagcaatttgacatctttccactcctctgagcaacacagtgttaagtggatctcttgaaggatgagcctggtgcttggctgaagctgtcacaaagtggcatttctcacagtatttgcagaggccctgagaaatgttaaccagagactcagtttgctctttgatttcagtcttcacggttgaaaacctttcttaaatgcatctttttgccactttagaggctagaataaaaaccaaaagagcaaagtttgtgaaagattgttttatctttacaaatcagaatgggtttaagatgtagctctctaatgtcactcttactcacttgcattctgatttgctttcttgagagaaagagattgggatgcctggagttcctgttggctgctgggatttgcatgtgatccccgacatagactatttgtgacacacgctggtatgtgtgtctgtagctgatgtcctattaatagctgatacatgaatgtcatttgttggttgggcagacacaggaagtgtggcacgatgtaaattctgtgaagacagggctggttgattcaatgttttatccccgatacctagaacagcactcaataaacatgttgaatgaatgaaaaaaatgataattataattgaatcctggatcactcagaaacctacagattcagggtcaccagtctgagcattaattctcaccatctgggatcctaaatatagcatgtgtaggcagcactggctgcataatttgttggggccagtgcagaataaaaatgcagagcttcttgttcaaaaattaataactgtgagacagcattagcagagtattcagccaagcatgcagctcttctgagtgtggagtcctgtgctcctgcacaagtcacacccacgatgccagcccagcaggtaaggaatgggacaaaattttaccaattctggtaattttctggaaatggctttacaattttttccagaaatccttgaaatgactttttaatttaatttaattttattttaagatggaatctcactctgttgcccaagctggagtgcagtggcatgatctcagctcactgcaacctctgcctcccgggttcaagtgattctcctgcttcagtcccctgggtagctgggattacaggcacccaccatgatgcccagctattattattattattattatttttagtggagatgagatttcactaaaccccgttggccaggctggtctcgaactcctgacctcaggtgatccacctgcctcggcctcccaaagttctaggattacaggcatgagccaccgcgcccggccatgaccttttaatgtagttattttccatgaaaaagaaagtaacattaaaaatgaaggttgtctgtgataggactggattatcccaattcttttcttcctccttggaatgtatcctttctttgctatgttgctctacaatgcctcctactggagagattagagtctgtttccccacttcctcatgtcgggctggatcgtgaggcttgctttggccaatggaatgttagtgggcatgatcagaggctttaaatgtgctcatgaggtttggctttgcttctcaggctctgtcctttaccatgagaactgtcctgggtaagctgttggctcaagcaaatgacagaaatatggggtagacttgatcccaatcagctgccccagctaacctgcagacctacatagaaagatggaaaagaaatgcttttggtaagccaacaacgttttggagtcttttgttacacagcatttacataacagaaacctaagaaggcatccttcaggaggatcctaataaatgaatatcaactggtttttttttaaattttgaggatgctgaaaaagaacgacaaaagagactagaaaaagaatcaaaattaatgctgaatattggtatacaatcctgctcagaagatggtttaacctgatgctcaaatcaagtcattaagtcctaaaaaaactcagtgctaagcactttgcaaactttaattcaagtaatcctcccagtaacactatgagtgaagttgctaatatcattgtcgttttcagctgtggaagcaaaaaatcagagagatgtaagtaactcagctaaggccacacagcttggaagtagtgaagccaggatcctaacccaggtgggatggatccagagctgcacacttaatcaccacgccttgctacattgccatctagaaagcaaaggccagtggctcatgcctgtaatcccagcactttgggaggccaaggtgggcagatcacttgaggccaggagtttgagaccagcctgggcaacgtgatgaaaccccgtctctacaaaaaattcaaaaattagccaagcctggtggcttgcacctgcggtcccagctacttgggaggctgaggctggagaatcacttgagcccgggaagaagaggttgcagtgagccgagatcgcaccgctgcactccagcctgagcaggagtgagagcctgtctcaaaaataaaaaataaggaaagtcctggggaaattcaaggtacttttatctctgtcctgaacttgacttgacttcagaccacttctccttctgcctcctccttgatgatcaactcaaatacctgtttctttgctcttgccttcacccacaccttgagtttgatgcccgagtggatgatgctcccagctcccagcagcccaaactccactctccttacctagcatgatgtgtctgaggaaactgagccaataacccacttgtttgcatagcctagggctctttctcccaggatgtagctaccattcccaaccttagaattgggcccacaagaagaccttgagattcaaaagctttcaaggtatgtgggaagggtttgcaaaaggggaatcaggtttatggctaaatgtcaataagaatgtatgcccctgcctttctacacttctctgaatgcccttcagccaggcttcttggtgactgtgtggtggctgaggccattcctatagcatgaatatattaaaacatggtataatccagacatttgtcattctccctccaggtcattacatatgagcgggtctctttgacaatgctgtaatatgccctcaaggaggcttcatttatttagagctgcatacagattttgaagagaatgtatttaagacaagtagaaaaagaatcttccatccttattagagattatgtaaactccttgccagattctaatcttgctgatcccaaacttgccaagaaagcttttttttggacatcattaaatagatcttattctagttgtctttgtttgttttttagagattgcaagtactccataggatctccttaaagaagcagcaggaggaagaggcctcatttttaagaaagcttgtcttatgcttgggcaaaggtggacacatcagctactggtgcatgggccggcagtggagaggaaggatattcacaagacttaacagctagtccagaaagagttctgatcaatcagggagaggccctgttcctgacccatctgccaagcagatgggctgtgatcagaccggtcatcagaaggggagcatctctttcccaagaatcccagtccaagttccaagcctgtgctgggagccaccgttgttgggttgaactgatccagaatatacggtctgagagtagaaagggaaggttccctgcagtaggcagaataatgtccccaaacccaccacaaagaggcctatgtgtgaatccccagaatctaggaatatgttacatagcaaagggaaattaaggttgccaatccattgactgtaacatagggatattaccctgggttttccaggtaggcacaatgtaatcccaaggatctttaagaggagaagaaggaagtggaagaggaaccaccaaagagaaggcagcataagagggatctggcctggcattgctggctttgaggttggaggaagggactaccagccaaggaaaaaagaagctaaaaaagggaatgagacagattctccctagggcctccagaaagaacacagcccagttaacactgtgattttagcccagagagatctattttggacttctgatctccagaactataagataacaaatttgtgttgttttaagccactaaatttatggtcatttgttgtggcaacaatagaaaagaaatacattccccaacaggaaattagggcggtcttacaaaaaggaggaggaagatgctgggcaggccaacaaaaatatcagaacagatgtgtactgcagatgagatctctgggagtgcttgttctatagctccctggatgggtattttcccaggggagacagaatatactttcaaagtatcaatagtggtatggacctgttccacaaagcaaaagctaagctcatagcacctgtcagcaagaccagaagagctggagttaggagtgtggcctctgaaggcgctccacacagattggaaacctggttccctcattcaccagttgggtaactctgggcaagttacttagactctctgtgcttcagtaaaatgaggatgataaatatctgacagcattttcataagaatcgatgacatttatacacataaagaattaagaatcacttctggcatatggttaaggctcaatgaatgttaatggttgctcttatgactaatactataacctagctctggagccagactacctgggttcaaagcccagctctgccacttagaacttctatgcttgggcaagttacttagcatctctgagccccaggttttttcatgtgtaaaatggggatattaaaggtacttacctcatagagttgtgatgaggattaaaacattaatttatgtaaagtactagaacaatgcctgatatacacgatacatgttatctagcatcatcatcgttagtactagtatgaggtcactgtcactctggaggactaataactaaaacaccaccgccgtgatgatgcagtggcatcttatgtgatcattaagaccttttaggttgggaataaccatggttcccaaactgtagggacctctgggagcaacattctctatcttcctatcagaattcaaaccatggaagcaccccagtgagatggctatataatatatgaaaagaaaagaaagtagaaaaattcatcatcagaaacacactgtaagactcctgaaagggatgtagagagaacccacttgtgtctcctatttctctgctctgcagttctacagggttgcatttgcctgatgcttttgattcagtgtttttacactatgtaacatagtgagaacgttaggttaaggaagcttgccatttcccttttcagagcagtcctttcaacaataccaagaattcgcactttggtagataatgacaagaaatacgacagcccagccgttagtaaacaagcaaatcatctaatggcaaaggctgatttaatcaaaacattctggttctccctcatctgaacccacacaaggaatgaaccaatccaactggaaaaaaatatttgttttatctttgccacatttatttactcttaaggactgtttaacttgatggggcagagaagttggaaagaacaaaaatactcaaggcagtgaacagcctcccaggtctctggcagcaggcaggaatgccagtggcctggaggtatttccacaggggcctgtttgtgagcagtttctgaagttgtttgccctcatcttgaggggtggagaaatgacctgcttatgtggcaggtttgcagggcagggggtgcagaataagaactagagaaaataagccaggaatttaacccctgctctgtaaatgattccaaaatatgaaatacttattccaaaaactctactgagcattctatatgtgcaagacattgagacaggtgttacaggaaggctaagataaagtagacatagattcgagctcaagaaactctgtcaaatagggcacgagaaagaaacacagatacctacgggatgtagaaagctccaggtgtgttttattttattttttactttttttagacagagtcttctttcgttgctcaggctgtggtacagtggtgtgatcttggctcactgtaacctccacctcctgggttcaagtgattctcctgtctcagcctcccgagtagctgggattacaggcatgtgccaccatgcccagctaatgtttgcatttttagtagagatggggttttgccatgttggccaggctggtctcgaactcctgacctcaagtgcttcacttgcctcagcctcccaaagtattgggattacaggcatgagctactatgcccagcctctaggtgtgttaaattggaagccctagaaacaggactggagatggggcttgtgtacaggtgcttactgttgtaaattgtttttatttttttagagacaggatctcattctgttgcccaagatgggtgcagtggcatgatcttagttcactgcagcctcaacctcctgggctcaagccatcttcctgccacagcctcctgagtagctgagactagagacgtgcaccaccacacctggttaatttttttattttttatagagacggggcctcactaagttgcccaggctggtcttgaactcctggcctcaagccatcctcctaccttggcctcccaaagtgctaggattataggcataagccaatgtgtctggctttataggtgctttcttgtagaagagctcttgggtggaacctttaaggatgcaagtgaagcagaatagggcaggggagaagctgggcaaagaggtgactgcagccccagcctgaagccattcttagatctggagggtgattggtacctgtggtaaaatacaaaatatatatttactcttggtccctggttcccagcatagagctcctaacacccttggaaattactcttttgctaatgagaagactcttgttgggcagagggggcctaggtagctttaggatgggacctggacacaggaaaaaccaaccatgtactgagaaggttagaacttccagccttgctcttccacctctgagagcaggagaggggctagagattgagttcaatcaccaatggccaatgatttaatcaatcatgtgtacttactgaaactgccataaaaaatccctacacaatggggcttggagagcttctgagttggtgaacacatccaggagagtggctcatcccaactctccagggacagagcctcctgcattcagatgcttcctcagtacccctccatctggctgctcgtgtgtgtccatcataataaagtgtaatagtaggtatggcattttcctgagttctgtgaggattctagtgaattatcaaagctgggtagggaaagtcacagaacccttgaatttatagtccactgggcagaagtgtgggtcacctggggaccccatttgtggctggtgtctgaagtcttgtggagctgagccctttaatctgtgggatctgggcttggtaaagtgaatctgggcatgacacaacagcatttactacaaggtaatgttactgaaacaccagggttccagtctaggttctgctgcttgttacacagaatgccaatcactgagacagtaactattgccagggaagaaaactttaacggggtgttgcagccaaggagaacaggagataaagtctcaaatgtgtttgtctgaccgactaaaattgggggttttgtatagcaggaaaggtgggaaaataggaattaaggaggagtatagaagcaatcatgatggatgaggggtctggcgtctctgtctggatacagtgatctgatgagttttaggtttttgtttttgcctgagtgtctgttttttgaggaaggaattcagatgagataaatgtaagttttaaattttaaaaacaggaaggttaatttttatgtttcttttaaaaaccgtaatatcatttctatgggacaattgggctggttttaatccccttttttctattcatcaatttttcgatcatggggaatatggttgtctgcctttttggctacttaatgctaaggggtgcattgtgggataatgatgggaaatgcaaacatcacccctgaatctgaagtgctcaggattacctgactggcatcccgcttgttggagcaccatgattaaaaaaaaaaaaaacacccaagaattaaagtggatcccttaaggaatccaagagaacaatcctaagcctattaaaaagtatttctgattcatggctgggtgtggtggctcacacctgcaatcctagcactccgggaggctgaggcagatgtggctcacttgaggtcaggagttcaagaccagcctgagcaacgtggtgaaaccctgtatctattaaaaatacaaaaattacctgggcatggtggtgcacacctgtagtcctagctacttgggaggctgaagcatgagaattgcttgaacctgagaggtggaggttgcagtgagctgagattataccactgcactccagcctgagtgacagagtgagactctgtctcaaaaaaaaaaaaattactaacaactatttctgattcattacatcctgcatgcaagaagggttttggggagaataataccaacctgaaaagcacatgtttcctttatgacttcttatttagggtctttggctgggcattgaatattaacttaaggccatcttagggttcacaacagcatgcctgtttttttctggagggatcccagaggggcaggttttatctgagcgtggtgaatccatggcttaacactggctaacttggcagataagtgggtagtcagcagcatctcaaaagggctgacccattgtagttgcagctggtttgcagcctgctgggatttccaggtcttcagcatgacttggtttctcagcttcaaagagaaaagaggcacatctgtaggacactggagcctgttggaagcaagctcagaaagactagttaatatatttttaaaacacaaagttaatattcccatcattataaagccagttcccaatggcttgcatatgaagcatattggttgcttcctctggggtgttccacttaatattgataagtggagttgggcagtccacttctcagggtaaatagatcgtatagtggcttttatccagttcaccaggctggccgttctctcaggaatagcctcctgtgtgtctgaattatatataccgatctgtgattgttcagtagtgagctgcgggtcttgtattaaccaaaacatactctttcattttgcagcatttaaaaccaaagacattcctctcaaattagttatttttacaattcattttagaggaggtttttttgggaagctgatgataccaattggtataccaacacaagatggaacaatccctttgcatcatatcctctggttttaatagttatttggtgttgcattttcccccactttgactaccttcttggaaaccacaggtgtgagaggtactttctggtgtactggcatagtttttcttttgtgggtagtctcgaggctagtgatctgagcttagacagacccacatctgagcttggtccagccttaaggcccaactcagtgtttttaaatttttaattttagctattatagatagtgataaccaagggattgaatatttcactttttccttattcgttcacattaaaatagatgtatatttagtgaaccaatttccctgggagttgaattcatttttattttacttttatttattattattattttgagacagcatctcgctctgtcactaaggctggagtgcagtggcatgaccatagctccacagccttgacctcctgggctcaaatgatcctcctgcttccacttactgagttgctgggactacaggcacatgccaccatgccaggctaggttttttttaaactttttgtagaaacagggtcttgctatgtttcccaggctggtctcaaactcctggcctcaagcaacccttcttgcctcagcttcccaaaatgctgggattacaagtgtgagccaccatatgtgggtgaattcattttaattttttttctggtaatttttacctttaacaattgaatgcagcacagatgcacctccataccacagaggtccgctattagtttagtctgtgcaattaactcctgttttgctttatactgggttagcattccttatgtacacatcagccttttaattgcagtcctggaagtttttttctagttcaacggcacaatgtctaaagttaccagaaacctacattcaagagtctttttatgaattttcctaaaggaggatcctttggattgtaactgattctaagccactttttgagaagaatcaaagtaaaataataactatagatgacaaaaattttaggacagccataaagacacaatttggttattttgtggcatataataacttaatgtaataatcataataattacagaaaacatacactgacatattagaattttagaaattttgtgatctgggaatacatattaacaatatatttatatagctataactcagaatgggtggacatgtaccctagaacttaaagtataataaaaaataaataaataaataaataaaactcaagaaagttacacataattttatatttgacatataaaatatgctttctgtataattctaaaataccaaataagcataatatgtctctcttggacttttggagaccctaatatcttaaaagttagtttgaggtcaaaaagactgaattttgaatttgacatttttgctttgggaaagtttgtcaaatatcaaaggtttaaaacacttgatatcacaaaatagaatcacaggtcatttatttagccaaaacaataatttaaagatttaaaaaaacaaaagcctttattctttgataaagggggtactcagtttcccaaacagtaagaccaaatcaaggcacaatgagaccaactaaatctgtctctctctctctcctcttttccctgcagtttattcaaaaggtaaaatttttaaaaattattttttattaattgtacatgaaaatttagttcaaaaagagaaaaataaattttacttttgtatagtatattattaattttgaagctaattttaataaaatcctatttaaaaaaagtatctaattttaagcagtttgaccataagttaagatttttataacctttcataggtttttacaatttgttactaaagagtggatcaatattctaacaagagcctgttattctgacacgggggcccagatgctggccttgcagcagtgtgcttttgatattaacgtttagtttacagaaaagctctgaactattgttatgtctcaaaatcggcccttacaatctcacgtgcccacctcttcagcaatagtccccagggctagagggattgaatagttttaatttctggtcctgtgtctcataaaagcagtttattttgattgttaccttttcctgggtctgaagatgaggctttgactagtgccaatgttcaagatttagcaggagtcagtgagtgtctgtctttcttttcctcccttccttccttccttccttccttccttccttccttccttccttccttccttccttccttccttccttccttccttcttagatagggtcttgctctgttgctcaggctggaatatagtggcatgattacagctcactgcagcctcaacctcctgggctcaagtgatcctcccaccttagcttcacaagtagctggaactacaagcacgcaccaccacactggctcattttttaattttttgtagagatggggtctttctatgttgcccaggcttgtctcaaactcctggacttaagctatcctcccaccttggcctcccaaagtattgggactacaggtgtgagccactgagccagggctagaattcttattcttaataaccttaaattttagtgaaaaatctcggaagcaagaaatcctaaactgtctatcagatattagcactttattagaaccttccacaatttttttaaaaatgtttatttttattacaacgctccacatttataagagcctttcacaattaaaaaaaaagtttctccatatcacaaccttcttaaaattggccaaacatctaacgagtatcctaaattattttaagattttaaattacacagaagtttatttatagtatttattccattaacgttattcatttttagcagtttatctaaatgacttatgagaactgagatattagacaaagctagtcattatttccttgttaatcatttttacaacctgtgcatattaggtgttcacctaagtaagaaacttaaatacatggatattttcaccaataactcagaagattcggctatttgcattaaaccgacaatattaaattgttcttatttatcaaaaaatcatacaaacaaagattattttgtttttggctggttttacagtattataacctattgtgctaaaccctgataccttaaaatatctagcagagacaaacataaaacccagacaaaaatatatgctagccggcacctgagctgagatcatgccactgcactccagcctgggcaactgagcaagacttcgtctcagaaaaaaagaaaaaagaaaaagaatatgcagaggcctcatcctagggtggggaagtcaatttccccttcccactggctcagtgccccagtccatagcagacaggccatcatgcccaccaacgctaattgcagcctcacaccaggacatgctcagcacctggatcagggatgggaagaagcccccgataagtagcccatggattgagctggtgctgccatcctagagtggggacagctgctgcctggctctggcctgggcaccatgcagtgtgcatgcaaccccgatcctctctgtgtttgtgcccgggcccccaccaggggcagagggcaatggcaaacacaagcctcctctcatcaacacaagctggctgccacctcgagtggagggtggcagtggtcattgggcagggtgggagaccaagtagggaggatggggtgcaggtgctgagaacccagggtggaaaggggaagcgggatgtgagccaagtctccaaacccccatgcttgctccattgtccaactggacttaggaaacacaaattagaaggtaaaattaaacttcagattcgaggctctgtgtggctacactagttgcacacccatgaattcaactctggccagataatatttacatttctagcaggttcccaggtgaccctgagaagcacttgatctttcctttcttttcttttctttttctttctttcttttttttttttttcaagactgcccaggctgggactatatgtcccttcttttttttttttttttttttttcctttgagacggagttttgctcttgtcgcccaggctgcagtgcaatggtgcaacctcggcttactgcaacctctgcctcccaggttcaagcaattctcctgactcagcctcctgagtagctgggattacaggcactcaccaccatgcccggctaatttttgtatttttagtagagacagggtttcaccaggttgaccaggctggtctcgaactcctgacctcaagtgatccacccactttggcctcccaaagtgctgggattacaggtgtgagccaccacgcccagccagtcctttcttttgaaaaggtgcaaagcattgctccacagtgtgactttcctcttttcctcagtaaaatcgtgatgctatttcccgcatgtcctgcctcataggctttggtgagaggacaaagggaaggatgcctgaaagtgcccggcacagtggttagaacaaagcatgcactcgggaaatgttagcagcagcactaatagtaatagtcataattattcttgctgccatcacttccacttttgttcgggctattgtctctgatgactttctattgctccctatttaccctctgctgtcttcagaaaaggaactagagaagtacaggggcagggcagggctagggagggacacctcaggtcagagccagttattgccaaaagtcaaatcatgaagagatatgtaaggatgctgagatttgccagaacaaactgaaaactcagatcctctgaaactggccctggaggaagaaatctgagtgtgaggagaatataggcagaccattgcaccccattgttccctggagattgagtgcccagtctgtaaaagacacataaatatctctaaggggtggaaagctccaggtgtccttcagaggaggacagatcaagtcctagagataaagatccaactcccacagccacccgctcctgtcctttcaggagtgagtggggaggtaccactttcccttcaacgtttagaccaggttatgacgtccagagcacaagaaccctgcacagccagccacagaggcaggcttctccccacagggctttaccacattctagattacatggtcttgcttgctctctagggctcacccttcccatctcacatggcagacatccactgttctcaaactccaggccaggagaccacagccagagaaagagaacaagcctgagtgcctctgcagtgggtcttgactgtggaatcttccaggatgcttaaaaaataccgatgcctgggtccctcccccaggaattctgatttaattaatttacggtacattctatgtatcagtgttttgaaaactcagcaggggttactactgtgcacttgaggctgggagccactgctgtcccgcccactcagttgtaggatattctctgaggatccttctctgaatggctgacaggcagggtgaacaaccccctcagaggcacctccattaatcagatgcatgaacttgccttagtagctatccaggaaggtcttcaggaaccgcactgcatgaccacaagagagagccagccactgcaggcgaggtgaggatggcctgtgcacacggaattattttgggaagaagtgggaggatcaccaggtcagcacagggtcgattgtagggctgtgtctagggcatattccctggaaataaaataggttcttggagctgtactgagagcagctttcgaccatgctaaattcctattagtagttttttttaaatgaaccaatttgctattaatatgtattctttggtgaaactgtccaaatattttgaccatcttttattttattattattattattatttttgagacggagtcttgctccatcacccaggctggagtgcagtggcatgatctcggctcactgcaacctccacctcttgggttcaagtgattctcctgcctcagcctcctgagtagctgggattacaggcgcctgccaccatgtccggctaattttagcatttttattagagatagggtttccccatgttggccacgctggtctcgaactcctgacctcaggtgatctgcccccctcggcctcccagagtgctgagattacaggtgtgagccactgcccccaatcagttcaatttttaaaaaatattttttattggcctggcatggtggctcacgcctgtaatcccagcactttgggaggccaaggcagacggatcacctgaggtcaggagttcgagaccagcctgaccaacatggtgaaacccaatctctactaaaaatgcaaaaattagccaagcgtggtggtgggtgcctgtaatccaagctactcgggaggctgaagcaggagaatcacttgaacttgggaggtgggggttgcagtgagctgagattgcaccactgcactccagcctgggcgacagagcaagaatccctgtcaaaaaaaaaaaaaaaattattattgagctgtaaaagttctttttaaaattaaacttttttttttgtagagttggagtctcgccacattgcccaggctgtcctcgaactcctgggctcaagcaatcctcccacctcggcctcccaaagtgctaggattacaggtgtgagccaccatgtccagaccaaaagtgctttatatgttctgggtacaaactgtcagatatagaagccttcttctggctccaagcagttgtgctagagagtgttcaccaaagcctggtataggtgccccgtgtttatgagcatttggcctggtctgccctctcttctctgccaggcagcactgccagctcaggtacaacctgctcacatcagatcaattccacaaacatttactgaacatctattccctgacaggatcatgctaggaaccggggagaatgaaataaatagctcttgtttattaatattctttgtagaatgttgacctcgagcaagttacttgcttctcgatatttcagtttcctgatctgtaaaatgtgactgtgaaagggcccaccctgaagggttgtagtaaagtctaagtgagttaatacatcaaaatactcagtaggatgtctggcatatattaagtacctaataaatgttagccaatgttgtcattattttaaaaattctcattatttgttatggcctgaatgtttgtgtccctccccccaaatttttatttacatatatatatatatatatatatatatatattttttttttttttttttttttttttttttgagacacagttttactgtttcccaggctggagttcagtggcacaatctcagctcactccaacctctgcctcccaggttcaggcgattctcacgcctcagcctcctgagtagctgggattacaggcgtgtgccaccatgcctggttaattttttgtgtgttattagtaaagatggggttttgatatgttgttcaggccggtcttgaactcctgacctcagttgatctgcctgcctcggcctcctgaagtgctgggattacaggtgtgagccactgcgcccagcctccaatgcaatattattaagaggtggagccttttggaacttattaggtcatgaggcagagccctcatctatgggattaatgctcttatgaaagaggcctgaggtagcttgttcatccccactgtcatatgagtatgcggccagaaggcaccgtctttgaagcagagtgcagccctcaccagcaactgactctgctggcgctttgatcttggacttcccagcctccagaactatgaggaatacatttctgttgtttataagttgcccagtctaaggtattttgttatagcagcctgaatggactaagacattatgacaactgctaccatggtgagacggaacttagagggtaatggggaaaacaagcaattataatagagtggtaggtactaatatacctggaagcagaggtgcccctatacaggattgggggttattgaaggtttcctaaagaaaacaatggcttagctgagaacaagaaatgatcaagacatttccaggtgtgggaaggactgtgtattagtccattttcacgctgctgttaaagacatacccgagactgggtaagttacaaagtaaaagaggcttaatggactcacagctccacgtgcctggggaggcctcacaatcatggcagaaggcaagagagagaatgagagtcaagtgaaaggggtttcccctcataaaaccatcagatctcatgagacttattcactaccatgagaacagtatgggggaaaccacccccatgattcaattatctcccaccggtccctcccacaacacatggaaattatgggagctacaattcaagatgagatttggctggggacacagccaaatcatatcagactgtgaggaggaggaacattccaggcagaggcactagcaatgtacagtctgcagatgagagaggaatggcttgttggagaagttgtggggtgctgagaggaagaatggacacagcggtgaggtcatccaggcctgataagccatgataaggagtttggacttgatctaaagatggagaagtcatagatcctgccctttgagtagctccaagttaaacaggagaggtggacataaaacagatcatttattaattatgtcatagtttaatataatgtgagatgacagaggagagaccccaaaccctgactatggcagagaagtgcttctggaaaaaaacaagatgatatataacaaaaaaacaagatgatatataacaaaaaaacaagatgaaatgcccagatcaacatggacaggtatcacaagggaacacttcctcttcccaagcatgccgtcttcccctcttcccagagtcttttggtgtaacatcatcctccaccaagtcagaaaccttaatgtgaccccccttgctactttttccctcatccctccctcacattcgaccaatggccgagtcccactgagttgttgcctctaactctgttactcccaatttccctaggcaagggcttcagcatctgttcaagggatgctttcagcaactgggtctatctatctggatttgccctgatcaaattccctttccacacggtgactgccagagtgtcttccagcacttccaacatgtcaatccagtcatgtctctctcatgggcaaaactatttagttccacaacatcttgctgtgtctgaatttctacgcatccatagatctattgagagctaagaatgaatgtgtgtaaaatatctttacctcctctggggaacttaagagacctctttttaatcctatatttagtattaaagatatgtcaatatcttttcttatgtgtcatttcactaaacctgaactatcctttcttgaaaaacctgaattaaggttggaaggtgtgtctagaccttctggtagtagggattaaaaaaaataaatatgtaaatatgaattcttaacgtccttatttgttttcccagggtgagcaccatataaatgctaaattattggttagtaggaaggaaggttattccgtgatggagtcctccatatacactgacctcagcctgaataatgtaagatttcagcattttcctccttctttgttcttctctaaggtggttcttttctacttttgcttttgcttttaagagtcaggtttattagagactaattttaataaaatttaccactgtacagtacataattcagtaagtattgttgattgtctacagtcatatatctttgtgaagatatagaatacttccatcaactccagaaatcctctcatgcatctttgcagttgatctcctcatccacccccatttcctggcaatagctgatctgttttccagaatgtaacattaatgaaatcatataaaatatagtcttttgtttctggttgctaatagtatattggttttgagaataattaatattgttgcatgaatcagtagtttgttttttttcattgctgaccattattccatggtctgagtgtagtggaatttgtttatccatttccctgttgatggacatttgggctgtttccagtctttagctattatgaataaaattgtaattgtaatgtgaatacaggcctttgtgtagacatatgaattcatttctcttgcataaatccctgagagtggtattgctggattatatagtaaatgtgtatttaattttataaaaactgccaaactcttttaaagtggttttatcatttttcattcccaccatcagtgtaagagagtttcagttactccacatgcttgtcattgtttgataatgtcactccttgtaattttagacattctagtgggtgtgcaatggtactttgtcatatcttaatttacgttccccaaaattcaaattagcatcttttaatgaacagattttccatttatatatatatttgttggtgaaagtgtctgttcaaatattttgatcattttttagttcaatttaaaaaatatttttatttttcagctgtcaaagttctttatatattctggatacaagttatcagatacagaattttataaaatttttctgtctgtggctttaaatttttttcttatctttttgcccaggcatggtaatcccagcactttgggaggttgaggtgggtggatcacttgaagtcaggagtttgagaccagcatggccaacatggcaaaaccccttctctacttaaaatacaaaaattagctgggtatggtggcacatgcctgtaatcccagctactctggaggctgaggcaagagaattgcttgaacttggaagatgaaggttgcagtgagtggatattgtgacattgcattccagcttggtcaacagagtaagaccctgtcttaaaaaaaaaagaaaagaaaagaaagaaagaaaagaaaagaaaaaaagtttatctttttatagcagctttattgagatacattcatatgacatcttttgaagagtagaacattttaattttgatgaggtccaatgtatcagatttttcttatatggtttgagatgtttgtgtcctttctgagaaagctttgcctaattcaagatcatataattttatcctatgttttctcagaagttttataattttgacttacatgtaggtctataatccatttcaagttaatttttgtatacggtatgaagtaatgatcaaagttcatttgttttgatgtatgaatgtccaattgttatagcatcatttgttgaagagctatcctttctccattgaattaccttggcacttttgttgaaaataaattgactctatatttgtggtctatttctggattcccttgtctgttcctttggtctatatgtctattcttacaccagtattgcactgtcttgattcctgtagctttagaataaatcttaaaatcaaatagtatgactcttccaactttgttattctttttcaaaatcatctttaggtcctttgcatttttatataatttgttaatttttacccccaaaaaaggctgttgaggttttgtttaggttatgttgaatctaagactaatttggggagaactgacattttagcaatgttgactcttccaagccatgagcatagtctgtctctttatttattctaccataatttctctcagtatttaaaaacattacttcaatgtagagggcttacattactaattatttcacgttttaaaaattattataaattgtgtttttaacattttaaatttccaattgtttcttgctagtaaatagaaaaactattttttatattgacgttttcatatcttgaagcctaactaaatttacatattttatttttctagcattggctagaaccttaggggggaagcatttgattttttaccattaaaaatgatgctaactgtaggttgtttataaataagatttatcagattgaggaagtttctttctattcctagtttgctgaaatttttttatgaggaatgtatgttgaattttataaacactttttttgcatgtattgagataattatataattgtactattttagtacattgagatcaagagtttcagtgattgactttaaatgttgaactaaccttgccttcctagaatatgcccaagtatgtcctttttaaatatttctggattcagtttgctaatattttgtgactatgttcatgagagatattggttgctagcatcatgatgacaggatcaaattcacacataataacattaaccttaaatgtaaattggctaaatgtcccaattaaagacatagaatggcaagctggataaagagtcaagagccatcagtatgctgtattcaagagacccatctcatgtgcaaagacacacttaggctcaaaataaaggaatggaggaaaatttaccaagaaaatggaaagcagaaaaaagcaggggttgcaatcctagtttctgacaaaacagattttaaaccaacaaagatgaaaacagacaaagaagagcattacataatggtaaagtgctcaattcaataagaagagctaactatcctaaatatatatgcacccaatacaggagcaaccagattcataaaacaagttcttagagatgtacaaagagacttagactcccacacaataatagtgggagaccttaacaccccactgtcaatattagacagattatcaagatggaaaatttaaaatgatattcagaacttgaatttagctctgtagcaagtggacctgatagatatctacagaactctccacccaaaaataacaaatatatattcttctcagtgtcacatggtgcttactctaaaactgatcacataattagaagtaaaacacttctcagcaaatgcaaaagaactgaaataataacaaacagtctctcagaccacagtgcaatcaaattagaactcaagattaagaaacccattcaaaaccacacaactatgtggaaattgaacaacctgctcctgaatgactcctggataaataatgaaattaaggcagaaatcaagaagttttttgaaaccagtgagaacaaagagacaacatacaccccagaatctctgggatgcagctaaagcagtgttaagagggaaattcatagcactaaatgcccacaacacaaagctagaaggatctgaaattgacatcctaacatcacaactaaaagaactagagaactaagagcaaacaaagtccaaagctagaagaagacaagaaataatcaagattggagcagaactgaaggagacagagacacgaaaaacccttcaaaaactcaacaaatccaggagctgggtttttgagaaaattaataaaataggtagactgccagctggactaataaagaagaaaagagagaggaatcaaatagacacaataaaaaatgataaagtggatgttaccactgaccttacagaaatacaaacaaccatcagagaatactataaacacctctatgcaaataaactagaaaatctagaagaaatagataaattcctggacacatacaccctcccaagactaaccaggaagaagttgaatccctgaatagactaacaagttctgaaattgaggcattaataaataggccgggcgcggtggctcacgcctgtaatcccagcactttgggaggccgaggcgggcggatcacgaggtcaggagatcgagaccatcctggctaacacggtgaaaccccgtctctaataaaaatacaaaaaattagccaggcgtggtggcgggcgcctgtagtcccagctactcgggaggctgaggcaggagaatggcgtgaacctgggaggcagagcttgcagtgagccgagatggtgccactgcactccagcctgggcagcagtatgagactccgtctcaagaaaaaaaataataaaaaaaataaaaaataaaaaaaaaataaataaatagcctaccaaccaaaaaaagcccagaaccagatggatttacagctgaattctaccagacgtacaaagaggagctggcagcatttcttctgaaactattccaaacaattgaaaaggagggactactccctaactcatttcatgagaccagcatcattctgataccaaaacctggcagagatgcaacaactaaagagaacttcaggccaacatccctgatgaacattgatgcaaaaatcctcaataaaataatggcaaaccaaatccagcagcacatcaaaaaacttatccaccacaatcaagttggcttcatcccaggatgcaaggctggttcaacgtatgcaaatcaataaacataattcatcacataaacagaactaaaggcaaaaaccacatgattatctcaacagacacagaaaaggcttttgataaaattcaacatccttcatttaaaaaactctcaataaactaggtattgacggaacatacctcaaaataataagggccatttatgacacactcacagccaatatcatactgaatgtacaaaagctggaagcattccccttgaaaacctgcacaagacaaagatgccctctcttaccattcctattcaacatagtattagaagttctggccagggcaatcaggcaagagaaagaaataaaaggtattcaaattgaaagagaggaagtcaaactatctcttttggcagatcacatgatcctatatctagaaaaccccatcatctcagcccaaaagcttctaaaggtaataagcaacttcagcagtctcaggatacaaaatcaatgtgcaaaaatcactagcattcctagacacaaacaatagacaagcagagagccaaatcatgaatgaactctcattcacgactgctacaaagagaataaaatacctaggagtacagctaacaagcaaagtgaaggacctcttcaaggagaactacaaaccactgctcaaggaaatcagagaggacacaaacaaatgcaaaaacactccatactcatggataggaagaatcaatatcatgaaaatggccataatgcccaaaataatttatagattcaatgctattcccattaaactaccattgacattcttcacagagttagaaaaaactactttaaaattcatatggaaccaaaaaaagagcccctgtagccaagacaatcctaagcaaaaagagcaaagctggaagcataatgctacccaacttcaaactatactacaaggctatgataaccaaaacagcatggtactggtgcaaaaacagacacatagaccagtggaatggaatagagaactcagaaataagactgcacatctacaagcacctgatcttcttcgaatctgacaaaaacaagcaatggggaaaggactccctacttaataaatgatgctgggagaattggctagccatatgcagaaaatggaaactgaactccttccttacaccttatacaaaattaactcaagatggattaaagacttaaatgtaaaacccaaaactgtaagaactctagaagaaatctagacaataccattcaggacataggcatgggcaaagattttatgacaaaaatatcaaaagcaattgcaacaaaagcaaaaattgacaaacaggatctaattaaagtaaagagtttctgcacagcaaaagaaactatcttcagagtgaagagaaaaccttcagaatgggagaaaatttttgcaatctatccatctcacaaaggcctaatatccagaatctacaaggaacttaaacaaatttacaagaaaaaaaaccaaacaactccattaaaaagtgaggaaaggacatgaacagatgcttctcaaaagaagacatttatgcagccaacaaacatatggaaaaaagctcaacatcactgatcattagagaaatgcaaatcaaaaccacaatgagataccatctcatgccagtcagaatggtgattattaaaaagtcaagaaacaacagatgctggcgaggctgtggagaaataggaacgcttttacactgttggtgggaatgtaaattagttcaaccattgtggaagacagtatggcaattcctcaaagacctagaaccagaaataccatttgacccagcaatcccgttactgggtcccaaaggaatataaatcattccataaagatacatgcatgcatatgttcactgcagcattattcacaatagcaaagacatggaaccaacccaaatgcccatcaatgatagactggataaagaaaatgtggtatatatacaccatggaatactatgcagccataaaaggaaagagatcatgacttttgcagggacatggatggagctggaagccattatcctcagcaaactaacgcaggaatagaaaatcaaacaccacatgttctcacttataagtgggaggtgaacaatgagaaaacatgaacacacggagggggacaacacacactggggcctgtaggggtgatgggggaggtgggagcaagagcatcaggaaaaatgactaatgcatgtggggcttaatacctaggtgatgggttgataggtgcagcaagccaccatggcacagatttacctatgtaacaaacctgcatgtcctgcacatgtaccccagaacttaaaatttaaaaaaaattttaaaatgagagatgctggcttatacttttctcttctgtcttgcctgtccttggtatgacagactacataatgttggcctcctgatacaagttgttaaatgttctcacatctccgatttattttttttttaagtttatgtagggtggatattatttttccatgaaatgtttggtataattcatcaatgaaggcttctgaacctggagactttatttcattaatataaatagggctataaaattagccacttgtttattgtttgtttgtttgattatttatttattctgaaggtacatcagcaatctacttcttcttgaataagctttggtagtttgtgtttcattttgtggtggtctttgtgtgggatgttggcatataactatcttctgacttcccagtgctacagtgatcatctatgtatttattcatatcatcttatgctattgttatttttgtccattcaatggctggaatcaatagatcacaatataatctgttgtcaatgaagatgtggcagggggaactttgtggttgtggcaaagtagaaggcattgtagatcttgggctaaaaatataagaaagacaaggatttgcctgatggctttgtcagtcaaatttgcctcttttaattagtatgggttttaaaaatgggagaaaaatttagaaaagagtaattggctcagagaaacttgtaataaaaaaacactccttccctgcaagcattggaaaagccagagaaaagccagataaattggcaggacttactagcatgatgctttctctctctctctttttatttattattattttttggcattgtataagaaacaagacttgactttagtatgtattttagaattgttggcacatactgaaatgtaacatttttttcgattgggagtttttgataacaaaacagacaaaaaaaccaattttcctcaattctttatcccggtcctatgtttaaatattgtaaatcacatttgagaatattatagttacatttgttggaatagtacacagtgatttgaatcacctattttaaaagcaagttacttgccaagctactttttcacttaaaatgttactttcatttatattaaaccctatatatactgtttttctaaggacaatttgtttacaagtacagaataaactacttaatgtactttggtttaatttacttacatgtgaggtaagtatttttttctaccatcatcaaagggttgccacaagaataaaatcaggcatatgctataatatgttggtgaagagagattaaaaccataagtaaaggcaaagtgataaaggcaaactgatattattatatcacattcctttatggtgggacatgataattatgattgtaaatttaacgcgataggatagcagaaaaggcctatatgtgtgatcagctggcctttccaggtggaatgtatatagaagttgtcctgtggtttgaggaagcagctactatttgcagagcctccctcatgtggttctgccacaagccttggctaaaggtagcctcacccgtgattgccagcctgcaggttggttcactgggtgctgctgcttctcagaattccgtgactaagccaggagtggtgtttgttctttactgataggtattcttctgcctgctctgcttaccacatcatcacaccaggccttgacctttgtgaacctctctggaaagtcaaacatacctagaggctgaccaggcttaggtctaataacaccatcaactgctctttgcaaggtcatggaaaagaggttggaagtgattcaaatgagaaggaaacttaatagctcatccagtccaaatttctcatgacatggatgggaaaacaaaaattcagagacgttagggggctccatccgggtcccctctactgtgatgcctttctggacatcccaaggtgattacagtggtgcttctggctgtttgcaaaaccattctgtgcactctcccgtgacttctcaccctttgttagaattatctgttgatggtttctctctcactagaactagacctctttaagaggaaggctgagtccccctagtgggttctacgaggcctggaacattgtaagtactcatgcatgtttgttgacttgatgaatctctctcatgctactaggtactattgttttggggccaggctcatggagattaagcaggaacttcaagaaagccaagctcttcttggtagcacaccagagtctgaagggtaagccaaagagtaagctgggaagcacatccaagtaggggaagataaaaaaaagtggatccagggcagaaagaaggtggcaaaaatgtttcggttccctcacttacagacgcattagattcatttatttatttattcattcaataactttatattgggccagaagctgttgtaggcactgaggatagaggggtgaatataacaaagtccctgcttatatcacagtgggaagaaaggcagtaaacaaataaatgagtaaccattatatggtcagagaagagtaaagtgttaggataaaaaaataaagcaggaggaagaaatggtcactggtggggcttctattttacataaagtggggagggaaagccactcagagcaaagacatgaatggagtgagggagcagcgacatgggactactggggaaagagcatttcaaagagaacaacaggtacaaaggccctgaggcaggattgttgtgtttgggaaataaggaagccagaaggttagagcaccatggctctaacgagtaaaatagtgtccttcccagcaccaaagtcttattgattgatgatcctctgactatacaaaccaattccaataaagagagtcccagccaggtgcagtggctcacgcttgtaatcctaacactttgggaagctgaggtgggaggatcacttgagcgggggagtttgacaccaacctgagcaataaaaggagatcctgtctctacaaaagtacaaaaattagccaggtgttgtggtgcacacctgtggtcccagcaactagggaggctgaagtgggaaaactgcttgagcccaggagtttgaggttgcaatgagccgagattgtgccactgcaccccagcctgggtgacagagacagtgtctcaaaataaaaacaaacaaacaaacaaaaaagagtcccatacaatgctcaaggcagacttttatttctcagggttatcttaataaagaccttccactcccttagaacaagtgttctcacctgaggtcaacagacccatgcggatttagagtgaggtgtcaggttgtcaatcaagcccccaaatctgtgcatctagaacatttttctgcagagaaagtcttaggtgtagcctgccaataaatgcctgcagagctaggtgggaatatagaagaatgaaatacatcaggtgtgagaacccagtctcttaaacacagaggaatattattttcttccacagagaaatatgccttctcccttttattctgacatattcagccttctgggtctgtcttttatttcgtcacttctggtagagacttgggtccaaataaatatctctccaccataagaaacagtaatgcaagggtgatgacaaaaggcaagcaatgctcagtgttggggagaccttggggcgggtgaggattgggcaaacgggagggcacatgccttctaaggcaggcactcactcctctgcttcagttgatcactgccttgaggaaatgggacccagtattgacagaccttatggctgattaagagaaagcagaaatctggttctctttggagatgaaatctcaatttagttcacattttctttagagaatcctggcataccaaccagaacactctgagtgagtcaaatatggtcccgataggcaggtggtttgtgacctctggtctctagattctaccggaatttctgattgattcatgtcttaaataagattgatgactgctgtcctagaacatgtttcccctccattctgtgggcggaaagacagacggcatggacatttaccatgttcttgggtcccagaagtccaggagaaagccatctgcctcactgctccctgccccatcctgggcccagagcactaatgccagtggcatcagctctgctcctctccctcttcctttgtctaccagtgagtgtcctccattatggggatggagcaagcagtatattgtaaaagggacttagtgctgagaagcaccagaggaaaagtaggagatgctcattaaagtggaaggcagctctcttcttccccttctcaattctgcattctgctctctcccctaaatgccccccacccaacccccaaactcttgagaatgcccaaatccaaccaggtcaggaaaaaataaactcactggctcctgtattgagaagtccaagtgtggtgcggcttccggcatgtgggattcaagcactcaggaatttctccctctcacccaacctcagctctgctctcttctctgttgcctttgttctttgacaggctccctccaagtggtggaaaagttgacctgtatggtcattatcactcatcatttcagaaggggagagcctgcttctcttgtagcatttccatcaaatcctgaaaataaaaataatctggttggttctactggacttgtgatactggacaaacctctatgtccaagagctcgagtcattcccattggctcacctgggccacacactcttcgttgagtgcatcccaggatcacagggagtcttgagggtgctgtgtgtggtggtggtggtggtacggagatggcaaactctaaaaggaagagatggtggatacttaaagcctaccttctgcccacaggtgtgtcagacacaatctccaaaggccatcctattgttaccctatcccccaaacaaacactgaaaaactctcctggcaatttggcagtagctcagtgtggagcatttgttaattccagtactagaacgtctgcattgcaaaaccagaaatgtccagttctggtttggcacacagaagagattttcaagccttggcaactcctcagtgcaggcagtggaggaaatgctccagctttgtgaaaatcttctcccttcgctcctcatggagaataaccgttcatcactgcagccatgaatctgccacactgaatagatatggtctgaaaatctaggaacaaatggaatcactttggaaacctgtaaattttaaagccgaaagggcgctccagggaaccaactacatgaagttctctggaagccacaggatgggaggtttggtgggggtggaggtgaccattgaattttacataggcaaatgtaagacaatcttatccatagacagaaaaatccaaactcaccgagagtaaaaggatgacagttgaaataacagctaattgttattaagtatttgctaagttccaaagcacttttcatagattagctcaattaattctcacaacagccctgtaaggtagggaccatgatcatctccagaagaggctaaataaattgccaaagatcacatatgtagcaagtggtggcagagtgaggattcatacctggacagcttaactttaaagccatggtgctaatgcattcattcattcatccatccattcattcatccatccattcattcaatgattatattggatgcctactacatgctaagaactatgttcaaggtgctgaactacagctgtgaacaatgcaagtacaaatacatgaagcagagttggggagaaagtaagctggagaaataagacataaactaggttagatggtgaacatgattaaggaaaaaactagagcagggaggaaagagaaatgtgcagggggaaggtcaattctgagtgagccaacaggcaaggtctcactaagaaagcggcattaaataaagatttgaggaagtgagggagtaaaccttgcagctatctaaaaggagagcatgagaggtagaggagacagcaaatacaaagaccctgaagcaggggcaaggctaatgagttctagaattagcaaggagtccagtgtaacttgaacagagtgatcaaagaacagagcaggaggaaatgaggtcagagaggtaaacaggctggagtgcagtggcaccgtctcggctcactgcaacctccacctcccgggttcaagcgattctcctgcctcagtctccctagtagctgggattacaggcatgcaccaccacacccggctaatttttgtatttttagtaaagacggtgtttcaccatgttggccaggctggtcttgaactcctgacctcaagtgatccacccgcctcaacctcccaaagtgctgggattacaggcgtgagccaccgcgcccggccaggattcttttaatcaagtatgatgcagccatcagggttggagcattctaggaagagggaacagcatgcaccaaggcaacaggaaagcacataaaaaaggagttgctggaagattcatttcaacccactatcaagtaaatattaaacttactgtataaaaatgttagggccaggaggggtggctcacgcctgtaaacccggcactttgagaggccgaggcaggaggatcggttgaacccaggagttcgagaccagcctgaccaacagggcgaaaccccgtctctactaaaaatacaaaaactagccgggcgtggtggtgggcgcctgtaatcccagcttctcgggaggctgaggcaggagaattgcttgaacctgggaggcggaggttgcagtgagctgagatcacgccctgcactccagcctgggcgacagagggagacttggtcatgctccctccccgccctccgtcagttttaggaataaatacctttttatttaagctaaagtgtgggtacacccttcctctaggattctccatcaaggaataagaagccatattaggacaatttagagggcagttaaccctagtagacatagtggttcttaaaaggcttggggcctcagactgtacacaggcttcacatggaatctgatttgttcctttatcccagtccctcacccagaacccgaatctagcccttcatgttataaaaagggccagaggtccaaagagggtaagtgccttgtgcaaaattattcaactactttgtagaggattttaactagggttcagttagctccgcccacactataaaaggctctttctaaaaaacgaaacatgattaagggcacacggctccagcgttaacaaagctctttgttagctgggaaatgcccccctccccgactcatctgcttatcatctgcatagaattatgtactcaaaagcaggaaaattattgagaaaaccattggtccccggctgcagaccccaaggttgggagctggttcccgtttcctcccagagccggcagggggggcaccaggcaaagtttgcaagacgcgcctccctcccacccctcccccttcctcgcccaacttcccatagccgcggcctcaactaaaagtggccattgacctttcaagctttcgagcagtgatgcaatagaatagtatttcaaagaaaaatgcttatcgaaattttggatccggttttcccgtgattgttaagggtttcttttaaaaagtaggtcacatttcaagtaggtcatatttcgggggcgggtgcgcagacaaggagatgagtttccactaaggccagggggcctccaacggggttggaggtgagaatcccaggtagggtagaggtgccgagatccttccgaatcccagccctggggcgtcagccctgcagggaatggcagagacactctccggactgagggaaccgaggccagtcaccaagccccttccgggcgcgcaggtaagggcgcccccttagcagccggcgcaggtgacccgggcgggccgccgggtctaccggagacgttggagcagaggggaggaggaagggaggagccgggtgggtgcgggtgacaaggagccggagcgccagggggaggggactaaggacggccggcgccgcttaaggaggcgctgctctcccgctcgctgccttccaggacctgatcaaggggaccgcctccggtccccggccgtgggcaccgggacgagcacggcgtccccacgccatcgatgtgtcttagagccggagagtctggtttccgaggacccacagtcgctcctgcacgcccaccccccgcaaaagtgcggccaggagggtcgcatcgagggggcgccgccgggatgtttagaggaacccacccccgtggcaggccaagggccaaggatcgctatccttccctgaacccgggcgctcagctggcccgggtagggggcaggctccggccgccgaaacggggttggctgtagccggtggccggggagatctctagcttgcgcccgagcaccccggggtgtggggccagaggcaggccgaccccggcgtgcacaccgcccgccctgcacccgagcgctctcacccggtcttccctgaagcctgtgtattgcgaccgagcctctttaaagcagtagcggggcccgcggtcacgtgaggccgattcctggaaagttcctggaaagccgcctccgcagcagccgggcggggcgcgagcggagcgctgactggggagggaggcggggagcaagggaggcgcgtcggtctgggaagtcgcgcgcactcgctgctcctgggaccgacgtttaactcttgccaagtctcgtcgcagccgccgcggctggcgggccttgggcttcccctgaagcatgagccctctcgcccgcagccaccctcaccgcgtggcccgcggacagtgcgcgccggggtcccgggtgcacagcctcaggataccccgtgcccgcagctcgggcgcccgcggcaggtaccggtagtgggggaagcccgaaggctccgccccgaggagagttaccggggagggcggcgaggcgcggccgcgtgcgccggggagcggcggacggcctgggcttccgcagctcggagcgccggggaagagagagtccgaaccgcggctctgccccgcggcctagcgttgctgcctgctttctccagccccttctcggcgtctggaagtgtctggagtttcttttttttatttcccctaaactgccattcaaattaataatcctcctaataacctgatctcccgctcctccccaccggcctgcctcccgccctcgctccttcctccctccctccctctctccttcccacctccagggtcgcagccggagggaaacccggcagcagtccgagagtggaggtgtcccagcccgtagggggcgtcgccgcgcggtgggggatggggtcgaggcaatgatcctcgaggcttttgtgtgccctctgcgcacggaactccgaccgccgcctccgagcgcggggctggttgcatccccgggcatctcgttcccaaattaaacgttaacgggggaaacaagggcagacgcccctcctctcccgggcccctcccacctccccttttccccccacccccccgccccatgtccgctgaggaggctgcctggtgcggaggcggcggcggcggccgcggccgaggtcgaggtaagagcgcggcgttggtggtttgcattttccgcagcgctcgcgaccgcccgctcggccccggcctcgcctcggagccccgcgagggctgcgcgctcgggccgattcctcgacagcgcccgcggcggcgagaaccaccgcagccatcctggtccgggagcgaccgccgcggcacccccaaccccgccagagcgggcaccaggaagcggggggaggggagcgaggagcctcccgggcggagatgcggcagctcccgcacctccgcaccccgggttggtgcctcggggccccgcagcgctttagggcggagaaccaagtttgtgtgggtgcttcttcctgggggccctcgggctgcgccaggtgtgagaccggaatgccaatttggggaatctctcctgttctttcctttttaattttttctacttgtccttgacaagggcctattcccactggatctgcaggtgactatttgctcttcctaggtcgccagtctttgatttcagctagtgaccctgggcgggaagacaccctgttcaccctcctcctgacctccgccccccacctcttcagccaactttatcttggatctctgctctctttatcttttctctagagctgggccagggcgctaactggaagcttggggttaaatggtgcaggaacgtagaggcggaggagtccctgggattttccacgtctatttccccacccccaccccagccgcaggggtccagtttggactgacccaacctcccgctttctctttgtaggcgatcagtgggtgaccgcggctgcgagggactttgtcatccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctcatgaccctgcggtgccttgagccctccgggaatggcggggaagggacgcggagccagtgggggaccgcggggtcggcggaggagccatccccgcaggcggcgcgtctggcgaaggccctgcgggagctcggtcagacaggtagggagccgatcggccgcgacgcgtgcgggagggagcgcctccccaaggaagcagctaggaagcggggtcgaggtgggaagcaaagaataagatggaaatacgtcccttgcttccaagggaccgcggagagcacgctcgcagggtcctgggtccttgggaatgcgtaaggaaagtggttctccagggactcaggcctggcggagcgcagagcgcgggaagagcttcttggaaatagcttcttagcacgctggaagatttactgttttccgcagctgctcagggttaggctcccgggctcgaaccccggccggggaaagcgtcgggcgcctccctttgcacggggtgcaatcagcaagtcggtgccgcgggccccgcaggcccagcagcatctggctcccgggcggagctgcggctgcagcccaggatcttggcggccaagttcagggactgacactgccgcgagggcggctgcccgggcgtcgagagtaggctgcgaagcccccgccgagcgcggcttccatggtcggcgcgcccagggtactgccgctttcaagtacagtcaggcaattcgcgcggcacgctgtctctaggcatctgaaaaaagaaaaaagaaaaaaagtaaagtatctggcaaatcattctggctttccaaatccgtatcctaaaagcttacagttgtggcacagttgaaattttggtagcaacagggggagggagagggaaaagttctctcgcttgcgattccggtctttccgtgtgggccacgggctttccctcccggggaggcaccggcagattgcaagtatcccggtaattgtgggggtggggggagcacaaatgttcagacttcttaaatacggacggtctctgagccttcttagaaagcagagtgggccggggagatggtgcaggcagatgaaatcaagaatgcaggggagatggatggttgtgattgggtttggattagggcaaagttcaaaagagtttagggaagattgtaaacttgaagtagtaattatcacttgggaattcccatttcttagtgactggtaaggtagtcataaagcagcgaacagaagctattgtactagagctgtgcttttacaacaagtacatagcagtgctttctacatagaaggctgttcatagcaggctttgcagattctttttttttttttttttttttttttggtggggggcacaccaaccatccaaaaaagttgcttctgtttttactgtagttcaattacaggagttgggttttccactttttaaagggcatggcttttatttctaacttctgatttttttctaatttacctaaatctttattttacttaaataatgttaaaagtgtcatgcttcatcagccagtgtgtcatgctgcagatgttcttttggttcattagaagaaaatcttaagaagagcttcagaaagttgattttttaaaaaagaaagaaaactggctcgccgtttgtgttcataaaatggacccaaatttttattaaattcctactgaaagtatttgtggtggcccggtaaactttcgctcacacaccaccttttttttttttcttttttagagctaaaaaaattattgccaattacttgctctgttctaagaattcttataataactgttttaccctcttttctttttctttttgaacaaaaaccccaggatggtactggggaagtatgactgttaatgaagccaaagagaaattaaaagaggcaccagaaggaactttcttgattagagatagctcgcattcagactacctactaacaatatctgttaaaacatcagctggaccaactaatcttcgaatcgaataccaagacggaaaattcagattggactctatcatatgtgtcaaatccaagcttaaacaatttgacagtgtggttcatctgatcgactactatgttcagatgtgcaaggataagcggacaggtccagaagccccccggaacggcactgttcacctttatctgaccaaaccgctctacacgtcagcaccatctctgcagcatctctgtaggctcaccattaacaaatgtaccggtgccatctggggactgcctttaccaacaagactaaaagattacttggaagaatataaattccaggtataaatgtttctctttttttaaacatgtctcacatagagtatctccgaatgcagctatgtaaaagagaaccaaaacttgagtgctctggataactatatggaatgctttctaagaacagctgaagctaatctaatttaaatttaacagcttgaagaggtagctaggtgtttaaagttcctccagatacttttacctgagtgatgcttcccttcctaaggctgaccaagacctgttgatccttttagattaaaaataaaatgtcgcatgtaaaggctgaagtcgcgttttatcagaatgccttgccttcttaggttcttttccattatgtcaaaggtccaggctccagtaggagagaaagaactcctcataggaatactgaagaagtgggaaggaaccaagctgacacaggcctcactgcaatttgatatgcctgctgatcagagtctcttgggcattttatattttgcattctgatgtacctaggagttttgttaaacagatgatgtatgtgagtatttatcccattttatgcaattaaccaaatcaaccaaaaaaagtgaccatgaagtcctgtatttgtctttttactacatgtaggaactctcatgtgaatgagtactgtagtaatccattctatgggagccttatttcagaaatatttcaaactggtgcaaatggaaaagactttctcttttcctttaaagctaaagacaagaatatcatgctatacaggtgcaactcaatccccgttaataaaaaccaatgtaggtataggcattctaccctttgaaatagctgtgtcccaacctgttgccattgattttttggaaatggctttagaaatatccaagttgtccttgaattgtctaaccatggacataaacagttgtctcccttctactgtgtagaatactttgacttaattttcttccagatacagggggatacctgcctgtttttcaaagtgtttatttactgctgttactatttgattagaatgtattaaataaaaaaaacctgatttctacaagttgcacttattgagttctagagaacgtacactttcatggtaatagaggattgccataaaaacttacgtcaagtgaaataagccaattattcaacaaaaggtagaacattacttgccattctgtaaagttatgggctgtacctgccccctttgcaatttggaaagcatggtttagaaactacaggcattgtcaagtggccgggtcttttataatttgaataggcataacactgatgtcctctgtgtttccaaaaacatggtttagaaactacaaacattatgacatggccagtcttttacaagttgagtaggcataatactaaagaaaaatacaaagttttgtggccacttattttttgctatgttagtctgcataactgttataaatgtaccatcttttctagagtccagacattatttattttatggctttaaaattttcctgcatagctacaatcctgtggtgtgtcaccataaaggtggaccctgtgtgaatgagaaaattcagttataaattgtaataaaacctgcttactggatatcttaccttattttcatgaagaagttgaaaaatggttttgtgcctggcaggaaacatactatgtatatccaaacagcagagccaaacacaaaagattgctaggtgtgcctcaggaagagtttacttgtggcctaaaacttcaagaaaagctagacatttggggtcggatctatgatggggccataaccatttgatgaggatgcttagaatctgtgcttcattcaccgtttttctcccactgacaacacctgtttagtgttggatgtttgatttttctggcaaaacttctatatgatcagtgccaaggggctttgtggaatttctttaaaggtcttttgcctttctattgtcactgttttgaacactctatttctcagttactgggagtggggaggcagttgtgaggcatgagtacctgtgaaattggaaaaagttctgagttactgctcgcaagtgactaattatgagaaggctggaggacagcacaaacatctctggagtgtgccatgaaacctattgccttatatttcaatcttccatattgcaagtaggttgataaacatcaggaggcaattatttttggttttgttttgtttttttacgatgactgacatcatttatttattgagtttattgtgaaccaggttctcactcagcacttgtattatctcatttaattttcccaagaacgaaatgagcaaagtacaatgatgataggaggttcccctcctgatttgtgagtcaagaggcattccaggaatatcctagctcttttttttttttttttcccccgggagaggaattgggaagagcaaattgctgctgaaaatttctacattgatccagacaaacaagttagagcaggctgaaaaagaacccttggtgtttttactgctgttcaaccagatcaactggaaaagtatagataccttaattagcactgtgctctgtgggattctggtcagcctggcccagtggtttttttcccctgaacacgcctgaaaggggagctcataatgactgctgtgcaggtgggcggggagggggcttcctatttgatttagtggctgatcaatgccagttaccaattattggtagccccatttatacatggtggaaaaaaagtacacttgtctaaattatcctcaccaaagcctggaagaatatccagtgttttctcccaatgtagggcaatttagggcatttgtgaggatatttattattgttgttgttgaagaatatggtatacaagacttatatatccccaaactctgaaaatattttgacctcagtttctgttctgggcagagatgaggcagtgcagtttttcatgaccattacagtgagcagtggtgattgctttttagggacttggagattttttggaactttggatagtggagaaaaaggcagttcagcttatgagatgagaggtcttttttggtgtgtcagtaagaaagtcttgacttcataataattatgtaatccaaataggtaacagaatgggacagttgtttgggagtgtttattttcttgggaaggattttctctgcttttagaaaattgtaccctgttaggagggtaggagacagagacgtcatcttcgtcaagtaatccaaaggatggaatgtcctgagaccaggctatgcccttctcagttgtgagtttaggcacggggtaggtggggtttgagtggctgtggttatgtctaacagctgggctgaagtctccgtctttaagtcgtcctttctatcctttagagcaaaacaatgttcttgtaggcctttcatttacttaagaggtcttctgtattctcctttcccagtttttttaacttcttagaattttaaagcttgaaaccactttttagatcacatattatggattttatggaagactttcagatccagaggggctgggagatttgcatgctcgcacacacacacacacacacacacacacacaggcacacaacccagccaatcaatgacagagtcaggattcaaacgcagatattttagtcttaggattactatttgtaaaagttgcacgctcctaccctttgataaaattgccgagactcttctttgctttcctgcaagtcctacagttctcttaacatcatatatttcttccgctgggattcagaagccaggcctgtggaataccctgtgggataattacagttcttggcctcctctacccgattctgaaaaatctgcctctgctggatttcatgatgtcttgatccacattagttttttgttgattttaactccttaacatttctaatctgtttgctgttttaaaatccaaaacctcccatccatgctgtttgatgatctcatttctacctccaccagatgtgacacacacccagccacaatgcctgggcgactgcccgccctcccatccttaccagcaggacccattcttgcttttgcccattcatgggcataagggatagttaattcctgccttactttctccctttcctatcataaagttgccctcttgacttatctaacacagcctttctggccgcatgatactccagtgaaagaggataattatactctccttgagttgggtaattgaatgatttggactaccttaagattaaatctctttgtatctctttttggttccattcaggttgtgaagcaagtaaccagccccagatgccacacttttgttatgggcattttttttttaaatctacttattttttaagtatggcaggctcctttttcagtgttaagttaaccttcatttgcacggaataaaaatgccctccattcctttgcttctgctgctgtatgtctgtaagtaagaacgattctgtgagagttttgtttcatttcttcatatgcatggttcttatattctcatcttcacatatttttgatttttctaacttttcctctgtgtggcttgagttcaggtgactattactatggtaataaaggtaacaagtgttgttagagtggcctctaaaagtcctggagtccccagtgtctgaagtcatggagcagagctggcttttcctatctaccccttcctgagctttgtcagcaaaggaggctggatcagctaagtgtgccacagagaataggacttacttcaataaacatgcatttgtaaagataaaactaactgcttttacagacaactctcactttgacccacatccttaacttataggcattctgacttgccctagatcagaagtgcattttgtgatgtattattcacgtggctttgcctctcttagagaaaggcttgccagagtcctagtgagagaaaaggaaatatcgccagctgccttcttctcctgtctcagcataaatgccacccaaggagcccccttgccatggtggggtgagactttttcgccagttaaaccatcacacaacttcataaaattttcctacatctccccagtttccggtttcctacagtgttaaagataaaaatttgtttgtttttgctaagcattttttcccttctgttagtttggtatcctttttcctgtttagtgtttggtccagaatgctgctgtgatctttaacattcagaaaaaatccatgttagccaggcacagtggctcatgcctgcaatcccagcactttgggaggccaaggtggacggatcacttgaggtcaggagttcgagccagcctggccaacatggcgaaaccacatctctactaaaaatacaaaaattagccaggtgtggtggcgcacacctatagtcccagctacttgggaggctgaggcaggagaattgcttgaacctgggatgcagaggttgctgtgagcggcaatcttaccactgcactccagcctgggcaacagagtgagactgtctcaaaaaaaaaaaaaaaaaaaaaagaaaaggaaaagaaaaagaggccatgttatttctacccagagaaagttgtttgacttcccattttaacattcccccttgccatcttgatgaacttgacccatcttaggtttccagcatagcttgtttctcttcatttttatttctaggttgtggccatcaattctgtatttggtcagaaagtgtctttgtattttgcatattggattagagcatctgctcttaattatctgtaggaataagaggcagagagactggggaatagtagaagcccataaacacatctagccaatagtttcaacttcctccccattctgtctcctttgctagaaccactgacagaaaaatcagctgcttctctgttctctcattttattttccttgtccatcatgtgatagggatgttaatatgcaacaaactggctaaaaaaatatcaagagagaaaagtaagggagatggagcatcagtagtgtgtggaggctcctgagagtcaattactaaaaactgagagattttgtgagctcaatcattatgcataaattattgatagattgaatcagccatggtgggagtattacaccacagaaataggcagatgctataaattaagactctccgccaccagatagctgatttaacaacatagcactgatctaggtattatgtcctcctcaataattgagacctcattagggtaagatcagtttatttgtagcctcttttataccaagcccagtgcttagagcagaataggagtgaacaattcaaggaatgattttttttttttttaatgtgtgtcaatcttatattgggttacattgtcttctactatggatcaggccatctcctgattctgtgtctttttctagttactctggggtatctgtagctaccttttcaatttcttagtaggaaggtgttaggcaatctcaacatcatgtgatcattgtttacaacaactcagctctaatagatcagggcctcttttttccttctagcttcgttcatttatctcattagttttctctttttttttcttcctccctcccttctcacctgctttctccctccttctctcctttctgccaacgtttattgaatgtctactgtattactcaacagtaggaagtgttctttcattgagggagctcttacagaccatgagaaaggatggagaggatggggactaacatttattaaacagtctaatatatcccattaccctgcttagccattgcatttcatcttcacaacaacctgatgaggtatgtatgaccctcatttattccaaatgaaacagaaacttaggtcaaatatcctgcccagtcaagtagggaagtcatgaatcaaacccaggttctgcatctcaggataccatattgtataggagctgtaattacatgaataacttattgtaaaatgcattgttaaaggcagtgtagttactttgcggacagggtgccattgacctgctttgagggtttatgaagacaagcccccagaggaaggtatcttgtgtctgagtgttaatagactggaaggagtcctcagacctgctgagtggggaagatcttttggctgaaaggttgaagaagagggtagagatgaggcttctgggaggtgctgtctgagggtgacttggggcagatcttgcaggcctggctgaaaaccttggaatttatcctgagggcagtagggagcagatgtcagctttttaaatggaggggaaaacaacagaactaagtttgtgttttatatcatccctctggaggtcctttggaaaaatggcttggaacaaagcaagggcggagagagggagaccggttaagtgttaggtaggagggaggtagtccttgtgagaagattggagagagagtcagaggttgactctttccttccttggctgcaggctcagatttgccctggagtatgcggctttgagtcacacagattgcacgcttccctttgaggagcggcttccactttgggcaagttggggtaactggcacagattctcttctcaggaaagcaagaggtcgcggtgcagcgggcacaaccctgaactaggaattggaaaacttggggtccactctggttctctgaccttgggccaaacattgaatctctgttatctgtaaattgaagagcctggagccttcaggatttttggtcccttccaaggaggtcccatctgcccagatgtgatagtacattggggtgagagtgctcagaggagaggcaggctccacctatcagtggagtctcagtttctacgtagattgtagtacagattttacctctatgctataatatattctcatttattttgaaaatatacttccttcttaactctgggttttgtttttttttttttttttcacagccagctgttttttatcctggttagaagaattttgtgttttcttttagctatggatctttgaacattaccctatgatcgaagagttttgagttgggtttttagatgttggttgtcatggagaaacaggaatctggtgtatgccagccatcatcatcatcatcataaccctttggatgaattttcattatcaagggatctggaaggctgtcttcgctctgcttcccagctaacaaacagatgtgttcccagaagatgatgggcatagggtgtgtttttgcaagtcatttttcccatttacgtagattattcttatttccaattgatcctcaatagataagagtgccattgagctttattttcatctgtcaggcaattaagaaaaaagtaaaggaaacaaaaaagctataatatactaaggaaattcttagattctttggtaaaattaaaagaatcttggtgcatgaatgatccggccctaatctatccatcttgcacatttgggttttcctggatctctcttaaagtggggcacatctctggtcttgatagtcaaggaggagggttggggtaatcagatgtctcaagcagaggtgcatcattgagcctgggtaatggctgaaagtcccccagatatccagtttgaagctgcgttgggcaggccatgggttttattacgtccaaggcgtgacaggcaaccattctataacagaccaactcttgggcttccagaagactgaaaaaagctagaacatttactaatgccaggtgttgcatttgacactttacaagtataacctcactgaaagttccccacaaacatctgaagtagattctgcttttatctccacttcagagacaaggagattgacacttacacagattaaatgatttaatagtgtcgaaagacaaaatcacaacaatttctcttaaagatcttaattacctttatttgcaattccagaattgggtaacacttcattccataaaatagagtaagtgttccaattagctaagcagaagaggttggttttacagccagagaggagtagaagaaagcaaaaaacagaacccagagtggattggtcctttcaaagttaagttccttgtaaggtggggacagggagacagaacaatagaaaagtaactgattggttaacatcaggttactccaggttacttttttgtaaggattacagtagagggaacttaattatcatgctgattgaaactagcctgcttgggaaattaggctgttacctctctcccgatttctcagagggtcagataacaacctattttcagtttggtaaaaatctcagcttgagtgactccattttgattaaattagatttttggggtctagtgcaagaccttagtccaaaacaatgactttctataatttttatttaacaggagggaaacttgagatttgaattcaagccactctgactcaaaagccatggttttctcactcttttgttcattttctcaataagcttgcaaatgcttttaacctctgatgcctgcagccagcatgtacctcaatattgtctgctagtcacatgtaggtaatatttcatcatgtggttaatactaagagggctatgacctcttaataatgatgcatcttaataatgatgctattattgggactttgatttcagaagtaatgcaagatctgcctaaatcctaattatccagcttggaagagtccctgacatctgaatttacaccttttcttcccttcttttttttttgagacggagtttcgcttttgttgcctaggctggagtgcaatggcatgatctcagctcactgcaacctctgcctcccaggttcaagtgattctctcgcctcagcctcccgagtagctgggattacaggtgcctgccaccatgcccaactaatttttgtattttttgtagagacagcgtttcaccatgttggccaggctagtctcaaactcctgacctcaggtgattcacctgtctcggcctcccaaagtgctgggattacaggtgtgagccatcacgcctggccattcctcccttcttttaatctcctttaggtgtctatccagtgcaaccataacccacaagctcttccctatcactcctttcctttctctggaggtaaattttataaatgatgtgtccatcataatagccattttacgttgcagaacaaacaaccccaaactctcggtggcttaaaacaataaagatttctacatctatacacatctgtcataatcaccagggaggctcttttagccactcagaaccaggctgatgaagcagctgcagcacctcctcaaacagctggtctgaggtgctgagctgatgggcaaggagaatcagaggatctcttagtggtgtttaaatgccctgtcacttctgctcctgacagattggccagaactctgtaaaatagtgccacccaaccataagggggccaggaagcacagttctcccctgtgccaagaaggagagaaacagaaatgtttggtgagcggcatggtgtaaccaccacatataccatgccatatatatcctgcttccttctttttttctgcctagcttggcaaatctgacttcacgtaaactttatagaacatgtatagcctctttaattccatttctctttcgcctttgtcttccaaaagtttttcaggtactgcaaaacagtgtctctccttcgtgtaagccaaaaggaaagatctcaagccttgaagtgaaatatacataattcatccctcagtatcttcagggattgatcccaggactcccgcccctgccccctcaaaagccctgccaaggataccaaaatctgaagatgcttaaatctcttatatgaaacggtatagtatttgcatataaccggcatacaccctcacatataccttaaatcatctctaaattacttaataatacctgatacatgtaaatactatgtaaatagttgttatactatattttaaaggtttgtattatttattagtattgtattgttattttttattgcttttttttccctcccccaaatattttcgttctgtggttggttggatccgtggatgggaaacccacgggtacagaggactgaccatattaaagagttagggctactaacctcaaaaagtttctgaatgaccggaagttcttctgatcttcacaaacatctcttgggttttctcacttgctaaaattaaatctgtcttttctccagtgtcaatattcaagataaataaattatgttcacattcactcctattgtttactgttttgcttaattggctatatttcaataatattaaatggtattattttctaccagtttttaatcagacttgaagcttttcaggcacattagagagtaaatggacttttgtgtgataaattgggtacctaatcaccaattttaatttacttctgaggaaaattctattgtaaattccagacaactggtttgcaaaccctgctttagaatgcaacctctttctaggatgaggcctttttctgtagcaaatttctgtataacgaaaataccagaataaatgctgggttttaatggacagttatgctctactacattcatgaaaaatgtacttaatttacaactctactgaacacaattcagttttttccttcgttcagttttttttcatttcagtttttctactctaacccagattgaaactttgcattatctttaacttctctgtctttatatttatttccttcatttagttattcattttttcaatcattcattcactcactcattcaataaatatttactgagcatctacttgttgtagtcatgaagcaaggttctgaggaatgttaaaaaacacagtccctggccgggcacagtggctcacacctgtaatcccagcactttgggaggccgacacgggtggatcacttgaggccaggagttcaagaccagcctggccaacatggcaaaaccctgtttctactaaaattacaaaaattcgccaggtgtgatggcgtgtgcctgtagtctcagctactctggaggctgaggcacgagaatcacttgaacccgggaggcagaggttgcagtgtgctgagatggcaccactgcactcctgcctgggtgacagagtgagactgtcttaaagaaaaaacaaaaacaaaaaacatagtccccgacctcaaggagattctgtatagcagagaaacacacaagccagcatgccatgatacatggtacaataagataatggctgcaacggaggtctctgcaaagagcagctgagcagagaagacctatctggatctgtttgaaggagtcaagaaagaaatcagaaaggaggcagcttttcatctgagacttaaaaaatcagttggtggctgggcgcagtggctcacgcctgtaatcctagcactttgggaggcagaggtgggcagatcacgaggtcaggagatcgagaccatcctggctaacacagtgaaaccccgtctctactaaaaatacaaaaaagtagccgggcgtggtggcacgcgcctgtagtcccagctacttgggaggctgaggcaggagaatcgcttgaacctgggaggcagaggttgcagtgagctgagattgtgccactgcactgcagcctgggtgacagagcgagactctgtctaaaaaaaaaaaaaaaaaaaagtttggctaggccaaagagccaggcaaggcagttccaagtagagcagaccacacgaaggtgtgagagaacacagtttgttcccataagttctaccactgtgggtggagcttcaaatgcaaaagaggaaaccaactaggagataaccctaagttggtgggcagggaactgagcactcagggctttgcctgcctctcaaaagagtttgtattttatgtgggaagtgaaggagctatcgaaggcttttgaacaacagagtgaccgcatcagatttggtggcaatatggaggctgctctggagggacgtgacctgagatcagggcttctgaactttatccctagacttgcaagggacccatggataagatgtctgggatctgtgaacttggattggaaaaaagcgttatactgtcattttcactatcctctaaactgaaatttagcatttccttcaaataagaatctaggcaacggatcacagtagaattaacagaagatgtgagtttatcaccagtagaaatgctctgatagcatattacagttgttgtaggtatttcaaaatatcttttacacttatcactaaactgaaattattatagatattagactcactgccataaattgttacttaatgaattaataaagaacatatataactgtgtgacaaatataaaaaataatttgatatttacattttaatataatgtatcttttgtttttattttatgatttaagcacagtattctgagaaggggtccataaaaaaagtcaaaactcaacacaccagaggatgtgagtcaaaactcacatcaccaaaggaacgtgatcgttgaggaggtcagtgtagcctaaggcagcgatggggagaaggaggaagaggagttggaagaatttgtgagaaattctggagacagtgaatttttttttttttttttgagccagagtctcgctctgttgcccagagactagactgcaatggcatgttcttggctcactgcaatctccacctcccaggttcaagcaattctcctgtctcagccttccaagtatctgggactacaggcatgcaccaccaagcctagctaattttttttttttatttttagtggagaaggggttttgccatgttggccaggctggtcttgaactcctgacctcaggtgatccacccgcctcggcctcccaaagtgctgggattacaggcgtgagccaccgcgcctggcctgacagagtgaatttgttgatagatcagggacataaagcaggggtaggggtacgcatagaccccatttcctccagcagttttctggctggagcagaatgcttatgcttgccacatgtgttcctttcttcccagtgctatcattatttaccgtacagcatggtttaaaacacggaaaacatccatcctttgcttccctcctctgtgcctgccagtcctacacctttctcaactcttttagtgttatcttctccagctagactgcagattctgggcaggcagtgccttgcagtctgcgaccccatcatatatttttcacagttgatgttgaatacatgactgatagatttcaaaggcatttcctgttttgaggtcaccatgtacaccatattctagttacagaaattataccaaccttgacattctgggaattttttttttaaattcccatgggttctatcatttgtcttctcataaaataatacaaaatgtgcaaataaaaaaatccatatgcttgggcttcctgattgtttttattaaagtgagtttagtgatggtgggttaaataatgctgtaatcttaagccagaaattgagaatatggatttgaaatgtccccattccctttttttgtttgtttttgttttgttttgtttgctgttgcatgttcttggcagcagtggttgatgtcagtattgttgcccatgttgtagactgcagatgttgcagtgtagcttagtactttggttcgcttgctgaaattcctcactgtgcttcttatgaggtccaggaacatatagatttgcagtctgatgtattttgatgattgccagataaaactgatgtctggcactttttccaggagaaacacatgtagacgtttccaagttgatttgtagggacttagtgttattagaactttgtggcaaaactttttctcaagtggcagaagaaataaaggaacttcagttttgagggctgttaacagcacttccattagtggcaaagctgagatggttgacaaagtactggattgttgagatggaccttccaggccgggtgtggtggctcacgcctgtaatcccagcactttgggaggccaaggtgagcggatcatgaggtcaggagttcgagaccagcctgaccaacacgatgaaactccatctctaccaaaaatacaaaaattggcctggtgtggtggtgcgcgcctataatctcagctactcaggaggcttgaacccggtaggtggaggttgtagtaagctgagatcgcgccactgcactccagactgggtgacagagcgagactcagtctcaaaaaaaaaaaagaataagcaagtactgtatttggacttttaagcattactgatacagtaaaatacagttttagctaccgacgcaagactagcacccaagattttagaaaaaggcactttttcccttttattttccaataacatttctcaatctggtaaccagagagactactctgggattaatttgagtctgattgctgtttactgttctaacaagaacagtttttttggagaggagagcagagtttaggagaaacgaactattaaaagttagcttcccgtatgggcgtggtggctcaggcctgtaatcccagcactttgggaggccgaagtgggcggatcacgaggtcaggagatcgagaccatcctggccaacatggtgaaacctgtctctactaaaaatacaaaaattagctgggcgtggtggcacgtgcctgtaatcccagctactccggaggctgaggcagaaagaatcgcttgaacccagcaggcagagccgagatggcgccactgcactccagcctgggcgacagagcaagactccgcctcaaaaaaaaaaaaaaaaaaaaaaaaaaaaaaaaaaaaaaagttagcttcccagtgtacacatgaaaagtacaatccttttcttcatttatattataattatttgaagagcaaattaggtattgttagtgaagaaatgagagtgattacctggtaatatgatgagttactttttctttaaacttactggcttttcccttaacactaatggtctggataacaagtttttacttgttggcagtgcagtttagcctccgaacactcttggaacaaaatgactaattttttttaacgctttattgaaatataaattttaggagagtaaacattttcgatttggaagaagtagttacgttacagaccttcaaatccagcttgttcgggagacttgacatttaatcactaggctaatgaagcgccagaagagagagcttttatggttagaaagggaggtgttttttaaaaaaaaaacaaacgaacaaacaaaaaaaaaaaaacaaggctcagcccgagatactggaagcgacttgaccttgatttacatatacaaggaacggaaatgaattagcccggctagatatttctaggaactagttaagggagaatgaacaagatgggagcgaggagaaagcgtgtgtgcgttcgtgtgtggctgtctgtctgtctgtctgcggcaagaggaatctcagagtttcggttatttctccttgaagaattttcaaacggagttcctgcaggggctggctctagcgtctacgatgtgcacacactgtctctcaagagggaagtgatcctggcgccacggggtgatgcagcagaagttctttttgtctgtggccagggtagagtgcggagccccacggagctgtggcgtggcggctcctcccagacgcgtccggggcgccgctcgggtctcccaggaccttatgtaacccagcgtcggcagcaaggagccggtcacaggctgaccaacgtcaaggcgtttcactttggaagcgcaccagatgagtgtggtattgagagcagacggctgggtgcaatgtttttgccgcatatctcatgggttattttaatcttttcacgtagtcttaagggtctcactagaccgtatatgagaatgtggccagggatgtggcttctatagattgtcccagataagagcatcccttttgtttttgttaatgcagggtaaatacaacctcttcttaggagctagtttttcaattattctaaaagtgataacatgctcatggttcaaaatttagtcagttcagaagtgcacaaaatgaaaaaattgtccaactcccgtcccactccccagaggtaactattattaaaagtttcctttttattgttccagaatttttttaatgcagtcgaagcctctatttaaatcatgttttaaagcacacacaaatattattgtactatactttctgctctgcaatttgcttttaaaatttaatatttggactctctatgtctacctttctctctatatatctatttatatcttcatggcaacataaggctttgcctcattcttttcaacagctgcacaatattccatgatatgaatgtaccattactgattgaatcagtctcctgctagtggatatacaggttgttcccagtttcgtgctattacaaacaacggtgcggtacaaatctgtgtgctaattgttgctgtgtgcttatgggaacatatatgttgagtacattcttagaagtggaactttggggcccaagggtacatggcacttaacattttaatagatatttactttcaaatcacattcccaaaaggttgttcccatgcatatttcagatggaaataaattctgtctttcaagttgtacacatagctgagggttttccttaaaatactgttcatttttaaacagcatattttccattgagatcgaataaacttgtttatttgctaattaattgcccttgaagttaaatctctattctagaaaagatgtctgagaaacctagtggaaaggcctcaacaacttcgtcccagccttgatcagagacattcacagctatgggacaggcacatggctctatgccttgactgtggcttcatagacagctgtctttaaaaaccctagggtaggactgagaaagctttttttttttttttttttttggtatgtgtaataatatcatcttcaattagttctgttcaaaggacatcgattaagcacaactatagtaaaagtttctccagttccctactctctgtccccttatcctggtttcctgccttctctctccccttttgtgtttgtttcttttcataccagttatcctctgcacccactcctgacaccagattgggtggccagttctaggaacaatgaaactgatttcctacaactggaaggtggttctggagagggaattagctttgcctaagattattatcacgctgacccgactctatatctagatcctgcctccagtgggatagctgatctgctatgactcccaaatgcctaaagctctccgcctactcagaaacacagcatcttctttaaagctccagaagagagagcttttatggttagagaaggaggtttaagaaaagcaaacaaatagggctcagcctgagatactggaagcaacttgaccttgatttacatatacaaggaacagaaataaattagatattagaattaaattaaaatcaaattttaatttagatttgtataggtaagacctattacagatgaagccagataccaagatatgtttcaaaaaacatgtggttcacattgctattaaattgtttataaatgatcatagtagcatcccaattaccttttagattatagccaactttttgggaattacaggacttttacaagtattttatttcccaaattacctgcttatctggaaaataaccctagtaagaccaagcccactcatcctgaaaactcatcttaaatgaagccaagtcaagtcagaataagatctgggtgtcagcaaaaaggaaaacaaacaaacaaaaatcaaaccgaaccacgctaaaataaaataaaataaatttcccatttaaagtctgaatccctttggctttgtaagctactgttaccatacagaggcatctgccttaaaataaaggaaataaatcaagagcgtagaaaacctgtttaatcaaaactcttaatttcaaatcagtgtttccataacacattacaagccagcaggaagagaggggaggcaaaatgtgcagttccatgatgtccccaaatagaatgttcacaactgacaggaagcacctgggggattatgattatttgctttagaaattcaaaaataaattgttttttgaaataaaaagggaagaacaaatcggtttctcagttcaggttgtttttaacacttcacacacatccatttttataatcccaattcagaagacaatgaattcaagttaataatgtatttaaatttaaggataatgcagagaatgtcaaaatagaaaattgcaatagaacagttgagctgaactctgaggctccttttcttattttgactcaagttgaccttcaatattatagtactttcatttttacagctctttacatattctgtaaaaaagcttttaaaaagtgaaatgaagatgtttcttaactattaaatttctattgcctaactcttttaattttttgagtccattaagactttagaagatattctttctcaaatgtgtcatttaattaacaatttgctaatggccttgataggatttttccatttttgttttccaaatcaagaaatctccatgttccttttattattttcactttgtttctttagatataattcttgtttttcctggataattagtatagaatttatttattgtagagaactctgttctgacagctgataatataaatatatgtttgacccacattactagaaagaatgttatgtaagggagtttgtcagggaatatcagctctcgaacactgggagttcagggaaagaaatgaatttgtaggtcattgatctttgtgttttaaataagaattaaccaagaattttatggttacataaccagtacatgaactagtttttactacattttgttaatacatcgaattgaataatccaattcaaaacatagggtaccaattcctcttgtcagcaatactttgaaagtagggatttattgagagttcttttattgccttgacttccttacgtttgtaaactatgtgatgggtattacacttagatttattagggtacttaaaatcttgccaaaatgaaacaatctctttttgtcataagtattgccgacttaaaagcatttgtgaggggacggggggtgattttgcttttggagtcttactcgttactgaaaataaaatatgctcagctttttctttttctagtagacatttattttactgagttccacactgatagttaactttaggaaatgcttcacatattttaactaattttatgatttaatttttaaaaaggaggtacattttagaattttttcccccttttagatacctgacttacgtgtttctgaagataaattgcagatccagtcactataaattcagttgaaagaccaatctttctacccttctttgttgttctgatttcagaattccaggccagtttgttgtcaactttaatgtaccttttgagaaataaattgagtctcacatttcttgcatgtgtttgtgcccctagagctggaatgcttttcttcggccaactgaaagtagagcctgctccttctcctctcacagattaaatctgctttcattcgtgttaaattcagttagttcatgaccaaaagaaaagacgtgctctcctttttctttttaattttaaacaaccaccatctatagtcttcctgtagtttttgagagcttcaagttatatagctatttttgactttgtgtttggttaatctaatagagtctacatttttgggaggcatttaatttgtgattatcccttattgtagtctacagagtcacatcaacaaaatgagctgttttattttattttactttactttcttttctggtctttttgttttgtaatttatttttaaatttattaatttgtttttaatttttttttatgtgattcttccagctactttccagtagcaaatagagggcaaaaacagtcataattttattgaatttgcctcacccctgtgtttgcccctgttcctacttactcacaatttaatacttctcagaactttcacatttcacctagcatggaaacctgattgttaaatggttggataggacagtgtgtaggagaatccttgggatcaataatagacatatttgggtttatttcacaggtattaggctgtgtttcttgacttttagttgagtgcttactcttgccaaattttatgccatgcactttacatacattatttgatttaatccccataacaccatgcttggcatgaaaccacatagtctgtttacattttgcagatgaagaaactgaggctcaaagaaggttaaagtagaaaggcatccctttactaagtggcagagccgagatttgaatcagcttatctgattttaatacctgatttaatatttaatatttgggatcttaagctatgccatgcagcctgagttactaactgggaagtcatggttatatcagattcctaagataagactaccaagagacccaggcccatgcatttgatctcttgaatgttcaaaggaaactgcaggggctgggcacagtgactcacacctgtaatcccagcactttgggaggctgaggcgggcagatcacatgaagccaggagtttgagaccagcctggctaatatggcaaaactccgtctctactaaaaatacaaaaattagctgggcgtgttggcctgcgcctgtaatctcagctacttgagaggctgaggcatgagaattgcttgaacctgggagctggaggttgcagtgagccaagattacaccactgcactctagactgggagacggagcaagaccctgtctcaaacaaacaacaacaacaacaaagctgcaggttctgcaggcctttctgccctgcaccctccaccacctactacaaattgtctttcttcttgggggcctcacttgtctcatctgtaaaatagaagtattatttcatgtggtctatatctctcctttaaaagaacacatttttaaaaatttcaaaagaattatagatctcaaaggaagttgtggagatagtacagagaaggcctgtgtacctgtcacccagtttccccccagtggttggctacatcttttgtaactatagcacaagtaaaccagaaaactgatcttggtataaagtgtttgtgtagttctgtgccattttattacctgtagattggcgtaaccaccactgaaatcaggatacagaactatcattacaaagatctcctttgtgctacccatttatagtgactcccacattcctaaccctttgcagctgctgatttgttacctatcactataattttatcatttcaaatcccttttttttttgagacacagtcttgctctgttgcccaggcatgatctcagctcactgcaaaacctccttctcctgggttcaagcaattctcctgcctcagcctcctgagtagcttggactacagttgtgcgccaccacacccgcctaatttctgtattttcagtagagatggggctttgccatgttggccaggctggtctcaaactcgtgacctcaagcgatccacccacctcagactcccaaagtgctgagattacaggtgtgagccgccatgcccgaactcaaatctcgcttttaaaaaataattttttgtattatgaaatagctcatcagaaaagtacagggaatattgtaacaatacttatgtaatcaccactcagccataacagatagccagatttaataaatattgttgtacttcctttgctgatttattttaaggcatctttgtcctactttttgaccctactgacctcctaccctccctagagataaactctacccaaaagttattgtatatccttcctgtccatgttttttctgtttcactgcataactaggtgtctacaaacactatgtagtttagctttgtaggttttaaaaattcacataagtcaacaaatatatattgagtgcctactgtgtgctagacctcaggaatatggtagtgaacaaggcaaatcttttgttctaaatatgtaaacatttgaatacatgagataattgcaggcatctgtaactgtgtgaaaatgataatataggatatcagactggcagggaaagtggggaagtgaggggattggcagggcaccgaggaaacacgttgctgacgatactgtgttttcgatcaaaacctgattgatgagaaggaagagcaagtgttgatgccttaacgtaaggatgagtttggtttgtacaaggaagggcaacaagcacaatgtggctggaacagtgtagactccagggaggaagtaggagatgagctcagaggggtagaaggtgaaggtgggaggagagggggagattaggaaggaccaaagagatggcaccgaggagtttgggttttattaaggctgcagtgggaagccattgaaaggtataagcagggtcatgccatagttatgatataggggatggcataaaaggcattcaagtgagaagagttaggacgctgtttccattttccagggaagaactcaaccagagggatggtgataccttctattaagatagaaagacttgatattgatttatctgtctggatttgcctgaaggattcaacattgtttcaaaatttacttatgttgatacttttagataaagttaactcattttcattgctatgtatattccaatctatgagtacagtataacaaattttctttatctattaatttacttattagtagatgttaaagaaattctagcttttttactcctgtacacaattctgccaaagcatccttacatagagaggtttgtggataggatactagagtttctctggagtgtatatctagcaatagaattgctggggtctttttgatatgctcattgtcaactttgtcagatagttcaaaattgctctccaaagaggttgtaccaattattgtccctagtgcctagctgtttatgagaatttccatttcctcacctcctcaacagttagtgttaagcttttaaccattgctgatctgatggatttaaaatcatatgtcattgttataatttgcatttcctgcttactagtcactattttttttgaccatttagatttagatttcttttctaattcctattcctgtcctatgtccagtttgctgttgtgctgtttgtctttttttttttttttttttgagacagggtctcactttgtggtccagggtgaagtgcttacggtaacttcaaactcaggctcaagcaatcctcctgccccagcctcccaagtggctggaactacaggcatgcaccaccactcctggctagtttttaattttaatttttatttgtatagatggggtcttgcaatgttgcccaggctggtcttgaattcctggcctcaagtgatcctcccactttggcctcccaaagcgctaggattacaggcatgagccactgtgcccaggctgtttattctttttgagttataggatttctttacatattccaggtaaacaatccttcgttggattttaagcattgatatatacattgaaaaaacctttgttggcttttatgcactactgtggtttgaatgtatcccccagagttaatccccagtgcaacagtgttgaggagaggtgggacctttaatagatgattaggtcatgagggctctgccttcttaaatggattaatgtagttataatgagagcgagtttattatttcaagagtgggtttgttataaaagcaagtttggctttctcttgctctcttgcacatgcatgctgtcttgctcttttgccttctactgtaagatgatgtagcaagaaggcccttgccagatgctggcacctagatattagatttcccagcccatagaagtgtgagaaataaaattcttcatatgttaccctgcctcaggtattgtgttatagcaacacaaaatggactaagacatgcactgaaataattttgtcttccagttttagcttgtcttttcactgtttaaagtaatgctttacatttacaatattactgtagtcagatttaccaatcttattctttacattttgtgttttcctaccctgtcataaatatattcaagttgtgcttttcactttagttgttgaattcacctgaaaaaaaaattaataaatggagataaaggtatagatttaaaaaaaattatttttcttttctttatggaaaatgaactaacccagtaccacttattgaacagtcttttcctttccctactgatttttaatgttacctttgtaatatatcaagttttccataagcatgggtctgtttatgagctcactattctgttctgctcttctatttgtccgtctccacaccagtgccattcttttgtaattactatagctttataataactttgctatctagtgtggtgagtggtttttgtttattcttctgtgttatcttggccatttttgattctttactctttgatactagcttaaggatcaacttgtcaaatgctgtgatgggaaaatgtatagattttaattgtaattacaatgaatttatagattaatctgaaaacaattgccatctttgagcttttccatcccatacatgaacatgaatatcctttcatttatagagatttttttatgtacctcaatcaagcttcacttcataatgatcttgtatttcctttgttaaatctgtttataagttacgtaaagttttttttttttactattgttaatggaatcttttaaaattttgattaaataaaacattttattatttattattttcatttttttttttttagagatgaggtcttgatctgtcacccgggctggagtgcagtgacgtgatcatggctcactgacgacttaacctcctgggctcaaggggtccttttgcttcagcctcccaagtagctgggactacgattgtgcatcaccacacctgactaatttttttaaattttttgtagagacagggttttgctaaattgcccaagctggccttgaactcttgcgctcaagttattctcctgcctcgacccctgaaagtgttgggattatgggtgtgagccaccttgcctggctggaatctctctctctctcttttttttttttttaaatataccttctgttagttttgtgctggtatatgggatcactattgatttttggatattcatttgtatccagcgacctttctgaattcttactaattctaatagtttgtctgaagagtctggagtttttaaaaatttcatatttatttatttattattattacttttttgagactgagtcttggtctgtcacccaagctggagtgcagcggtgtggtctcggctcactgcaacctccgcctcctgggttcaagggattttccatccttagcctcccaagtagctgggattacaggcgcccaccaccatggccggcttttcagtagagactgggtttcatcatgttggccaggctgttgtattttttgtagagactggatttcaccatgttggccaggttggtctcgaactcctgaactcaagtgatctgcccgcctcagcctcccaaagtgctgggattacaggcgagagccacagcgcctggccaaagtctggattttttaaatgtatttgttcatattgcttataagtagctattagttttctcaaagaacgagcatttagataatctctttaagtctctcttccaaactctgtgatatatgattctattcagtgcttttgtatctatatatgggtaaaaattaagcatgaccactcattcttggtacattgcacaatatcttgatgcattatacaactgtcttttttttattcctgcttcctattcctgtctctattgaatttactagaaaattttcacataaacttagattaagattttaaaaatatatagcaaaagtaaaaatctttaagagatttaacaaccttatatcacttgctgatgaccatcagcatgtacagttactgacagtgtgtgactatagactcaaacacattctagacatattacagattgcaagatggggccaagaaaaaacaagaaaaagagaattatgtcagtccttagtatttgtttgtttttttaaatacaagggcttgctgggtcggccaggctggagtgcagtggcgcgatcacagctgcctgaagcctccatctccagggctcaagcaatccttctgcctcagcttatcctagactacaggtgtgtgccactccacctggctaacttttttaaaaatttttatttttagtagagacgaggtctcactatgttgctcaggctgttctcgaactcctgaggtcaaacaatcctcctgccttggcctttcaaggtactgggattacaggcataagccactgtcactggccaatcctcagtatttgtagcatatacatacacatgaaaaccacacatatgaatgtatgtgtatgtataaagtcatgtgacctgtacaacatatcggcatgagaatgtgtgaacgtgcttcctgttcacatgtactccaggaaatggaaccagtttccaattaagattcaaaggtatatgacaggtctacaagagactttgggagatattatttcagagttgagtccacttcaccaggcctttcagaccaggagtggctcaaatttgggtagtactcaccacttaggattatggtcagggcagttcacagggtgcttcgtaacaaaactccccttcacttctcagctcccaggaaagaagggggctctttcctgcctcagagccctgcattctgtaatccactaagatactcaccttgactctgcgaggagagggtggtgacagggaaaacacagaagtcagtgaactcatacaactcacagccaggttgtcatctgggtcctttccatctttgtagttttctaggtgaagtagctgacaaagggcctggcctagagagcgctgctgggcctgctttactgggttgtccaaacttccctggagtgaggtccattcaagatgtgggctcaactaagaggaagttaccagactatttagtccactgccgaaccttggtccgagaccaagtcgtagctgttccccgaagctatgagagtaaacactgcctcctatttttagtagttaattgcttgcaaaaaatagctggaaatccagacctttaagtctcagcagcctttagcttcacagaccgtcctgtggcaacaacaatcttaacaacaacagtaaaaaaaccactaacacttacctggggtcactgtgtgcagggccttgtgctatatgcattgttttgtttaatcctcagactgagtggtcattgttattatccctatttttttaggtgggaaaaagaagactcaaaaaggttaggccctctgcctcaagtcacacagcccttcagaagcagaaccaagcccagtccaagttagtacagcctaaggctacagcctacggttttgaccacttctctttcccacctttccacatcccataatggcatccatggtgggatgtttattacatggatctggtccagtttcctcaaagcactttcgttgataaactggactcaatcaagttaaataaacaagagattattacctttattattttttttaaagccattagatttacaagttaccttgtcttcctcctcatgttcccttttttacagagaaacccggtatttttccagtgcagtattatttggggtaatgcttgacaatttaaagggcacgcagcagttgtgtggaatgtagtctgaaaatggccaataaaaccatcagagtatgagcaagctccagggtggaaccagaaatgtggccgcctgctccttgggctgattgctttagcagaaaaatcaagttcaggatcctgtgtttactgagatgattggcatgtattatcagagtagctgcacctggaagatttccgacttaaatctattgacttcatgtaaatggcatatggaaaacaacaaatgatagtttggttgccaaataaaagtacacagaacacccacatggaggcaacatgcttgtttctattttgacagctctcagagggaaaacgttgcggtgttggcctcttcctggtgagtcctcattgggtatatgggtataaaaaagctttgaaacatcctttgctcctactcttctgcactcatagattctcaaaaaaacaaacaaaacaaaacaaaaaaaacaagaaaaatagtttttctcactgttaatcctctgatgtggaaagaatgtgaaaagcagacgacattcttacatgaataagccatatataaatgaaatattgggcaatgcctatttaaaaaaattaacacccaataatctgcatttttattccccagaccaagcagaaatgattcattttatcctaatctaatatttttatgcttgagttttattgttcaaattaacaacaaaaactacaataaaaatgtagttttgtcagaagaatgattttataggcacagttatgcctgccaaatatacctaaactcaatgttttaagaaaaaaaactgtggtgggtattttagaaagttagacttacattcgtaaagtgtttggtcacctattaacatatgagcaagttcagaatttttgcatgttgggttttttctttttctttgcttttatttatttatgtttttttgagacagggtttcgttttgtcgcccaagctggagtgtagtggtgcgatcacagctcactgtagctttgacctcccgggctctagtgatcctccctcctcagcccccatcgtagctgggatacaggtgcacggccccacacctggctgatatttttttcttttttgtagagacagggtcccactatgttgcccaggctggtgtcaaactcctggtttcaagcgatcctcctgccttggcccccgcaaagtgctaggattacaggtgtcagccactgtgccggcctggattttttttttttttaagttgattgctcacatgtatagggtaaaatttttaggaaataagcagccatgcccactccccactcctgccccagtagtcttgtaatgttatatgtcaaagcagctctcagtgcttttacattttcttacttttaatttaaaattgtgtttataatgtatttcaaatatacaaaaagcacagagcacagtaattaccaatgccaccaccaccacccacatttaacaaggatagttgttgcggcttgtctttatcgctctcttaaacgagcaagttgccgagtgttacacacactatataactaacgtatataagataagaaattaccccaaagtctactatgtattgcttatggatacttatacttcttaagacataaatacacaatggggaaaatacttaaccactcctgaagggccattacctgtcagaaattgggtggatgaggccaggggcttcaaccatacctgtgaagccttatttttaaaaaaagtcatctgaggtgaatatgggaaatgttaatagttgttgatccctggagattttcagtgtaaagcatatggtgagacagtttgactcttcaagcagaaactggtcccttagaaatgcacctcctccgccaatcaggcacatttgtaattaacaaaaaggaattatgtgaaatgactacaagtggatgcctcctgcatgcatttctatggtatgaatatcacttgagtcaggtaatggggaaaaaacaaatgtaaaagaaagggagcagggaaaggaaatgtacttcaaattgtgtccttcctaattttattctgtctgacactcttctgaggggcagtagaggcagaattcataacctccaccatcatcttcataattgatatttactgagttctttataatgtgtctgtcattgccaagtactttacttcagatattagacagggtatagtttcatatgcctgaacagagacccaaagtaacagcagcttaaacaagatagaattttatttctcactcacatgacagtctggacatatgtagtccatgactgatatgatggttccacgtgggtcaaggatccaagctcctcctatcttgttgctctgctcttcctagagtatcgcccttttactcatgacccaaaatggctcttgactctccactacaacatctagttgttgtttatatttcactggccagaatttaatcatgtgagtgcatctggctgcaaggaaagctgggaaatttggtctttgttctgcacagctatggatggcagccataaaaattggggttctattcctgtagaaggagaagagatggatattgagggccactagaagtgccacaagtggatagtttctattaatccttctgacactaggagtcaagcccaagttaccccattcaacacatcagaaaaagactaggtcaaatgctgtaggtcacacagttaatactttgtggaactgctgaggtgtggctttatttttgttcctttttgcttttgcatctagtttgctgagaagctctaatactaggatcagggctgagagttcttggcctccttgggattaccatacctcatcagtgtttgcttgatttcatcacaccttttaaaacaattatccagcaaggcactttgtggtgtgttctttagagttgaaaacaagcacacatttaattgtttttgtttttgggacagggtctcgctctgtcacccaggctggagtgcaatggtgcaatcttggctcactgcaacctctgcctcccaggttcaagtgatcctcctgcctcagcctcctgagcagctgggactataggtgcccaccaccacacccagctaatttttgtatttttagtagaaatggggctttgccatgttggtcaggctggtcttgaactcctggcctcaagtgatccacatgccttggcctcccaaaatgctgaccttacaggcgtgagctaccacaaccgacccatttaattttgttcaaggaattctgtgacacttatttagcagtgggtagtacatttgggtgttgcctaatcagaactggggacctagaccagggaaatatcattctatagtttgattcagattatacctggcttctggttaggctagaatatgtgctcccaaaatcttttaaataaggacatcctttaataaaatatgtgttctttttctataacatctttttctgagccctatcttgagaccatagactatctcctacatattaataaaagatggcagattttctaggaatggttttatttgaaggagaaaaaagtagcattgaaaccagcttttgcttttctacatcctccaaccactggcatcttccatgaaacacaatttgataagggagtgatcccttttttccactcagagtacaatttccaagagatggcatgtgctgaaaacaaaacttaaaaagggaacctggttcctgagagttcacatttgacatttttcaaggtcatgccagataaaaaggatacaccccaggaagaagaacacaagatacctgctgtagccctctgcctttggaaacgttaaaattgaagtcattgcatggtgcaatactggagtaaggaatagggtgaggcaaatgaggcattcactcctgacagcaaaattcacaggggtgccaagcaaaattcacagggatgccaaaccctttgtaatcaaaatcaatactattttaatgcaatagttgaaacttcatgacgagcaaatatcaatattttaaataaaaatacgctgtcatttgtttgttttaccattctgcatcatcgtgtgatgggaacagtcatttccagtcagcctgagggtcctggccccctggaatacccctcactgtgtggatttatgaggattgacaattgtgagaacagactgtatgatgtggggctttattacagttacggcttctaaaaaatttattctcaactttatggaagaaaattagtctgtcaactaaattttgtttttagtagttatggattttgactgtaaatctttttttttttttttttttgagacagggcatcatttatcacccaggctggaatgcagtggtgcaatcataactcgctgcagccttgatctcctgagctcaagtgatcctcctgcctcaaactcctcaaactccatgtgccaacatgcctggccctttttttgttttttggttttttttttggtaatgacagggtcttgttacattggccaggctggtctcgaactcctgtcctcaagtgattctcccaccttggcctcccaaactgttgagattacaggcatgaaccaccatacttggcaatgttaagcttttattaatttttctcacttggctaaaaatacagaaggatattttgatgaatgtatataggagggcacatttttcttttgctcctggctctaatgtggctctacagagcactgttctggacctctgagaagcctgttcttcatgctagatgagtcatggctcatctaggttctattttcaggatgacatcacttactaactctgtgaccttggggcctcagtttcctcatctgtaaaactgaggatgatattacatagttcatatacatatacttcatatacatgcagcactatagaacatgatgtaagcactatatagacatgacataagcaatgttgaactatgtaagtattagcaatttttggtattatttctgacaatgcgatgtcttatttattgctatgccttctaccttctaaaaatcacctcctatatcacattaaatcatctcccattccctgatgggatgcatcccactcggtgcaacatcagtttaatggaaccaccacaggctctggaaagttatatccctgaaccccaaaatactcagcttaattggtgttcctttaagcaggtcactaagttctctaaatttgaattttctagatgaggataaaaatacctactttccaggggtaagtatttaccttaataaacactgtaagaggccaagcatgctggctcatgcctgtaattccagcactttgggaggctgaggcgggcagataacttgagttcaggagttcaagaccagcctgggcaacatggtgacaccctgtctctatttaaaaataaataggccaggtacggtggctcatgcctgtaatcccagcacttcgggaggccgaggcaggcaaatcacctgagttcaggagttcgggacctgcctgaccaacatggcaaaaccctgtctctactaaaaattcaaacattatttggacgtggtggtgtgtgcctgtaatcccagctactcgggaggctaaggcaggagaattgcttgaacccgggagacagaggttggggtgagccaagactgtgccatcacactccagcctgggcaacaagagtgaaactccatctcaaaaataaataagtaaataaataaataaagactgtaaaatttacttatttagataaagtattttattaatttattaatttttattaccttaataataaattaattacattgatttacttaaatattaccttaataataattatttatcttaatttattaccttattatttactttaatttattacctttattatttggtaataataatttgtaactatgggaataaataagatcagagataaaatagagagcatctattcaaacacttgagctgtaaaggatgatcagtaaatattggtttacttaaaagcagtaatttatgactgttccctagggatctgtggaaatctccagtggaatcttcaaacatgttgcctactgtcttagtttgttttgtgttgctacaacagaataccacaaactagggtcatttataaagaaaagaaatttatttctcacagtttaggaggctggaaagtccaatgtcaaggtgctgatatctggagagggccttcttgcagtatcatcccatggtggaaggtggaagggcaagagagaacaagaaagcaagaaggggctgaagttgcttttagaagaagcctattgacatggtaatgacattaattcattcaagagagcagagccctcatgatctaatcaccttttaaaggtcccatctcccaacacagtcgcactgaggattaagtttttaacatatgaacttcagggaatacgttcaaactatagcacccaccatattatattaattgtaaaatatccacacatatgttacaacagtcgttctcagactttagcacacataagaatcatgtggagctagggcaaccaagtcatctcagattgccctggactttccagttttagcactaaaagcccctcatcccaggacacccctcagtcccgggctaacctggatggttggtcactctgcctggaggatttgttcaaacacaacttcctggacccccacctttagagattctgattcatcaggtctgatctgaaggggagcctgtgagtttgtatttctgacaaagctcccaagtgctgcaggggtgtctgagaccacagtttgagtaacattgtgctatgacttgaatccatgtgttcctccaaagtccatatgttgaaacctaatacccaatgtggtaatattaagaagtagggccttttggaaagtgattgagtcatgggcactccagttcatgaatgggctcagtactctcgtagaagaggtagaagggagtgccctagtccgtttttgccctgccatctcttttgccatgtgaagacacagtgttcatccgttttctgcccttccaccatgtaagaacatggccataaggtgccatctttgtagcagagaatggaccctcatcagacactgaatctcctagatccttaatcttggacttctcagcctctgaaactatgagcaatgaatttctgttgtttctaagtcacccagtctaaggtgtttttttaatagcaataggaatggactaagacacactttcacaatatcatactaatggccatacttggtgttttatttctaaaagttgagaattgctcaatttttagaactccacagggttccttacatccctaggaggctggtgttttaactctcattttataaatcttcaaggaggtgtcctagtccccctagtttcctggcctagactggccaggagatgaacttctggccagttattaccatagatctgcagtggacacatagagactcaagtggggacctctgctgagcaaattttgcttacatatcccttttctaattaggaactgtcaaaaaatgatttttttttctttttgagacaggagacggagtctcactttgccacccaggctggagtgcagtggtgtgatctcagctcactgcaacctccacctccttggttcaagcgattctcctgccttagcctcctgagtagctgggattgcaggtgtgtgccaccacgcccggctaatttttgtatttttgtagagacggggtttcaccatgttggctaggctggtttctaactcctgacctcaagtgatccgcctgcctcggcctcccaaagtgctggaattatgtgcatgagccacctcgtctggccaagaagcaatgtttgctttgcagacggcattatttcaacaaatttcacaccatcagctatagcaaccaaagcacctaattgcttaccaaaaatgtatttaaaaaattctctttcattacactgtaattattggcagccccaggagtcatattttattctgattttatgtttcagcacaatttatccaatttctgcagtccccaaaatgcagaattgctaaatgattgcagaaataaacaaaatctaatattttattgtattgtttcaataatcagtactattatgtgtacatttggtaagacttcctttgatattcagtttatattgattttttttttcatctatcacaaaggaggcctccgttggtttgcttctctgttttctttacaactcctccctctgctcagagaactgctttttttgtttgatcagcccccatctactggttatacttttgattgaattctcagtcaggccttgtcatttctgggattggagcttttccatgtagctccagggaatgttgttctttgattccaggagatgctagaacgaccctgtgagcaacacctacttcatggggttggaagcaaaataaaaggatgtatctaaactgctaaacatgagacctgcccattttgcactaaaaaaatttctctgatctgtccatttcccttcacacttcctcccaacccactgcctttccatgaatactccccctgcctgaaattcaacctctcctgcagtctaggttgattcctccatggtacttttccatggtatcatgcacctgtcctttggagcaccaatcacagtgccattgtactttttttttttctgtgattacttcatggctgtcttcctcctctacactgaggacaacactgaaaggtcattccatatttacaactccttgtgaggctggcccaggcttcctttgaaccagtttcatattttggcattgtcccctgctcaatcctgctatcttcacttctttccatggtgttaatcctaagtgtactccctaaagcaaactatgcattctaatctctgtctcagaatcatcttcctagggaacccaacttgtgccatggtactcccaacatagggaggaattgtattgtttttttccaattgtgtatattctcagtctatcatagtccctggcaccaggaggatgtcagcagatagctgtgaaatgaatgaacaaatgaatcaatgaatcaatggtggtagtatcattggtaatttctgttttatgccccacccttctcctttctttaaaggcaatgtaacccctacacgggaatttcttgggtttctgcccagggatctattttactcctcttcatttccttcccttttcccttttacagcccctttttctcctacccctcccttttgtaaaatctctgcctagcaatagctcttagctgtagctaaggagtgaggaggaagcccaaggaaagtggctgagagacaaagacggaaaacagctaaattagtttagaggccaattcaggaactccggcacttctttctatcagagcctgtgtggagccctgcaagaaagggcaatgccaaggaacagaggaagccaatatctgaaggctctgctcattgcatggctttccgaaggtattttctccttttgaatgagaataaagagccttttaaaacaacaaagcttctgtataaatagaaaaaagggagaactcacattttcagtccatatgaaaaatagcctcttcgttagtaatttctcatcctcatgtacagcctactgcggtcaatgctttatttctgcagccctgttttttgtttttatggtcctttttttctttttctttttgctccttccgcccctcccagaaaaaaaaaccaaaaacaaaaacaaacaaacaagcaaaaaaacagattcaagctagaagacttgagtttgagacctagttctaccactttagtagctgcatactgtctccgagccttagttctttatctgaaggtgggcatttgttaaccagctcacagagacgggctactgagaagctcaaatgaaacaacggatgtgaacaagctttaagaattgtgacactctaaagagaaattgtcattgccacttaatttttagtgaaacggaacagcatgctgaatatagttaacaattgagtactctggctttcaatattggttaagaaagtaactttctaatgttctcatcacaaaaatgttaaatattggtggcaataatatattaattagcttaatttaatcactccacactgtagtcaaaatcataacaccactttgtaccccatcaacatatactactatagcgtgtcaataggcaataaaaaaataaaaagaaatttaaagctggtaccctcccaaaaaagaatagaacacacttcaaagccaagtataaaaggttttttaattattcctcattttgcatgatgtttggcaaaggtccttgttagcccacatgattaggaatccactttacttggaatggactgagaatgtcaaacttctaggttaaccagccattttttttttttcattgattcattgatacatgacagacttggaagccactcgctctctcaaccagggttttgggttgatcaagtagatgttattgtcacagctcaatgaatacttcttatttctcatctgcctaaggcagccctggtgttcaaacatatccttgtttttcctccaaacacacgatgctctgagaatttacaccattaggaataatctcctaccctcaactctgggtgtatagggattcaagatttcctttgtatatagcaattttccttctttctttctttctttctttctttctttctttctttctttctttctttctttcttcctttctttcccttccttccttccttccttccttccttccttccttccttccttccttcctttccttccttccttccttccttccttccttccttccttccttccttccttccttccttccttctttctttctttctttctttctttctttctttctttctttctttctttctttctttctttctttctttctttctttctttctttctttcttttgatggagtctggctctaatgcccaggctggagtgcagtggtgtgatctcagcccactgctacctctgcctcctgggttcaagcgattctcctgcctcagaccccgagcagctggcattacaggcgcctgccaccatgcctggcaaatctttctattttagtagggatggggtttcaccatgttggctaggctggtcttgaactcccgacctcaggtgatccatccgcctcggcctcccaaagtgttgggattacaggcatgagccacagcgcccggcgccttgtatgtagcaattttctatttaaaaaaaaaaaaaaaagacagactgataagggtcattgagcagccggcaaaggatcctagggagaaattgtcattgccacttaattttccaggccctgtttgggatctccttctttgggatgacttctctgaatctctccttatctcctcatgccttaaccctctcccccactgggataggtgccccttttctgagctgccttatcatcctgcctctgcccttgcttgacattctgaattgttcatcagtgatctacttgtctgcacccacctcaagactgttgttttagagagcaaggactttttttggttcattgttcattcccagagtctagtacagctcttgagatgtaagaattacatcataattgttggttgagtttatcaatgaatagatgcttcagattccatccgtttctctccactggcaccaatctctctggcttgttttcctgtgacattcctgggcagggatcctgcagagtagatagaaaaggcctgtgtctatcatggaacttgtccctcccaattggcttgtacaggcagttatgtcactacagatcctcattttaattggattaaggtattctcctctgagaagtgaaaacagcatataatttacaagggatattaggtggagttataaagtgtgaaagtatttgttctgttttgtttgagacagagtctcgatctgtcacccaggctggagtgcagtggcaccatgtcatctcactacaacctccacctcctgggttcaagcgattcttatgcctcaacctctgaagtagctggaattacaggcatgagccaccatgttcagctaatttttgtatttttagtagagacagggtttcaccatgttgaccaggctggtctcaaactcctgccttcaagtgatcctcccgcctcggcctcccaaagtgttgggattacaggtgtaagccactgagcctggcctagagtgtgaaagtagaaaggaccttagaggttacaggatccatccctcttattttacagataaaccaggctcagaggtggaaagatttgtccaagctctcatgattaattcatggctaaggaagatatccattgctttagcctgcctcaggccctgtggggaatcagcccttcccactcttggtcctagcattttggctggtgctgactttactcccaaatccaggatgagcatgagaactaggcctcttcaatcagagcaccaggacttatgttcccagaaggccaatcaaagccagtgagacatgatttcaggacattggaaagagaagtttatgtgctccattggggttgctgagaggatgagattcaagcttgagactgtagacagccatcttgtcaccagaggcagacagccaagggaagcagtaccaagagatggagagaatgaaatccagttttcttggtttggcactgaggtctctcataatgacatcattggagaccctgatacaaccatgcctgacctctgatctctgtaggagctaattaattactggggtttctgtttatttcttgctcagtcaagtttctgtcactttccactagttagcctaaagaattcaacattagacctagaagcaggcttcttaactttcaaatgctgtcctctttccaccaaaccacatcgggcattcctctgattaacccaataccacccactgtcacataacagagagcagaattaggcaggaatgggagacaatgggctgcatttcaatgggcgggggtatgtgtgcatccagtgacgtgctccggggacaagtgggaggcatgaggccatggggtaatgaaagggttacatcaaaacaaactttggctgcttccctgttttaaccctggcagtctaatgaataagaattggcgggcaggagatggggaagtacatgtgactagaagctgattcagctggatgtttcttctcgattaatgaaaaaaccttttggtctggacctggcaaaaccaaaagtcaaggcatcactgttttattgttaacctctcatgactcacctaaggcatgggaatatacaaggctacagaagagtcacagccttaatcaacaaacattatgcaaacccagtactaccgaggtggctgtgctgggccgtgtccattgatggggatcaggcaaacaattatatcactgtgatatgctaagcagactgtcttatgctttggggataacctggttgcaagcctctgagatcagttcttcattaccaggtgcaataagcaggaacagaaattgtgggcctgttcctggtgggaatcccatactaaccacatcccagggtgggatttttagcaatctgctttctcctgatttccccctcttctcaggtactgataaatttcaacaaccagctaaactaaactagggtgtgggagtagtgacttggagaggacaggagaggggttcctggagtcttggtgatgttgagttcctaaactgtgctgcttctatggagatgttcagtttgtgaaaatttattgaactatgcacctatgaatgttgtatttcctctaagtatattatgtctgaataaaaacaccacagtatgttaaatgctgttattgtaggcaattatttggcactgtggaggtcttagaaataaaattaaatggggccactgaaattatgtgataatactcttccactctaaagtggccatacagatactccacatatttatatttacttcaaaatatgtaataatcaaaatgaacatataaatgtaaaaaaaaaaaatagagttttcacaatcttccaggagcctaggatactggttgggaaagactgaagtattgttatagttcagaatcacagtgcaagttgacctcaaatccatttacatctctccacttccactgccatcactctagatcatgccactagtaactccggcctggacaggagcagtaccctccactcttgcctgatgtgtaatcctttgtctactgatatggtctggatctgtgtccccacccaaatctcacgtcaaattataatccccagtgttggaaatgggatctggtggaagatgattggatcatgggggcagtttctcatgaatgatttagcactaaccccctagtgctgatgttgtgatagagttctcatgagatctggttgttcaaagtgtgtggcacctcccactctctcttccgcctgctctggccatgtaagatgtgcctgcttaccctttgccttccgccatgattgtaagtttcctgaggcctccccagaagctgatgccaccatgcttcctgtacagcctgcaggactgtgagccaatgaaacctcttttctttataaattacccagtctcaggtatttttctttatagcagtgtgagaatgcactaagacaccaacccagtagaaaatcagaagatgatagtttttaaatatggctcaaattactctcctttcccccaggcctcccacccaagcccttcgaagacttcctgacactcttaaagtccaaatccttctccatggctcactgtgtccatccttgaccagtccccacctgcctctctgaccagctgcccaccacccttccccagctcaccagtctcagccccactggcctcttttcattctcccaacaccacatgcctgtcctagccttagggcttttacatgtatgcctctactgcctaaaatagaagtctcccagatctttggattgctggctccctctgattccttaggtcccagctcaaatatcattccctcgagtagcccctctcagccattctatgtcattgtctcactactttactttattttcttcactgtatccaaagctattatgttaatatggttgtttaccagaacataagccccataagggcaaggatgttgtctaccttgtttatggtttgtatcagtcagggtaccagcaaggcgtctcactatgttgcccaggttgtacttgaactcctgggctaaagtgatcctcccactcagcctctagagtagctgggcctgcaggcacacaccagcacacccagtgagatggcattcttaaaggagtttaactgaagggaatttgagaaaggaaccaggtacagaaacgtgggcagggttaagagaacacatgatgcggcacccagggcctaccactgtggaaagctatccccaccggtagaactgaaggggcaagagtgcagagctgtgtttggagatggtaagagcggaggctatgggagaggagctacccaccacagccatggcaacgcaggggacaagcggtgactgggtaagttgccccgcttcttcctcctcccaccttcagatttcctgccattatttcctggccaagcccaactggaagccagagagcaagagagccttacacagtccataggggtcagactctggggccccagaacagggcaggaagggtggggcacagggcaggatcggagcaaacagagcctagccaaccctacattgcttgctacataggtgctcccacatgctgattaaatgaatggttgatcgaatgaatgaataaatgaacaacaaagaaagctgaagagaaagacaaagggatatccacaggaattaacatttaggaagctcctagtgggtgccatgtgggcatcatatataaataatcttgtttaatccacacaggaatcctatgagataccttactgtccctgtatatggctgatgatcctgagaccttagaggttaccataccctattaaagagaaatcatggagccaggattccaactgaggttccaagtgtttttcccttgcattacactaaacatatattgcatgtttccatacttgcatcagcctggaacctgcatccctcccattcctgcctggaatgctctatagcctgcctaaatcccagttaacttctggttcagctcatgctcctcctcttcacagcctgccctggatcaccacagccaaaggtaatctttctctcttctggatattatagcaactgttatatatcttcacgtttcaattgccatctatttcttcataatctaattatttgagagcttctcatctcctcaactatattgaaatatcttggaattggaaatttttgtgttttcttttgtctattactttgtatccttattgcaggtaatcaataaatatttgctggtttacttacctgtcttatataactcattttcaatgtctttttttgtttaagaaaaaaaatcacttaaatgatacatttttacatatactgtataaacaacttgtatcattttctcatttaatattggatcataagtattttttattacacataatttgtaaacaatgttttgatggtagtctaatagtcaattctatggctgtaccaaaatttaaatcattttctattgtggacattcgggtggatggcatcccccatcgcctcaatatcaatgttgtcctgaagagtttggagctacatttcttttctttttttctcttttttttttgagatggagtcttgctgtgttgccccaggctggagtgcagtggcacgatctcgactcactgcaacctccacctgccaggttcaagcaatcctcctgcctcagccccccagtagctgggattacaggcatgcaccaccatgcctggctaatttttgtattttagtagagtcagggttttgccatgttggccaggctggtctcaaactcctgacctcaggtgatccacccgcctcagtctcccaaagtgctgggattacaggcatgagccaccatgcctggcctggagcgacatttattcctatggaatcaatttccttcactaagctcttttttagggaatgcttagtgaagatttgattaaacactacaattgttaactacaccagataagtttaactttgacactctattttgtaattcatcttgtaatggaagagtcaaaataacagtgtctcctggtatatgcagatagatggatacctttgggaagcccactcattcatctatccattcgtccagccatatccatctatccaagtctgcactacttgggagcccaggtgaggagagctgcagtcatgatgggaggttggtggtcttctctgaagatgtaacatttcaccatcttcagtgcaactcttgtcctttggcgaccaagagctgagcatatacgtcctcgtgactgttccaactcctagtcaagactatatagattccatgtatcattatactgatcacctatctagacatcacagtagtttttgagatacctaattgaaatgacaacttttgttagtatttaaaataccaaactgtctttctttagcatcagaaaatccccagttctgtttctgaagttgcctcaaagcacctgaggggatgttgggaagggaaattacacagactgtctatcatggatcagaagcttgtactgcaagcataatgcattgattaagagaggtgaaatctgaatccagattgcctgggtctaggttcaaatccctgccccacttcttcatgactgtatgaccagaacaaggttacttaacttctctctctcctttttttgagacagagtctcactctatcacccaggcacagtggaacaatcatagctcactgcagcctcgaacggtcaggcttaagagatcctcctgccttagtctccccagtacctgggaccacaagcacacaccatcatgcccagctaattaaaaaaaaattttttttttgtagagatggagtctcactatgctgttcaggctggtcttgaacccctggcctcaagcaatcctcccaccttggccttccaaagtgagtgctaggactataagcatgagctgccatgcccagcctacttaacacctcttatccttactttctttatctgtaacatagaggtagtaattacacctccctcataaggttgttctgagacttaaatcagttaacatatgaacaccaaagtggtgaagcgagcagaatagtgcctgacacatattaagtgtgatgtgagtacttgctattattattactgatcttattttaaactcatttaatttagttcttacaacaactcttacttagattgaggctgaaaattgtcagcctgtaggttgaacttggcctgcagatatgttttgtttggcctgcacaattttctttagtttgagccaacatttaaaactctggagttttatacaaaaatcttgatttctggctcttcttgtaaaatccttatctgacagcaacccacaggagctgagggctgctgatttctttagataaggaatgcaccttggtagtgtgccctgattctgtggggatgatgtcagtggtgagtgatagaagacccaactaatagtcgcttcaactaagaatttatatctcaattaagaggtctgaggtagggtagttccaggtttcatacagaggcacaaaagtgttgtcggagactcttgctcctttactgttaatgtcttccacctgtcctctctgacatcattggcatgtcagctatgatgctgcactcatacctactgatgcctccaaaggctcacacatgtcacatgcagatacacgaccagtgaagaagagatgtctttttactggtctcttttccttataaaggaaacctttaaaacaaaacaaaaaaaccctagctgagtgtctcctgagctcacaattggccaagactggcttctatgccaatactctggttggaagaaagcctaggaaagctggtctcacacttcctgcccttaagtgggaaggcaggatgtgcctataagagggatgaggcaaggggtagtgaacaggccaagactgccaggcacatctcactcagaaatcgctcaagcacacacacccagcttcctccacctatttacctaactgagggcaactggataatggaatctgtatgtcaagttcaggattcagccctataaacttatggaaggtttgagccatgactagtttaggtggattttttaaaataaaaaaatcactttcagttcttaaaaaaggaatccattttaggttcaaagtagcatgataactttgctgtttagagtttgaaattcaacaaggatatttactcttgcctggataacctgcagcactgatagcatttggctctttgtccccacccaagtctcatctcgaattgtaacccccaaatgtcagggaagggcctggtgggaagcaattggatcatgggggcagcttctcccaggctggtctcgtgatagtgagggagttctcacgagatctgatggtttaagtgccaagaagttttcctcctctcactcactcctttctcctgctgccatgtaagacgtgccttgcttccccttcacctgcagccatgattataagtttcctgaggcctccctagccatgtggaactgtgaatcaattaaacctctttcctttataaattacccagtctcagggaagttctttttatttatttatttattatcattattttttaatttattattattatactttacgttttagggtacatgtgcacaatgtgcaggttagttacatatgtatacatgtgccatgctggtgtgctgcaccgggaagttctttatagcagtgtgaaaacggacttacacaagcaccaaccaatatttatggtgtctctgggtgaacatgtaagatgccatttaaaatgctgtatagagacatgggcactaccctctaggtactagctgtggtctaaatgcatcctctaaaattcacaagttgacatttaatcatgaatttttttttttttgagacagggtctcgctctgctgcccacgcaggagtgcaatcgcgatctcagctcactgcaacctccgcctcccgagctcaagcgattctcctgcctcagcctcccaaatagctgggattacaggcacacaccaccatgtccagctaatttttgtatttttagtaaagacagggttttgtcttgttggcccggctggtcttgaactcctgacctcaggtgatcacccacgtcagcctcccaaagtgctgggattacaggtgtgagccaccccacccagcctgagccactgcgcctggtcttaatcacgaatattaataggtggggtctttaggaggtaattaagtcatgagagtgaaagcctcatgaatgggattagccgccttgtaaaaggtctggaggaaactagtgtttgtcccttgttatccttccatcccttccaccacatgaggacacagaggtcaaggtgccatcttgaaagcaaagactaggccctcaccagacacgaaacctgccagcgctttgactttggacttcccagcttccagaactatgaaaaatacatttctggccaagcgcagtggctcacgcctgtaatcccagcactctgggaggccaaggcgggtggatcacgaggtcaagagattgagatcatcctgaccaacatggtgaaaccttgtctctacttaaaatacaaaaaattagccaggtgtggtggcaggcacctgtagtcccagctactagggaggctgaggcaggagaatcacttgaatccgggaggcggaggttgtagtgagccgagattgcaccactgcactcagcctggcaacagagagagactccatctaaaaaaaaaaaaaaatctattatgtgttaattaccagttcttaggtgttttgttatagcagcacaaacagactaagacaatactcatcacccaagtcactctggaaggcactgttttataagagcagaacagagtgtgatacatgaatgctgcaggcatcagaaattgctggaacccattaagttgctcccattaagttgggggcagggtaaaataagtagaagtacacagtatgccactgtgtgggcaaagttgtttctgatttcatactaaagatagaaccctaaaacaagacctaacaagaggtttctttgtggaaacaatcttcttgggttaatagctaaatatagtgactaatgcttcttcctgttctttctcgactataccttatgagctacctttagaacaagcaggttgaagccctgccttttactaatcccctgagataatctttttaaaactctcagtggcaagtgaagaccccagtgttttccccatctctgagatttctttcatatccctttagcattcgcatttgctcttactggttatttcccatgctgaatcattcactgactatctggtcatctcctgggggagccaaatagttttaaacattctcagtgactcatctatcctcaccagttcttttatttatttgttgttgatgtgtcatacacacacaatctctctctgtcattaaaatgctaaaaaaagtttctatttaccgtcatagtatactccactttctcagtgcatgtcttcacttgttttgtagttttctagttcatgcaattgaaataaaggtacagttacttagtctttaaccaagtcccaggtttagccaaaattgtcaaactcaggattcagcccttcaaagcttacgaatttattgagggccgggcgcggtggctcacatttgtaatctcagcactttgggaggcccaggcgagtggatcaccagaggtcaggagtttgagaccagcctggccaacatggtgaaacccagtctctactaaaaacacaaaaattagctgggtgtggtggcacgtgcctgtaatcttagctactcgggaggctgaggcaggagaattgcttgaacctgggaggcggaggttgcaatgagctgagatcacgccactgcactccagcctgggcaacagggtgagaccatctcaaaaaaaaaaaaaaaaaaaaagagaattacttggtgaaaataattccatatcattactattttgtaaaagggaaactgctctcttagcacattgtgttgtttgctttgctaccttcagttgctctgcgtcagaaccctgtatctgaaatccctcaataatgagactaactgaggtagtggtgatactctatcttgttattttaaagcaggcctgcaaatactgggtgctcagtaaccatgagaaaaaggcctgataaaagcaacaacagaagcaattgggacccaaggtggacaccacggcaaatcctcagcgcctgggttttagacggttctgccaaaggtttggttctttccagcctgagatcattgcttagatctttctggggtgtagttaaagtaaaatgagcctctttctatttatcccacagatgccgttctctcttaacaatgtactccttgaaggcttcttaaggtaatgtctggtctctgctgaatgcagccataaatgcaatagaacgctacctttgctgaatgtgctcagtcctccccccttagcacagctcaccctactagccttatcttgctggcctccctctacccccactgcaacctcccaacaggctttaaaatccagacatacctaacgaatcacacaattaccaagcaggtcaggatactttacatcagagcctctgaacatactgttctcttcccagaatgcccttctccacctcatccacctggagaacccctacgtatccttcaagactcaactcaagctttttttgttttaacccccctacagccttcttacctttccaaatagcaccagaacttttcatccaccactgtaccttgtatgcaactgtgttacagcactctctaaaccttcatgtcatctgccttactttttgaggtttatgagaggagtgatatggtttggatgtttatcccctccaaatctcatgttgaaatgtgattcccaatgttggaggtggggcctgatgggaggcaattggatcatgagggcgtatccttcattaagcggttagcacatcttcttggtgataagtaagttcttattctgagttcacacagggtctggttgtttaaaaaagtgtggcacaacaccctcaccttgctcccacttgaccttccatcatgactgtaagcttcctgaggccctcactagaagctgagcagatgttggtgccatgcttgttgatatagtttgaatatatgtccccaccaaatctcatgttgaatggtaatctccaatgttggagatgaggtctggtgggaggtgtttgggtcatggggtggatccctcatggtttgcggctgcactggtgatagtgagttctcacaagatcaggtcatttataaatgtgtggcacctccccagtcttgctcctcctcccgccttgtgagatgcctattcccctttgctttccaccatgattgtaggcttcttgaggcctcccctgaagctgatgctggcactatgattcctgtacagcctgcagaactgtgagccaactaaacctcatttctttataaattacccagtctcaggtattcctttatagtaatgcgagaatggcctaacacaaggagggacttacattattttctgaatctcagtgcttatctcctggaaagtgtttacaaagtatttgttgaatgagtaaataattattttgaaatatttataactctctgataacataacattatatggtaatagagaatttaggaaatgcagaactatacaaagaagaactaaaaaccatctgtaatctctggttaatggtaattaaccaaagttaattattattcaataattttctctgtagatttttttctatatttttaaaataacagctttattgagatatactttacataccatacaagtcacccatttaaagtatacaattcaatgatttttagtatttcatagacttgtataaccataataataagttttataacattttcatcaccccaagaagtaacctcatatccattaggagtcattcgatttccctctaactctaacctcctcccatccctaggcaatcacttacctatttttgcctctaaagatttgcctattctggacatttcataataaatgaaaccatacaatacacagcctttcgtatctggcttctttcacttagaataatattttcaagtttcattcatattataggatgtattagttagcacttcattcctttttatggccaatagtattccatggcattaatataccacattttatttatatggtcatcagttgatggacatttgggttgtttctacctttttggctattgtgtataatgctgctatgaagatttgtgtacaagtttttatatggacatatgtgtttgtttttctcttaagtacatgcctaggaatagaatttctgggtcaaatggtaactctatgtttaaccttttggggaaacttctagacttttttctttcaaagatgctgcaccattttacattcccattaacagtgtaccagtgttattctagattctccacatccttgtccgcacttattattagctatcttttttatgtggcatctcattgtggctttgatttgcattttcttgatagacaattatgttaagtatctttccatgtatttattggccatttatgtatcttcctgggaagatcattcaagtccttggcaatttttagttgggttattagtcttttaaattattgagttgtaggcattctttatacattgtagttacaattcctttataagatatgtgatttgtaaatattatctcttattctgcgggctggctgtctttccactttcttgatggtgtactttgaagcacagaagtttttaattttggtgaagttcagtgtatctatttttccttttgttgctgtgcttttcatgttagatctaagaagccattgcttaactgaaagtcagaaagatttcacctatcttttctgagagtttcacctatcttttcttctaagagttttatagttttagctcatacatttaagatgtctttgatctagtttgatttaatttttgtagatggtgtgagataggggtcctactttattcagtaggctatccaattgttccagtaccatctgttggataaattattctcccccaactgaattgttttgacactcttgtcaaaaatcaattgactgtaagtatggtttacttctaactctgaattacatgctgttgatctatatgtctatcctggagccaataccacactatcttgattattgtagctttcttgtgagttttgtagttggcaagtatgaatcctcaacttcattcttctatttcaagattggattatttttgggactgttgaattttcatatgaattttgagattagcttgtcaacttctgcaaaaaggccagctgtgattttgaaaggaatgacattgaatttgtggatcaatctggggagtattgctagcctaacaatattaagtttttaatcaatttccatttatttaggtcattttcagtttcttttgtacgttgggctttcattttcatttgcctcaaaacattttctaatttcctttgtgattttttctctgattcatttgttatttaaaaatctgttgtttaatttccacatatttgtggatttctaatttaataccattgtggtcagagaatattctttgcataatttcaaaccttttattggataaagcaaatacggtatatatacaccatggaatactacagagccattaaaaagagaatgaaatcatgccctttgttgcagcatgaatgcaactggaggcgattatctttttttttgagatggagtctcactctgtcacccaggctggagtgcaatggcgccatctctgctctgcaacctctacctcccgggttcaagtggttctcctgcctcagcctcctgagaagctgggattataggcacgcaccactactcctggctaatttttatatttttagtagagatggggtttcaccctgttggtcaggctggtcttgaactcttgaccttgtgatctgcccacctgggcctcccaaagtgctgggattacaggcatgagccaccatgcccagccgaagccattatcttaagcaaattcacccagaaacagaaaaccaaatgctgcatgctctcatttataagtgagggctaaacattgagtacacatggacataaagacgtgaacaatagacatgagggggctactagatgggagagggaggagaggaatggggcatcagttgaaaaactacctattggatactatgctcactacctgggtgatgggattagtcagatcccaaacctcagcatcatgtaatatacccatgtaacaaacctgcacatgaatcctctgaatctaaaaaataaaagttgaaaaaaattttcaatctttttagaatttattgagatgagtagggctggccgggcaagttggcttacgcttatgttcccagaactttgggaggctgaggcggatggattacttgaggccaagagttcaagaccagcctgggcaacatggtgaaaccccgtctctactaaaaatacaaaaatcagccaggtgtggtggcacttgcctgtagtctcagctacatggaaggctgtggcaggagaattgcttgaacccgggaggcagaagttgcagtgagctgagattgtgccactgcactccaacctgggtgacagagtgagaccctgtctcaacaacaacaaaaaaagaaaaagaatagggctaataccacatcatgcatcctggaaaatgttctctgcacattagaaaacaatatgtattctgctgttgtttagtaaaatgttttataggtatctgttaagtctagttggtttatagtgttgttcaagtcttccttttttgttgttgatcttctgcctaattctattaattattgaaagtaggatattgaagtctctagctattattgttgaattgtctatttcttcatttagttctgttatttttcacatgatatgttttggaactccattgttaagtgcagagatatgtttataattgttatatctccctgattgattgaccttgttatcattgtaaaatgtccctctttatttctagaaccatttcttaaaaatctatgttgtctgaaattagtattgccacttcagctttcttatgactgctgtttgcatggtatatctttttctaccctttaactttcaacctatttgaatatttaaatctaaagtgtgtctcttatagacagcatgtaatcctgtttttagcatagtggcaatttttgccttttgactaccttgtttaattcattcacatttactgtcattattgatgtaattgcatttatatctgccattttggtttttgtgttttctgcctcttgtctttgttcctctattctcctttgctgctttctgttgcattaagtgattatttcctagcgtaacattttaattccttgaatgattttttttgcagtgcatttttgaggtgttttcttagtggttgctgtaggtgttcccatatatatcttagcttatcggaattaacttcagatttatactaaattaattatagtaacatatagaaactttattcctacatagccctattttctccttcctttttttggtgccattgttgttacatatataatatgtgtatataatagaaatccaacagtatgttattataattattacttcatatcattttatgtcttttaaagaagagaagaaaagaaagcaagtagatatttatagagtctgttatactaaccttatttaccttttctggttctcttcatttactcctttagatatgagctactctctggtgttacttacttactccaatatgattttgctaccatctacttcctttgtgttgttattgccaaatatattacattactttatgttgtgggcctaacaatacaattatatatatatattattttatacaattgcttttataaaaaagaagaaagggaaagaaatatgtgtttcaattttctcttataatcacctacataattacctttattgatgctcttcggtttttctgtgtagaatcaaagtattctctgggatcacttgcttttagtgaaaacaactttccttaatgtttctggtagagtgtgcctatattttttgcattgaatctttgtgtgtttcacataacaatccaccctgtcatttcctgtcaattcttcattcaaagcacaacttactatgtctacgtgaaatgctgtgaccagcatgtatgtaactattctcctaaggggttgtttttaacctttaatcactgcaaatgatgctatcataaacatctttgcatatacatcctttataaaactttttaaaagtatacaagtgatatggtttggctctgtatccccacccaaatctcatctctaattgtaatcctcacgtgtcgagggcggcacctggtgggaggtgattggatcatggggggcagtttgccccgtgctgttctcatgatagtaagtgagttctcatgagatctgatggttttaaaagtggcatttccccctttgctatctctctcctgccacgttgtgaagaaggtgtctgcttcctcttcaccttctgccatgattgtaagtttcctaaggcctccctagccatgcagaactgtgatgcaattaaacctcttttgttactaaattacccagtttcagcagctctttatagcagtgtgaaaatggactaatatacaaaattggtaccaggagtggggttggagaccccatacagagtccctactggggcactgcctagtggagctgtaagaagagggccactggccttcagaccccagaatggtagatccactgacagctagcaccatgtgcttgaaaaagccacaggcactcaatacctgcccttgaaagcatctgtgggggctgtaccctgcagagccacaggggcggagttgcccaaggccttgagagcccacctcttgcatcagtgtgccctgaatgtgagacatggagtcaaaggagatcattttggagctttaagatttaatgactgccctctgggttttggacttgcatagggcctgtggcccctttgttttcgtcaatttctcccatttggaatgggaacatttgcccaatgcctgtacccccattgtatctttgaagtaactaacttgttttttgttttaggctcataggtggaagagacttgccttgtctcagatgagactttggacttggacttttgggttaatgctggaatgagttaagactttgggggactgttgggaaggcatgattagctttgaaatgtgaaaaggacatgagatttgggaggggccaggggcagaatgatatggtttggctctgtgtcctcacccaaatctcatctcaaattgtaatccccacatgttgagggagggacctggtgggaggtgattgaatcatggaagtggtttcccccatgctgtccacatggtagtgagtgagttctcacaagatctgattgttttaaaagtggcacttccagctgagcacagtggctaatgcctgtaatcccagcactttgggaggctgaggcaggcggatcacttgaggttgggagttcgagaccagcctggccaacatggagaaaccccgtgtctactaaaaacacaaaattagccgggcggggtggcgggcgcctgtagtcgcagctactcaggaggcagaggcaggagaattgcttgaacccgggaggtggaggttgcggtgagccaagatcgcaccattgcactccagcctgggaaacaagagtgaaactccttctaaaaaaaataaacaaataaaaataaaaatggcacttctccctttgctctgtctcctgccaccttgcgaagaaggtgccttcttctttacagcagtgtaaaaccagactaatacaacaagtagtctgagaatatatttatatgtaaaaccattcagacaacaaaatttccctccaaatctgctcttcctggacatccccatctccttcccaaacataatcatgcttatgggcttagtgtgtgcacctttttttatgtttgtctatgcatttacacatacacagagagatgaagaggaacagggatgatatggtttgtttttctgtccccacccaaatacccaggtgttgagggagggtcctagtgggaggtgactagatcatgggggtagtttcccccatgctgttctcatgatagtgagggagttctcatgagatctgatggttttataaatggcagtttcccctgggcttctctctctctcctgctgccttgtgaagaaggtgtctgcttctccttcaccttctgccatgattataagtttcctgtggcctccccagccatgaagaactgtgagttaattaaagctctgttctttatacattactcagtgttggcagttctttacagcagtgtgagaacaggctaatacaagggagaaggttttatatttgttgtttgttttggttctggttttagttttacatcaatgggatcagcttgtacatcctctttttcaccttgttttcttcatttaacaggtctaggatatctttctaagtcataattggaactcctttttattttttagctaccacatagaattccagagtcagttaacaaatacttgttgatccttactaatgtagcaggtcctggggattcagagactatgttctcatggaggtcgactattcatcacagtatgaacgtatcaaatttaacattcttattttgatgaatgcgtaggtttttctccaaggatagatgcttagatgaggaattactgagtcagaagtctcttgacaagtagtatgaaattgctttccaggaagtagaaccagtttatattcccaagaggagtgtatgggagtgctggcttgctaatttggtagaggggaaatttcagttttgattgcatttgttatactactactgaaattgaatattttttcatgtttattaaccagttttattttctctgtgggctgttaaaaacttttttctcttgttcaacttttaataatattaatatttttgtgttttcttgtttatttgcataaacccatgtattgactgtattttcttcttttgtagtttttgttgcaaatattctttcctattgcttttttacatctcatgttttgtgactttttgatagacaaaaagatttttttaaagatttcctttttaaagtcatttttctccttttttatttcttttattatctttgtgctttcaaaatccttgcccaaattgataagataatctgtttacttagctattggtttcatttttagcatcaaactttttaacagacttgaaaaaaaaaattgtaaagagtaaagaaagatttaactttacttttattcccaaaattgtgctcacacagaatactgaatgtcccttcctttgcctattgtatctgatgccatgggattctgtcctccttcatccatgtgaggcccttctctttacttacattttttacttccatcactgatcccactcccattctatatgatctatagacacccattttagtgtatttgctctagatccttgaataatgtatgcatccttctaaaatgtacctaaaatacacattcaatggtaaaatcccacaaatcattctgtttcttacttgatgagtcttactattaatagtgttatgtctattttgttcatctttccaaataatcaatttttggtttattagtattttttatttattttctggagctatctttattatttctttccttcatatttcaccagatggattagactttttccccagtttcacaaattcagagtttagcttattttattttgatttcttgttttctaacaaatgtatttaaagctataaactattgttttggttctgctttaattgtgtttcatactgtctttttttttttgagacaggatttcactctgttgtactttctttcatgtagcatgttcaatgtggttcaattctaagcacatttaatgctgctgaatttctgctctaacccaagagttactttagtagaatatattttgattttcagacataaggaataattttaatatccttttgtcaatgacttttaattttattagaacatgattggatgttaactcgaaaataaaattattaaatttattaaaattattaaattttattttgggattaatttttataagggttctatatttggttggaaagaatgttatatttattaaagtttactttgtggtttttaaaatgagaaaattctatatttgcttggaaataattggtttatatttaactttattcattgttttttcaaatgatccatacatttgtttttgtttttatctgcttgatctatcagtttctttttttttttaactctgatatcaagaatcagtccaatgatctattggtttctgaaaataatatgtgaaatattcaacaattgtaccttctgtttcttcccatagttctcccagctttatttaatggagagatgctcatgtcattatgttttatcgaagttagtctctttttctttccttttttctttgtttcttttttgagatgtagtctcactctgtcacctaggctggagtgcagtggcgcaatctcggctcactgcaacctccgcctcctgggttcaagcaattctcctgcctcagcctcccgagtagctgggactacaggtgcacgccgccatgcccggataattttttgtatttttagtagtgacggggtttcaccatgttggtcaggctggtctcgaattcctgacctcgtgatccacccgactcggtctcccaaagtgctgggattacaggcgtgagccgccgtgctcggcctattattttattgttccgggtatgatatggcagactcccagctcagtaatttgtttctcaggtgtattccttgagatatttatcttaattactgagttattttatttcaactatcatgtcttttgtaatcaggttttccacttggttcttccttattctgttagttcttatttcattttgccaatattgtctcttatttgtttgaagatttttatgcttatttagcatttgttatttacctactacattcattctgtggcttttctttttgtcctatttccttttatagtgatgctcttcacgtgtgtgggtttttgttttgttttttctctttgggcttcgatgcccctgggaacatcagcttctatagttggcaatgtgcactggggagtgatcagtacaccagggttgtggtgcagtcaggtcctggaagggagtggggctacaaccccccaaccccaggttgttaataaagattgggccgttatctctacctggaaggagaattgttcttttgtcctcttccattagtacataactacgtattatttgatcagataaactctcttctactttgacactcagaagtgactttctggacttacctgagaggacataaagtaaatcaattttaatgtgagctcataagagcgttcagcacaaggaacagcagacctaggagtttggaattggcacctcaggtgatgtagggggcaaccttgggaggaaggattctcagagaatccctcagtttctataatcattcattctgcatcttggcagagaggataactggatattgagaagagtggtgaaaatgcttacttgactctgacacttgatagctacaaccctctgaataagcatcttatttatgatcctcagtgttctcacctggaaactggggtcataatactcaccttagaatgttgttgttagaagtttatggaatactaatagagaggctatgagtttcaagcactgtgcctggtcctcaatagatgtttaataaattctagatccttccccaaaatattccccatcattttcctttctatcgtaaagttataaacataaggcaagagaatgaatgctattacttttcagcaaatgtgaatatctttacatttcatttttttttccatttatatctcagctgtgtttctttacgttattgctagtcaggaatgcaatttgcaattacatgggttcatgagttctgaaattcaagggaaacctatcttcacacatgccttcctctttcaccccatttctgtgcacttttgtccaagcctttttctttcctgaacactgtcattttgtcatgtactctggtcctaaaggataagcagatgaattgtagaggagtcccctttgtatcgaaacatttacagcttctattccaagagttaacgtggcgaattttcacaatctgtttgttgttctcattctttcaaccttcttttgcactttttgcaaaacagctgctattgttagtttttctgagtactcttgtgaacattgggagctgttctgttgtcaaaatctttgcagctggctcctggctagtattttgtaatccattctcaaaagtttaatagctcctagtttttcatgtcagctgtgtttcttgttttagagataattgtgagtaatggtcaaggcttagttgagccatccattccctttttccacatgtctttgaaaggcagacagttcagattcctaaggctgatagaaactgactaatccttttttgtttcctactatgattttcctcaaagatattgctatttacttcacttctgagcattgattcgtccttgaaatttgtgtggtttatccttttaatatatttgggtgttttcttagttgtcttctttttttctttctttgtgaatgattcttaaagagttctgggcatttgcatgtgtaccagacttttaaatttcatggaccagtgaaaaagaaaaaaaaaaagctgaggactgatggagtgttgccaacattttatttcaccatgaatataagagagaggaaaaaaaaagaacaccatcttctatcgtcttttcacaaaaggagatttaatatcaaaactgtgaaagaagaaatcttggaataaaggacagtcttttaagtgaaaggtataagggaaacttgctacattgtccttttttgttggggaccagtgaaaacctccacaaagatatttgggaaccgccacctcacgagctgtatccacaccctcttaacagtttgcttccagcactttgttgttcactttattctgtcaaggttattcctacctggcactttcccttctcgctccagtaacatttaaagacctttcccccggcaaaggctttgctgccacactggagagctttgatcatcaattctgttaggctggttgtcaaaggagctggtggtggaaaaagcccagcagaggtggctgctgttagctctgaggaaaccgagcagctgtttgctgtcgttccagggttatctcataatttattgtgcgcaaaggtggctttactgttctccttcatccttgtcctcatcacccaggctctgacaacccagtgcctttcatctgggtgccatgactcaaggtcttcaccatttgtcttgcttttcttcagggctttctgtaagttattcgtgtcagacactggagtgtcttccaatgtcaaacacaaaatgcagccctccatagagagaggagtcctactcttttggctttgattggatttctttctgagttccaaccaaaacctctgcaaaattgtgaagaagatgaagtgtgtggtgtgcctggactttcctctttgcacccttcatttcatttctatgtaccctttctcctgagagctggtggcttcacgctgtcattctctcttcctccagactgtaagtaatctaataaaatcactcacactaagaggttaggagtttaattctgtctctcccagcggctcttgcacacaatgaagtggaaagagagcccagcattagagtttgaaggatttaattccagccatggctctacttgctgttgcaggacttacacaattcacatcatttctctgggactctgtttctccttcagcaaaatgggaatgatagtaagatctacctcacaggtttgatgtaaaagttaaatgagattgtcataatgttttatcatctgaaagtgtttttttttttttttttttgcacatcactcctttattatactgatatggaaaaaggatttagtacagttatgctcagatgaacactggacccatgtggcagggtcaagcaactagaacatgattcagaaatcagtgaaagatacacttggacaggaccaagaggcatttcactgccatgaaacaaggcaggaagggattctaatacacacaccaggaagcactcctgcccctcagaggtcaaggagctgatcctatattggtatgaggaatggcttattttctgatgaccacatgtgggactatttcaaccgccacaagaaaccccagaagggttattgttttgtattatttatatatactatacttttttaataaaagtaaattaacacataacgaaattcaggattgatcccaacctagagccagatcctctggggtcagggaggaaacagttgtcacatcaccacgcaggttacattcgtcttccactggaatgactagagcccccaggcagtaggcagtggcctgactgcagaagagcagaggacagactccgctcatggggacagacaggctctgttgcttctcctcactggtcatggcttagcatggttcctccccaaagtccttagtaaacaaagcactcgcaaaaacccaagtcactacttttaaactctgttggataaggggagcttttccatagcttagactgagaacctgtgctctagaactgctattctgactagattgtatgaagggagtgggtgcaggcgacaaaatggctaaaatgaaaatgggagccactggtccccatctgcagctacaactcaagatgtctacagatgtggtcagtgtgacatgtgcaggtgggaggggcagagggacaagacgggcagggagggtgctcctggggacagtatcctccccgccggccttcacttcttggccttgccctgggcagccacagcttccatggctttgcgcaccgtctcttcatcccccagaaactgcatgggcttgataggcttcaagttcttgtccaattcatagacaatgggaataccagtcggcaggttcagctccatgatagcctcttcagagagaccctccagatgcttgacaatgccccggaggctgttgccatgggctgcaatcagtacacgtttcccctccttgatctggggaactatttcttcattccagaagggcagagctctggcaatagtatccttcagactctcacaggagggtagctgatcttctgtgaggtctgcatacctacgatccttactgatgttgctgtagaaaggatggtcgggctccatcggaggtggtgggacatcataggagcgcctccagatcttcacctgggcctcaccatgctttgcagcagtttctgctttattgagaccggttagacccccatagtgccgctcattgaggcgccaagtcctcaccactggcagccacatctgatcaatggcatctagcactgtccagagggtccggatcgctctcttctgcactgaggtgaagcagatgtcaaactcatagccagcatctcgtagcgcctgcccgccgcgcttcgcctcctcgtggcccgccgggctcaggtcggcgtcgtaccagccgctgaagcggttctccaggttccatgcgctctcgccgtgccggatcagcaccagtttgtaggcggccatggcggcgggctggggatgcggcaccgactgtgaaagtgttttgattatttgttagtccataaatactagaaactcacttgtgctagcttgagtaaggatattggatttgaccaattaagtgtcatacagcacaagatcaagaaggaacccaagacattatctttcccgtatgtagcagatccttccagggttcacaaatatctggttctttttacctttgtaggcacaaagtgaagttaaattttctagtcttctttgcatctagatagaactgttaccaaaccaaactgggttcgtttgcctgcatgcaatggaaagcgaaacactgaagcactgcatttttgcagcaaaaaggcttattgccagtgaactggcaaggagacaggaggaaatgctcaaatctgactccccaagctgagggctgggttgggtttcataagcatagtgtagtgaggtgtgatctgattggatcttacaatgcggtggtgccaggaggcatgatctgttgggattctgccatggagttacaccagggctcaatctgattagattctggatcctaccatgaaggaatccaagacgttccaagatgtctgcttcttgattcagtccttgcccctcagtgcaagcactttggttccacttgtggttgcacgcttggttcatctgggcatgctcagattacatgaccttcaaccttggggtgggggggtggtccatgggactaaaaaataactcacaactttgttacataggagttgaaccagattgatccagggcagttacagaactatgtgattgagttctggctaatggatagtggaaggaagtgaggtatgcctattccagcatacatcacaaaatgtctcttgtgatctttcacgttctctctcttcctcccctctcctggctgggatgatatcatggggctcttgaagccataagatgatggagacatgagatagaaggagcctgggtccctgagtcaccacttggaaagagctcacaggaaagctatctaaccagcatcatcagattcgaatttttgcatgaggaagaaataaacttgtattgtcttaagctactgagatttggggctgtttcttatagtgggtagtctaccttaatacatacactgtatctcaggtctgcttctccctgccccctgcatcttgctgcacaccactttctctgccttcttattcatcatggtggaaaaaaggcctccaggaacaacaaccaagttgacttctcttctattcagggaaacaggctgattgcaactaaaaacacttcatttatttcaaattcctttgagaagactgggttaggtccagctggtattggatgttgactgaaccaatcaacttgtagtgtctatgaggataggggaaggacaataccccagaaaaatggtggttggcagccatcctaaaatgtagttgacgctgtgctccatgcttgcagttaacatttttaaaaagaaacatggggagagtgaagacatacatttctttttatataccccaaaagaatgaatctctatggatgtcttttcagtgttcagttagtgatttacattttggggctgggtagcttttcccaattgctctcaaattatatagcttgaatgcaacaatattgcccatccagtgttggaaagcacagagttaggggctgcaggctctggcctgtggggcacactggacacaagaaccatgctaaaatatgcaggtaagtaaggggtaagaatcattatccatgcattggtacttaaagtgtggtgcagcaaagtccataaagtgaccttgacgtggtgctgcaagatgtggtggacaaaaattagagttcgattctctccaaagctgattctccatgtatgctttctcctctgcctgaaacacccttttcccttcaccagcagataatcctggctgacttcaggactcagctccagcacaccttctagaaatggcccactcccacttagggttaggccacctctcctttgtgctctgttataatacccaaatgtgattcagtttttaaaaataacattttttcccttcagttgcaaagggaaaaaatgttaatgctacaaactgaaaagtccaaatgagctcaaaaaagaaaataagagtctctcattattccactctctaggggagtatacgtacacacacacacacacacacacacgtaacatgcttctaaaaatttttgcttttgtacttttatctcttaacagtatgtcatgaagattttcccactcatttacaatatgatttatgaatatgtagtagcttatggaatctcataatttcttaaccaaattcatattgttggacatttatgactgtttctaatttttcattatagtaaatgaactccattcaagtctgtcctattcaagagaacagcctgattgcaactagatagacttgtatgtaaagttttgcatattttcttagttatttcttcaagataaaaacctaggattagattgctggatcaagaggtatataaacaaggcaggaaagcagagagtattcattactgtcttgggtccctttctaagaaagaagagaatctttctaggtaccccctctccctagcagatttccctttgtgtctcatggacagaattccatcacatgctgtatcagtctgttctcacgctgctaataaaaacatacccaaaactggataatttgtaaaggaaaaaggtttaattgactcacagttccacatggctggggaggcctcacgatcatggcagaaggcaaatgaggagcaaagtcaagtcttacatggcggcaggcaagagggcttgtgcaggggaactcccatttataaaaccgtcagagctcatgagacttattcactaccatgagaacagtatgagggaaaccacccccatggttcagttgtctccacctggccctgcacttgacacatggggattattataattcaaggtgagatttgggtggagacacagccaaaccatattacatgcatatgcagaaactaggtaccagcaagggtagtgagactatgatcagtttagaccatccagatatttcctataagattcaatacctcagaatttttttttctgttaattaggaagatttgggagtagctgtggtacaggaaccaagtccttttcatacttgctacagaataataaaatgtttaaaaatctgttctaagttaataggtaacagttccttcttgtcatctttgtttatattttattgattactggtagatgtgaacagtgtttcaaatatgtattggtcattgtatttcttctgtgatttactgagtcatattatacctatgcatcctttaaaaagtgactgttttatttttgaattctacggagcagcaaattatgtcagccatatagttagcacaaagtaaaagctcatcaggtgaataaacatgtatgtgcttgcacacagtttgctgtgtgttttgtagttataaataatagtagatgggagagtggttcctagtgcaattggcctacagagactaaaaagttgtggagaacagacttaaggtagtcctgaaacagaataagacatcaggcagtcacatctaaaattcagctttctgggccaggcacagtggctcacacctgtaattccaacacctttggagaagaccaagttgggtggatcacttgagtccagtaattcgagaccagcctgggcaacacggcaagaccctgtccctacaaaaaatacaaaaattagccaggcatggtggtgcacatctgtagtcccagctacttgggaggctgaggcggtgggatcccctgagtccagggaagttgaggttgcaatgagccgtgatcatgccactgcactccagactagacgacagagtgagaccctgtctcaaaagtaaaataaaacaaaacccgactttcttttctgttagtctaatgtattttttcactggctagcttttgaatcaattttacaatgatcacgacaatgtcatctttatttaagctgaaaaatctttgttgggttcggagaaaaaaaaatctatcactcaaaggaaaaacaagaacaataacaaaaactagacattaattatggaattgttgcctggctgtaatccttttgttagtgagtccttgcataattatcacccagtttaatgagtgtgaatttgcaggtaggagaaattatcatgatatcttaaggctaaaattacagtgctctagagagcaatggcgagaaacatcagtctattgccagaaacctaatatggtgagtcatcagtttgaatcctgaggtttatggagatggaataagcaggagggactcccagaaacttcttttgacaataggaggcttggcagttggtcttacaaacccaggagcttgaagttctaaatgaggaaagtacacaattttaaaatgtcatgataaaaaatgtaaaagaaatcttttttgtttagagattaaaaaaacaagatctaccttctatggagccttaagcaagtgaataaggtcttctttaaaatgtagctaatgacatacatcagcacagcgagaaatcagcattgcatccaggtaatgaataattatgtaccctacggtctatcaataaccaattatctggttatgctaacatacccaaccgtcatgtgcaagtagttatttagattttgtaataattgattattgaattgacttttacaataatttatctaattctaactgcttatgcttatgttttattttaccttaaagaatgaatgcatcaaatcactttcttttttaaaaaaataattaaaaattgaaatgacttttgcatgaaggatatgcagaccattcaaagactgtgtaattgatcagaagattctataattgtttgcaaaagctaaaattctccatcatcttgacgggagagcaatcaatagcaatgacaagctgatgagaattacaaagcacatatgtgttgaaattcacttactcttcaggcattcaggtatgtgaagagattatagaaacatgccgataagaaagaggccatacaattctgaccagtttcctccctgccaaatccacacgagtctctgaccaggggtagcatcccctagagcagaaaccctgccctgctcattctataaaatgatcacaggtagagaattaactttggactgatgttatagactgaatgttcatgtctcccccaaattcatatgttgaagtcttaacctccaatatgatggtatttggaggtgggtcctttgggtggtaattagggttagattagaacatgagggtagggccctcatgatgggatcagagtcctcataagaagaggaagagacaccagagctctctctgtgccatgtgaagatacagagagaccgcagccatctgcaagccaggaagggagctcccaccaggaactgaatcagctgacacctcaatcttggacttcaaaggctcatgaactgtgagaaataaatttctgttccagctggatgcagtggctcatgctgttaatcctagcactttgggaggcctaggtgggcagatcacctgaggttgggagttcaagaccagcctggccaacatggtgaaaccctgcatctactaaaaatacaaaaattagccaggtgtggtgatgcacacctgtagttccagctacttgggaggcagaggcaggagaatcgcttgaacctgggaggcagaggatgcagtgagctgagatcgcatcactgcactccagcctgggcaacagagtgagattgtcttaaaaaaaaaattctgttccataagccacccagcctatggtattttgttgtggcagcctgaggatttgatcaacaactgggtttatcaggggtattgtttcatgactgtacctttcttcatatgcatttccttcctcatttttatcagcaaccatcagcacacctcatcagcaattacagaatatgtaagttggcttcattactttattgaataagtattttttaggcatataataatgcagccatcctagacttaagctttgattaggatacaaagaggaatgagcaccagtcactgcaattgagatcctaacactttacacctgagtcataaataaataaatgatgtgggccacaaaagggtactgaactgaacaggacctgtgggaacccaaggagggagatttccagaagattccagcaaggtttccaagggaggtgatatttgagttttactaagtaataaaactgcatgtaaaagttaatgtcaacactttaaatgttatagaccataaattatgaaaaaattaagcatacagaaaatatagaaaatactctaatagactttcatgtatccaaatttaatataggtaagctttattttagatatctccctgaaatagttggaatgtttctcccctccaaatctcatgctgaaacctgttccccaatgttggaattagggcctagtggaagctaggttatgggggcagatccctcatgaatagcttggtgccctccctatggtaatgaatgcgttctcactctgttagtttacaagagctggttgtttaaaagaggctggcacctctcttgctccctctctcgccatgtaacatgtcatctccccctttgccttctgccatgattggaagcttcctgaggcttccccagaaacagatgctggcaccatgcttcttgtacagcctacaaaactgtgagccaaataaacgtcttttctttattaattatccggcctgtattcttttgtagcaatgcaagatggagtaatacactccccttcatttttttttaatttttagaaataaaatgcagtagttacagctgaagttccatctttcttccctttatcttttccttgtccagaggtaataactatcctgaaatggataggtatcactacacatattttagaatgcttactgtattggtaagtaatatgtatatataatattgttatatgttttatttttatttttttgaggcagagtctagctctgttgcccaggctggagtgcagtggcatgatctcagctcactgcaacctacatctcgccggttcaagccattctcgtgcctcaggctcccaagtagctgggattacaggcatgcgccaccatgcctgtctaatttttgtaaattatatgtattttgtaaatgcacatgatagtattcctctaaaacttgcattttcatgtagccatacatttttgagatgtgttcacatgtaaataggttattccttcacttttttttggaagggctatgaattagtaatgtaatgggcatttatacctagagaatgcttctttaagagcacaagggttatatatatatatatagtaattaattactgtatatatgtttgtgtatatatgtgtgtatgtatgtgtgtcatagatcataaatcatgaacaaattaaacatacacaattaagagcacaagggacatatacacacacatatatatatatacacacacacatacacacacacatatatatacactaattaattactatatatatatatcccttgtgctcttaaagaagtattctctaggtgcctagaaatggaatttttaaaccccattttaaagaaactctgtgactgcattttaattgtttcaagaaggtgttgttcctacctaggaaattgcttcatcatttgaatgcaaattgcaataggaaccttgtcagtaacaataataaaacaacacaatcattaattattggggcttcatatatgcctggcactgttacaagtggtgttataagtggtcatgcaattaatttacatgagttaattacaagaattaatgcaaaatgtacatttaatacacaatcatgtggatagtaccactgatcctctaattttactgggttggacaggagtccatcacactcataggcagggtggctgagaacagctaaagcaatggttctcagacaccaatgtgcatcattatcacgtggaagaattgttgaaacttctttgctgagtcccactcccagactttctgactcagtaggcctatggtggagctcaagaatatttctttcttttctttctttcttttttctttctttcttttttttttttttttttttttttgagacagagtcccgctctgtcatcaggctggagtgcagtgacacgatctcggctcactgcaacctctgcttcccagattcaagcgattctcctgcctcagcctcctgagtagctgggattacaagcacacaccaccacacctggctaatttttgtatttttagtagggacggagtttcaccatattggccaggatggtctcgatctcttgacctcgtgatctgcctgcctcggcctcccaaagtcctgggattacaggcgtgagccaccatgcccagctgaagaatgttaatttctaataaattcccaggtgaagctgatgctgctgacccaaggaccacactttgagaaccattgatctaaaccattccctcaggccccagcatcaatcaccacaaatctttaggcatgagcataatgaaatcaatcaatcttccctccctccctcccgctaccctgctccttttctctctctctctctctcattttttgcaaacatttatttcatgcttactagttgcacagtaccaaactgggtgctatgaaaaaaaaaatcaaatgataaatattgagtagtacatatgaagaaaatatttagcgatgctggcaattaatgaaaagttgctggcttcaagtggatttcactttatctgagaagacagtcacatgtgaaaaattaaataacaactgtgattaaatgacaaattaaagttatagaaataactcagacacatcataataatcctggctaatgagtatacaattcaacatttataagatgctatatttgtttttcttctaataagaatatcccagtagcattttcaagtagaaatgtaataatgtgtaggttcagacactttaacaaagatcaacttaatctggtttaaaacaaaataaaactgtctctcatgtgacagcctgaaggtagtgatccagggaggtccatatttcagcttctggaaagggaaaagggaaatgcaggtcatgccccccttttttatggatttacctaagaagtttcacacatgacttctgctcacatcccattggccagagctcaatcatatgaccacatctagatgcaaaggaggctgggaagtgtatcttagcttagtggccatgtccccagccagaacttgggcgttcccttatcaaagatggaaaaggagagtggatgttggggaacaactaccatctttgcctaagaattactgtccatttttatagatgtagaaaactgaaaacagagaatgtaaatgacttgcccttaattacataatcaataactggtggacttggagttgaagttctggcttttttgtttgttcatttttgtttgcttcgttttaagtccattggcctttcccttctattaaactcttcaagtgtaaagccattctattttaaacaatccataaaagaaaatgttggtttctgtgatggttaatattagatgtcaacttgattggattgaaggatgcttagatggctggcaaattgttgtttctgggtgtgtctgtgagggtgttgccagaggagactgacatttgagtcagtggactgggaggggaagacctaccctcaacgtagttaggcaccaggtaatcagctgctagtgcagctagagcaaagcaggtggaagacagtgggacaagctggcttgctgagtgttctggcttccttctttgtcctgtgctggatgcttccttccgctcctactgcccttggacatcagactccaggttcttcagtcttcggactcttagacttacacccatggtttgccagggctcctgggcctttggccacagactgaaggctgcactgttggctttgctgcttttgaggcttttggactcggaataagccactacaaccttctctcttccccagcttacagacagcctattgtaagatttcaccttataatcatgtgagccaattctccctaataaactcatacacacacacacacacgcacacaccctacttgttctgtccctctggagaaccctaatacagtttcctacgtactttttttttttacaatactcattgttaggaatatttttctggaagtaaattaagtttccgtttactgcaatttcaatccactctattttatttaaccaacaaaatagaacataaaatattaaagattcactgtccactttctgaccagacactaagctctcacttgactcgtacagaatctaagtgttcataacctccagcagacacaagtcatccattgatatgagaccaaggagactgaatctacttccccatttcaaacccattccaaataatgctttcttgtcaatatctcagactgtgccatcatgactgagatggtgtttttttgaacgttgatggtttgcagagcactgtaatagtttatgtgtgtgaaggtgaatgtgcaacatgaccaaacaaatcaaacatcactctccttccagctaagagttttcttatggggctaataaaagccacagctggccaagattaaaaagttactcataagaaggtagtttgagaaaaaagaaatgacaaactaggaaaataaaaagttatgagcttttgtagtatgaaaatagatttaattaagaatatttaggtcaggcacagtggctcatgcctgtaatcccagcactttgggaggctgaggtgggtggatcacttgaggtcaggagtttgagaccaacctggccaatatggtgaaaccccatctctactaaaaaaaaaaaacaaaaaacaaacaaaaaaaactaggtgagcgtggtggcacatgcctgtaatcccagctacttgggaggctgaggcaggagaattgcttgaacctgggaggcgaaggttgcagtgagctgagatctgccactacactccagcctgggtgacagagcaagactctgtctagaaagaagaagaagaagaagaaaaaaagaaagaaagaatagataatctgaaattgtgttacaaccagatttgaacccaataataattttcctaacaatgttggccaggctggtcttgaattcctggcctcaagtgatctgcctacctcagcctcccaaagtgctaggattacaggtgtaagccactgcacctggccccaatgatttttaaaaatacatttgggtcatttcccaaccaataggtcaacacgagttcagatgatttggtgaaggtattgactctttcaacctttaataaaaagtgttcaatgatagtcttattaagctaccacgaatgaaaataaaacataaaaatgagaaagaaattaggaaaacagtaacataaaactaaaaaaattattgatacaattgtgtgatattcatatatagtcattcatggatatattcaacattttcctggcccatacaagaattgcaacaggattcaccttattcttatgacattttacagtttaaaaagtttttcatataattattttatttgacatgaggatgaatcagatagatagcaactcaactcaggagattatggtggaatagaggatgtgagagtaatatgcaaataacggtaatatacagtcatacatcacataagcacattttggtaaatgatatgccacaaatatgacagtgatcgcataagattataatggaactgctctatacagatgtgccattaaaaatttttatactgtatttttactgtaccttttttatgtttagatatgtttagatacacaagtacttactaccgtgctacaattacctacaatattcagtacagtaacatactgtacagtttgtagcctaggagcaataggctataccatataacctaggtgtgcaggaggctatgcttgtatgatacactctatgatggtatcacctaatgatgaaatcacctaacgatgtttttctaagaatgtatctttgtcattaagtgatgcataattgtaatagaaaaagtggtgaatatcatcagggaagttgcaaggcaattccgagaagggagcaatggtttttcgttgaggaggagggagagagtgtgtctttgatacacaagtgatacttctatctgctatactctgttccaagcatcagcacccctcagcaggatgattgcaacagccgcttaactcgtctccatacatgcccttaactttactccactcctgccctttgatgttcttttctgttttgcaagggactggaaccctgaaaactacatttcccagactcccagctgttctctggttagattctgctagtaggaagcactggctggagattagaatatgctcttatttaattatctactctgaaagctaaccattggcattaggtgaggatctctgcctttatgagcttttcctaaacaaagctggacttcttaagcaaagcttacttttactatggcagagaaaacaacaacaacaacaacaaatggttaagctgaagtttgctttcaggtccctggcattcttttttagctttatcttactcttccatcaaacctcctcagttggcaactaatgctttacttttgcctacctgaagaaaaatagctcataaacatattgagtctagtaaggcccaggaaggggcagtgctagttcattcagagtctttgcatgcagtggaaaaggctgccttcttccattaagacaaagccctaggacaggctcacagtttggcaaggggagcacaggctgtattttgacctcctcctacctgcttagtcaggtgtctttgctcagtggacaatctgcagaactgtatatagctggtcaagacaatacctcagacctactcactggagttcaccactggggactttgttcctaccactgagatcttcccttaagaccattactggtgccatttcatagatgcccaaccatccatttccctacttattcattcattaattattaaggcagggtcttgctctgttgctcatgctggagtgcagtggtgtgatcatagctcactgtaaccccaaattcctggcctcaagtgatcttcccacctcagtctccaagtagctagaactacagacaatcaccatcacgcccagctaattttttaatttttttttttagacggagttttgctcttgttgcccaggatggagtgcaatggtgccatcttggctcattgcaacatccgcccccggggttcaagcgattctgcctcagcttcccaagtagctgggattataggcatgtgccaccacgcccagctaatttttgtatttttagtagagacggggtttctccatgttggtcaggctggtctcaaactcccaacctcaggtgatcttcccacctcggcctccaaaagtgctgggattacaggcatgagccactgtgcccagccttaatttttcaattcttttatagggacaggatcttgctatgttgccccagctggactcaaactcctggcctcaagcaatcctcctgcctcggcctcctaaagtgctggaattacagtcatgagccactgtgcccggcctcattaaatattattaaatgtctgctctgcacttggttctattccagactctggaaactagaagcagaccttaagatgatgacaacacagtgaccagagttagagtcaagctttccagagaagttaaccttcacacctagcaatgttggggaaatgggttctgtgttccaatttggaatggcagttttattctttccttactggggcctccattttcctttacccttgtcttcagggcttgccgtcagctgttaatggtgactgtcttggcttgaggttccattggactgggtctggagggctgacattcagagtagggagtttaggggatgggaaggtgatcttctggccatttgaaccctggggatatgcttttaatcctgacttgatgccctctctgctaccttacttttcttttgcatgccccggggcctcatggtttgcttcgttttccaccatctacagcttctgaatggtttttctctcccttccctgccctgtgaaggaacagaacatgagcttagagcatctctcttatccttctttcacttggtaagcagtcagctcttctgacacttctgagggacacatagaaggttcaaatgcccaccttcccatctgcttttcaggacaactacagataggcacgtaggatatgggggggtcttttgtcaaaaagaaaactgagggaagagaatccacaggtaagttcccataggttatctcccataaagcctcacaataagcaggctaagatggacattctcttcatttttcagcaagtgaagaaacctgcctggacctacagagctggacttgaacctgatctaactacattaccttacactctctcccctttagaaactgaagacctaagggagaaagcttcttacacagctggcacagcacactaaatcgtcacaaccctatgaggtacatatcactattagctcattttacagatgaggaaactgaggcactaaataattactttacttgcccacagtcacagggtttttaagtggtagaggagggattccaatctaggcagtcttcaaagcctggactattcaccattgtcttctgggcaaaagaaggtgcctcagccacattcctgaagtgttcctgtacccctgtttgtcttgaagtaatgttcgcctgggtcaggagccacttctgtaaagttaccagataactctgggctcctgggaacaagagaaaaagcaggctgtggtaagatttgggctctcagttgtccctggctttgctgtacagggactattatattagtcaaggttctccagagaaacagaaccaataggagagagagagagagagagagagagagagagagagagagagagagagagattatgggaattggctcacactattacggaggccaatacatcccataatctgctacctgcaagcaggagaaccaggagagctagtgatgggcctcccagtcaagtctgaaggcctgagaaccaggaggtcctatgtccaaggacaggagaaaacagatgttctggctcaaaaagagagtaaattcagcttcctttatccttttattctatttgggccctccatggattggatgatgcccaccaacattggtgaggaccatcttctttattcagtccactgattctaatgctcatctcatccagaaacaccctcccagacacacccagacataatgtttatcagctatctgggtaccctttagcctagtcaagttgacccataaaattaatcatcacaacttttccaggcaaccacccagttgtttgatgacagtttctcttaggcacatcagatgtaaaagccaaaaggctgggtccactacattatttgtggggcttaatgtaaaataaaaatgtaggtccccttattcaaaaagtaagaaaagagtgccaataaacatattaaaatataaggccatttcctgtctttctttaaattgcttgcaaaaaccttaccaaatctctttctattgtgcaattgtaaatgctagtataagagcatttcattcatatgtggaatcacagatattacacaatttgtattttgcggcccatacatgcacatgtgtcttgttcttattacaacagtggaattgttgcacaaaattaaactaactcaactgtttttattttgcttcttgatgtgcatacttgtttttgttgttgttgttgttgcttttgagacggagtctcactctgttgcccaggctggagtgcaatggcgcgatctcagctcactgcaacctccacttcctgggttcaaacaattcttccacctcagcctcccaagtagctgggattacaggcacccgccatcatgcccggctaatttttgtatttttgtagagatggggtttcaccatgttggtaatgctggtcttgaactcctgacctcaggtgatccgcccaccttggcctcccaaagtgctgggattacaggtgtgagccactgcgcctggccgctgtgcatacttttaccaacactgtggaagctggtggcttccataattcactatcttgtactcactttgagtcttgctgacttccgacagatcgtgggtttgaaattctgtgtgaatggatggcgagaaactgtgggcacatattaatatattatgcatatctcctctgctcacactcacactccattgtcccatcggatttcaattacaaaactcaagttcaaaggtaaagttattcagaatttcaagatggtgacagcagagcattacaccaagcaggaagccctttctagcctggggcccatgaagccagtcctgccaaaggggaccgaaaagatttcactggagctcaacctttcattttggtgggaatgcccaagccagatcagaattaggtgagccttgagcctctaactgaaatgcatgacattcctaattacacaattctaaaattcagagctgaaaagggcattatttagctatgggtttgtttgtgggtatttttttgtaacgaaacctacattttgaaacctaggaaaacacataaaatactgtaataaacatcatttcactccagaaccaatcattgttaacattttgcttcttttcttcatagttcttttttttttttttttttttttttgagttggagtctctctctgtcacctgagctggagtgcagtggtgcgatcttggctcactgcagcctctgcctcctgggttcaagcgattctcctgcctcaacctcttgagtagctgggactgcaagtgcgtggcaccacacctggctaatttttgtatttttcgtagagacggggttttgccatgttggccaggctggtctcaaactcctgatctctagtgatttgcccacttcagcctcccaaagtgctgggattacaggtgtgagccaccgtgcctggcccttttttatttaaataatagaactgagacattttaggtaaaactgaagcctccttcatcttccacccctaatcagattccacagttccttcaccagaggcagccactaccatgaatttggtgtatatttttccaggtcacttaaatactataatgctttacttgaatatacagtatccataaacaagacagatatttttgaatgtaagtttgtttcttttcttttaagttacatacagtggcatcttctagtacaaattgttctgtaacttgcttttattctcatgcaacattatatttttaagatctacctatcttaatatgtaggattagtttattcctatgaaatggttatagtgcattttatgaatatgccacattttatttacccgcttagcctggtggacatgtagttgtttccagttgttcactattataaacaatgctgcaatgaactttctttttttttttttttctttgagacagggtctcattctgttgcttagcctggagggcagtggtgcaatcatagctcactgcaagcagcctcaacctcctggactcaagggatccttgtgcctcagcctccaataggtgggactataagtgtgcaccactacaccgggctaattttgtgtatatgtgtgtgtgtgtgtgtgtgtgtgtagatgacgtcttgctatgttgcccaggctggtctcaaactcctggcctcaagtgatccttccacctgagctcccaaagtgctagagttacaggtatgagccactgagcctgacctgcaacgaacatttttgtgtgggagttctagtgcacatatgagagagtttctctaggacagtacttgctgtgtgccaaattgctctccaaaaagattgtagcaatgtgcatgtccactggctgagtacgaaagttctcatttcactgcatccttgacagtgctaaataatacctatttcttttttcattcttgaccttcacgttttatagccttgagacttgggcagaaacagttctagaacccaggactcatttccagcctagggctcagcagttgattcaaatattaaactatcatgctcttttcccgctaccttccacaaaattttcagaaacattctatggtagttgccaaagttgtaggcctgggatttgggttgtgccctgacaacctaccctgtattgtatatattgtaaatgttctgtgtattttgatgttttgatatcttaagaaccctttctaggtgaggagagactgcccctcccggtgctagccaattcttacagatagcaaagagccaagataggagcatggctttggtaggcaaactaatcagtgcagagccatgccttctccattaggatgcacaacccagcagacaatattcctctctctcagtcctcccagggccaggtgccaggcagctaaagaccactctcttagagtttaagagcccactgaaattatacaaactagccaatcctaaaccattcaccctgccctatcttgcctttcttgcagaaactccaataaaggcagtggcctaatgttctcctctagctcttgtcttttgcctcctgcctaccctggcgcctttcccacctggctctgtgtggcatgctgtgtctcgaggacttgtgagtataattaactttttttttttttttgagacagggtcccactctgttacccaggctggagtgtagtggcgcgatgatggctcactgcagcctcgacctcctgtgtgcaggtgatcctcctcccacctcagcctcctgagcagctggaactataggtgtgggccaccacggctattttactttttattttttggatttttttagagatggggtttcgccatgttgtccaggctggtctcaaactcccaggctcaagcgatccacctgcctttgcctcccaaagtgctgggattacaggtatgagccactgtgccaggtcataaacttcattttcctgagcctctcctatgtcacctcttgggggtgcccctgaaaggcaatctcataaaagaataaaaataacccctaccccaagtctggcagtagaggggacctagccagtcttatcttttgtctcaaaaacctccaggaaaacatgacttcttatcttgtgttttcctatgtgcatatgaggacttgcggcaaagtatcgggtgaaatcatatacaggatataagtactgttatttggagggtctgaagcactttaagacaagactggggataaaattcaaggaatagttgaatcaaaaacagattaatcagaagaggtgcagagtattatgaatgcaatcaaggagaaagattgtttggagagaaatgctaaacaattcaagtctggaaggttgacgtgattccgctgttatgaaaatagggggtgcgcttttatagatcaacacacttctatgcaaatcatgtatcactctacagaactcattgttcaaaaataatatgaaaagaaatcctccttccttcacctttgtcccaggggacattctgttggctaaaagaataggtcttcacagaggtttatcagcacgaattaaagcttgggttttttccctgagggccatgagaactggaatttggccctgcatttatgaataatgcaaagagatgctagggaaagagcagcatggtgggaggatctctgtctatccacactcctcgattttctcctttacttaatccagaccttgtttgtttacaagcaagctaattagcctttaagacttgcaatcctcatctgaaaatgaggatgatgataattctgacttcacaggactgttgtgactactgaaacagatcatgcattcgaagtgcctagcatatagaaggcacttgataaatgccagcccttcctcttattagtttctaccctctttgaattcttaagaggcttttcattgagagcctcataatttagtagctgattgcatactgtcttatacagtttgctattgtttctcctaagttaatcttatctttcttatgcctcgtagaacttatgaaggagatactgtaagatctaaacccgctgctttacagtgtatgcaatgtgtgcacagatattcttttacatatcttttgattcctccacttgctcggcccacagctgaacatggacgaggcacactacagtccgtattaactgattgatggctctttgtcacaaaggcgaatccctccagaacttttttcaatgattgggaatcagagactttcactttgaagaaagagcacagtgcattttcaacatcctaagagaaagctctcaccttgagaattttcagtctgctagattaaatacaaaatgattatgaattcttcttcatgggagcacggtggtaaagttaaaaagcacctgtggcacactgttcttttttgaagaggaaaacacagggctgtaatggtacggcagagcccattgctaagcaacagaaccaggtctagactgcacaggagcaaaaattcttctttgttcagtataatgaagaatttttaaatggaaaatgcttaatagatttctagcagcaacaatactccttatgattttctaaagtactaatcagcagttgatatctaactttcatgggagtctctgacagtagctcactgttttgttttctaaatgaaacacttcaacaagaaggtttcagatcatcaattttataaaaggcatggatctaatgtatggattagaagtcacctgtccctgtgttttagtttaaattcaggattataaaaatccatctcaagtaatgtcaatacccgttaatgttgatgaaactatgttgtttgttggcataacttgaaatgagcagcatctgggaacctgttagaactgcagattattggcagggcatggtggctcacacctgtaatcccagcattttaggaggctgaggtgggcggatcacttgaggtcaggagttgaagaccagcccggtcaacatagtgaaaccccttctctacaaaaatacaaaaattagccggatgtcatgcctggtgcctgtaatcccagctacttgggaggctgaggcagaagaatcacttgaacctgggagatggaggttgcagtaaactaagaccatgccattgcactccaccctgaccaacaagagcaaaactcagtctcaaaaaaaaaaaaaagaaagaaatgcagattatcgagccccatccttggcctactgaatcaaacactctgaagacgggttcagtgcttggtgctttctggggctctccaggtcattcctctatagttcagagtttgagaaccactgagttaagggattgggatcactgtgtgagacacgaagaagcagagagtaacgagttaggtcctgtttggtactagtgagccctgggaatcagtggaactcccgagccatttggaactggggaagaaatctgtagtggtaactcagacagcatgcagaaaatagcatatgaaatggagatgcttcacagtagccttcacttcctgctgaaattggatctgtctgtaaacactgtctgggatggttaattttaggtgttgacttgactagctgaaggaatacctagaaactgggtaaagcattatttttgggtgtgtctgagcacatttccagaggagattagcatgtgtgtctgaatagactaagtggggaagatctgccctcaatgtgggtgggcaccatctactctactagggccctggagagaacaaaaacagagaaaagaagaacatgtccatctctctgctggggctggggtacactcttcctctcctggccttggacaacaactctgggctccctggcctttggatttcaggacttacatcagcagccccgccaggctttcaggcatttggccttggactgagagttacacaattggcttccctggttctaaggcctttggacttggactgagccatgctgtcaacatctcaggtctccagtttgtgaatggcctgtcatgggacttcttagccttcataattgcagagccaatttccctaataaatcctctgtcatatatctatatctcttattagttgtgtttctctagagaaccctaatgcacctcccaattgtctccaaacaattaaaaaagggcactattttaaatggtcatttgtctgtcgagtatttactgggtaactcctatgggccaggcatcacggtaggcattacaaacaattgtttgtaataaatatatagtgttttgccgagtcagcggtaatatgcttatgcagagttgaagaagagggatatttcttgaaaactggaaattatacagattaaaggaatagtgaataggaatataaacagctaaagatatagaaatatagttagtgaagtttctattcctgtggccagattaaagatggccacaaattctttgatgtcaaataattcctgcattgagaggtgggatatatttcccgcctccttggacctgagctgtgacttctttaacaagtagagtatgacagtttcaggcctaggcttgcaagaataccagcagcttcttccttgttcccttggagccctgagctgccaagtaaggcattagactactgtattagtctgttctcacactgctgataaagacatacccgagactaggtgatttataaagaaaaagaggtttaatggactcacagttccatgtggctggggagacttcacaatcatggtggaaggcgaaaggcgcatcttacatggtggcagacaagagagaatgagagccaagcaaacggggaaaccgcttataaaaccatcagatctcgtgagacttattcactaccacgagaacaatatgggggaaccttcccctatgattcagttatctcccactgcatccctcccacaacagatggaattatgggagctacaattcaagatgagatttgggtggggacacagtcaaaccatgtcaactaccctgctggagagggcaggtgaagtgccctgagactacatggataatgagaggagtcttgctgagctcagcctttcattgtccttgccaaaaagccaagcttgggaatgaagccagatgaaccatcagatgactaccaccaagtaacaccagtcaacaccatatcgagcagaagagtcacccagccaaaccctgaccacatttccaacctgcaaagttgtgaaatatagtaactttgttgttgtttgaagccactaaattctggggcagtttgttatgaagcaatggatagccctgcactttaaaccattgctgacagagatggaaaatgacctaacatgagtaaagccgtcagacatggactcatgtagaactacaaagtgtaagaaagaaaagcaaaaccaggacaatgcagatgaggaccagattagaacaggccactcctgagttagggtgtctcccaaaacccagtgagaagacacaagaagtcaacatcagaatcacactatttttacaactatacagcaaaattgttaagagtgcagggtatgcagtcaggccaacttggcgttagagcccagtgccaccattactggctgcatgcttagaagagaaacttgaccatgctaagatccaatttactctagggcatgtagtagtacctgtctgttgtgaagattaaatcagataatctgcatacaagtgctttatcagaatacctggctatgcaggttctaggtctgcttgaccttgaatgtatgccttgtctttcccctgacttgctctgcatgccgagtttcctgggctgtgtgttgtctgatttccagttgggttcagccaagaggaggcaacagcaaaatattggagagccaaggaagagagagaagcctagctgttataccctgaatctcttctagccttttgttgttgttcattttgtatctgttttcttctgacttttgttttcctcatcaaccttttttttctctcttttttttcctgaaggtatagttcattgcctatcctagctctatacaagatggtctccaattcagcttcccaacctccatgagtccagggctttacttccagccttcctctccccctactcccactctgctacccacttcacccactgctgctaaatttttagccctataatttgtaggtgagtatcaggtgtacaaggctcagccacctccctggactcatgcacccactctggtcatggcctcagagcaattttcttattttttgtaggcttatgcattcataaaagagtaacttttatattttatcttgcatttttaacattgtgtagcattaggttgcaggatctcttatccaccatgttgccagagatgttgaaactattttttatagtattaagcatttagtaaactctattatgtttttccaggcttttggtcattttgataaatttcttctttatttgtaaaagtttctgctatcgtttgaatatttgtgttccatcaaaattcctatgttgaaattgaatccccaatgtgatggtattaggaggtggagcctttgggaggtgattaggtcatgagggcggagccctcatggaggggattagtgtccttataaaagaagtcccagagaactagttcatcccctctaccatgtaaagacacagtaagaaggtgacatctctgagccagacagcaggccttccccagacaccaaatctgccagtgccttaatcttgaacttctcagcctctagacatgtgtgaaattaaatttttgttatttacaagtcatcaagttcatgatattttgttatagctgtccaaatgaactaagatagctccaaattaaaataaatgctttatatataattaaaaggagttatctcaagcaggcagatgcttgcagtcatttttctgttgtctggggtagctgttggaattctgggtgacatggctctttatatagaactatcccttggattacaggccatttatactaacattcttgtccactagacaccaaatgccaggagatttctctaatcattatgacaaccccccaaaaaatcttcatacatttccaaatgtcggcacttcctgttgagagtcactagggaaaaaagcacccattgacagtgtccatctgcaggacttttactgttcaaatgcgccatatgttacagttccacctgtgacaatttttgaagagatcattgatcataaatgtatagtaattttgtcttgttttgtttttcctggagacattaaggtgaaacgatgcctactgctcattatatgggcgactggtctcttcgaaaaatgttttataaaatataaggtccagaaaaaatatgtccacatcaatatcataaacttggcatcattttgaaagtttgagatcaggtgtgttaactcagttaagatgattgtaaggaccactgctgagattcagattgaaaactaaatttagggccggatgcggtggctcacgcctgtaatcccagcactttgggaggccaagacgggtggatcacttgaggtcaggagttcgagagcagtctggccaacgtggtgaaacccggtctctactaaaaaaaaaaaaaaaaaaaaaatcagccaggcgtggtggtgcatacctgtagtcccagctacttgggaggctgaggtgggagaattgcttcaaccagggaggcggaggtttcagtgagctgagattgtgccattgcattccagcctgggcaacagagcaagaatccgtctcaaacaaaaaaaaaaaaagaaagaaaattgaatttggtaaacaatgtaatttcattctataggctactagcccctcaaccacaagtcactttacctctctgtgcctcactgttccctttcataaaattaggtgccatttcttagttcttttccatttccagaattctgtgattatattatggtgcacattctatgtaatagtttgtatttttttcaaagagatatcatatatactagctcacttgatccttacaagaacccaatccttctgtatgtaaaaagaaaattttgtcaagtatcaactttggaggcctgaatcttagaaaatgtgtaataatcattgtacaggttcagcaggacactcagatatttattaattaactaactgaagaaatgctgttttggctaatgtcttgctgtgctcacagcatatgcgtcatgggaagaatgctcttgtatagccaagctttgatgtccatgtgctctcaaaggaaaccacacaaatgctgcagccttttaggggagagccatggggctctacattgaggctaagctgccctgaccttactttgctggatgagtgttctagggaatctggccaatctgaaaggaacattcatattaatatggtaataaaaagcttgggactctggaataagcctgacttttatttgaatcctggctttgccacttaactagttatagttactttataaggctgtacaaggatggaattaaattcagtgagctaatatgtgaaaaaatgtccagtttctggcatgtaataaatgttcaatgattgttaactaaaaaatattagggtgggagctgtcaaaggaaattggataatttaaatttagtctcaatgaatctattacttacataaaaactgtgttgttctgcattctgctcatctttcacgttcaaatacacattaggcttattcactaattgattcattaatttcttaattcaatgactatttattgagcacctattatgtgtcaaactctattataaataaacactggaaatgcagaagcaaacaagacattaagagtccctactcttatggacgtgcattttaatggggagtgacagaaaatatcctccttcccaataaaaaaacaaacaaataagaaaattaactggtaatgataaatgctaagaaaaacatgaaattaggcaatgtgatagactctggggagcaattttagattgggtgttcaaggaaggcctctctatggatgaaaagatgaagcaaagttccggggtccaagcaagatatgatgtagaagagagtagaggtggttaggatggagagaggcgaatgggttaggggatgatgtagaggaagagcaatagtacttattgatgggtcggacagtaggtgtgagggacagagaggaattaaggaggagccctgaagtctttgacttgagtggatggtggtaccatttacagaagtggagcaggctgagtagagtaaattgggagtgagaggatcaggagtctggtttgggaaagattaagtttgaagtgcctattgaactccagtggaggtgtcaagtagacaactggatacacaaggtcatagcgaaacatttgggggatttttgcctttagataatatttaatggagtgggcgggatgagaatggttaggggaaagagcacactctcacttctcgacaatgggagttaaaaaagagaagaggttcctggtatattcttacattttcaggtatctatgactcataacaaaagcttacagtaataaaatacagtcctcatagaattacccacatggaaataaattgataggaaattctggccttttcacattctttagtatacatgaatgggaatcagaaataagtcggattgtaatacactagtcattctttgacccacatttttgactgcctactgctaggcactgtatgtaaaaggaaatcaatagcacagtcatgttgttggtcaaacatttactgagcacatgctgtgtgcatagtaccagatgagtcgggtagagactaaaaaatggaaaattaattttctgccccaagaaaaagcggtctaaattagggatggagtacaaaccactcaaaagtttaaagaagagtatgtttccttttccttccacatatctgatgttcttaggccactaggagttcttgcactgctataaagaaacacctgagactgggtaacgcataaagaaaagaggtttaattggctcacagttgcacaggctgctaaggaagcatgatgctggcatctgctcagcttctggggaggcctcaggaaacttacaatcatggcagaaggcgaaggggaaagaggcacatcttatgtggcctgagcagaagcaaggggtgtggggtaggtgccacacacttttaaacaaccaaatctcgtgataactcactcactatcatgagaacagcagcatgggggaattccacccccatgatccaatcacttcccaacaggccccacctccaacactgggtattacagtttgacatgagatttgggcagggacacagatctaagccatatcaggcagtatgtttccttccacatatctgatgttcttaggccactaggagaaacccgtttgtgccgaatggatttggtgaggtaggccacagtccataactccttctgtcttttcccctcccttccacttcttgacaatgggtgggcttctctgagtaaagagaagtgtatttcagcccatattttattgctagccaactagtactctaggcaacccagcattcatattcccattattagagaagaaggtacattgacatttttaatgggttgattttttttgcctgttaaattaaacacagtctccactttcacattaatatccactatttgggccggatgtggtgactcacatctgtaatcctagcactttgggaggcgaaggtgggaggatcgcttgagcccaggagttcaaggtgagaccctgtctctaagaaaagaaaagaaaaaaaaaatccactatttgttcaacatgctacgcttcctgtctagctagtatgtagattggatgcatgcccacttatcagcaaaaatgggagggaagggaagaacccttttctaggccaatggttgtatttgcctcattaagatgcagcagaggccaggtgcagtagctcacgcctgtaatcccagcactttgggaggccgaggtgggcagatcacctgaggtcaggagttcgagaccagcctgaccaatatgatgaaactccgtctctattaaaaatacaaaaattagccgggcgtagtggcatgcatctgtaatcccagccacttgggaggctgagacaggagaatttcttgaacccgggaggcagaggttgcagtgagctgagatcatgccattgcactctagcctgggcaacaagagtgaaactccatctcaaaaaaaaaaaaaaaaaaaaaagagatacagcagaggcttttgatggcttattgtcagaaagaacagccagcattaattatgtggaaacaaaaatcattacatttagcagtcatttagtttttaaatgaaatttattaagtaaccccagataaaagctttcttccttcaactacttgggacatttactgataaatcatcctggcagaccaatggtgaggtaattctgattggaaagaaattctcagtagggtccacggtgaagttcttttgtggtcaatatggccaaataaaatactcagggatttttttggggggaggatgtcaaaataacttctttatgcttggtgatgtcaagttctgtgatctccaaatacttggccatcttctgaaacaggttcaaactctttttgttgtacattgagaaacatcttggccctcttccctggtaccagtgcagcctgcttctatgtcaatttgcttgaacgagaatggaaggttagctattaaattgtttgccacaaaatgttaaatcagtccccttcatgtctgctatctgaaccgtatgtatttctcttccatcaatgatatgcaatgtcagcccagtagatattcagcagagatttttagctattaaattttgctattcagaatactgaagttcagggttgttacttagtacctgagagaatctaagtggcattcatttactagtttctttcagtccctgcatgtagttatatcaccagaaagtcactacctggactgcattatcttgtggtttatattgggttacgatcagaaatgtcatttgaagaacattttagtatcttatgcaaaataacacgagaaaatggcagtttattaacttatctgatattccttatagaaagaatcatatgataaattgctgcttgaaaccagtgccagagaaatattagtccctttaggtgactcagtatattttctttctttgagagatgagaactctacagtaatatgaatgatgttgtctttttactgtgagtgccaggaaactaagaagttattttaacatgtcctcatacctttttgtgtcctaataccttaaattcttgatttttgttttttttttaatccagctgttatttatttatttatttatttacttatttgagacagagtttctctctgttgcccaggctggagtccagtggcatgctctcagctcattgcaacctccacctcccaggttgaagtgattctcctgcctcagcctcccgagtagctgggattacaatcgcgtgccatcatggtggggtaatttttgtatttttagtagagacgggatttggctatgttggccatggctggtctcaaactcctgacctcaactgatttgcctgcctcggcctcccaaagtgctgggattacaggcgtaagccactatgcccggacatcttttaaacgtgtgtagtacagttttataactcctgccaagtctttggaagaaaactaggagaaaggtcatctcctcagagaggctttctccgaagactgaattagaatcagctcccatctcccagcccctgaaccagtttatcttattaaagcacctttccttcattgcacttatagtaatttgtaattattacttttgttttgtttccttgttaaagtttgttttctccacgggattctaagttccatgaagactaagaccatctctgtctttcagtgggttatccctagctgaccatagcatgtaatcaatgctcaatagaaacttcttgttgtcaattattaataaattataatagtcctagtattaccaccactaaagtcttatggtgtaatgcttcaaatttctagaattgttggagtattaaattagtacatgatactctgcataataatgtatttggctcttttaaaaggtttttgtaaatagtctcaggatttttacaacaaacagtaattaagatgaaaattagatagcaaagaattgaatgaatcattggaattcataacttagtaaaataataatttattagtgcagatgatattatctacagcatatcttaatcaaaagttatacagaaagaggcaacacttgcatatttcaagtgagttttttttttttttaaggatttacagttacagggatagatgtctgtatttcttttgacaaattcttatttcatctctttttggggagcgttggtccaggaaatagagaccatatgaaattctatgctgcatgtcaagaaaatagctaagataaaatggggactaggaatttggtcccagaagttttcatttctccctgactatgagcaagtcctttatggagttccttttctccttctttctcttctgatcctccctctcttgctccttccctgcctcaagttgtcacacctccttgtcttcttcaatctgtaacaatttctcagtctttcatgaccttgacacttttgaaagtacttgtcagatattttgtagtggcaaaaaccacaattagttttgcaacaacctaacagaatatctctcagtttgagtttgtctgatgttttcttacaaaaacactgaggttctgaattttaaaggagaatattgcaaaggagatatgcctttcttgtcacatcgtattggagcacatgatatctccatgactaattactggggaggtttaaccttgatcacttggttaaggcgatgtttgccaggtttctctactatcacgtttttctttttctttctttctttctatgttttattagttatacaggtgtgacttttttttaaacccaagggtttaagaattgttttatttagtttccaaatttatgggatttatggaagctatccttttgtcaaaatatctaattttattgtataattatagagtacatagtttgtatgctagtgattttcaggaatttattaatgcttctttgtgacctgatttatgatctattttaataaatgtttcaagtatgcttgaaaagactctggttttccccatgacttaatttctacatcaatgaaacaggaagaaccaaaacatccaattccttttatttattttttgaaggctgcaaaaccaaagaccaaaccgaaagagaaaaatactgcatttgttctttttgactctttattttgcaaactcacaatagggatatcttgacacaagtaaacatactaggggagagagaaaaatgaaaatatctgtccttcctgtggattcgttaccactgggtaacaggtgcttaatcctccgtgggggcacaatttcagattacagagggtctggccagagcggaggagtaaccacctgtgataatgattctgatctgtgttccattccttagaagccctctggccttagctaatctgtctaagtaaagttgggtctttggtgtactgccatgaagtatcgctgtatgctgaggtggggtggctgatggcagtgggctagtcgttcagcctagttgcttaagagacagcatggatcctcatctgtatttgccatgggaagaggcattcgatgattaaagacttcacgctgcagatttaagtcagatctttaatggccaccctttcaggttgtttaccataggacgccatgcccctcggctgctgccctgacactctcctgctgtctctggctgcttctcttctgtgaaccctcacggatcctattgttggttccccacctcctcctgggcatcatcatcaaggctcaccttctagcttctaggagatctcaagcctttccaaatatgatgagtcatcaagaaatatgaaactttatatgggcgtttattgcgctatttgtttcaactttcctatatgtttgaaatttatcgaagttcacagttagaaaaaaatccacttgcttttcctctctaaaaaagttagtataggttgatgatcccttacccaacatgcttgggaccagaagtgttttggattttggattttttgggattttggaatatttgcatatacataatgaggtaacttggggatgggacccaagtttaagcacaaaacttatgtttcatatatactttttatacacatagcctgaaagtaactttatacaatattttaaataattttgcacatgaaacaaaggtttgtgttttgactgagacccatcacataaggtcaggtgtggaattttccacttgtggcgtcatgttgacacccaaaaagcttcaggttttggagcatttctttttctttctttttttttttttttctgagacagggtctctctctgtcgcccaggccggagtgcagtggcatgatcttgtttcactgcaaactccacctcccgggttcaattgattctccacctcagcctcctgagaagctgggactacaggcgtacacaagcatggctggctaattttttgtattttttgtagagatgggatttccctatgttgcccaggctggccctgaactcctgggctcaaacgatctgcctgccttggcttcccaaaatgctgagattacaggtgtcagccaccactctcaggcaggttttggaggattctggatttcaaatttttgtattagggatgtttaacctgtaaacttcaacgcttggcagtgttgcaagtggtctgcactttatctggatgaagacaaagaatggtgctaacatttgtctatgaacagatgggaaatcttgctgaggaaaggacaatgattctcaagcaaaaggggaaaagggagagagaaaagagagcacctggaactcaagagtatcaagaatgggaggtggcaacaggatgatttgcaaataatatttggctatcattagaacaataaactcttcactatacaaggttgtatggtgtattggaaagagcatgaaatcagagaaacttcattagacttcaagttttgctctatattagctgtgagattttgcctaagacaattgaccattctgattccacagtctttatacatgcaaatgctaaaacagttgtaacagtggagatacattgtgaaaaatgtgtcattgtgcaaacaaaataggatgtacttatgcaaacctagatggtatagcctactacatacttaggccatatagcatagcctattgctctgaccaccatcatatatgcagtctgtcattgacccaaatattgttatgcaatgcatgactgtaataataataatacttgccacataggtaaaaatactgtcattaacggtgtagtaaaatggtaactggcatagtaatgctgtaaattgaatacaatttttagaaggttttgaggagggaggttcagaactgttctccattgatttgcttaacaaagatattttcattttccaccaaagggtttggctgtgaaaacctttgcagaaataatattttaggagttttttccccctgtactgtcaactgatttttagtaagcatatgactttctgtatgtatcatccaattgatttaaaaatgaatcaatgaatgtatttattgatcgcctgcctcgcttcacaaaggaatgtgaggaaggacacccaatttggcattgctgtgtttctctgtatttgggtcatgcattttttcttgctttccacattgaaaatgtggtggatgcagtagattggctttaagtgtcaggccttccctcatttactatacctttttgtgtttcacaagctggaaagctaccaactacatgctctagacatccttgctgctaatattctgcatgtcagattggtctcaccaatggcacgcagcaaagcaagatttgcaggtgctgttttcttgctgctggcaaatgcagccgtggagaccaccgttttttgcagcactgttccagtgtcctgttaattgttctgtcggtgttgagaggaggttggggaccaggcatggcaacttcctgacgccatcttcctgattgtgggcagcagccacaatcagcaatcttatctaggtagtcatccatggatgttcagctcagcccttctccagcctttccaatgatttcgaatgtccccaattccccctaacgaatccctttctgactaggagtaactagctgagtgctgcaatgaaatcctgactgacagatttgtaaactctttgcgggcaggaacccttgatataaataaatgaccttgcattttaatggagggaagcagaaggataaacaaatgaataagtgaaaagttttaataagatggtgatgcgtaaaaaataaagctggttaatggggagtgcaggaaatgagcgcagctgtcttgccgttttaatcagataggtcagagaaggcttctctactagggtggcttttgacctgcctctctgttaggtcaattgtgtgcgaggccctgatggagttactgtgttaaaatgcaatgattcaattactccattacttagataccctttaagtgacactacggttgtccatctccccgctattgaattgtttacccacagtaagcatggcgggaagagcttcgatccgacccttgaacgctcaataaaaatggcgacagcacttcctgtacttgccctcaacaaagatggtgtcaacacttcctgtttagggttttcgccattaacaaagatggtgcttatggggcaggttccctaacagtcaggattccggttgcagtttttctcccccgccccaaagatacgtggttgcagacgtaagtaacaggaatccatctttctttgaaagtcctgcattgtagcgtctgcgacctgggccctgcgggggcttccccgccccgctaacttgctccgcatttccgatccgggccaaggctgggtggctgcggcagtgccggaggcccgctctccccttggtccgctctttagttcattcccagcactccctctttagcgggtcaagttgccgcagaaaccgcccgtagtcttcctgtttgatacaagggtttcagcggccgaagcagagcctttttaaatagttcccaatgggcgctcacggccaaacgtgaacacctcccctcctcacctgtcacctcctgaactttacagggttgcgagggggagtgtgggatcgggtgtcgcctagccgtggtcgtactgcccgggtgtgtctgaagccccatctgtcatccctgcctgccttcccggtcacttaaccttcactgccttacacacaaccaagccacagcacactggtgcaggggtggtggaactgcaccttcaaatcgtgcctggctactgaccagtgctggggtgtgtgctttttttgaaagaaaaaaatcccataaaatgtcccatgcatgtgcggccacgacagtgttgtgctggagattcggaattcttagtgggaaggaatggagtctgtgactgtatattgtgtaaagtttattgtagactgggcacaaacaacaattttcttaaaggtgatcgtgtagaggacttttagcgaaaagagccttaaattctgaacctgctgatttctgtcctgcactcctattactgatcaggttttgcaaatacttgtgatcaaaaaaaggggacctgcgtccaccttggcagtttctgccttggtggtggtggtgcaggtctgatgagggcaatgtgaaaataaaaccaccatttcttctccagcgtgttaaaattagtgctgctctgtaatcttcagataaaaattgcttgttcagaagggtctctgacccactttttttttttctttttccaaatttctttattgaacgaggaattgagctgggaccccattgtgtgaaaagcagaaacagaaaagatgattcatcttcattgttgttcattatgttaggaaacattcaaaattaacctggcttggcttaatcagtgaattaaataccatgacctggcagtctgctatggtttaaagatgtgcttgacctgaaggaacttacattgcagtgacactgtctttagggccacatcaacatgtctgtaatttgagctgtgattttggctctttccagggagaaatggaggccagagacaaacaagtactccgctcacttcgcctggagctgggtgcagaggtattggtggagggactggttcttcagtacctctaccaggaaggaatcttgacggaaaaccatattcaagaaatcaatgctcaaaccacaggcctccggaaaacaatgctcctgctggatatcctaccttccaggggccctaaagcatttgatacattcctagattccctacaggagtttccctgggtcagggagaagctgaagaaggcaagggaagaggccatgaccgacctgcctgcaggtaggcctcagaaagatcactttgaaccagctccaaaatgttgtaactatgctctttgcttttttgtttatttgtttgtttgtttttgagacagagtcttgctctgttgcccaggctggagtgcaatggtgtgatctcggctcactgcaacctctgcttcctgggttcaagcaattcacttgcttcagcctcccgagttgctgggaatacaggcatttgccaccatgccctgctaagttttgtatttttagtagagatggggtttcatcatgttggccaggctggtctcgaactccgtacctcaggtgatccacccacctccgcctcccaaagtgctgggattacagacgtgagccaccacacctagccagaactatgccctttggatttgaagttgggatgtaaggcaggacaagggtcaatggttgatgaaagtgggtaaggatttgggactgaagggacatgacgttggaggaataggatcaggaggtggcattaggaagtgcagggaaggaagaatgaaccgtgactgggaggtgagggagggagctcagagaatgcatttagaaatgcttccaggaaacctggcatgtcacttgggaagcatgttctcatcagagagccaggtcatatctcagccgttggcatcaggagccatttggaaagtgcagatgggaaagcaggcattcggcctactgacaactgatttgtgaggtgccagagctaccagctggaaaaggtcagattcatggaggaggagacagcctctaggaaggcatgccctgcacctgtcccctgggctgtcctgtgtggccaaaggggattattttgaaggctgacttagtttgtttttaaaggttattcgtttaaagtgtcctttttagtttagctttgttcagacactggagtatttaattttgcaaagagcaatagtttggggagggtctcagtttaatttgaaggagaattggaagctggagaagagagaaacagttctggttctgttagcctggcttgtagcaggaagaagatgtgatatggaaacacttgctttttcttaacctcccttgactctgtttcacaaagatagaggggcagagaactgaactggcaaaaattaaaaattgaaaaaaaaaagtaattgaaagttggcttgcaaatttttaacaaagttagagaatcaaggttctctggggtttctgataagagtgatagaactattccggttcagtgggccccagacttcgtggttgctattttttaaatactggttaaaaaaaatgaatactgataataagaccacttttactatttttgctccatggacctcatattttgacatatgtctgaatacctgatcagcatgacatagccagctaactttaggaagacctggtaagatcccagtggaaaaagcaaaagtattttcattcctagtctgggctcgttacagttaaatgtatctttaggctttttgaaatattagacatagctggcttttgaggaccactggaattcactgcttggattgtccttacaaaattaaatactccacatgtctgaacaaaatgtatctagatgtttttatgactttattgaaagcagaatagataacatagagttggagaaatgttaaaaaattattggtgttttcctgatatttgacttagaggtttctgctggcatcatatagttggaaacaacaaaacaggtgaactgaaagcctttcactatcaaaatactgaatttaattttatggtcattttgggtgatacagatcatgctgttgtatgtcattcgtagaggtataataccatttttttttttttgagacggagtttcactcttgttgcccaggctggagtgcaatggcgcgatctcggctctctgcaacctctgcctcccgggtttaagcaattcttctgcctcagcctcccgagtagctgggattacaggcatgtgccaccatgctcggctaattttgtatttttagtagagatggggtttctccatgttggtcaggctggtcttaaactcccgacctcaggtgatccgcccacctcggcctcccaaagtgctgggattacaggcgtgagccaccatgctcggccataaccccattatttcttcagattcattcagagagttagaaagaattaaggcattttttacaaaatgatgagagttacagagaagctgaggaaaaatagctttttaaaaaagcaaacagaatgaagcagtacataatgggaaaaaaattgagcatatctgtgtagaagtttagaaaaataaggtttttctcaagatttgttaattctgtagaaggttggctctggaacaaattcgtacagtcatcttaattgttttactttttactgagtaacactgctattgaaaaaaacattctgaagtgagggtttgatttatatatgtctttgaataccttccacggtgacaatcacataaactcttttaaaaaagacttgtatttattaaatattgactattttaaataatattacaaaatataagtaagatatggagaataatggtacagcgaacacccgtctcctcatcactcagtttaagaaaaataatattacgattgcctttaaaaaccccgggcactccttcccaatcttgtctcattcccaacccccacgcagtgaaaagccctgaattgggggtttatcattcattcacttcttcactttatagtttcctatctcctaaaaatcacttttaaaatcttcatatgtttttgaaaatcctgtataccgtaagttctagaggtgtgtgtgtgtgtatatgtatatatgtatatagagagagatatatatgttttttgtgtgtgtgggaaggaaagggtggaagtaatggaagaaattatgcatttaaacttgatagttaacaccttctcttgtttcagaacttaaaatattttttacatgtttaaagtaatttaattggtggcaatattttaattctaaaattaaattgggatttactgaattggaaacctaggttttgttattttgtaaatcctgggaagagtatcagagttgaaatcccttcaatttaacgtccctataaaaaagaaatccagaacctactgcctaagacctcggtgcttctccagtgttgtaattgagtaattttagtaagatttaaaatagtccacttaaatttttgtaaagatatctttgagttttgaggatctagactataggagaatgtgtgtacacattaacctcttaatgtatgtacacattaaactcttcctaccttttcctcattttgatcatacttattaattaatttgtatggattcagtagtctcttgggaggccttgagaacaaatgggaaggaatggccttcttttttagccaagacgttgatccttctctaagaatgaactgattttatcttattaaggttttcttgtgttggtcttcccagagatgcttggtttcccctttattggtttgttgttttaattttcgttgtttcacttgtaaattttgagctgtctcagaggctttattttggtgattgttcctggttagttgctttttacttatgtgctggatgtaatttgtttagagaattgagctgtatcttgttcttctctactcttctgaacgccacccccatcaaatctcaaaacatacaaaaacaccctaaaccttttgattctctcagaatctgcctctgtgactagtctcccaatctctgttaggaaaaaaaaaaaggtttaagttgttaaagttgttaatggatcattggttttgtgtttttctcaccctgtaaggactcttaccttttaaaagaggaattctggtgataaaatgacttaatccaccttggcaccgtggagagaacacttcatggtttgtctctctggccaaggtcacatactagacattagatcagctggaaatcctctctgggctcctgtcaggtcatttaggagatagggacagtgccgtgtctgggtgaaggcagcctgtgcctgcctgcctggcttctcactgctcatggggcctgtcggcactgacaggctccctccagtgcctgagctaatctggatctggaaaggaggttgatggcagcccagcctccccatctggtgggactcagcgtaaatcacggtgggagtgactcctgggccacaggaccccctccctgttccactgtgttggccctggctgtgggtctgggtgtctgccatgattctctgccttttgccccagtcttcctttaagcttgggagtgtttttgtttttctctcctccgttggtttgattcatgctttatgtattcttagccatggcgagagtgaagaacagagctctgggaacacagctcggtgcctccggcatcagcattggatgtctcaactcttgagcctgttggaatggctgtccctaagctgacacttgcttcaaccttctctgggcttgatcttgtcctccccatagactctgtgccctggactccctggctgctcttacaacagcagtgcgcaggactggctagtccatttcccctctacctgtgggctcaagggctctgcctgccccttgtggcgccagccttgagtgacaacacagaaccacacctgccgccctcctgagatacattctagctctgagttgcatacttggatgcatctaaagtcactgagctcttaatggcagatattttagatattgtgatgggtttattagagaggtttctagcttgggattcttttcataggttcctccaatcataccacgtaattgaccttgctctgcatgtaagttcagtgttggtctcagtgtatctagcttgcagtctatccatgtgcttccactgtgactgagtagtgtttgcctagtggcgtcctgtgtgctagagtgagaacagtgggtcagtatccatagcaagacccttccctcggtaaagggagagtctgcagagggcccaggtttctgtgtatacccagcccgattttcatatacttcctaaggacctactgaatgccaggtactgggtatataaagacaaatggaggatctccagatcagttgagggcattcatgcgttcatccagcaaatatttgctgagtcttgaccatgtgctaaaccagaggtccccagcctttttggcgtcagagactggttttgtggaagacaatttttcaaccaacgggagagttggggggaatgatggtttcgggatgaaactgttccaccttagattattaccaggcattagattctcataaggagtgcgcgacctcgatctctggcatgtgcagttcacaataggttcatgctcctatgagagtctaatgccactgctgatccaataggaggaggagctcaggtggtaatcctcgcttgcctgccacttacctcctgctctgcgatccggttcctaataggccacggaccggtatgggagttggggacccctgtgcaagacagtaggtgctggagatataacagtaaacaaaacaaagcccttattttcatggagttcaatgtattctagtagagggaggggataagggcagggacagataataagcaaatgaataaataacatttggtggtgaagagcgctatgaagagaagcggtatgtgtggtggtgggggtggtcagggaaagcctctctgatgaggggacactgagcagagaactgagtttggctgcagagttgatacagggaggagagctttcagatagaggggaccacaaatacacaggaagtcaagtgggagccacaggtgacaatgtggctaataagacaccttcctccctgggatgaatcacattccacatcagcagaggctcagtggctaccttttgttttgctctcaacatgtgagatgtgtgtgcagccgtgatcttgtgtggctcgtagcatgactttagttgatacgtggatgtgggattaagtaatattgaattacatgatgagaaagttatttcctttctatttctgtttcagttcggtaagaatgataggaggtcctcatgcttaaagccttctgtgggcaacagtatttagctagaatctagttgtattgctttttttgtgtcaacttaatgggttccttccatttatggcaagcaaaacttttctatttacgaagttccttttaaaaatacatgacttttagagactagaattgtggttattagggactgggaagggtatgagggaggcagggatggggaggttggttaatggatacaaaattacagctagatgggtggaataagttctaatgtcctagcactgtagggtgaatatggttaacaggaatttattatgtgttttcaaaatgctagaagagaggattttgaatattcccagcacaaagaaagaataaatgtttgacatgatggatatactgattgcccttatttgatcattacacattgtatgcatgtattgaaatgttaccctgtatcccataaatatatacaatttttatgtatcaaccaaaaataaaaagaaaaatgttcataggaatattgaataggaaataagattgaaagtataccaaattatttaggaaaaaaccattacttacatttaagtagaaatgtgtcaacataaaggagactataaaaaaataggccaggcacagtggctcactcctgtgatcccagcattttgggaggccgaggcgggcagatcacctgaggtcaggagtttgagaccagcctggccaacatggtgaaacccccatctctacttaaaatacaaaaattagccaggcgtggtggcaggcgcctggaatcccagctacttgggaggctgaggcaggagaatcgcttgaacctggcaggtggaggttgtagtgagctgagatcgcgccattgcactccagcctgggggacaagagcgaaacttcgtctaaaaaacaaaaccaacggaaataatggttgggtgtagtggctcatgcctgtaatccctacactttgggaggctgaggcgggtgaatcacttgaggtcaggagtttgagaccagcctggccaacatggtgaaaccccatttttactaaaaatacaaaaaattaaccgggtgtggtggcaggcacctgtaatcctagctagtcaggaggctgaggcaggagaattgcttgaactcaggaggtggaggttgcagtgagccgagattgtgccactgcactccagcctgggcaacagagtgagactccatcccccccaaaaaaaaaaaaaaaaaaaaagaaaagaaaataataatggtgtgaggatgtggccaaaagttgcttttcatcatatatttttttaatttaaaaagaaagacaggcatttgggggaggagccatcacctggctggcatagttaaagcaggaaggctccagttctagtatagatagtagatagagctgttttcatgatgcttcacagttttgctctttcaatttatgcccagtgataggaattagttaaattaactagaatttcaaaattcgtaagttctctaaattttaaacacatttacttgctagtgaaacaaagtcagcaagatggagccatatcctggtattatgaattttagaactgggtgggactcacaggtcatctaatttttctctgagaaaacagaggcctagggagattaagtcaacttgcccatgatcacacagctagttaatgtaatttattactgggactagaatccaggctttgcaactcttgatttaggactttttctgctgcgcaatcttggcttcccactgagtttgaaatggaattgtattatgctgcagtgttaataattgaaagaggctttttaaaaattgtactaatgcatttttttttttttcattttaagaggagaatttccaagggcctttagaggtatgctggaatgagatttcactaaaatattttatttttatgaatgctaattttaatcatttaaaaggaaatgatgatcgttcagtactgcattttgtcacaagatttttttcttcctacctctgcaaggctgacataaaggaaaagcggaagactttcatcgagtatttatgggactgatgaaataatgcatctgttggcagctaattgcaggtctttctaggaatagcaaacatgtgacaggtcttgccccagcggagatgcctccatttcactttaaaacatggatttggtattcttttcacttagaaattctggctatgcctttttttctcccttctgtggatgtatagaccgttcggctgcatcagacactgtattgaacatcagggttgatttaactcattgttgctcagctgtggctatgctttggaatcacctggggagcttttacaaaactactgatgcccaggctctactccaggtgaatccattacacaatctctggagggtgggttctgggcaatgggatgttaaaggcacacacgggcatgcccatgtgtaagtcaggcacacgtacaaatgcttcgtgaggtcatcttaaattgcagccggggttgagaaccttgagctctgaccagctggttaggagcgtgcctccttcctcactcactgcttccaagtcgtggcttcccaaagctgtgtacttgcttgaagcattgttcttattttcaggtagcaccagatggaagggtggtaggaatcagggtgtagagggatattagtttgcaaatccttttattccttgaatttcctgagcattgttgctcaagaatgttccagaatctcagaccccatacagggggtgatgctgctaccaacattaaaatccattagggctctatggggatatataggctacacacatgaggcaacaattggaggagtttgaattgctagtgaatttgaatttgggaattatttttattgctattcacattgtttggtacagtcattacaaactacatgcagtaccttgtgctctgtagatcaggttatgtccaaatggagacagagtctcctgctgaagaacgagttggatgctcctctcagttaaaaagtgagctgaagatggctcgaggatggaagagagaaggagagacaaatggctagttgggaagagtgggactggcttagtctgtcagactggctgtctgtctgctcatggtctttattcataattaaaaatgaatttcaggccaggtgcattggctcacgcctgttaattccaacagtttgggagaccaaggtgggaggatcacatgaggtcaggagttcaagaccagcctgggcaacatggcaaaaccccgtttctactaaaaatacaaaaagtagctgggcatggtggcacacacctgtcatcccagcttcttgggtggctgaggcacaagaatcacttgaacccaggaggcagaggttgcaatgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaacataaagtcaaatttcacttcaaggcctactgattcatatcttataaaaccactttctcggcattcagttttctcctcttcctaattctgataacctgtggctgctccagagcccatcaccctaattcttcttcagaaactcccctacttccagtttcttccagacacacagcctcaggaggctttctctttcttgcctcttgtcctaaggctgattcctggttggtatctctctcgtatctctcattttatacttttttggttgggggaaggctagggtctaatggaagaccatacggtggggaggggtcatggaacagagcccctgaatctctcccatttcaacttgctactttgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttatgggtgtagttcaaacttgtaggctgctgttatagctagctgtgggaatgtttgctttacataatgttaataggcagctgtgtttatgcttgttcctcagtttaagcagtaaggagtgtatacatatgattctttgagggcatttcccccagactaaaaaaaagaaaaaaaggtatgttgtgttttttccaacagtaaattttaattgaaaaggaatgtagtttctagaagaagtttggggcaggttttactcctaggctttattttgttaatgttatgaaagaaactttaactccttctaagaagtgccaagttgacaattcctggaaatgttcatgttctatttatgctcagcaccatagcagacagggtggcaataccattaccaaaataataccgccgagatgtactaagtgacaaatgagaggcttctggttttataacctaaatacaagactttaaaagcatctcccaattctaccatttgttgataaggtctgtgggtgctgagtagtaatggtgaagttgctgtggagaattatagatcaagtagagcgtatctgcagtgacttgtcctgttgctagaactatagaaggttagagttggaagggatcttagaaacactttatagatgaggaaacgaagggatatccaagtctaacagcatgcatatgggttcttctgttcaaatagtagaacttcatgtaacataaaaataggaatttctctgaaatatattgggtagttcacaactttgaaggaatgataaaggtttcagggcttaataagggcaggaatgaggcaacagtgggggatctcaggccatcagatggtcatcttcaatcaagtttctacactgtaccttccttccagattcagactattggccaaacttgggtcctgagcccttcctctaggacaccagaatcacctgaagtggggaaaggaagttccaaaagaaagagtgaaagctgattgaagcaagagttgtctactgtgccatccttcttctttttggattgaataggtctcacgcccatgggcctggaaaacaaatgatagccctttaagggaggaggttgctttacctcttcttcatacagcaaggcccaggttgagggccaaaggtggtagataaaacgctggagagcagttttggagcagcataggtctccttaaacttttccaaaatcagaatgtattgggggagaaaaatggattgagaatgtagatgtaaagaggaggtttagaaagagaatttgaattgggtactggcctaagggctttagatatataaactcactttattatcataatagccctttgaggtaggcactactgttatcatttgcatttcacagatgaggagactaaggtgttagataaattgctcaaggtcacacagtttggcagtagcagagctgaggttcaaacactgacagtctggctcacagtctgtgcttctaatcactagggtcctgtctctatcggtctactaccagttcttagatctgattggagtcacatggcttagatgacctgacctgggctagctgcagcttctttattttctgacccttgcttgcctcaggtctcacacatagccggcattttcattatgtgtatgtcagtctcttttttaacagttaccaaattttaaaaaatacaaaagaaaatgaaagatgttttctaagaaatatgattaggtaaaataaaggttttgaatgtgattgatgtggacatttttgttcatttagtttttaaacatatctcttccctttcaatctctttattattaattagttatgtgctacgggcaaatgtgacttttcaggcctttcatatttgtttgagcccttttattccatcatgtgccagtcacaattcattcaggagacagaaaccacacagtaatttaaatagggaaaacttaatataaagaattttcttttgttttctttttttttttttttgagacagagttttactctcgtcgcccaggctggggtgcaatggcgcgatcctggctcactgcaacctccgcctcccgggttcaagcaattctcctgcctcagccttccgagtagctgggattacaggtgcccgccaccatgcctggctaatttttgtattgttagtagagacagggtttcaccatgttggccaggctggtctcgaactcctgacctcaggtgatctgcccgccttggcctcccaaagtgctgggattacaggcatgagccaccgtgcctggccaatataaagaatttttaactggtgaaaagcaaaccatggttaaccactaaatggggtaaaagaggtctctaagtaatacaggaatggcagaagctactttttctgaggttgaaaggtagtgcaggatacagtcactaagaatgtggaagagggccctccccacctctaaggctgagattcagacttcggtggagttgaagtgactgtcacactagctggtctgtaagagcagcctacctggtagctaacttcaagaaaatccagagaaataattgcatgaagtcagaaaagtaataaatgaccaaaatgagaaattttgaaattatttaaaaaaatcaaatagaaattctggagctgaattaggaaaaataactaatgcatgtgggcttaatacctaggtgatgggttgataggtgcagcaaaccatcatggcacacatttacctatgtaacaaacctgtatatcctgcacatgtagtccaggacttaaagtaaaaattaaaattaaattctggagccgaaataaaaattaatggactgaaaaatgcaatagagagtatcaacagcagaattaatcaagcagaagaaagaatctgtaaacttgaagacattatttaaaattacagttggaggagaaaaagaatgaaaaggaatgaagaaagctcatgggatttatgagacagcatcaaaagaacaaacatttgaataataggagttaaggcagaggaagagagataaagtggtagaaagctgttttaaagaaatattagcagaaaactttccaaatctggggaaagatataatatccaggtacaggaaggtcaaagtctctaattagattcaatccaaacaagactacactaagccttattataattaaactgtcaaaaaacaaagacaaagagaagaccctgacagcagcaagagaaaagaagcaaataacatataagacaatttcaataagcctagtagtacatttctcagcagaaactttataggccaggagagagtaggatgatatgttcaaaatgttgatggaaaaaaaaaattgctaacaatgaatagtgtagccggcaaaaccgttctttagaagtgaaggagagaatgatactttcccagataaagctgagaaagtttatcaccaccacacctgtttttacaagaaaggctagtggagtcttcaagtggaaagaaatggaaggttaataataacatggaaacgtacgaaagtataaaacttacatagtcaaatttggaatctccaatactgtaatggttgtatgtaaatcatttacatctttagtttgaaggttaaaagatgaaactattaaaatggatataacaacttataaagtatatacaaaacaaaaagacataaattgtgccatcaaaaactaaaatatgggggtgatggtggagtaaagtgtagaatttttgtatgtgatcaaaattgagttgttatcagcttaaaataactggctgtttataaaatgtttttgtaagcttcatggtaaccataaaacaaaaacctatggtatatacacaaaaaataaaaggtaagggaccaaaggatatcactagagaaaattacctaatcacactggaagacagccagaggaaggaaagaacaaagcatctacaaagcaaccaggaaacagttaacgaaatggcagaagcaagaccttatcattaattaccttgaatgtaaatggattaaattctccagttaaaagacagggtgtctgaatgggttttataaaaagcacaagacccaactatatgccatccacaaaagattcacttcctttttaagaacacatatagagtgaaaattaacgggtagaaaaatattttccatgcaaatggaaaccaaaagagagtaggagtggctatacttatgtcagaccaagtagattttaagtcaaaaattgtcaaaagagacaaagagggtcattatgtaataataagggggtcaattcattaagaaggtataatagccataaatatatatgcaccaatcactggagcacctaaatatataaatcaaatattaatagatctgaagggggagacagactagaatatagtaatagtagagaactttaataccccactttcagtaatggacaggttacccagataaaaaaagtaataaagaaacagtggatttagactacactttagaccaaatggacctaacagacatttacagaacattccatccaatggtatcaagaatacatattttgattagcttagtaatgtataaggatattgagtcagtaatacaaattctcccattaatgaaaagcccagaacctgatggcttcattgctgaattctgccaaacattcaaagaacaaataccaatctttctcaaactcttctacaaaattgaagaagaggaaatacttccaagcttattttgtaaggccagaatttactttgatatcaaagctagataaggatacaagaatagaaaattacagaccaatattctattcttgatcaacataggtgcaaaaattgtcaacaaaatactagcaaactgaatttaacagcacagtaaaagaatcattcactgtgatcaaaggatgcaaggatggtttaacatacacaaatcaataaatatgacataccacattaacagaatgaaggacaaaaactatatgatcatctcaatagttgcagaaaaagctttcgacaaatgtcaacatcccttcattataaaatctctcaacaaattaggtatagaaggaatatacttcaacacaaaaaaggttatatgggacagactcgtagctaacttcatactcaacagtggaaaactgaaagctttttcttttaagatcaggaacaagagaaggatgcccactctcaccactcttactcaacataatactggaggttctagccagaataattaggcaagataaagaaataaaaggtatctagattagaaagaaagaagttaaattatccctgtttgcaggtgacatgatcttaaatataggaaaccctaaagactctaccaaaaaactattagaactaataaatttagtaaagttgcagtatacaaaattaacataaaaatcagtagtgtttctgtacacaaacagcaaactatttgaaaaagagatcaaggaaacaatcccattttcaatagctaccaaaagaaaaatacttaggaatacttaaccaaggatgtgaaaaacctgtataatgaaaactgttaaaacattgatgaaagaaactgaagaagacacaaataaatgggaggaaacctcatgttcatggattgaaagaattaatactgttaaaatgtccatactacccaaagtgatttatagattcagtgcaatcactatcaaaattctagtgacatattttatagaaatagaaaaaacaattctgaaatttatatggaaccacaaaagaccctgaattgccaaagcagtcttgagcaaagaagaacagaactggaggcatcatactaccttctctgacttcaaaatgtgctacaaagctatactagtcagaacagcatggtgttggcataaaaacagacacatagaccaatggaacagaatagatagtccagaaatgaattcacacatttatggtcagttgattttcaacaaaggtgccaataagacacactggagaaaggacagtcttttcaataaatggtgttggaacaactggatatgcagaagaatttagaccctcatctcacaccatgtataaaaataaactcaaaatggattaaagacttaaacataagaccaaaattatgaaactactagaagaaaacctaggggaaatgctctatgacattggtctgggcaatggattttttggatatgaccccaaaagcacaagcaacaaatacaatagacaaatgggataaacaaaagcttctgcacaggaaacaacagagtaaagaagtaacctatggaatgggagaaattatttgcaaaccatatatatgataaggaattaatgtccaaaatacaccaggaactgtaaaaactcaatagcaagaaaacaacccaattaaaaaatgggcggccagcgcagtggttcatgcgtgtaatcccagcactttgggaggccgaggtgggtggcttgtctgaggtcaagagttcaagagcagcctggccaacatggtgaaaccctgtctctactaataatacaaaaattagtggtggcactcgcctgtattcccagctacttgggaggctgaggcaggagaatcacttgaaaccaggaggcggaagttgcagtgagccaagattgagattgtgccactgcactccagccttggtaacaagagcaaaactccgtctcaaaataaataaataaatgggcaaaggatgggaacagacatttctcaaaagacatacaaatggccaacaggtatatgaaaaaatgatcaacatcgcaaatcaccagggaaatggaaattaaaattataatgagatataacctcatacctattagaattctaggtgcttattaaaaatatgaaaggtaacaagtactggcatggatgtggagaaagtggaacctttgcatacttggtgagaatgtgaatcagtatagtcattatggaaaacagtatggaggttcctcaaaaaatttaaaatagaactctgtgtcttagcaatcccactactgggtatatatccagaagaagtggagtcagtatatcaaagagatagctacactttcatgttcactgcagcattatttacaatagccaagatacagaatcaacctgagtgtccatcaacagatgaatggataaagaaaatatagcatatatacataatgaaatactattcagtttttaaaaagaaataccgtcatttgtgacaacatggatgaacctaggtgatattatgcaaagtgaagtgaaacaaggcacaaaaggacagataccatataatctcacttatatgtagaatctaaaaaagttgaactcatggaagcagagagtagaatggtagataccagaggctggaggagatgtgattggggagatgttggtcacagaatgcaaaggttagttagacaggagaaataagttcaagagatctattgtgcaacatgatgactatagataattaacaacctacagttggccctttgtatctatggattcaaccaaccacaaatagaaaatatttgaaaaaaaaaaccacaataaaaaataacaattcagcaataaaaaagaatacaagtgaaaatatagtaggacaaccatttacatagcacttaccttgtattaggtattataagtaatctagagattatttaaaatatatgggaggatgtatgcaggttatatggaaatattattatcattttatatcagggacttgagcatccatggattttggtatcttgggtggtagtgggggcctgtagtccccctgcagatactgacaaatgactgtagactgtattgcattcttgaaaatcacctgagtaaatctgacatgttttcttcacaaaaagtgataagtgtatgagataatgcatattttaatcatctctatttagccatcctgcaatgaccatcctgctatggtcccaatgtctcccagaattcaacttaatccccattgtggtggtattaaggggtggtaatagggggtggtattaaggggtgaagtaattaagtcataggggctttaccctcatgaatagattagtgcctgactaaagggctggagggaactcgcttaggctcttgttgccctttggcattctgctgcgggaggacacagtgttaacctcttctgccacgtgaagatgcagcaagactgccctcaccagacaccaaatgcttgatcttgcacctttatcttggacttccagcctccagaactgtgagaagtaaatttctattgtttataaattacccaatctgtgatattttgttatagcagcaaaaatggactgccagttttcgtatttcaaaacatcatgttatacacgataaacgtgtacaatttttatttgtcagttaaaataataagttaaataagttaatttaaaaaagagatagccagtgtttataataaatgaatcatcttaacatttgagtttttgctgtaggggaggaaaaatctcttttcctcattcattctaggttcatgactgaggcccttataccaaaggacagataaacaagagcaagcatagaaatttatttaatataaattttacatgacacaggaacttttataagggagtgaagacccaaagagatggttaaacttgtgtatttttatgctaggtttgatggcatgtggatggttgtggggaaatgggattggaaaaagaatatgagctctaatgataatgaactagggtaaactttgctagggctaggtgttcctgttctctctgtgatctgcatcttccgaaataaggatgctcctttcctctggggatagggaaggcattgcacatgagagtcaccttacctgtttcaggggaaggtcagaaaatcctttctagggtttacaacctgctttaagggagaatcgggagaattgtgggagctgaggggaggtcagagtgacctgcctgcttatgctgtcttctcagattccaagtgccatatcttgggccagtgtgtcttgaatcccatcattactgttggaaattccgtttcagaagcccactctttgctaaactccagttacttctagaactggacactgctgctgaaatctggaatttcttatgtgatgccaaaaaaaggagaaaatttagaagattacgagtatgtgtgtgtttaacaaagtatatatacttttttcttcagagagtaaaacctctgaatcaacttgaagtagtcttttcaaattgttatcaaggcatgctgctatttcaactattagagagatagcaccggacttaaaagaccttctctaaatgactcttcaggaactaggaagagcatttttcactctgctgtttaaagtattttgtttgtctttctatgagtatactgtttcaaagtgtttcactagattataacctgatttttttcagtgtcttctgtttgtatgcttttaagtttctaaatcttttctcttcattgtttttccccaaattgttggactctgagtaagcttctgccagtgtcattttaaaatatatttatatccttcagatgctaaaaatagtttgtgcacttttaaatggttgaaaaagaaaagaagattacatgatgtttgaaaatcacatgaaatgcaaatttcagtgtctataaataaagttttattggaacacagccatgcttatttgttaacacgttgtctctggctgctttcacaatacaccagcagggcagagtcaggtagctgcaacagagaccttatggtccacaaaacctaaaatgtttactatctggccctttacagaaaaagcctaccacccctggtatagagtgagaaaggccagaaaccagaaaaaaaacctgtggcttttcccaaaaaagctttggtttttttcttatgaccggaatcagctttatttgcctttctttacttggtgcctaactgagtgctggattaaagcaaatgcttagttctaaaattgttttgagagtcaaaactggggaggcctttcttcagggtaaacttttcctatgaatatatatcattatctttgccattttttgagttagattttgccagaagagatttgtcataccagggccattgaagcttttctttcatttctaaaattgtacataagagaaaaagaattagataaaccaaacagataaaacccttttgtgctctgcacattcacacgaggatttagtttcagcttatcctgtgtatttactcatggtttagtctcaagatttttaagtattggcatgatgagataatgttagcatttgaatactaaccacagaaagcattaagcaaggtctgcagtcatgaagcatttgccttttgttcccatccattaggtatttaatgtattttttacatccccccaccttgtctttgttttcacctcctttgaaggaaatcttttgtcattgagactcaaacgttctgatgagtaatgctacgccagggtatgaatttcttcccattccctgagatagccattgtactattaatatttctgtctgttgtttagaagtgtagcctgtattaggttctcaatcccctaaggaatataacattttaagtgctcgtagagtgctgtgggctctaaaaggtatcaaaagcattccatcagaaatagaagctagagagcccttgtccttcaaggagtttgaagtctgtatggtaagagaggggtaacatgcatacgaattctgaacatgtactagcagcctacaaagtgaatggaatttcagcagagcatgcagcatgaaggagcgatctcagcggggaagggaataaagtagggagtgcttcgaaggtgaatctgggttttatggaaggtagagtcattggttccaggggaagaagccagtccagatggaggagacgccaagtacttccctgacatctcaggatgccttgctagaacattaaacccagcatgttgcagatggaatgagtttttctcactaaatctaggtcctgctcctgccctcagtatttccgtcaatgtcatggttttctgagttatgcacctgccacttactttaggcttttattgcttctccaaactactttgtaactggtttgcctgtacagagaagctgccagatttgtcttccaaagctttcttcctatcactgtgacccctgcacaccattccagcatccattgtgccattctctggagagctgctcttctgcatactagccaaatttgtcttccttcagtaattttttttttcttttgagatggagtctggctctgtcacccaggctggagtgcagtggcttgatctctgctcagtacaagctctgcctcctgggttcacgccattctcctgcctcagcctcccgagtagctggaacgacaggcgcccaccaccatgcccggctaattttttgtatttttagtagagacggggtttcaccttgttagccaggctggtctcgatctcctgacctcgtgatctgcccgccttggtctcccaaagtgcttggattacaggtgtgagccaccgcatccggtccagtttgttttttaatgtgctgtgctgttgggttttgtttgtttgatttttgttttgcctgagtgtctttgcctatagtgtgaatgtttttacttctctctttgccacgttaactccagttcctcctttgggctttagcttaggtgttttttcaggaagccttcccataccttctatgttggattaagtcctctctcatgcgcttctgagcatcttgcacctcctatttggtgtgcttctctataataggttgtaacttccagagggcagggacctagtgctattggacaaatggcaagtgctcaaataaaagatgttgtttttttcttaaaatatatttaaattttcctcattgtctacaaaattaatttcagacatttttaaattcatttcagaccttctgtaatatggcccgaccttatctatattaattattgaattagatttggcaacatttaacagaaaacccaaatgacagtgattttaacaagatggaaggtttatttttcccttctcctcctcttcctcctgtttctcctccatatccttctctctctctctctgtgacacacacacacacacacacacacacacacacacacaatctgtaagtagtctccagggctgtgggctggtgtgactgctccacagttaccagaggccaaggcttcttctctctttatgctttgccatccttggcacgtgatttccactctcaagattccctcatggtcctaactggctgctggagccccaggccatcttgtcccttgtgggaatagtgctagcagagtagaagggagactcagagagaggaagacaaaaaggaagctaacatgaaaaagacattttcgtcaaatgctagttctttgaacttctgggaagaaaagagtttctaggagaccacaactttttactgctttgaagattccaaattcctgagaatatgattcagttagtgagtaacattctctatgctggcaaaggaggaaattacctggatctggacctatctttggaggatgagagaggagctgttatctctcccccactgatacaatgatgttgtaatgtcttttcagtaggcatttgcctgagctcttttttttggactataatttccccccaccccactttctctaatctctgcttctcaaaatcttatctattcttcagagcctaattcctttcttttcccagaagcttttccacattctcctcatctgggatttttttttttctttgaacctccacagatttttgtgatgatctttctccatgttttaacatagataccggtaaacttatctaacgcttccctagctccctctcaccatcgaatgccatccccttgagttaagtcagggactatgccttgttcacatctgctgcagccatcacagaacctttaaaaaagtaggttcttaaatcttaaatgagtgcatgctgtgagggaaggaaagcaaatagactttttggctcaaataaagaattgatgtgtttagaagacaggtaaagagaaaagggacgagttgttggatgatcttgatatctaggctttgaatctgggcttggcagggtaggtgcatgagccctgaatataagggagctggcctagggagagaaaaaaaaccatcacttcaactcctgtcttccagggtgttgacatcattaactgccccacatccaccagatttccccagatcttagttgacatagagacattcattctgtttctcaccttaagaaaatccatcctgagttagcttcagttggtgctgctgctaggctttatggtgataggctttgggaggaactgagaatcccaaatgctaggtggtatctgaatgtggcattacgagatataatgctctaaactctgcaatttctcttgtaagacggaaacaattcaacctgttctttgactccttttctgggttttcttggctccaggcttcttagaacactgatcacactgttccaccacccccaatctttacctccattctctctaccctcccagcccccaccaaaacacaattcttttcaggcaagtgcaccatacaggtgctctggtggtcccgtaactgaggatgtagttgccagccttttagcaatatcaagagttctctggaggctcttgagagctgtggccttggttaaattggacagaatcacctttttggtaaattcccttccgattcatttcacaaatggcttaaatcatttatgttgttttgttcaatccagtcaggaaatgaaagcattgccattttaattgttttagaacagcattttacacctaatatagactcccaaagccagccaaatgcagattttggctcctagatcgctgactgcatgctgactgtgttcttgagtgtggaagaaaacagatccagccaaagactgattaccttccaaaggtcacaaaagaagtttctctttatctaagaaagaaagtaggtgccattaggtgttgattttttttaaaaagtccttttaatttaaacaatatttgaataaaaattatggtatagtcaaccacaaatcagttgatgaagtctcaaattttggcagtctcccttggttctgtgttcttgggcaagtttactttctttttctttttcttttttttttttttttgagacagggtctggttctgttgcccaggcttgagtgcagcagcgtgatcttggctcactgcaacctctgcctcaagcattgctcaagcaaccctcccacttcaacctcccagttagctgggactacaggcgcatgccaccacacctggctaatttttgtatttttttgtagagacgaggttttaccatgttgtccaggctggtgtagaacttctgagctcaagcgatctgcccacctcagcctcccaaagtgctgggattacaggcaggaaccaccatacccagcctctttttttaaaaaataattttttactttgaaataatttaagacaagaagttgcaaaaatagtactgagagatcccaggtacctttcactcagcttcccccaatgataatatcttacatgatcatagcacattgttaaaagcaggaaattgacattggtgcaatactagtaattcaagaacagaccttattggaataggttttacatgcaatctgtttttagtgtgtgtagttctgtgaaattttattacctttgtagattcatacatgcttttgatttttaatgctcacttaccgtcaaattatttggagcctttcttttttttttttttttttttttgtagagatgggggttccaccatgttacccaggctggtcttgaactcctgagctcaagggatctgcctgccttggcctcccaaagtgctggaattacaggtgtgagccaccacacctggcctatttggagcctttgtgtgaataattaataatagcaaaactggaaattatttaatctggaaatctcaatttaatactcttaacaaaaagactactggattagaaagtagaaagtcaggttctaattccagctcttcaactaggcagttaaacttctttggttaagtcatttacatatttggtacatcatgtactcatctctgaaatgagtgagctaaatgaaacaaatcttgatttccactttcccttctctaaacatccttctgtgtactgtattttaaaaggcaccatctgtattttaccacattgttctagccaaaaacttaggcatcatccttgtttccttctttgctgtacctaccctctttccttctgtatattccattagcaagtcttctacaacattccccaaatctgtctacttgagtccatcccttgcctggattactgcagtagcctccacatgtactttcccgtaaaacgttttccacatggcaatcagagccatcttttaaaaatagaaatcagactttgttattcctctgcttaaaacctcctcctaggactttacattgcactgagaatcagagctcctcaccagggcccaaaagggacaccgtgacctggggactcctgctggcttcttcagtcacatctaccattccctgccttctccctgtagcccagcacaggcctcctctgtcactccagtcggccaagtcagtgcccacctcgaggcctttgttccagcctagccgttctctgtgcctggtgtgccctgctcccagttttgctctaataagtggctccctctggtaatttaggtgtcaggcctccttgatgaggcctgcctgatcaaattagccacctcccaagtcactttctgcaacattatcctgttttgtttcttgcacagcatttaacactatctggaattatcctccgcacttgattggacttgttacttgacaagcgaatttcccttctctagactgtaagctctttcagaagtagggcagctttaactgcctggtttatcctgcatccccagaccccaggacagtgcctgtcccatcaataattatgtgttgagcagatgcatttatggaccagatcatcacagaggattttgaaattgaaaaaattacttaattaaatgaaatgtttaaaattaattttttgggattctgaagggaacttttatgattaaatttctgtgtactacaggttgcctattgtgtagtcatgttttagtaaaagttcttttcctgaggcaggaccatttcagatgggaaagataagttttctgtgctctagggacagtctcctgtctgccttgaacacattagacagatgaccttaatgatcggaagagatgcattggaaatacattcctttccctcatcagcagtgcttttgcattagcattgagcagggtttgactttcttggtgatacagaaggtgcaagaagcttagtatcatgtggtttgacatttaatcagacttgctttccttgttaacctaaaggccttcctcttctttggaatttaatgtgtcagtaatggctcctagagctggaacagatggagctgttgatgttctcacttaaacgaaaaaaaacatgatttatatcctcagcttcatttcttaaattcttgttgaactttcatttgattgtcagagccacataaccagaatgtcactaaatttgctttcgcggcattaccatctacttttgctttttaagcagttttggaaatgtgatgtagtataggaacatgagtacatgtttttaaacatgtattattcggagttaatgattcactgctgctgaaggagtagtttctgtgtgaaggcaatggttatttttttcattaaatattctcatcagaagttaatatgtttttcttctcttattctggacttgtcttataaaaaatacatgtactcgtatagctgccaatgagacaagtgttgacattttggtttcttttgttatggttttattgttgttattgctaatgaatgatttttgaagcaaatatgtactttcaagcaaatatgtgcaaatatgaagttggaagatgatattttctcttaaaagcattttaccattttcacattgccatgcccttagctttcagggtgttttcttgagtcattattttcttttgttgattctttaaaatgtaccaatggtgagtgtgaattcatagtatgaaaaatgtgggtgatagactatgattagacatagttcaagataatagtttatatgaaaaattgatgctctaaagcatttgctaccaaaatttgtttttttgtgtgtgtgttacctttactcttctccctgggtccacttaatggttctgtatttttttggagagccaaatatgtcttgaaggtagtcggggagagggaggaggagcaacatgaaatgagtgtgctgttttatcagaagccacttattcacagggcctgaagtgatagctgttgggagaagtgatattcatactgatgggggtaaaactgcctactcattttggggagcttttgttttcataataaaaattgtttgtacaaataaaggatgttctaaaggagaggactatttgcaattgagtgttttctattctggcagcatccgattgaaaatcatttcagaaattcttagtattgcatgcaatcattgtttagtagctagatctttttaactttatgatagaattgtgcatttcatttctgttttaagtcctatccatgtatttaagtagtgtaataaattattttcttgccagcagggtgacttgagtgaaaaaatatgtataatttggccaatagcctaattctgtgacctctacaatccaaatggatgccgtggcttttactttggttacatttcaaatgactttaattggcctgaaattctattagtatgattgattcaggatacccattcaaagtcatctcatttgtctgtgtcatttgtcatggatcaaatctctgggcaaagcagtcattgaaccttggttaaacctcagactgtgtccgtctgtcaattttataaatgattgggaggaaggcactcttgtgagttctggatcagtagtgatataattctgtttctgttttttgcttttttaaatctactgctacataataaaccactccaaaacttggtgccttaaaataaccattttaccttggtcatgattttgtgggttaggaattaagaaagggctcagctgggcagtttgtctctgatccacatggtgtcagctgaggaatctggggataggggatccacttttgagatctcagactcagatgtctggtgccttgactggggtgcgtggctctgggcagggggcttagctggggcccagcatgtggtctctccatgtggcttaggtttctttcagcatgggagctgggtttcccaaaatgtgaggatggaagcttcaaggctgaaggtttctcaggatgtagactcataagtcccagaacaccagttctcctgcttattggtcaagtaagtcactaaattcaacccagacttggggtcaggagggggtcagggaggggagtagcattatccttcacttttcattgggagaagaaacaaaggatttgaggccatcattaatggctagtgatgagatcacatcagaatagcatttatttaatagcaatttattactctcctgaggttcaggtggcttaaagtgcaaatattagtaggtagttccatgtaagggaatcccattccaagtggcacagccttcatttagacaaaactctgatgtaattcattctagtcatttgatggatggagactctaaaagtggcatgaatataatctcaaaatatctagaaagatgtcagtcctctgagtcattgtgcaaactagtttgttgagagagttcaaaggcatcatggatcttaacagctagaaaagattctaagagattacatcatcattatcaccttctggaaagatttattgagcatctgttaggtgccaggccctgggaatacagaagagaatatgactgattcttgccgttgagacatagttgaggacatagaattgatacacaagagatgaatagaaatccatggaatatagactaactggtaaataaaagtacaggtgataagagcacaagaaggagaagtaatcaatagaggcttagctaggggctgggaaaggctgtagggactttccgtcactccgaaaacatgaagtccaaagtggtggccattacctacaagtccctttgagatctggatccctgtatcctctctgatcccctttgctacctctcttttcctcactcactggccttcttccatggaagtataggcatttgaggatctttgccacttgctcattcctctgcctggaatgctctttttccagatattcccatagtttgctttctcacttccatcagatctctggtcaactgtgctctccaccagccttctctgaccactctatctacttcctgttcatcaacacatttatctccatgaagccagggcattgtctgccttattaattattgtatcctgagcacctagagtagtgcctggcatcattggtgcccaacaaaatatggttgaatgtatgaatgagtaaatgaatgcagaatcttgaaacagggtgtgctttttgggctgatagaacaaagtagtgtaaactgggtagcttataaacaatagaaatttaattcccacagttctagaagctgggaagtccaagatcaaggcaccagcagattaggtgtctggtgagggcccatttcctggttcatagacggtaccttgttgtgtcttcacatggtaggagggtcaagatagctctctcgggcttcttttatatgggtaccaatcttgttcatgaaggctctgccaaaggtaagatttagcaaagtggagaatagatgatattgctggatgcctgcaaggcagagtgaaagagaagcagaaagttacataatatattcatagatcatgtgcatcagctctctgacaccaggggtccttattttacaactctgagtcctgcaaaccattttgcgaatatgtaagcattgtaatagggcttgcacaggaagtgatttatttttttctttatttttaacttttattataggtttggcaatacatatgaaggtttgttaggtaggtaaacatgtgtcacagaggtttgttgtacagattatttcatcacccaggtattaagcccagtacccagtagttatcttttctgctcctctccctcttcctaccctctcccctcaagtagacccgagtatctattgtttccttctttgtattcatatgttcttaccattcagctcccactaaaaagtgagaacatgcagtatttggttttctgttcctgagttagtctgctaagggtaattagccttcagctctatccatattcccacaaaagacatgatcttattcttttttatggctgtgtagtattccatggtgcatatgtaccacattttttaaatccagtttgtcattgatgggcgtttaagttgattccatgtctttgctgttgtgaatagtgcttcggtgaacattcatgtgtgtgtgtctttatggttggatgatttatattcgtctggctatatacccagtaatgggattgctgggtcgaatggtagttctgcttttaggtctttgagccatagtactttccacaagtggttcattttaactagaatagctggttcatgactggtggcagttattggagaacttgcctttcttgaaaaatattctgtactataccatttctttgtcttttctcctgctcatatttctgtctggaatatccagctttttgtattgacctgttgaaattccacatgaatgttccaaaatatagtgacttaaaaccacagtttattatttctcacaatttggtgtgttggctgggttcagctgagtggttttctgttccatgtggtggtgtctgctagcatcactaatacagcagatgttttcagtttcagaacttggctggactagaatgcccaagaaagctttactctcatgtttcctgttggctgtgcactagagttccttagttttcctccataatatctcatttcccctggtatctagaccagccaccttacagcatggtggctgggttccaagtgtgagaataaggaagcttttacttcattttccttttccttttttttttttttttttgagacggagtcttgctctgttgcccaggctggagtgcagtggcacaatcttggctcactgcaacctctgcctcctgggttcaagcgattctccttcctcagcctccctagtagctgagattacaggtgcacaccaccacactggctaaattctgtatttttagtagagatggggtttcaccatgttggccaggctggtctcgaactcttgacctcaggtgatccacccaccttggcctcccaaagggctgggattacaggcgtgaaccaccatgcctggccagcttctatttctcttgaagcctagatctagaactggcacatcagtttcatcacatcctattggtcaaaatgagtcacaaggccagcccaaattcaaagggaggggaagtaaatgccccttcttgatgggatagttgggatgcgcagacagggataggaagaatgattagtggtgaagtttgctgacagtcctcctcagtatgcttagatatttgttagcattatcttttcagtaaaagataggtattattagtgaagtccaaggcctttgagtattatttgaaccctttggttttgagctatgaattgtttatagagtgaattgcttgaacattttgggctttattgagccacagctgaagatgatcattgattgactgcccccctccaccccaccctcccacccccgcctttttttttttttttttttgctttacttgccattcatattgtgttgtacatgttcctctgggtatattagaggttgaaatcaaaagccaaaggaatctgaagggggtcctcagctcttctctgggtcttactgtaacctagagcaagtgactccatcagcaggacaagtaaactcaggaaaagaagcaaaaaggaaacaagccagttgctctgggctgagataatgttaaatggcagagggaagcttgagttactcaactgctgcttggcttccatcttcactgtccttgtttctctgattcaattcttgcttcctacagttgatttcccacataggcaagcagagggatcttttaaaaatgtaagtcagatcatgttattctccagcttaaaaacccgaggggggatttcattgtacttgtaataaaatccagactcctcatcataaattagctcccactcttgcctctttacctcttctcttactcttctcccctccctctttatcagccacattttatttctttctgttccttgagcccttgaggttcattctgccaaattcatcccattttaggggttttgtacttgctgttccctctctctggaacactctgaccctagatctttgtgtggctggttcttcattcaagcctcagcccagaggacctcataaaaaccttttgtaccctcctagactcttttttttttttttctggagacagagtctcactctgtcccccaggttggagtgcagtggcacaatctcagctcactgcaacctccacctccccagttcaagtgattcttgtgcctcagcctcctgagtagttgggattacaggcgtgagccaccactcctggctaatttttgtatttttagtagaattggggtttcaccatgttggccaagctgctcttgaactcctgacctcaggtgatctgcccacctcggtctcccaaagtgctgggattacaggcatgagccaccacacctggtctcctagactcttaacagtgcactagacactcgccctctcacagttcctatgttctgtttttttctagcactgactgttctttttctctattttctcatgtataaaggtggggttaatgaaagaggtacatacttcgtagagttgttaagaggattaaactagttactatttagaagagtatctggagcatgatattgctctcaaatatagctttattgttatatcattctttactacctgaaattgtcctgcttagttatatgctagtttattgtctttcacttattgctagtgtcagccttttgcaagcaaggacagcatttacatatcttttttacagctcatccgtattcctagtgtgttgtcatacacagtaggtccttgacaagtactcgtaaagtcaataaatgaaaggcaggaatatttattttgaacaggccagaaaaaacattagtaacattaaattaaagcttgcgaaagttgaatggattgtaaaagattgtttagttgttcaaaatgggttttggatttttgatccagaagcattctgttccaggacactgaaagaacccagggataattcattgttaatttttatttttatggaattttgaagagtgagaaattgttggaattatgaagacaggtaaatgacattctgattttcgagagtgaggaatgtgggcttaaaaactgtagactaggagctttatgctacttgtgggcagaattctagaatgggttattaaaaggatgatttgtgaatgcttaggacagtgttgtttagtgggaaagtggagcacccttagagaaaagaggcctggagaaatgaattgattttttttttcaggtgactactgagcttggtggcagaattgagaataaagactccctgacttcagaccagtgttctctctgttccagtagtgttttcaatctgggaccatagagctgctcaaattcaagcaaaatagaatcttttttgtgtgtgtctttattttgaagatcgtttttttttaaagccattttcaaaaacagtttttcagttggggtacattgacctctgaaagttctaggacacagtctcaggagcccatgagatttagttctccttcccaccacttcaaaagaggtctgtgcggtactctaggttcagaaacttggcaccatgatattttgccagtttatcttattaactgaatgctgtctgtagtgactctgcagaaaacagtgttatgttcttctgtcagacttgtgctgttcaatatggttgcacgtagctatgtgtggccattgagcgtgaaaatgtgactcctgtaagttgattatagactaccatgtaatatagtcacccctcagtgtccgaggggtattggttccaggaccccctgcacataccaaaatccacagatgctcaagttcctcatataaaaatggcatcgtatttttatgtgatctacatacagcctcctgtatactttaaatcatctctggataatttataatacctaatacaatataaatgctttgtaaatagttgttatattgtttgtttgttttcttaacgttttttttaatggttgtattgttattgtttatttaaaaaatattttcaattcaaggttggctgaatctgcatatacagaacctggggatacagagggctgactatatcatacacattagatttcaaagacttagtatgaaaaaataatgtaaatatctcatgatttattttgaatatctgttgaaatgatatttttgatatattgggttacataaaatatattaaaattaatttcatctggcttttcctttttaaaacgtggctactagacaatttaaaattatatatgtgactggcattcattagaacttgacacctctctcaggaggaaaggtggaaggaactggtggatatcactgtgcagatgaggtgatatgacagctgccttcagctctttggatggctctcattcgtaaaagagattctttctgttctgtgtttctcaaaaggtcgaacgaagacatagaaaaagcaagttaatgtaagatagacccttctaaaatagttgtccaaagaaaatataggctccttctagagataatgaattccttgtcactatacataattcaagaagaggctaaatagctgcttaatgaggttgtttagagggagatcaggtggttaaaagtaatgcctttccaatcctgagaatttgtgacttgatgaaattgggcaaagggctgattttacagctacatgaaataaatggattccgtgggcaggagaagaaagcattttatttcactccctgtgcttttcctttaaactttcacatgagtattttccagttgaggagcttttgcattcttggttacagaaagatgtttgattgtctaatcccagggaatctggtgaacagtgtatcagttaggaatgtgcttggcaacaagtaaacaaacaaacaaaccaaagtgacaatggcaaataagtagagatttattttaatcctgtaacaagaactctggaggtcagctgcttctggcattgattcattggctcaaaggcatcagagcgagtgtctctgctattctcttggccttccttttcctcgtagtagcaaggcagtcacagctaccaacagcacatccgtaaggctggaagaggcacggaagttgctcagcccctactgcgtctgtcactttttcttgggaaaagaagtagtctttccagaaatcctcaacacaattcctcttctgattcattgggcagaattgtctcatggccactccttggtacaagggaggctgcaaagtgaatgtttgctcttctagactctacgattgagacaagacaggaggagaaggaggttgggaatggcatttgtgtcagccaaaaagaacagggtctgccgcagatagttttaggtgtgactgagggcaccactcccaagtcaaacatcaagtgcttgggagttgagacatcatccaatgtcctttttttattaaaaaaaaaattctttcactaagtggttttagctgccattgatgattgtagccttggatgagttttattaaacaattctttctttttagagaagaaaaaattgaggacccgagaagttaacgcctttgatttctattgaaattactcatagggtaagagtgagagttcttgctttgccctttccaccttcctgacttcatcagcaaagaagagaatcttggttttatttttcattatctgcaaatgatatgtccataacagtagttatttgtcacaaaaatacttcacaagaacattggtaaacacatacaaatgttagcagttctgaacaggcatttattgtagaggaacctgtttatgatgagaaatatgaaagaattgagacagtgggcctctaccatagaggagggaagaaactagttgggtgaaatttagtgttaggatgttttgtcaaaaaactatttttgggaggctgaggcaggaggatggtttgagcccaggagttccagaccagcctggacaacatggcaagattccatatctacaaaaataaataaatagaaatttaaaaaaatttttttcatctttagcattaatggcaaatatttagagctatatttaatggaagtatatgtgaattggtggtataaacagatttttccaaactctttttacttgtaatttctgtggctgtaacaacttttactagcctcttaggagtttcttaaatcctttttccccattttctttggtctatgataaagaagtaatctgaagtagaaaaaaattatttaggctgggcacagtggctcatgcctgtaatcccagcactttgagaggctgaggcggggggatcgcttgaggtcaggagttcgagattagcttggccaacatggtgaaatacaaaaatacaaaaattagccaggcgtagtggcagatgcctgtaatccaagctactcgggaggctgaggcatgagaatcgcttgaatccaggaggcggaggttgcagtgagctgagattgtgccactgcactctagcctgtgtgacagagcaagactccacctcaaaaaaaaaaaaaaggaaaaaaattacttagatgagctaatttttgaagatggtcttataaagtttattttttattaatacactttattttttagagcagttttagattcccagcaatattgggtggaaagtatgaagaattgctatatactcccttcccctgcagatgcacagctcctcccactgtctacagttcccaggagaggtgtgacatttgttatcattgatgaacttatattgacacatcgttattacccaaagtccatagtttaccttagggttcattcttgatattgtacatcctatgggttgggacaaatatataacgacatgtatccacatttatggaatcatacagagtattttcactgccctaaaaattctctgtgctcttgattgttcatccctccttccacacaacccctagaaaccactgattgttttactatcgccatagttttgcgtttctagactactatatcgttggaatcatgtagtgtgtggcctttgcagattggcttcttttacttggcaatatgcattgaagttccccccatgttttttcatgacttaatagctcgtttccttttagtgctgaataatatcccattgtctggatatcaccgtttatttatccattcacctactgaaggatatcttgaatgctccaagttttggcaattatgaataaagctgcttataaacatctatgtgcaggttcctgtgtggacatgcattttcagttcatttaggtaaatatcaagaagcatgactgctggatcatattttaagaatatgtttagttttgtgaagaattaccaaactgtcttccaaagtggctataccattttgtgttcctaccagcaataaatgagagttcctgttgcatcacactataccagcatttggtgttgtcagagttttggattgtgaccgtctaatgggtgtatagtggtatctcattgtgttttaatttgtgtttccttaatgatatatgatgttgaacatcttttcacatacttacttgccatctgtatatcttctttggtgagatatctgtacaggtctttggccattttttaaatcaagttgttcattttcttgttgaattttaagagttctttgtctatttttggtaacagccctttatcatatgtgtcctctgcaaatattttttctagtctaactcatcttctcattctcttgacagtgcctttcacagagcacactttttaattttaatgaaatctagcttatcaattatttctttcatggatttctgcctttggtgttatacctaaaaagtcatcaccatacccataataacctagattttctcctatgttatcttccaggaattttaaagttttgtgttttacatttaggtctgtgatctatttttaatttttttagagtttcgctctgttgcctaggctggagtgcagtggcatgatcttggcttactacaacctccgcctcctggggtttaagcaattctcctgcctcagcctctcaagtagctgggactacaggcatgcaccaccacatctgggtaatttttgtatttttagtagagatgggatttcaccatgttggccaggcaggtctcaaactcctgacctcaagtgatccacccaccttgggctccccaagtgttaggattacaggtatgagccgccgcacccttcctgtgatctattttgagttaacttttatgaagggtctaacatctgtgcctggattctttttgtttttttgcacgtggatgttcagttgttccagcaccatttgttgaacggactgtctttgccccattgtattgcttttgctccattgtcaaagatcacttaactttgtttatgtgagtttagttttgggttctctgttctattccattcatctatttgtctgttcttctaccgatatcacactctcttgatgactgtagctgtacattaagccgtaaagtcaggtagtggcagtccttaaactttgtcctttaacattgagttggctgttctgggtcttttgcctctatatataaactttagaatcagtttgccagtatccacaaaatagtgtgctgggatttttgttgggattgcattgaatctatgaagttgagaatagctgacattttgacagtgttgagtccatgaacatgggatatctgtttattcaattcttctttggtttctttcaccagttttgtggttttcctcatatagatcttgtacgtattttattagatttatacctaagcattttgatctttgggggggtgctaatgtaaatggtaatgtgtttttaatttttaatttcacttggtcattgctggtatatggggaggtaattgacttttgtatattaaacttttattctgaatcttcttataattgcttattagttccaggaatttcttgtttattcttttggaattttctacatagacaatcatgtcatctgtgaagaagacagttttgtgtcttccttcttaatctacataccttttgtttctttttcttgtcttattgcaccagttatgacttccaatttgatcttgaaaagcagtggtaataacggacatccttgcctggttcctggtcttagtgggaaagtctcaattttctctctttttttttttttgagacacggtctggctctgtcacccaggctggagtgcagtggtgtgaacatggctcactgcagccttgatctcatgggctgaagtaatcctgccacttcagtcttccaagtagcttgaaatacagatgtgcaccaccatgcctgactaatttttgtattttttgtagagatggggttttgtcatgttgcccaggctggtcttgaactcctaggctctagcaatcttcttgcctcagcctcccaaagtgctgggattacaggtgtgggtcactgtgcctggctgactttctcactgttaagtatgatgttagctgcagggtttttaaaaatatgttttttatcaagttgaggagattcccttctattcctagtttgatgaaagtttttattatgaataggtggtgagttttgtcaaatgatatgatcatgtgatttttctaattaagtctgttgatgtgatggattagattacatttattgattttgtatgttgaaccagccttgcataattgggataaatcccacttggtcatggtgtataattctttttatacatttttagatttgatttgctaatacttttttgaggatttttgcgtttatgttcaagagagacattggtccatagttttcttttcttgtaatgtctttggtgttggtattagggtgatgctgacttcatagaatgagttaggaagtatttccactgcttctagtttctgaaagatattgcagagaattgttacaatttcttccttaaatgtttgatagaatttatcagtgaactcacctgggcttggtactttctattttaaaggttattaaatattgattcaaatgtttaatagatgcaggccaacttagattgtttatttttgtgtgtgagtattggcagattgtgtttttcaatgaattgttccttttcaggtatgttatcaaatttgtgggcataaagttgtttataaaacttctttatccttttaatgttcatgggatctgtaatgatgttctctttttcatttctgatattagtaatttgtattctgtctccttttttcttagcctgtctagatgcttactgatttcatctatcttttcaaagagcaaacattgctttattgattttttccattgatttcttgtgttctctttcgttaatttctgctctaatttttatacttttttttgcttttgcttactttggatttaatttgcttttctttttctagtttctaaaggggaaaacttgggttgttgatcttaggtctttcttctttcctaatttttgcatccaaatcctatgcatttccctttgctttagctagaaactacaaattttgataagttgtttccatttttatttagttcaaaatatttttttaaattatcttgagaattctcttacccctatgttacttagaagtgtattgttttatctccaagtactttggaattttccagctatgtttttgttattaattttttatttaagtccattgtgatctgacagcagattttatatggtttctatatttttaaatttattagagtgtgttttatggcctaaaatgtggtctatcatggtgaatagtccacatgagcttgagaaaaatgtgtaatctgctgttgtttgatggaatagtctatagatgtcatttacatacaattgattgatgttgagtttatgtccttcctgattttttgcctgctagatatgcctatttctgagggatgctaagcctccaaatgtaatagtggattcacctcttttttcttacagttctatcagttttacctcatgtattttaatgctctgttgttaggcacatacacactaatgattgttacgtattcttggaatattgacccctttatcattttgtaacgcctctctctatctctgataacctttcttgctctgtagtttgctatgtctgaaattactgtagctactcccacttgcttttgattattgttagtgtggtatagctttctccaaccatttaaatctacatatgtctttatatttaaagtggactttttgtagaccacatatgattgggttttgttttttgatctaccttgacaattcctgtttttcaattagtgtgtttagaccattggcatttgaggtgattgttagttgggtatatagttggatacctaccatatttgttattgtgttttatttgttgcccttgttttttgtttctatttttatcttccacacttttttgccttttatggtttattatttagtattaaatcattttacattattccattttctcttttgtaacatataaagtatacttgtttttaaaaattatttgtagaaatgaagtctcaactgtgttgcccaggcaggtctcaaactcatgggctcaaacagtcttcccatcttggcctcccaaagtgctgggattaacagatgtgagccaccatgctcctttttttgtttttttaaacttttttaaagtggtttccctagaagtttgctgtatatatttacaactcatccaagaccaatttcaaataactctgtactaatacatgggcagtgtatttcattataataatgaaatattcctaatttctccctcctgtcttatgctgtcattcatttcacttatacgttagtgtatataactatatgtgtatgcacatacacaaacacacacacatatatatatacacacacagccctccatatatgtgggctttgcctccatggagtcaaccaactgtggatcagaatatttgaaaaataagggataattgcatctgtactgcacatgtacagatgtttttctcttgtcattattttctaaacaatacagtataacaactatttgcatagtattaggtattataagtaatctagagatgatttaaagtacataagatgatgtatgtagattaaaagcaaataatgcatcattttatataagggacttgagcattcatggattttggtatccactgggggtggggccctgaagccaatctcccatggataataagggactactgtacacataagcatacataaccaaatacattgttgccattattattttgaacaaactttgatctgttagatcaattaaaaaaataaacatttttgttttacctccacttactccttcttgatgctcttgttttctttatgtagatcttatttctgacctaacattattttccttctctcaaaagaacttcttttaacatttcttgtaaggcaggtctactgccaacaaactctgtcaatttttgttagtctgagaaagtcgttatttctccatcagttttgaaggatagtttcacaaggtacaagaattctaagttggtgggttttttcttttcctctccacactaaatagttcactccactttgttcttgattatgtgatttctgagaaggcagatataatttttatctttgtttctctatagccaatttactttttttctctgatttctttcaggaatttttctttatcttttactttttgtagtttgaaacgatagcctaggtatagtttttgttggcatttatgctgcttggtattctctaagcttcctggatctgtggtttggtgtctggcattaatttgggggcaattctcagcctatattgtttcgtatattttttctgtttctttctttttctccatctagtatttccactatacctatgttaaaccttgtatacttgtcccacagttcttggatattctgtttttcagtctttcttctctttgcttatcagttttggaggtttctattgatacattcttaagctcagatattctctccttagctatgtccagtctactaataagcctaccaaagacgttcttcatttctgttacagtgtttttgatccttaacatttttttttcttaagatttctatttctttggttacattgcctatgtgtccttgcatgctgactatctattagagcccttaacaaattaaccatagttgttttaaattccctatctgataattccaacatccttgtcatgtctgtttctgatgcttggtctgtctcttcaaactgtgttgttttgccttttagtatgccttgtaattttttcttgatagctgggcatgaatatggggtaaagggatcactcttaagtaggcctttagtaatgtagtgatagaagtgtgggaggagaggaagtgaaaccatctttgcaaaaattatgaccatgagaaaaattttggcataggaaagttatggcagtgaaagaaatctaacctaactgactccatgttgcttctcacctccaagctgttcctattcattcctgggcataggccaaacaaaatataggaggaatttactttatagtttaattttgaagcaaagatgataacagccccttcctgagacaaaccccctctttgcttagggattagaccatctttgtaaaactgaaacgttagccacaagattagaaattctggctcaggagtcatgtagccagaggccacaagattcctaaacttcccaattgctcctatagataacatcactattgtaaaacctaagattggtgtttgaggtatttttctgaccctgcattctgatgaaccaaccagctggtgccacccagactggtaaactggctcatctggtcttttggcccgcacccaggaactgactcagtacaagaagacaaacttcgactccctatgatttcaacccaaccaatcagcattccctattcccgaccctgctgcctccaaattatccttgaagaaccatagcctctggatttttggaaaggcatatttgagtaataataagctcctgtcctcttgcttagctgcctctgggtttattaaactctttctctattgcaaaaacctgctgttcagtgcatcggctttgctgggcagtgggaatgatgaaactgcctggtgaatacagaagtgttctcttgtcctatgagtaggtctcagtctttgagtaagcctgtgcctctggactgtgaacttcacagtgtttctcaggttttatttcctcttaggtgggacagggtcgctagactcggctggaattatatgtttctgttcatcacatggaaggcttgagtgggctagagctgagaatttctcttccctccaggcccgttaggctgtgggaaaatccactgtcagatgaggctctggttaggtagcttctcctgaggacaggccttgttaggaagaccccagtgctctggcatatttcaaaatggttccttttccttctcctcctgctggaaagggatttttcttggggaagtttctgctccaggccgggtgcagtggctcacacctgtaatcccagcacttactttgggaggccgaggtgggtagattatttgagcccaggaattcgaggccagcctggataacatagagaaacccagtctctcctaaaaatacaaaaactagctgggtgtgtggtgcatgcctgtagtcccagctacttgggaggctgaggcgagaggatcccttgaacctaggaggtcaaggctgcagagagccctgatcgtgccactgcactccagcctgggtgacagagccagaccctgtctcaaaaaaaaaaaaaaaaaatttctgctccagtatgttgtgattctctgtatctgcctgtctgttgcttcaatttcagaggcatcagtttaccttgtgatctcacttttcttacagaactaagaagacttgttgatttttcagtttgttcagcctttttacttgttaggatggagtggcgacttttcagctccttaaatacagagctggaaaccagaagcctcttgacttttcattttttgcctttgaaaaaagtcaggtagttaatacttctctttcagggtgctgtttgaaaattctgttatgcaaaaacataatgtagataatttgtattcccaataaatgataaggcacattggatataattgttactgttttgtattttttagcatagttttagatgttttattttgctacaaaggaattttgagcagaagattgtgacatatatctgtaaagaacagacttattattattattattatcattattattattattttgagatggagtctcgctctgttgcccaggctggagtgcagtggcgcgatctcggctcactgcaagctccgcctcccgggttcacgccattctcctgcctcagcctcgcaagtagctgggacttcaggcacccgccaccacgcttggctaattttttgtatttttagtagaggcggggtttcatcgtgttagccaggatggtctcgatctcctgacctcgtgattcgcctgccttggcctcccaaagtgctgggattacaggcgtgagccaccacgcccggcccagacttattattttttatgttcatccccctgttaattatctttcactcacaatattccctttgcttttcctttttaccagtggtccagtatgggtatcagtggaacaatatatgtcttaagaataaagcaattttaaaccaccatgactagtagcagtgtttagctgagttctgttgcccagttgtcaccaactactgcatatactccctagatatacagttgcatgttctcacactgtcctgttttgaagaaaaaaatgtttttaaaaagtagaaattgaaccaaatgccattactgtctttattgacttgaaaggccctcattccacccaatcctgccctactcctcttaccccaattcctttgtgaactactttgggaaatgctgctggtggtggtgtgtgatgatatttgtaagagcatgaaaataaaaagctgggaatatataagagattcagattttgctgaagcagagaatttgacttgtggagtattgtaatgcaaaatttggtgcactgttaatggaaagcatttgctatattaaacagtaagggtctattgtaggttgagaagctggggagatttattttaccatttagcatgtagagaatttgaataggaaagtaggtgtgtatagagtgcctgtttgtcccattcattgttggggtttatatatacctttctctcttaatcctcaaaactccctgcctgtaatgtaggtattttccccattttgcagataaggaagctcagacacatgaacttttccaaggtctcaaagctagtacatcgtggggctgtattcaaacccagggctgacttcaagacctattattcttctactgaattaacctgaatgcttgcaaagtctgtggctctaattgtttctgtggctaattaatgttcatgaactggtgaagagtaaatagtttagttttttttttttttttttttttttcttgagatggagtttcacttttgtcaccctggctgagtgcaatggtgcaatctcgactttctgcaaccttcgcctcccaggttcaagcgattctcctgtctcagcctgccaagtagctgggattacaggcacccaccaccatgcccagctaatttttgtattttgattagagatggagtttcaccatatgggccaggctggcctcgaactcctgacctcaggtgatccacctgccttggcctcccaaagtgctgggattataggcataagccccagcacctggccaatagtttagttttttaatgactccctcaactttgttaggtctgtttatttgagagcatgtatttatttggggccataaatgtatttttacatttacctattttatttatctcaggtcttgctttttacattagagaaggaagctttactagtactctacttggaggggtacatctctttatcaggaaaggatcttattcagatatatacatacatacattgtatttatttataaatacaataataacactgaagtataaagaaccacaatttattacttttttcctcattttttttttctgctgtggagcttaccagctagaattctggttttggtagcaggaaagaacaagtggcaactttgtgaattgtggcatttgagattagacggatatacaagatggtgtactacagcactctaacagaagggaatagcactgttgtcaaagacattggaaggtctcttgtaactgaaagagccctctttggcatttggccgtctcagtttcacgataacaagacgaagcaggaaccttgaaattgctcctctttgtattccattcctggataattaccatctatactcagatttcgaaaggtccttttattttatgattgcatctttcagcaacaactattattatcctattatgcaatttgccttatttatgatgctcaggtgggaaaacgttcagactccacaattgaaaagatcgccctgattgagcattttgtggtgcttttgcttgttttgctgttgaacaaacaagagttcaagacaggtgaattttttccagatgtgcatttgaataattggacagatccctgtggtctcttcagtaataacacaagtgactgcttattgtcgccttcttcctccatgcctggcttcctgtggtcactctgcaaagggctctgtagttgcaagatgactccacagttaatattgagctcatgaggagtaaatagttcatccaagctgggaatctctgagcttcattaggtctgcttatttgggtaccagaacctgtcactatccaggagacacacagcagatcagctttcacttgctttgttaccattttaggcatgaaatagaacgattttctcccagaacatgatgtccctgtgaagtaataagtgatagcactttatgggctttaaggaatctagagccaggccagttagcaactgaagctgtagtaactcagctggacactgatgtccttttcctgaagttatatgagcagaggcatgtaagggaaatgtggctcggtgacccacagtgctcagtgcccagttcagtgacaggcagccaggagagctgagccatggagaggccagcaagccaaagggatttgctgccatgctgtgacatggaaggcagggtgcactcagcactgtattgatgacgttcttaagtctgaaggacttaatgcagtttctggatgtgcctcctcatcaccacacctgttcaagggggaaactgggacccaccccaagagtcagctctatagaagtttttcctgacaatactctctactcctggaggtagactgtgtttttctcctgtactctcctctaacacagaacttgcgtgttactatatgcaacttgtttatctgccccctggactgtgaacccttgaggacagggatattgtcttatcactctttgaattctcagtgctgggtacatattacgtgttcaatacatgtttgttaaataaatgaaacagtcacgtttggctcctttcttccacaaggcattctacccttccacggaaacaattatagcagcatggaaacaattacagcagctatctataattgataatcagaactaatgaaatatggtagcacaggcatgaatagagttgaaattatcagagtgattataaaatacataggaataaacttaacagaaattgggcaagacctttatgaagaactcttccaaacttaactaaggcacataaaagaacacttgaataaatagagaaacatgttcattggtgaaacgagtcaatgtagtaaatacgtcaatatcactttttgtccatattaacctaaaatttaatacagttccagcataagctgtaatgttatttttattctatgaaatttgataaaatacggtaaagttcagaaaaacattgcctgagactagtgaagaatgaaaaagaggggaaaattttatctcatcaagtattaaaacataaaatatagtaaatataaacaaaatggtagacaaactaagaaattggaagccagtataatctggataccaaaacttgacaaaggcactacaagaaaaagttatagccttaagcatagatgcaaaaatcatcaacaatatattaacaaatggaatccagcaaaacagaaaaaggataatatatcattaccaaatgggatttatcctggaaatacaagggtttagcatttgaaaatcaatgtaatttattgcatttattgaaataaaagagaaaataagagcatagctacaacaggaagtctagaagcaggcttgagtatacatggaaacctagtacaggttcacagtcctttatctgaaatgtttggggccagttatatttcaaaatttagggtttttagcagtatctcataatcaaattcatgtaaatttccacagcagaacagattaatacggacactaaatgggatgataaagaccagaaatagcctcacattagctcaggtcaagttttgccaccaaatgaatttaagcaccaaaccgcaaaaaacaaaagactctgttttcagagctttatgatttcagaatttcaggttaggaattatcaactctttaatgccagggtggcacatcaagtcagtgatgagatttgtaaaaggcattgggattacatactagtcatttagaggaagaaaaggataaagttaaattcctacttaatagcaatattgtttatgtttaaagattttatgttaaaaaactaaagaatctataaaagcacaaaatatatacttaatctttatttataatcttgtggtagcagagatctttgtaagcatgataccaatagcagaaactaaataaattttaaaaagagatcttacagccagccacggtggctcatgcctgtaattgcagcactttgggaggccaaggcgggcagatcacctgaggttggagtttgagaccagcctgaccaacatggagaaaccccatctctactaaaaatacagaattaccctggcgtggtggtgcatgtctgaaatcccagctactcgggaggctgaggcaggagaattgcttgaacctgggaggcagagattgcagtgagccgagattgcgccagtgcacttcagcctgggcaacaagagagagactccgtctcaaaaaaaaaaaaaaaaaatcttagattactaagcaaaaattacaaagaacaccataatattaaaaactaatgtcaatgtggagaaaatgttggctatatatatagtggccaaagggttattgcccatagtttataaagagctcttacaggttaataaataagagatgcattctccacgacaaaatcagaccaaagatatgaaaaggtaatttgcaagagaagaaatacaaatggccgctgaattctttactactactatatcactatcactactactagcaggtaccatttactgtttattgtctgccaagcactgggctagtatcatatcttgcttaagaaaatactatgagacaggtgcaattatttacattgtgcaatgaggacagtccaatttagggagctaaagcagcttgtcctagatcacacatttagcaaaactgttgcagcccagggctgtctgcctctgaaattcttgctcttcagtataacacggacctactgctcctatatatcagtatttgtataaaaagaaaattcagtgaaagcaaccagaagttaccatttgttttgcctattagattggcaacaattgaaaaggaatattcatagccagggaagatcagagtgtgaagcctgcactctcatatattgctgctggtagtgtcaactggcatgatttttctggaaggcactttggcaatatgtattgaaagctacattctttgatacagtctttctacttctaagaatttgtctgaaaggactaatttgataagtgcttatatgtaaacagtgttcatttcagtattgtttataaaagcaaaatgttgaaagaaacttgtccatcagtgaaagatgggttaaatgagttatgagagaattgaagatgtagagctatatttattatttaaacattgaccttcatttacttttttttttttttttttaatggagctttgccctgtcactctggctggagtgcagtggcacaatctcggctcactgcaacctccacctcccgggttcaagctattctcccacctcagcctcccaagtagctggaattacaggcacatgccaccacatctggctaatttttatatttttagtagagacggggtttcaccatgttggccaggctggtctccaactcctgacctctcaactgatctgcctgccttggcctcccaaagtgctgggattataggtgtgagccactgcacccggctgaccctcatttgctattggatggaaaaataaaataaaacaaagcatgttgcaaaacagttttgtggtgcaactttatatttgaaaaactccaagtcatatacacatatgccaagaaaaaagtctggggaggctgtgaaacacagtattgacagtggtataattattagtgttttatttttttcttcatatttttctgcagtatttattggtttatttttgctctatacatagactccagttgaaaaaagtatttaaaaatatatactataattttctcagactgatagaacatctcaacttgaagattaagcacagaatttggggatgttcatccagatctgtatatttactttgcttttgttagggagtatgtaggtacttcctgtacttatattttactttttgaaagttggcacaggcatgtgctcacacatacattatttcccacatgttagtccaagaattgccaggcttctatttcaatgactgtgtttaaagtaatagtttgccagcgacttggtttacatatccaatcagtgtgaaagttatgtatccttctccatagatacaaggaagtcctctttgcccaatcagtagatcaagaaggcgaacaccttcttaattacaaatgaggttttaaaaagttggcttaacaaatatagctatgtttgcttaacaaatatagccatatagcttaacgagtatagctaaggagacctacctgaggattcttctggtttagaaaagaattatttctgatagggagacaatcatgttgggtgtattttaaaatgcttgatataatcttcaaaatttattatgaaacagtgaaatctggccgagtgtggtggctcacgcctgtaatcccagcactttgggaggctgaggcaggcagatcacctgaggtcgggagttcgagaccagattgaccaacatggagaaactccatctctactaaaaatataaaattagccaggcatggtgatgggtgcctgtaatcccagctacttgggaggctgaggcaggagaatcgcttgaacgcaggaggtggaggttgcggtgagccgagatggcaccattgcactccagcctgggcgacaagagtgaaattccgtctcaagaaaaaaaaaaaaaagaaagaaagaaacagtgaaatctagtattttatatgacatgagcaatttgcacagtgactttgaacattatcctgaccatcaaagaacattatttaataagaattgtggactaagtaactttagtgtgcattttcagtgtctctaaagatttgggcgcagagttatgagctccatttggttgaactggtagttttagaaacagatttttaaattacttaccaaatgtaaaaggaaaacacttgtattgaaaacactggttgcagatcgttctaaaggccatttgggacaacagaacaaggcaacatctcagagaaaatggttagtaatgggctcttagagatggtgtcttaatgcagtagttattttgaattatctttaaaatggttttttgaccctgttcttctgttttgacattctcctttgaaggcatacaagttatactgatgatatttgaatagtggaactcttgtgtagcagttaagagggtgcattttagagtcagacagacctgggttaaaatccaggctctaccacttagtcgttttttgagctttggcaagtcactctagtctctctaagctttagtttcttcatttcaaaagtacagacctgacagagttgttgagaggattaaatgacataatttttgtaaagagcataactgcctggcagattaaatgttcagtaagtggttgctcttttttcataagtagtccaatttcttttagaagattttcataataatatgtagtgtaatggaaagaatgcacactgtcttgtctaatagacccagatttgaacactggttctgcccttaacaacctcctaaccttgggcaaatcattctgctctgtgcctcaattttcttccccaagaaatggagtcataatgctgacctttttaggggttgtaaggatttgaagtgatataggctaagtgtcaaactctatgcctggaggaaagtcagtattcaatgaatggttactatcattattgttataaagctaataaatatcaaagaacatgttaaggcttttaatatttttcctcttctcttttttatctttagttgtaattctttaagaaattgggtacacatagctaagactgtgcagtataagaaaagtgttaataagttatataaaaatgtattctaatactacatttggtaaacaaagaataagaatctgtaggtagggattatatgagtggagaaggatgtgtacttagggcttggctttggggtgcgtgtcagagactagtgtatgaggaagaagaagcaggaaaaggcagtgtttcatttctcacaatcgcccctctcaccagccacactgaagaggtgatgtcatgggcctctgatgctgtgcttgcccccatcacccagccgtctggaatagctgctggaggtgcccagtgtgccagcactgaaggaaggcctggctgcttggcaagcattggtgatgctgtgacattgagttcctggggaggctgcctgctcaggtggactgccacatgctgtatgtcttgcttcatatttgcacaatatggtgcttgatgtgattcattcatccattcatccatcctttgtttttttttttttttgaggcagcatctcactctgtcacccaggctagactgcagtggtgatcaaggcccactgcagcctcaatctcctaggctcaatcgatcctacaccacagccttctgagaagctgttactacaggcatgcgctaccacaccctgctaaatttttatattttttgaggagacagggttttgccatgttgcccaggctggtctcaaactcctgggctcaggccatctgtctacctcagcctcccaaggtgctcggattacaggcgtgagccacctgcctggcctgtccatccttttttcccttcctccctccttcccttcctttctttttttcccttcttgtcttcctccctcactttcttttatccagccatccgtctgttcatcagtccatccatctgtccatccatcccatccatccgtccatccatccatccatccgtccatccatcttctaggtcctaggtatagtagtaaaatagtcaaagtcccttccctcaaggagcttacattttagagattcaaagcattttcaaatgtattatttcatttgctttttaaaacaagtatgtgaattttgaattttttagtattttcatttgctagatgaggaaacaaaaatattttgagattaaatgacttacttgggataataatgctatgaataaaacccattattttttatttagaactcttttatctataccacttttgtattctaaacaagtttttcattaatgaaacatgttttcacactgtgtttttctcaatacttcaatcataggtagccaagggaattttaaagaacattaagtgcactcaactgagctgctttaacctttcaatatgttcccgctgctcttagaatgagatttgaaatccagaacaccactgcatcatcaggccagtgcttccttcccagctctgtctccggaccccgtccctcgtattgcctgtcttctgcaaatgctagccttctttcctgacctcagaggtattgtgttctttccagcttcagccctttgtatgcactgttccctcagcttggaatcctcttctctgtttccctccttgtccgtcttccccctatcttcaccaagctaatcccactcaactcacagatctcagctttcatgccacttcctaggggaggccttcctcatccccctgccaaggttaggtccctgtaccatatgtgctttctcatagcaccctgtgattttccttaatgactcacctatcacaatccaggattttgttgactgtctgcctccccttcctgtaaaggttagagggtaagctccatgggggcagaacactagttatgtcattttcaccgctgtttccctggctagcactgggcctcctgtaggccctccaaaatatgcaaataaatgaatgaacaaacaccctggcagcatggaaacccagagcggcacaagcgagttcaaatgcttatggtttgttccatctcacttccctctaggatgtgattttagcagtgtaggcagcttacgaaatggggcaggtttcttgtgttttactaatgtgtaaataaagatagagtaactcttaagatatggaaagtttgtaaagtggcagcaaaaagtgacaaggtgtggggatccaaatacagagcctagggaaaatagaataaaccaagttgtttttatgtctcttttccattagactgtgagcaagctgaagtcgagtcccagaacttatttatgtttatatcctcaaagagactatagtgcctggttcatcgtagctgtggaataaatgttgaatgaatgaatgatacacctcttacctttgaagctgacttcttgtgttcttcatgctgacattagaaataggaaaagtcagtcgagtacagtagttcaagcctgtaatcccagcactttgggagaccaaggcgagaagatcgcttgaagccaagagtttgagcccagcctgggtgacaaagtgagaccccatctctacaaaaagaaagaaaagaaagaaattggaaccgtattatttgtagaaaaaatactagatctagaaccagagacacctaggttaaaactgatttaaaatgagaataattattcctaccaagtggagttgttgggagggtggtatacatatagatggtgtatataaagtgcatagcaagctggttgtggtggctcaggcctgtatttccatctagtaggaggccgaggtgggatgatcccttgaaccctggaggcggaggttgcagtgagctgagatcacgccactgcactccagcctgggcaatagagggagactctgtctcaaaaagaagtgcatagcaagcaccaggcacatctaacagctcctcagaacatttaagctcccctttttttgcttctttccctttggtataattttagaaagacttttggggagcatgacatataaatcattaaaaaagagagagcctcaaagcagaatcatggcaattgagctagatttgtatttatcaaagcaagcatgatgctgggatgcttaaataacagtacagtacattgcaaaggaactagggaataatgttcctattatttttgtccatggtcagcctattactagaaaagagtgaccacattgatttctaaagtccttatattcaaaactttctgtgctgaccaccatcatttatgtttttcccatctctacttaaaaacgtcaactagccccaacttttcctctagttatttcttttattagatttattctgttctccacaataaaatctatcttctgttcccatccatgacaattcaagtagttataatgggtggatatagggtatgataaatgttggtaaatccactgagttccttgagttccacattgatgtcttttaggatgtgactaggggtaggctaaatattttctagtttctcagatcctacccctggtctaattatgatatagaggccagattagtgtcaccagtttttctttctcttctgaatgtagagcaagagcaaatgattgcagataacagcatgagaaacttaggatcaaccaccagcatctaagtgagtcttgtactaggctcattccagttaaaagctgtaaatcatttcatagccacatcagtttagttctcttttatagaactcattatgtgatacaaaatatgcaaggcactggagatacaaatacaattatttcctcaaggaactttgagttgagcaaacatggtactgtctggtgagaccagacatatgagcaaacatagtacttctctggtgagaccacatagagaaatgtacaaggggtagaggaggcagtgatgactactggtctgggatagttgagggaaggtggcataggctgcctattgaagaataaattagagtttgctatgtgaacaaggttgcagagggaatagtatatggaaaaacagggagatgtggacccatatattttgtgcagagatgtccaagtacttagatattactatattgcaagtatgaagaaagctttttttgagatctgacaatgccaaggtaggttatggactctctttggagtccccaaaataaaaataaaacattcacatctgctaaagatagcttgaatggtatttttgctaaaggcagagtcatatactgtatgtgccagataaaagtcaatgtctattatgtaaacattgagattacattaattaatttaaaagaaaggattcaaacttagtactaatctgcatctggagaactaatctggtatgtgttattttcaagtcacccaactaaagcagtctgttgtatggaactctgctccctcttagtcaaacaaatgcaaccataaaaagcagtgcaaattcagtgtcaccttttctccatgggattgggtggtttcttttggagcagagagagtttccagagaatcaatatagtagccagaagaaaagtggagggtggccttaccttgtccactccgtgctgcctgagggtgaaatggaacctcggatgttgtacacctttaaattgtccatgttgcctgtttcatagccttcccgggccagggagctgtgtagtcagtttatagttctaagaaccagagcaggactgctgtgcttgtaattgcatgctttttatggaacaggcaatgttgtttagggaatttgggcagctggaacctgccacattagcaatttggactgaggaagaatttcagggtgataaaataaagctcattatataaattcacttgggtatttaggaggctgagaagggagaggatgagagtattccaaaggcaagcaggagagtttcataaacaggtccctttctattcgtttttactgtaagtgttgaattgagctaggaggatcacatggcccattttgcaaagggcagtcatgttctgctgtttcttagctgttttgtcagttggaacaaaacaacagcgctgctcattttttgcagggttagaggaaaaaggaaggactggccgaagaatggggtggggagctggagaagagaagggccaaaagtgtcagactgtggggatgaggacctgaaggaggcccatgagacctcaggcatgggccctggaactctgcctttttgaagcctgttgacaatctcaccctaatttaaccctttgtggaattcttccatgagatgcagttgccatcatcaggcttcctagagaattgagcctgcccactctgttatgaagtctacccagaagagctggcagagtaggccccttcactgggactgcagcaacactgaccaaagcaaatccttctcttggaagaaacaaactcattcctcacacctgcctcaccccgctcccaccgccaccccctgcaccacacgccagcccttaataaaaactaaaactgatgtcattgtaacctttggttattcttttttgtgcgtaaagtgtcaacctcctgttttattctcataaataatggaaatcttaacttcatttcagaaaatcacaaaagataacagggaccctattcaaacagaataaaaataattagtaagtcacaaactctgactagaaagaaaaagagaagagagagagggaaggagaaagaaagaaggaaagagagggagagagagaaacgaggaaaggaaggaaggaagaaagtgaaagaagaaagtcctcttgttggtgttaaaatgtgtctttaaggggaaacttatcatttaggttactaatggtttctttcttcatcattttaatttccattaataaaatgtgactttgaaaggatgcagggagtttgggaatagagagttttatttttatttgtttattttttttccccttctcccagcaaaatacacaggtatctgactatgtagagacacgaagccacctatcctgaccaaacttggcagtggtcaggggataggaggaagtgtagtgccatgggatgggcaccagccctgatgaactcgactttctttccatttctctcctgcatccaaatgttgaggagactttgagtagtagtgtagcctcttttccttttaaaaatctgcaccctgcttatttccaatacagatatgaggttggtacccactaatcttaacaggatatatatatatatatctaaagtatataacatattatttaaaaactaatgtattatttaggttttattaaattatcctgtttttaggctatgctgatgggctaaatttgcctaaactcctgagatttagattctcatttattggcattagaggagttcctaaaaaaaaaaagctattaagattaaatatcataaaaatctttctaggaaaatataatcaaaagcatcaaggctgtctcctacagttagtggtttctattattttggttctcagagctatgacaatgtcactggatttcaagaattcagaaagacaaaaagaaaactcataattttgaaatggggaaagggaaagatcttggacatagtcttctgtttttaaaatagtcattctcattttaaaataggaaaaaaattatttttcatttaacaaagcaaaaaacccagtctgtacttttaaattaatgcaaacatcaatattttatagggagaacattaataatcattgtggagcccattaatcacaattctgcttttgatttattgtaaatatgcctcccattttcctcctcattaccaatcaccttctttaattataagagggctttcattaaaacttttgaatcatttattttggagcacctaactttagaagacatttattgatttttatagcataaaatacaaatgtttttattttagaaaacatcataaactaaaactttattggaggagtttggctaaagattcaaaaatatatagaagtaaaaatatatttaaaactgcacagtttttacaacagcatgtatggcatttggattcagaattttaactagcagtaacctcatctgtttagtaatgaattttaaaatagaaaaaaaatctgccaaaacagaccagttgtttattagctatttaactttgatgagctgaaatgagatagtgaagcagaataattagaacaactttttttctcaacatctaaatatttctctttttcattaacatttcagttaagtttgaagaaattccaaaaatgagattctcattaactaaaaggaattctaagggttataagccatctacattttttctatgacctgaagactttttttcgaaaaccaattttgggggaggattgtcagatttacctaaggttttggtttttaatttaaaaaaatttaaagaaactatcttagtgatttttgtcatcatttttatttgttgccatgattaatatatggaaataagataaattggattctatttctgtgaaagccatattcttaacatcaatgcctacctaaaaaatatacgagtcacacttgatcattcagaatcattttgaaattctctggtaatcttttaaaaagccagcgttgactagtattatgtggctagttatatttattacagcagtctagttattgtttgtgtaactatagtttttttctaatagaaataaaatgtctatttgcaggataaaaagaagtatgtatatttgatgattttgttgtagaaaatacttaataccttttaaaagctgtttgactttcggttttaaaacagctgtgtagcttggtgagtcctgcagattccggctttctctgtggcctttgagccaagtaattttttgcaacattttcctttgctttcttataaacactcaaaaattatacttgcttttcctgaaggccagctattaagttagaaagcaccaaaggtgttatgaaattgccctttattttttcgtacatcagggaggaatgatagattttgtgtatctcttgtgtgtcattagaacagaaatatttagggctgctaactcccggagttgtgtacttacccttattacagatgcaatgattttgtctgactgcattgctttaagatgagttttattgctttcatgcttaggcaaggatatttaattttatttgtgtttagagtatcttgttgtaatatacttctcccccatcttgtgctcctaaatttgggataagcatagaatccttttaagaatgtaggttattttccagtttactagaaagcatgacacatataaattagcgactaaggattatagcgtcctttcctaaaggttatcatgaaaaaaagttaaaatgtcaaagaagatcctactccagtaaaaacaatttactctgtaaaatcctgatacctcataggaagctttggatcttgttctcagctaccaaaattctttaaatatgaaagttaacatgacaggaaagtggaatacactctgtgctgaagacccactgttcaaggtgtgtggttattaatctgggtttgaatttacaaattatatggtctgattaatttgtagataggggtcggtggaggttagacgatgggctttagaacaaagaggctgataaaatactactcacaagcctttctgcttgtttgtgactctctggaaatgccattagatagttctcatagctatggtcaaaataagtaggcttagaaataaaagacattttctcccctgtaaaaggaggcggctggcctgtgctctttctaggctcttcccagagacagcaacctcggcttctgaacccttagtgctcattctatgctccaccgcgtctcctctacacgccatgatctttgttatctgatttgctagccattgttatggaaagttctcgactgtaatgcaaaaagctcagccttgggtccttgctaatgtcagcaacccaaaggcgcccctcaaaccacctcgaaaagaaaaatcctttaaaagatgtcaaactctcctttcatgttagcccaaaatgaagttcccgagcagcatctggcagagcagggtaattcaatctattttaatgcaaagattttccaagaaggcaggaagccgtcaaggagaaggctttgaggcatctgctgttttgtttccagatcccttgtgttaatttaatgtttctagggaacccggctctttcttttttctcggaatccctgctctaggaactggtgagtgcgggggcgctgtgggagctgcagataagccagcgcttggccgggcacccgcgggccgcgcagcggggcagggaggcgcgcggccccagccgccctagggcgccggctgcctctgcgggccccggctgcccagcccagcgcggggaggcggcgccgactgccggggggcgcctgcaagacctgtttatttgcatttgtccaatttggctcaagtgaaaggtaaatacggagcgatcagcttgtcctcactccagcaaaaccagggaaactcagctccatctccaggaaacaaacccaacccaaacctgagtgaaacgtaaatcttgcataaacaaacacgttcttttgcttctgggaaggaacaccggagaaatgggcattccttccgactgcccgcctcccactgtcggtaaaaatgagccgtcacaggttgccggcaatttcttgttgtgtcccgagccattccgcggatcttgttttgaaggggcgagtcaggtgtttgtgcggctccagatcctgaacaggttatgcgctgggtccttccttatcaggaggggggtcaggctgccctcccattctcatcttccgccccagaccagaggctacaccaaagttcacttttgaaaagaaatcctgcagaattaaaaataaatgtctgccctttaaaatagtttcgttttagtattatgcatatttctgtttaggaacttgtaatgctaataatttatgttgctatgacaattgtcctgcatacctaatattaaatttaatgaattaatgtggcgtatagagtaatagtaacttaactagtactccgataatgccagtattccctgtgttactaagttaatggaatcagaattttggagttacaatatagaggttttttaggccaatttttctatgggattctagggatctttttataacatttctgcttttcgaagcagtctataccattgctggagagccgtaattactaggatgctatttctttttgtttgtttgtttgagacagggtcttgctctgtcatccaggccggagtgcagtgggtccaactcagttcactgcaaccaccacctcctaggcttaagcgatcctcccacttcagcctccccagcacctgggaccacaggccctcgtcaccgtctggttaagttttgtattttttagtaaagatttggtttcgccatgttgcccaggctggtctcgaatagaacattattccttatagtaagctgaattccctgtgtaattattcttactgtcccttcaataataaaagcctaaaattattcttactcatatattttagtgagggtggtgcatgcttgaagaccgtgatgagtgttctcttcttatattcagggcaactatgatcacatattgggctccagatccttgctttatgcatcttcttttgaattgtttagaaacaatggcaaaatttccaatttcaaggtagtgcttgaaattatgcaataaaatgttatgttagcaacatttttttttattttaaaaattcctttgattatttcacacttatatcctgttctctgttatggtagttttgttttctattttatttttagtttctatgtaatttattgtgctttagctgaaatcactaaataaagataaatgagtttaacagactcttatgtgctcatttttggttcttttttgctttaccccttgtattcgttttctattacgggcataacagattaccacaaatgtagtggcttaccatatccatttattttctcatcatttctgtgggtcagaagcttggcacaggatggctctcctggcttctgtgcccagggccttcacaaggctgaagtaaagggagcagcaggcctggacttgtacctgtaggccttccaggggagaatccacttccaggctcactggcagaatttagttccatgtggtagttgtactgggggcccagttgcctttcttggagagcactaactgctggctgttaccaagggtcttctagaggttgcccatctacatcttcaaaggcagccacagtgtgcagaatttgctttagatttccctgccttcccctaatgtgtttctcttctacttttaaagggcatgtgattacagtggcccaactggataatccaggctaatctcgctagtcaacttattagtaaccttaatcacacttgcagtgtcccttcatagcagtacctagttaagtgcatgattgaataactgggtaatgggacttctcgggagagatctttgacattctgcttaccatacccctctgggtaccactttgttgtgatggtaacctcataagcagccatttaaaagagattttaagcatcttaattttgaaaattttgcaaggtaaaattaaaataaatccaagtaacatcaaatattacttatacataattctagaggtttaataaaaacaataaacattcaccataagtagttgttgcttttaaaacccaaagtttttctaccttgcaaaatcttccttgattttcttgttttgttttggtatcacaatagatcagtttctagtaccaccactatataaaataaaaataataattgcattttaaaaagaatggttttcctctgcactctgattttaaccatggaaagtttttggtatattcaaatataattctattagattccaattttgaataagaaactgggttccctgacctagctgccacttactcatatctaaaatgtacttgaatttgcagcttccaagttgggcacatgtaaaccccctcttcacttcttatagagctgcataattcttaaagcttgtggtgacgggagggcacacttgcttatacgtccaaatttactgtttatggatctcgattactgttttctacttaaattctaatttttctcattcattaattttaactggacaactattcagaagtatgaattacatatgggcaaattctagtgctttgaaattactggaaaaaaaataaatggatgatcaacagatgcaaggaacagaaaatgtttggcttttaggggagttttatgaatactcttttggacttccccacttccttttagtaactccaatgtcttccagtaactctagcaaggaggaggcccagggagagaaatggggatctcacagtctcatactaggaagctgtgctatggggaagtgactggtggtctggagatgtgaggtagaggcataggcagcaggtatgttgacacttgaaaccagtacctcctcagcccttgcgggaaatgtgataatccaatcttagccatatatctcaggtgactctatatctgaaacgtgcaatgtaggtaaggtacttctgttgtttctcctaatttgtgactattttcatataatgaatgatggtcgtgggcattttggtatagaaggttttaattatggctcagtatttgtgtaattaaccaagtggaatgatttagagttctgatattactgaagtctttacagctggaagtcaatggatccatgccagtacattattaagtatacaattacttatttgcctatttatcccttctccaccttattacaaaaagatattgaggaaacttacacacatacacacactattaccaccaccacctaaaatgaatagatgaaattaaggtaaagggaaaataaggctaggagaaaaataaccatgctaggatgaatagggttagggcaaagaacatgtaatataaaattctatatggggctagagctaggctgtaaatttggctctggattttctagcagccaaaacaaaaagagagaaaattaatgagctacaggattcaccatattcataaaatgattaaagaagattgggattttcccttgaacccatcttgtttgaagtgggggcatttgatgctttctttctgctagaaaggttaactctgagttgcaataaaaatcataaaaacacaactttggcagaaacataaatgaacagtatgacagaatggaagcagttcacaggatttctaatattacctctcttttcctcggtccacattctaatattccaatatgctcctcagcacacagagtggtccaagaagattggccattctttccggaagttggacttccctgaagattatgtgggaatgggacgtggaacctgataattttttttgcagaatgaaaacttttatcatgaagaatttttctttattgcatacttttatacagttaggccccaacccgggaattagtggtattccaaaagttcctttttaagttgcttgtttgaaattaagaatgtatttccctccaaaaatgatgttggctacaatctaatttcagacttgcgatgaacccaaggttcaaagaggttaaatctgaataaatacagttctacaattctgtattcaaagccattgagaccagattttgctgaatttggatttttttttttttttgaagaaggaaagaaggataatattgtgcatgtaccagtcatatagcagtgtggtctggagcaggatcctataatcaagcacattaatatttctgcagtgaaactgatgaatattcacacgcagtggataaataaaaactataaatagcctcatgtcagttcaggtcaggtttgtcaccaaatgaattcaggccaaatgagttcaggtcaggtcaggttttgctgccaaatgaattataaaaaaaaaagaatggttttcaccacttttggggtttcagattagtggatctttattacactttttttaaaataaaaaggcactagtattataaactttaaccacaatgtaatgttattttatggaaaaacgtattgaattcctattaaggaagccaataagtcattgctgtattgcggccctgtagcaaaaatggagtgtttccatcaggctggagtcagagcagaaaaggacctcctctgtaacccaggagagagagggctcttgtcaggcaggtactggtgatagtattgggagacctagggctgggaactggggaggggcatgagacagggagacgggaaagcaagggtgagtattattcttttccttctcccttattcatttccctactttttctctttttttccttcctcttaatttttcttcttcttttttttttttcagatgtagtcttgctctgttgcccaggctggagtgcagtggtgcgatctcagctcaccacaacctccacctccccgcctcccaggttcaagtgattctcctgcctcagcctcccaagtagctgggcctacaggcatgcgccacagtgctggctaatttttgtatttttagtagagacagggtttcactatgttggccaggctggtctcgaactcctgacctcgtgatctgcctgccttggccttccaaggtgctaggattacaggcgtgagccaccactcctggcctaatttttccttcccttttaatgctagggcaaggagcatggcagtggtgtcaggtggccttacacttccctcttctcccactctttccttcagactacctgtaaagacactggagggtgctgaaataacaccgcttttaaaggtagttagaccacagtctcagtcttggctctgccctctggctgtgggaccttaagtggtttgctcagcttgtaaagtggagaaaaaaatatatatatatatgaaatactttatgtaatattatatatcatatggtaagtatacgtttatataaattggagctatgcatatatctttgagtggcatcccagaatggtagagaagattcagtgcagtgttaggtgatagtccctaccacagaatgcgagttcagtagatggtaatatccttcatcattgtttgttgtcccctctcgcaccttccagaaatcctttccttgtctccctgaactctggctgagaagcagggagccacagtgcagctgtgaaggggaggaaacaggcttcttctttttttggttttgttttattttatttgagatggagtttcactcttgttgcccaggctggagcgcaatggtgcaatctcagctcacggcaacctccgcctcctgggttcaggcgattcccccctgcttcagcctcctgagtaactgggattacaggcatgcaccaccacaccaggctaattttgtatttttagtagagacggggtttctctgtgttggtcaggctggtctcgaactcccaacctcggatgatcctcccgcctcggcctccctaagtgttgggattacaggcatgacccactgcgcccagccaggaacaagattcttaagcgttgagtatggcaaggcatactggggaagtgatctgcaaaagcatgaaagccccaaagtgtgggtgtttgtatctggtctgactgagggatccagtcccccttcgggacctgcttttggctttggtaaatcctaagacttagaggtttctggaagaaagactaatctgcagtctcttctgggagttgattggaaacaggtatctttggggcttacccagagctgttcacagatgtgagggctgatagtgccttgccttatcccatggccagggcctagcaggagtagcagtaagccctccaagaagccactagaaattgcacagctattctaggattgacatgggccctggctggtggtactatagctcttcatattaactgcatgcaacctttcaataatattaagtgcgtaacatctgccaggcactattctggggacatgatggttaatgacctagacaagatccctgctgtcatggaaacaaatgagggaactatgttggagaatagcaagatgagggtggatgggtgagtgagggctgtcagaggaagtgacactgaagctggcacctaaaggatgagcaagaattagccatgccagtagcctcctagctagagaggccagcaagttcaaagggccaagatggggaggagcttggtgtgttctgggacctgccagaaagtcatattgttggagcttcatgagcaaaggggagaggatccaggattgagccagaccttgctgagccttataagtcctggacaggagaatggattttattcaaacaagaagcccctgaaggtttttaggacagggacatagtttgcacagaagagtccactttgcctctctagtggatgtcatgctatattaaaaactggcagagtgctgggcttcttcagtgatactccagcctttcccttgtttttaactcacttataaataattttaagtcacttttcctctttattttttaggttttctcttcaaatccaattaactatcatcattaattaaagaatatgtgagcagtcatgtctgtagtattgagcaattctcctgttatctgttttttgctttctattatgggttttatctatttatctcccaacacgcccatcatttgctgccagcactggcatgctttctcttttaagcttttctcttttcctccctgtttcagatttgtgatagactctttttgtgtttgtccatttatttcaagtccgttaggggcattttctcttgtctgtgctgatttgctttatagaacttggttcagtacaacaaacctaaaacagctccttgtacatagtaggtactcaggacatgtttgttacatgaatgaataaacctttaggggcaagatctcctgggcttttgtgaagaacatgcagactaatacattatgttcctgcccttaagcagactactgttttagcagggctacttcagaacctaaagccaatgtttgcaatagaagcctaataaaggaagaatgtagaagtgtgcaatgtagaaaggaacttcgggcatataaatctgactccagaacctcagatccagcctctattctggctttttagtaggcgagttcttcaagggagagggaagtgtggttatcatggacaactgaatcggggctttattcacactaggagaaatgacccggaacttggtaataagatgaaagaatgatctttcagagtcgtagtagagcgttgtctaacaagacctaaggctcatctgattctgtagaggatgtgacttcattttagatgttaacttagagaaaactgatatgatgcaaataatttctggcaggtagaaaagataactctaaaggttttgttttattgtcctatagaatattcacatactacataaaaaaataacaaaaaatacatacaaaaaattctaaattacatacaaaaaaacctacattttgtatgtaatttagaatcttattccagtatttttttttctaaaaccgactatatgtatcaatttcttagccaatttactgttttcattaatgaggtatatgtgtctttgccatgctcactatatatttgcatgtggattatacttttaacattttgaaaattatattttgacattcatattcagtaaagtctttagacatgaatgtacatgtcattatccaagttacctaattatatcataccatgtaacttttaaatggacacatcgcagatgtcacaataagggaaattatagtatgatagagaggtaaacattttacttacagaaaacctgaactttaattttaagaggttctcagagggactctgtctttgtagaagttcgatagaaacaatcttagttaattttaggccagcctcagggaatgctctcactgaactgacctggtaacttgcctgtgtctactatactctttcttgtattgtggaaaaaataaaaactgtaaacttgagagacattccacaaatacaaatcttgcttcttttgcttaaaaaaattatgaacataattatagaaaaaagtagattctggttgtttaccataaagaattactactagaccaatagcaaaggaagttacaaagcacagatcacaaaaatctctccaatcacgtcaggaagttcagccctggatggtgtttgtttacctacagtgagggcagtctgtcaccagctgatgccctgttgagagcctcttgatctaaacaggaggttcagtcaatcactattaactgaaacctacattaatatgtattattcctcattaaacactgttaagaaaatgaagattaatacatgctgtattttgaacagatgacacataaagacaaaaactaaggaagcaaaacatagtacctgttggtaaaaacttcccaatcactgcttaaacaaatcctagtactgacctcaatcagggttttaaatacttgactctaaatcctttatcttgggccaggcgtggtggctcatgcctgtaatcccagcactttggaaggcggaggcaggcggatcacttgaggtcagaagttcgaaacctgcctggccaacatggcaaaaccccgtctctactaaaaatacaaaaattagccagggtggtggtgtgtgcctgtagtcccagctactcgggagactgaggccagggaatcacttgaacccaggagaaggcgctgtagtgagccaggatcgtgccactgcattccagcctgggagacagagcaagactctgtttcaaaaacacaaacaaaaaatcctttatctttactttgctcctttcaggatagctctggaatttgaatctgctttccagagctttattctcaactgccagcctcatttttcatactgtagttacttaagggtggaggtagtcgggccggcaagtaactacctgcagtgtacttgagaacctttgaaagcatctgtacttgccaagggtggggcatgtatgcttgagagccctttaaagcgtctttacttgctaagggcgctatgaccattcccattcctgggacttcattcccgctgggacctcattccccagtggagggtaaagcatggcttttgctgacggtttccaggtagccttccaaagtatgttagcataaaggactggagatgctgaccatctggctaactcatgattcagaagccctttggatccacttataaggccattctatttaggcctgctaaggatgtctgccatgctaatgtcaaaagcagggattttaggttatgttagtgatcagtgaggaattttaatatgttgttttgtcaactactgaggctataggcccttttaggtcttcaggagaagtagaccagtaaaataaacactgtgtgtttaagctatgagagctcaggatccctgtggttagcagttatgaggcacttggacacatatttatactaagagttgtagcttttacttatcttgggtaaaagaaatactccaaacagttagaacaaaaaaatatatctgatggtaaaatggataatgtattagtccattttcatagtgctatgaagaaatactccagattgggtaatttataaagaaaaagagatttaatggactcacagttccacatggcagggggggcctcataatcatggcagaaggtgaaggaagagtgtattagtctgttttcatgctgctgataaagatatacctgaaactgggcaatttacaaaaggaagaggtttattggacttacagttttacatggctggggaggcctcacaatcacagtcgaaggtgaaaggcacatctcacatggtggcagacaagagaagagagcttgtgcagggaaactcccctttgtaaaaccatcagatcttgtgagactgatccactatcatgagaacagcgcaggaaagacccgcccccgtaattcaaccacctcccactgggttcttcccacgacatgtgggaattgtgggagttacaattcaagatgacatttgggtggggacacagccaaaccatatcaaggagcaaagtcacgtcttacatggtggcaggcgagagagtgtgtgtaggtgaactaccctttatgaaaccatcagatcttgtgagacttattcacactatcaagagaatagcacaggaaaaacccacctccatgattcaattacctcccactgggtccctcccattacatgtgaggattataggagctaaaattcaagatgagacttgtgtgcggacacagccaaaccatatcattccacccctggcccctccaaatctcacgtcttcacatttcaaaaccaatcctgccttcccaacagtcccccaaggtcttagctcatttcagtgttaacccaaaagtccacagtccaaagtctcatctgagacaaggcaagtcccttccgcttatgagcctgtaaaatcaaaagtaagttagttacttcctacatacaatggggtacaggcattcagtaaatacactcatcccaaatgggagaaattggcccaaacaaaggggctacaggctccatgcaagtttgaaatccagtagggcagtaattaaatcttaaagctctgaaataatctcctttgactccatgtctcacatccaggtcctgctggatgtaagaggtggtctcccacaactttgggcagctctgcctctgtggctttgcagggtatagcccccctcccagctgctttcactgctggagttgagtgtctatggcttttccaggtgcatggttcaagctatcagtggatctaccattctggggtctggagggcgtggccctcttctcacagctctactaggaagtgccccagtgggaactctgtgaggggctccaaccccacattttccttctgcactgtcctagcataggttctccatgagcgctccgcccctgcagcatacctctgcctggacatccaggcattgccatacattctctgaaatctaagtggaggttcccaaacctcaattcttgttttctgtgcacctgcaggaccaacaccatgtggaaactgccaaggcttggggcttacacccattgaggccatgacccaagctctaccttggccctttttagccatggctgggacacagggcaccaagtcctaggttcacacagcaggagtccctggacctggtccatgaaaccattttttcctgctaggcctctgggcctgtgatgggagagactacctcaaagatgcctgacatgccctggagacattttccccattgtcttggcaattaacatttggctccttgttacttatgcaagtttctgcagctgacttgaatttctcccaagaataggggttttcttttctgttgtatcatcagcctgcaaatttttcacacttttatgctctgcttcctcttgaatgctttgctgtttagaaatttcttcctccagatatcctaaatcatctctctcaagttcaaagttccatagatctttagggcaggggcaaatgccaccagtctctttgctaaagcatagcaagagtcacctttgctgcagttcccaacaagttccttatctccatctgagaccacctcagcctggactttattgtctatgtcactatcagcatttttgtcaaagccattcaaaaaatctctagaaagttccaaactttctcacatcttcctgtcttctgaggaagacattttcctatcttcttcttagccctccaaactgttccaacctctgcctgttacccagttccaaagtcgcttccacatttttgggtatctttatagcagcacctcattcccagtaccagtttactgtatcagtccattttcatactgctatgaagaaatacttgagactgggtaattcattaaaaaaaaaaaagggtttagtggattcacagttccacatggctggggaggccttacaatcatggcagaaggtgaaggaggagcaaaggcacatcttacagggtggcaggcaagagagcatgtgaaggggaatggccctttataaaaccatcagatctcttgagacttattcactaccatgagaacagcatgggaaaaacccttccctatgatttcattacctcccaccaggtccctcccatgacatgtgggtattatgggagctacaattcaagatgatatttgggtggggacacagccaaaccatatcagatacagttcccaaatattgccttatccctcacaaaggagtggtgggcttagaaggccacatgtcagcagagtcctgcatctcctctgcataggtttatatcaccttctaatttggaaaattttttaaatctctgttctagctttgtcatatgccctacatgacagtggaactaactaccctatgattttcacctcagccaggcttagtcttcaggttccaggtgttggttgtttaacagcatcacaaaacctagggctcccaacatatgaatacacaaacttacaaataagacaggcatttcagagcagaacatctggtgtttgtctgccccacaggcgtacctcctttaggtgtaattcattggaatcccagtcagccgatttaggagcctaagtgcattagctcatggccagtgcactgtagccacatactgtagtttcttcaggttgagtgatgcttattgatctgttagtttgctccgcagagcccctctctgccccaggtaacttactttctgatggtaatattttgatagaaagtaaataactttgtttcaataaaagaaaaagtagcatatgattattttaaagattaaggtacagattggatatttttggaaaatttgctgctttttaggcagatgaactgttaggtgggtgtgggccatgttctaagcccaactaaatccatctttagaacaattctaaagaaagcagaaaagataaagatatcaagtcataaatgtatacttgtttattgagcatggtttaaaattttaatcagcctacaatcagccctggcatccttgattccccttactttgttgcactttttaaaaaagcactaataattatctaaaacactaaaaaatttatttatgttcattacttactgagtatttgccccttcatcctccaagtgagtggcacaggtcaggcatctttctcttttttgttcaccaatatatctgaaatgtgtgttacagtgcaaataataaatgttcaataaatacttgttagtgaatgttgggaatgactcaccataagttcagcgatattaagattagttaagccatgatccagtgaatatgtccatttttaggaaagcaccctcactaaaaggaataaaattttgttgtaagacttaggcccattactctggccctggtgaactggaccagaccacttgtaagccacacagggacctgccacaaagagagaggagataagacagagcctggatctctaaggtctagagcggagctggtttaagctgttttattccagggccttccttgttcactgctgcatcctcagcatccagaactgggcctgctgtgtagtagatgctcaataaatattttttgaatgaagaaaggcaaagtccttctaagcagtaggaagcctttctgtataggagtagaagaaggaggaacaatccaaagaggaaatgggtccagtgataagagcttacaagaacatgccatgtaggcacaaaaccttaacttcttggcacatcaggtatcagggaacttccaggcagtgcaggacacacaacctcctagccttcatccacactggaaggtatctctcattctcctggcacacctacaggtgggaagtcttgagcactgtcttgaggctgaacccgccactgacagaaatgattcagtttaacagaaaatcagttaatttatttgccagtctatttgttcacttgattaccattgtcatggctgagtgaaattttcatttaagggatgaatgaattgtaaccttttaagcaccatcacttaaaactatccaaccacttttgttggaaaatttactaaaacatacgtatatttccccatcttcttaataaagcattagaagattttcgtattatctcaagatcatttgggaaacattgtgctgttatatagtagtacacttagagtctactccaggtagagttttcattatgccgaagaccatatattgtattttttgaattctcatgcctgtttttcttggttttactgtcttctctctctggtaggttatgtgttcattttctagtgctgcctatgtggctgccccaagagtctccaatctcccaaaacatactgtccctggttatctgtagaaaaatagatggccaagtttattagattcatctaaaatacaaaggaagtttaatgtatggactttgtgatacccacaagcctcctgtttcatctctcccatctctagttcttctcagcagtgctctggaaaattgggctcatcagacatgtggcttctggagaaatgaggttttaataacttgtcgtttttctgttccaaattttgagagtagcagtatatcactgcttaaaatgtgctaatttttgagataacttttcttagcctggttctcattagagcttaagaaggagacaatagcaataggacattgtttgctcagcctctccatttctgtaggaaaagaattgttaggaggaggaagggtagggaaaaaaaagtgcaggggagtgtcatcatctggtagatagtttaaaaaaattcctctggctttggagtaggaaaattgattgtagaggatccaggaggaatcagagaggctgttgaagaggctatggtagctgtccatgtgagggacaatggcttggacaagggtggcagtggtgcagatagaaaagggtggttggactcagcatacattggaagaagagggcacaggaccctgtgtcagatattttggtatattcctcctatcattagagtttagtcatgtgtattcacaccccacatttgtttcttctaagaaatgaagtctatccgttaaggaaatgtcagttaatcctcattgctgctgttatcatggttggatttgctccaaaaggtatgttaccatatatagaattaaaaccagtctctaccctgtggggaagtaatgcagatgttttgagattagagtttagaatctattccaaagatctgccagaacacatgtttaacaatgagcatgagagttttccccattgctattcttactatgttgtttatcaaacaaagataatttgggggcttgtgtagaaactccacaatatttaagaaaataaacacaaatctctgagtcaataactaaatgtttctgatggtatactaagaaatataacttattttattaatggttattaatataaccatgacttttaaattaatattaatattaactgatattaatattaatgtaaccatgacttatattaatggttattaatataattatgacttttaattcttttaattaaaatatttgtggttctttatagttcaccacagctttgaataaaacaaaattgttttcatgttttaaatgcagtggaaggttttatgtttggtgttattcaattggtaaggcaaattgctttgttattagcttgatttacgtgaaaatttagatttaattttagatttggtagattttaatctgataccattttatattggtttatatctgaatgcttcattaagatcctgggtatacacagtttaacctcaagcatatagtcttattatattattttattataagaaacagaagtatggaaacttgaggctgggactgttcagagctaaatcttatgaaatgaaataagttcttgtaatcattttgcagccattatttgttgtgcttttgtggtattttgtctcttttgagctatcctcacaggtttccaggaattcaaggcctaagaaacattctactaagaacttgaaataccaaggcatttaatttttggaagtgtagaatgttttattacttttgaagttttgaggaccagcaaaatagagaagtgtattgtgttacacaatttgctatgttataaatgtttacttttagtggacatgatgtaactagaatggaaaaaaacacagaaatagtaattgttgatataatcttgccttggaggtagcgatgggtgggggaatggggagtgggaacatagcatgagaggagaaaaaaatctgttaccaatttatggtaaaattattacagttaaaaagagttgcatatatgaataataataaaaccttcacccagctttcttgaaagtttacaaacttcctttctttgcttagaactagctcgagaaaggaaaaaaaaaatcttctcttagattctttgcataaaaaactaattcctttatttttctcaccggttctcttcatctttcattttggtccccagagaatactgtttgactattttgaaatcatttctcttctccactttgttgcactttgccctctgggatcgtttccccagctcactcttcttcctttgtcctactgctccctttacccccacctctctttctatagccaagaaagaaacttgttaaccatgactttttcttttaggaaccaattcaaaaatccctttggtacacaggtttacaggcaccctatctcagtctgattccagaaaaaaaagcaccaggaaatacaggaaaatatgtagctattaataaattccacagataggcagaagttgccaaaggaaaatgggagaacaacaaggactgttcattggacttccaggaatagaaattgttgggagtctactcttttcaaaataaactgacatggggctgaccaccttgtcagttactcccatctgatggtggggtgtggcaaacaagggcaaaggtattgtttggttttcaaggtcaggctgctaattgtataattggattaacccagcccgcagagacatggagactaccagtcacttgttagcctgggtcccaaggtagaagcagcacaaaagtatggggaggatgttcagctgaaatggaaggaagaaagtaaagaggatagagaaaaaaatacagaaatgttagccaaaggagttataattaggagaaaaccattatcttattaatctctgtgtgattaattaattataaatgagttttctcttggaaaagagcgaagctacttagtatgacttgtggggagagtgtgtgtgaggagaagaaagtgtactttttctgcccaattatggaaggtcttaaacatcagccatgtttttaggagtttgactaataaatccagaaggcttattatttattttatccaggcatgttttatttactatgagagatcttcttagttcttgcttttgttttgtaagaaaaatgagctaggttagcagtgtccgttttctgtttttagaaaataagatgtctgagatgttagaatcttcacatataatttgtcctaccccacagtcagcaatttcatatctactgctcacagtatgcccaatcagagcacagacaggtgtgtgatggtggcttctcagtaggaatttacatttaagggcgcttgtcttcattggtttgtttgccattcattcattcattcattcattcattcaacaagcacccactgcataccagcactgttgtagggatgtttatcctgggtgagtgtgagaatcgccttactcttcaggtgcctccacagttctctgctgatttctttagtgatgatttgctgacactatgcacagtggtagaggtggctttagcagatattggaagggtgccccagaagaagtgagtgacatttgagccaaaacctaagtgatgatcaaggggaagactggttcaagcagaggggcctgtaaagccagggctgtaaggtgggcatgtgagatagggagaggaagccgctgaggtaggagtctagcgaacagggtgagaaggggtaggagatgagactgggcaggctggcagtgtcttcaactctggctgcactttgcagccattgaggtggctcaggccatatcacagaccaattcaatcagaatctctgtggacccagacatcagcattttaaaaaaattctccaggtgactctaatgtgagtttagatttggtctgattacactgggaagctttggaagagaatgatagactcagcttttcattctttaaaaggttgctttgaggctgtgtgtagtgtgaagggtacacgggggagaaggggaaagggtgtcttcaggaggaccagttaggaggctctagtggtggtttgagtgagagatgatgatggtggcttaaacaaggctggcagtgaggacaactgggagaagtggtcactttcaggaagtgaggaatgagattaagagagaaatcaaggatgactcgttgtttggggaccagaacaattgggtgggtggagtggccatttatagaattagggacgacgaaaggaaggtggtacaggtgggaggaggatctgcagacctgggatgtcatctcattcccattatcctgggctcctagaagacacagctcacacttcctacaactctttaagttcatacctctattatagcactagtaggctgcacattgcctaatatggactctctgccttattttcagcaaaattcactgtgtgaccaaattggtattatgagcactagtttcatttcatgacaaataggaatagagagaaaattctcaataattttcccagctttaattctctgttgctcagcatgctttgagccctgatggatttctttcgatttttcagaagaatcctgcctatgctttaatataaaggaggatgaatacggcagattcagaaaattgtggtgtcaaaggatgagctttgctttcctgccatcttctgtgctttgtttccttccaaccttaaaggaaatactaccctacttcaataaaaaactaaaacaaagattcaactcagcagaaggaagagcccaataagcttaaaataaatttgcaaaggctaataactggaaaccttttttaagctaaataaaagccttgtgtttaaagtgatagtctgccttttctggtctgcatcatgatagcttctaaataaagaaaacgggccgatgttgtgagtaattgcagctgctactctgggggttacatcaggcaagtgatttgtcaataagaatttattgtcttcatttctgggatgaggctgagggcaataaggaattcagaaggctgcttccttgtctttaaggggtttgtagtccattggagagatatgtctggctttcttgaaccagttaacaaacagttacattagatgtaattggaagctaacttatagagatgagggcagtagacattaaaagaaaggagaggtcaggcaggaaaagccatgaggtcagtaaaggcctcatgggcaatagggcttgcctggcaaatatttggctgaggcaagttggaagttgagctggaccttaaatgatatagagacctttatttaccgttatgtgctaatagttaaaatttacttatttgggactgctaacatatgctcaagttaaaaatgccaaaggtctcctttctattcctgcccccagtccctcagtttccctttccagaagcagtgctatgactcctttcctacaaacccttccagatacagtatcaaactttttttttttacatatatagcatttcttatttttttatttgtaaaatttgtccttttccaagtgctaaaacagtaaagaacaggtaagctaaataaaacaaaaacaagtcaacttccctgtggggaggctagaacagtgctggtctcattgactagtggggagcagtacatgaatgaggtttgcttttcctaagatatttgccttctcattgattggagtattggtggctaaaacgtaagcaactctgaaccctctagcacttacagaatggtgataatattgtgttgagtgctatactatgctagaacttcacatctgttttctcacatctctgtaaggtgagcctttccctcccttgacagatgacgaggctggaactcaggctaagttagcctgttgtaggccagacagcaaataggaggtagagctgacttctgacctgaccttttcctaccatattatgctacccctctggatctaaagctcttggttctgtatttctagtatcattgttgctgttttcttttatggctttacatactgagtccttggtatgaacttggggtgacccaagagaaaaaagtgagtggaaactaacttcctctctattaaaaaaaaatctgctcaaaggagaagggcaaattcacagctcagtttcagggggctgcaagtcaagtcaatattttcttctttttttttttcatgtggataaactgcctccctcattttgagttttcgaatctgaaataatgagagtctaatgaataacaaatatatacctctttttcttcttttaattcttattagcattttggattcaagtctagaaattcctcttcatttttttttcttttttgtctaacatttcttttgaataaagagtattacctacttttaaatgcaaaaaatggaaaattgggaagacattgtcttcttgctttttgcagaggcaacatttttattagtgtgcatatgtgtaagtttggccccaggctgtgctcacaatccccaagcccctggcagaaggggactccagggtccccccatctcagggatgacatgtgggtcagtatagtgtcaggatggtgatgatccactggctctgaaaccacagaaatgttcatcagtgtctgctgccgcctacctgtggccttcttgttaaatgagagaaataaacccgatttcttttggttgttctatcattcctgcagcccagaaacaaagagagggtatgactggttcagggaattttattcagtctggtgggcagacagaatgtgaagagccagccagggtcccaagatgatgctggagccattagcacggcttacattttcaaaggtcttgtaaatcacattatggttttaggatgtttttcctgggcagttattttaatcaggggatcagacatgatcaacttttttttttttttttttgcttaagaacgatcactctggctgctctgtgagcagtgaattggaagtgacaagactaggggcagggagacctgtttggaggctatcgcactaaccctggtgagaggtggccatggcagagttgctggagggaagggggagaattctagaaatgtttagggatacaagagaacagggcttgatgtgggagatgagagagaaggaggactttagggtaacttcaacatttcttgtttgtgcagctggttggttggtggcgctttttggttgacaaagggtatacagaggatgatttcttagtcctcttattgatagattttaatacaataaagtcatctcgaagtttcagatacatttcttcatgctctttctaggtttttctttcttttacatgtttcatgggtgggggagggtttaagagtctcaattgctctggaaattgaccttcctgctagggaagagatggtggtatccttatgacagttttcttccaaattgtggaacgctttgtggtatttagtaatcatatttttggttttttttttttgtctacagggagtggaattactttcatagaaatatataaaaattcattttttctctcctaatttttttttgtgatacatttttctgtaaggaggaattataggacttaactttctatgagtgtggtaaagaggataaatacctctgtatcctctttatataaatgaaaggcatctatccagttttgaattatttggggaaaaaaatcccatggaggaatgaactcgagataattaaatttctccaattcagaaactctgaattttttttttttcttattaggaaagtggttgagatatggctgaatggaaatttaaaatcttgagcatggttatacatcagaaacgtaacatgtagtctaggtccattccagagagcaaaaaagactcaatatttttgacattattaatgaatagattgatgcatttgttatgcctgcagagaaacattattttatcacgagttgcctgcagctcagagagtaaagggcttttggaagagttattcagagagaggtcaagggggagttactggttttttgtttttacaaggaagttttagtaaatcatattaatagtaataataataatgatgatggtgtacatttgcatagcacttggcagtttacactgctctttagagtgcgggatccacgcagctctctgtgaagtaagcattttataggtgccaaaacagattcacaaagtgtacctgaggtcatctgtttcctggagctgtaatttttcccaataatcagtaatattccccatgcattacaatggtatccacaatgcagctgtgtggggagaaggtaagcctctttattgagggtgagagggcatgaaccggctcctgggtgcgccctcctaggattgagttagagtttgcaatattaaaagcacaactccagtcacacctgtggatggtaacaagatgctagactgagcacgataggctatttctcatttttttttcctagtaaaatttatttgttctttgttctcatgtcttctgttagcattctttggaaaggcattagttagtgccacaggttttagaaaaaaactaagggaaaaatactaaagctgagaatgttttattaagtttttttttttctgtgaattagtaaaagactgtcatgtatgattttagcagaataccttgatccagattgaggaactccaaccagtaatcctgggaggcataatttaagaaccgctaacagaagcattttgaaagtgattgaaattgacattccttaaaaaggtagtttattgccttctgaggaacatttgtttagctctttaaattattcatatttgaagggaaagcattctacaagaaatcttatttttgagatatagctggtaaatatggaaaactcaaaacgcctgcctgttctacttgtcatcgttcatcctctgacagcttacaccagtcaagttactaagtctctggttatttttgagactctttctccccaagcgttccttagtgaatcttaagattctgggatttagcttagcagacaggctgtgccaccatgcagtgtcttctttggccctccctgccccattgcaatgtcttttactacaccttatttagccaaaaatgtgcagtcctttagtgatgagaatgtaataatggaatacttaaagtaattaaagatactgctttttctgattgaaacaaaagctaatagacttccaattgtcacctgtcacagtgtacttttttggagttgccctttgagctgtgttatctgatttgaacttttcaagcttcctctggccacactgggatttttctctggctatgccctgcagtccctttactgaattggcagtgctcctaatgcttttctctagctttcatttgaccttcagtagaggttaaaattaacttcaaggtgaaactggtcctcgtgattggtcgattgcttctctttcttgagcactgcacccatttcagaagacagatggttttagtattaatggcatcaaccatcctttgctggaagataaagagtcagactttctatttggaatgtaagctccttgagggcactgagcttgtttattcaaccttctattcctagtgcctagaacagtgcccagaacactgtagaagaagatgtgttgattaaaggaatgaaactttcctatagggactctcaagagatagctggcctaacttagaatagaaatgtgtgtgccaaggactcgtggtttcaagaaacagatactcaagtgggtgtggacacatttccaggatgttctccctctcacatgtacccaaccagaccctcgggccttgtcctttctgtctggttctagggaaaaagcccattgcctgtgctttctaaaataataaatctcacattcacaaaggatctggtttctgcatgtttttctgcatgttccaagctccagccatgtgcaagtgatattaacaaatttatttatgatttgttcgtatcctcctccttccagagattggttgaaatattaaactgttcatttctattcttcacttcctttaagccttaattggagccacttcttctattggataaacgccttccctggttggcctcgtttctctcaggtcccttgtttcactttgtgtttcctcagttgccagtaggctgtgctgtgatgctttgcatttatttggttatatcatgtatacatttattctgtgtcctctattagatactcttgtcgttttttaagctaacattcattgaggtttattgtgtgtcaggtcctgtgtttagggctttggatcctaaattatcacattaattttcacagcaactgtttgcagtaggtggcattatccccattttacagatgagaaacctaagttttagaggagagacacacccaaggatgtacacctagtaaatggcagagctggggtttgaatctttatgcatttaatttaaaagcctgaatcatcacatttcacaccctcttagaggaaggcagggttcatgccatctgcttcctccaaccaccaccactcttcagcagtataccacagaatgctgtaagcttcttatgacctgaaaagatgtattttaaatgcaatcaatacaagtcttctgaagaaatacacacaagcaaattcaattcaacaccaccaaaaactccttcaattaagataaaccagtattgacattttggagtatatctttccttgtttcttttgcaaagaattaagtatatacattggaaacactcttaaggcttaatgcattctgctaataaatttctccttcttagaaccaaagttgtgtgctcactaagagccatttgtttttttcttagtactgtttatgccaatcgaacttactgtaattctgtaatctaattagatattacgtaaaccaatgaaatatgagtataaaaatagagttgttgccactaaaattaggttgaatgctttagcaaaatgtgataaaaacaaatctctaaaacaattgctctagaattcagagtaggtggaacaactgaaagatttgaaaataaatgttaaaagtcacaaaggattcaacattcatattgcttcacaagtgtatttaaatttttgtttcatgttaaagaaattgaaactgaaaatagagaagaagatggattatggatatgatttatgcaggaaagattatgtggaattctagccagcaaatactcaagtcctcagtgttaaagttaaaataaaatgttttaggcagcaggtggtttttttttttttatgaatcctcactttcactagcttttgaaattaagcaattaacttctgatcctaaatgtgttagataagaatgcttctactctatatatctcaaaaaagaataacataatttgctaagcagcttttttcatgtaatatatcatgaacatgttttcaagccaataaatatggattaaaacattttctggcaatataacgtacatgcagaaaagtacacagatcctaagtgtacaactcagtttatgatcacaaagtgaacacatccatttactgccctctacttaggtcaagcaacaatattcccagtacccccagaagcctcccatggcctcctcctccccaccagagataatagctactttgaatctaacattataatgtttgttttggaactttacgtaaatgaaatgtctgtagtttttgatttttttacttactttactcaatatttgtttgtgagattcatccatgtttttcacatgtattatttgtttattcattctcattgcagtttattatttcatgtgaaagaagataccataatatttactcattctgttgtttttgttatatactttatttatttttttttttggagacagggtcttactctgttgccaaagctggagtgcagtggcacaatctcagctcactgcaatcccacctcccaggttcaagtgatcctcccccaagttagccgcctgagtagctgggactacaggtatgcgtcaccatgcctggctattatttttgcattttttgtagaggtggggtttctccacgttgcccaggctagtttcgaacttctgggctcaagtgatccactcgccccgccctcccaaaatgctgagattaaaggcatgagccaccactcttggcccaccattctattgttgatggccattggggttgtttccagttgcgggctattatgaaaaatgttgctatgaacattcttgtacatgtcttttggcatacgtgtgcagttttaaagttgttcatttgtttatatgccttaggaatggaattggcaggtgataggatatgtgtatgttcagctttagggaatactgtgaaagtggttgcacaaatctacaatcccatcatcaatttatgtgagttactgttgttccttatctttggcaacacttggtttggtctgtcttaactggttttatccaaactggtaggcttgttatagtctcttgtgattttaatttgcattttcctgttggctaatgagcacattttcatatgtttattgaccatttggatgtcttttgggtgggcatgttgaagtatttgtttagtatttgtctcttgcctacttttccatagaactgtcagacattttctcatttatttgtacttatatattctagatgtaagttcctttgttggttatatgtgtcagcaatgtcttcttccactctgtggcttgcctttattgctctcttagtagggttaatggagcttcccaattttaatgttgtccaacttaccaatctttctctttgttgttagtactttttgaggcttgttcaagaatcttcacttatgccgaaggtcatgaagatatcctcctatgttatctttttttttttttttttgagacggagtctcgctctgtggcccaggtgggagtgcagtggcgcaatctcggctcactgcaagctccgcctcccgggttcacgccattctcctgcctcagcctcccgagtagctgggactacaggcgcccgccatcacgcccggctaattttttttgtatttttagtagagacggggtttcaccgtgttagccaggatggtctcgatctcctgacctcgtgatccgcccgcctcggcctcccaaagtgctgggattacaagcgtgagccaccgcgcccggccccctcctatgttatcttttatcaactttattcttttacctttcacatttagatctacaatccacatggaattaatttttgtgtatgttgaaaagttagggttaagtttcattttatgctacattaatatccagttgctcaaacagcacttaccaaaaagaccatccattccccattgctctgccatacagcctgttccataacataaatcaaatatccatatatgaatgggtccagctgtggactccttattctcttccactggtgtatttcccttgagctaataacacatactttgattactgtagcttagtagactgaggactacatcttcttcttttcaccagttcctggagattcttggttattcttgatccttcacatttccaaatgaaaagattagaacagcttagaacagcttgtcaatttccacaaatacacacagagacacactcagatttgcagagatttttaatgagattgttttaaatctatagatcaattgcttttacaatcaaatctctaagagaattgatgtctttgcaatattgaatcttcctctttgtacatagagtatctttccatttatttgtgttttctataattcattgaaagttttatgttttagttatttatcttcaacataattctttccaatggctatagaatattttttggttaacataaaaatttattaattaatctccttgtgttgtaaacctaggttgtttctgttttgtttcattgttgtaaataatgtgattatgaacattcacaagtatacatattttagtgcctttctgtctccttggaattgactcctgaaactggaatttctggaacatacagcttgcaccttcatattccccagtgagttctatcattttaaactctctcccagagttataataggttccactcttgtgaacctggagaataactcactgtattttccatttgaattttttaattactattgacagtgaactagttttcatctggccatttgtagttcttttgtgaatagccttttcatggcttttgctcagtgtttttatattttcctattacttaataattgctctttctataccacatataaccccttgtcacgtgtatttacaaaatatgtctgtgtgataaatgaattaaccagtatacgtttgttactggagtggaactttacagaagagcacaaaaagaaaaccttgttaagcctgttggaaatgtgattattccctgaatgtttatgtcctttgcacatttaggaatatcatagcaataatgaacttagtagtagggacaatcagcaactaaatgaagtagaagacagataatataattgcatgggaagaacatagaaattagatccagaaaactgggttctagacatgacctcactgctctttacctccatgatcttgattaaaccatatattctctctgagtcttaatatcttcatctgtatagtgggtgcacttatacttatttatcttccaggtctaagatgagatcatatatgaaaagcaatagtgcaaacagtgaaagttataccatagaaattataatgccaacaaatatagtgtaagtgtggcaagttgaatgtatgctttatttaaattatcgtcttttgaggtaacctaatttataaaatattcagcctaatggccatcattctgagtctgtggtttgtgagtttgtactaatttgcatgactccttttaaaaagaaatggtttgttgtttgaaaaaatcaagttgacatcctttgtgactgttcagagtgtgtttgtggtttattggcttctagggcattaggtttctgtctcccatattgacagtctttatgagctcgttagccactgttctggtaaaagccattttgatctgtgatgagggcactacattaaaagagtattgaagttggaaatctatattttggttctttcattagaatgtgccctttacaaaagaggcaatatgaatttgcattgcaaaggattgcttatttctttttagaactcttgaagtcaggtaatttaattatgtctatgccatagccttttatcttcctctgcaaagaaactctctcttctgacacctcatattggaagccggtcttcttatccccagaattaattaacatgcaaatacttgtctagagatatgggaacagtgctttttcaattagcatttaaatatcactcttaatgatgttagattgactcttttaagggaaaattaaaatagtatagtcatctctggattatttcctagagcatattattgatatttctgaagatatgggcttagtaggagcttttatcttctactgttcacagactgattgagtcagatccagggttggactggacagcaaagcctggttctggccttcctttgcctctggtttcctagctaggcctgctgatcgtgccctgcactgcttctcagtagcaagtgtatttatgtaggagcggcacctgcaggaactgtttgcaactgggaagggtacccagaagcaaggagggaagtatagaggagctttggtagcaatcatctcccaaaaaataaagaagatgaactttggagttagagatgcataggttcaaatgttgcctgtgccactttgaagcagtatgatgttgagcaagttacttcccttcactgagactcaatttcctcatctgtaaaatataaatagtaatatttaccagtcaggttgttaagagggttaaacatgacagtatatatgcaatatgtcttacgtaagtcagagtaggctctctgctgtaacaaagaactccaaatctcagtggtttaacttaggttatgatgtggtttgactgtgtccccactcacatctcatcttgaattcccacatgttgtgggagggacccagtgggaggtagttgaatcatgggggcaggcctttcctgtgctgttctggtggtgacgaatgagtctcacgggatctgatgattatataagggggagtttccctgcacaagctctcatctggtctgctgccatgtgaggtgtgcctttcaccttctgccatgattgtgaagcctccccaccacatggaacggtaagtccattaaatgtcttttgtaaacttcccagtcttgggtatgtctgtatcagcagtgtgaaacagactaatacaggttatttcctgctggaagaaagaggagggctttgcttcatgcagacattcagggacccagatatctttcatctagtggccttgtcattttctaaggccttggaaccctcattgaatcatctgtctctggctggcaggagacgggagagagtgaacatggattgtgcagaaggccaggctggaggtagggcacattgcttccactcagattacattggctagaactcatagccatacctactttgtgagttttttttttttttttttttttgagacagggtcttgttctgttgtccaggctctagtgcagtggtgtggttgtccaggctctagtgcaatggtgtgatcaggcttgaccacctgggctcaatcgatcctccttcctcagcctcccaagtagctgggactacaggtgtgcaccactccacctggctaattttttttttttttttgtagagatggggtttcaccttgttgcccaggctggtcttgaactcctgggctcaagtgatccacccacctcagcctcctgaagtgctaggattacaggcatgagccactgtttctggccaccatagctactttcaagtgaacctgggaaatttgtgcttaagagaaaaccaaaatggatttgtttaataaacacatagtccatcactatgtagttcaccacaaacatatagtaatacttgttgaataaatgaaaggaagaaaaatgaaatgaattttcttcttcatagattcctagagtattagagctgatgggggccttggaagtgatagagattttaccccttcttttatagatgaggagcctgagggcttgaggaatttagtggccaatgcaagatcatccagctgtttagtggcaggaccagaacttgaacccactttccccaaatgctgctgtttattctgcatttaattatttaaaatatcattgttttctgccatagggttgcccttgccttttggaatgtgaagatgggttaggaggtgggaggggggttaaggatgttattctgatcatgatagctagacttcagttttctttggggaagaagaggtttggtattttagggtagatataccctcagggctggaggctctacagcttctcagtaatttgtactgagagtgaaaattaatcttcactcactcactcatgtgtttaaatagcttttctttagtcccctcctatgtgtaacaaatcatccaaggtgatatggatgcaatgatgagcaagatgttcacagcctaaggaaggtgtcaaatatttacacaataattactaaatgaaatgaggagcaaggaagcaacaaggtggaagggaccagctgctagggtggggagggagagggcataaggaaagctttatggaggcagggtcttgaagaatggatcacagttttttgggaatttgatctgtcctgaaatacacacacttgtgtttgtgtagttggtgcaaatcaccttggccagttgtggatgtgcattgagaaaaatgaaagaaagaaactgacaaaaacccaaaatgatgatcaatgctcctgtgagcatttggtgctcacatttaccattcatcgataattttgtcaagtttttaccagtaaatgattaataaaataaccttccagatacagctcaaacatcaataagcaatattttatcacatgccagcaagttttagatccaatgtgcccagcaatttttggttaggtacagacccttagaatttgtaggggcaggggtaagatgcatgaaataacagtaaactaagtaccagtatgaagaggaagacacacacccgtgtagaggatgtgcaaacacgtatataggtttgcattaggaggcctggttttcagaaaggtttctgtgagatgtactatttagagctgagttttggagggctgatggacatgcttaggagttggcatctcaagtatagttactaaatagtggtgaaagagcacgggttactctatagtctggtgtagaggatttttggagaagggggatcgaatggaagttttatagttagtaagtggcagagcttggcttagtaccccaggcttgtctgacacctgtccttctcccatagcaccatagtgctttgctgagaatgtgggtaggagtcagaatcctatgatgctttccgtttggaggttagagtcagggttgccaggggtcgattatgaaacaggtgatgttcattttcagcatcattagctcctctttggtgtgtctcttctctccttggcattcattttctcacacccttcccagctgattcacagtagggtttcagaggactctaggacgtatttgtattattttaaaatatacattttaaattctaaagtatccttatagtaacaattcaagttgtacaaaaaggagataaaatgcaaagtgattttctctttctctaaaacctttaatcctcatctttaaaaaagtatcttttcagaaattttatatggacattcaagcacacacaatatatcctcttttatctgagagaacccatttaatatatgcattttctgtaatttgatatctttaattaatatatggaacagtctttcatacaattatatagttctactttattttattttaatcaacagaatagtggtccactgtactgcttttctgtgattcttatcgaacagtatttaaatttattttcttaatgtctgcatttattatgcactgtgttgcagagaacatccttatagcgatctgcaaacttgtaaaggggttatttgtaggggacttgcaatggaatttctaggttgaagagtgtgtgtatttaaaatttttttgaagactgtgtgtatttaaaattttgatagatattggggaattgtcctccagaaaggcagtaccattttcattgtatccgcagggtatgtgaatgcctgtttcctaaggctttttctttttaaagaggacttgaagccagagaagaggagacaaagagcagagtgggtactaaaagtaagtggcggccaagagaaacagaaacacaggttcacacaaaaacttgtgcatagcagcattatttatagcagccaaacagtggaaacagcccactgttcatccagtactgaatggataaacaaaatggggcatatacatacaatggagtattattcagtaataaagactacagtgtggataacctttgaaagcatgctgctaagtgaagtaagccagtcataagataccatgcatacttatgtgaaatatccatgtaggcaaatccatagagacagaaagaagatagtggttgcttagagcgggaggtggggatgatttgggaaatgactcctgatacgtaaagggtttctttctggcatgatgggaatgttctaaaattagattgtggtgatggttgcacaactctgaatatattaaaaaccactgaattgcatactttaaatgggtgaattttacaatatgtgaattttatgtcattaaaactatttaaaaaataagtggtggcagaatgcatggtataggatggaaaggatgaggatatggtcattctcacgggcctgtgggttgggcaggaagacagtgccatagccagcgagccaggcaaggtgggggaaggtgttctgccaggctatgctgagccaggtattcaggtggctgatgacaatcagctctaggggtggatggtggagttttttcccctaacagaatagagacaagaggcagttgatgccatgccctaggcagggtcagaactgaggttagtacactgaatttcttactcgttgttcttgttcagtccttcgaatacacagaagatactgttctcctggaaggcagtaatagtttcctttgctgacctagaaatgcctgctgtgctccagcatttggaaaaggaaggtcagagagaggaagctgagctcagctgctgagtcaaggaaaagagaaggaagacctaggggtcaccaacgaagatgaggccctcatttgtgaataagtgtagtcagttttaaatttagcaattaagctctttctatatagtggaagtgactgttcttttggaatgtgtttgctagtaaatatcataagaatgtttaaaaggaagttatgattttaagtgacctctgagttgtgctgatggataaaatttagctcaacggaatgagggttaatctcacggtatactcggaaagttaaagggaaatcaacacactttttcaccaaagcccgtttttcctggtgcttgcggctgtttgaacttgctctttgcttctcattccccatcatcgtggctccgtggcatacattaaatcaaaccatgacctccatacattaaatcaaaccatgacctccgaatcttcttagttattttcaggtacaaggttttcagcttcagaaaggacagaggtctccatggttccattttgaagatttttgggtggctactgcttgtttaccagcagtttggtatagaagcccaagacagtccatgtgtggttcagtattgacctaatagcagaataaatttggaccaaacagaagtccttttctttgtcactgtgtttgattaactatcctggatatgctttattctctaaaaacttcatttttgaaaataccatggttattaaacaactagtctttgtgcgtgattaggacataaacaggaatctcacccacttttaaacctttccaagaaataacttttccactgattttattttgaattgttaaaaaacttttagcagggagagaaaatttggttgatgattcagagcgcgagggaaaggaagcaagggattctggcacatgcgcacgagttgaatgacaactggtggatatttttatatttattgctattcttagcctaaggcctggagctgagtagggagtaactaagcttagccatacttattagacttagagattttactttgtttatgtcaatgtcaaggcctttgggaaaactttggtatgcttagctgatttcttgaaatacaatctttctctcatgcaatttcctctcattcagtacgtgaagaataaaatgttgacaggttaaactgcaagacaatctaagttgctgtttatttttgtctgttagccaaatcttaactcactattcatagccacacagggtgtttttttttggttggtttttttttttttttggtttcagtttgtttctcctaaatacattttaaagataattagttattgcctgtattagaatttctttttgtgttcttgtgttaggattctggaagtagcaatgaattcacaggagaactcaacaatgtaagagcaagatgtttccaccacttactgagttgagggtataagattttatcctttgccagcccctttagaaattgtgactgtgaactgccatgatttaacttcaaaacacagcctgttctcttgtcagtggagccaaagcgttatgcctgaacaacgattataggttagtatagacaagtgaaaaagagttttattttgctggattctgatactacacatacttaggttcagctaaatatcaaaatcgccacagccaagatgtagtcattgatgaggactttaattctacccaatgtctgatcaatgtttcattccatagaaacatagatgtttcaatccagaaaagcctttctattttttaaaccacagattgaggaggcaatgagatggaaatactaccctgaacttagttctaactatctagaaaaattttttattgaagtagaattgactaaaaccttgggcgggagtaaccatgatagtattgtttggtaacttcaaaagaaagaaaagttggacataaccaaatagtagtggtgattttaggaaaatatatttcaaaggaaaaaaacatagatttttcaatatatagagggatttttcaacatatagagacttgaaaagagtacaaaaaaataaaaagaagaaaggaaatagagaaataaaaagaaagtttctgacagcaaaatcatcttttgagggaatgaggaaaaagaaagaaccttttttttttttttttgagacagagtctcactctgtcacccaggctggagtgcagtggtgcaatctcggcccactgcaacctccacctcctgggttcaagcgattctcctggcttagcctctggagtagctgggactacaggtgcccaccaccatgtctggctaatttttgtattttttggtagagagagtttcaccatgttggccaggctggtctcgaactcctgacctcaggtgatctgcccgccttagtctcccaaagtgctgggattacaggcatgagccaccgcgcctggcccaggaaccattttaagatcaaggaatttttgatgggcttggatattaagagaacatgtatagaagattgaaagacaagcacatgatcagggacaaattcagaagagtggcgtaaaccggtaagaaaatatctgcaaagcacaagttcatactgagctgaagctgaagagaatgttaaagacaacaagaaagctctctttaaagctatgttcataacaagaaaaacaagtaaaggctaagctcgttgcttggggcagatggaataatgttaaaatatgacgaaaaacagacctactcaactatttggcttctctttctctattaaagacaatgatgttcaaactggaatgtgtaacataaacatagttaaggataaactgaagcatgcacgatagataatgataataatagttgtgactacaatttcctgagtttctattcaggactgagtactgtaaaagagaatttagttgctttttaaagtacttactggcaggcgtgcgcggtagatattactgttatcaatcccatttacagatgagaaaaccgaggcacaggaagatttaatgacaaacctgaagttacacagtcggtaaatgatgggctgggattcagatcaaggtctgactaacttcaaagcctggctcttttcactggactccctgattcccatgcctgtcacatctagtgttttcaacaggattgcatttttttggtttaaattatattgtaaggcacataaacaaacacatgccagtagatgttattgaagagccacagtgtgtaattgctgtgaaacaaggaaaatggaatatcaaaatgataaacaacacataaagacgttcttgattaccttttttttttttttgagacagagtctcttccttctgttgcccaggctggagtgcagtggtgtgatcttggctcactgcaacccctgcctcctaggttcaagtgattctcatatctcagcctcagcctcctgcatagctgggattacaggcacatgccaccatgcccagctatttttttttttttttgtatttttagtagagacacggttttgctatattggccaggctggtctcgaactcctgacttcaagtaatccacccgcctcagcctcccaaagtgctgggattacaagtgtgagccaccgtgcccagcctcttggttacttttttttaaaggttctctttgaaccatctagagcaaagccatcaaagagactgctgggatcatgtcagaatgattcagaagccaacctgaggggatcccccagagggcaaagatgagacagtttgagcatcaaaaggattgaaatatataaaaatatataaaagtccatgagtttatgacaaaattctaaagacacaagacaataagacaaaaaaatcccgcatttgtcacttctgagattgttagggcaccaagtcattgttctgaaaatggatttaaaaaggagatctcacatccacccctgctttcctatttactttatagagaattacagctaataaatgcagaagggtgctagaaaagttttaaaaacctacagttttgtagcatctaatgaagtaatggagctaagcaacaaccattaatgaatgataaaatcaggtaaaattggtgctttctaacagagaatcaggctgacaacacttgaacccacggatcagtctccatatcactaaaagtggaacagccgaacgttagttatgctcctccaatgtgatctgatagaaaagaaacagcaccacctgtgaagtattcttacccacatcccctccctcaacgaggctgaaccagaagctcatcaaacatgcacatctaactattaataccaggttataggaaatacgggagacagaggaacatgctaaacaccactacaagggtacagatcagccaatgcctgaatgtaggaagttctacaaaacaaatgacccatttttgttttcagtatataaatgctacgagaaaaaagtagagatggggaactgttaagtactgtaaactagttcaaccattgtggaaatcagtgtggcgattcctcagggatctagaactagaaataccatttgacccagccatcccattactgggtatatacccaaaggattataaatcatgctgctataaagacacatgcacacgtatgtttatagcggcactattcacaatagcaaagacttggaaccaacccaaatatccaacaatgatagactggattaagaaaatgtggcacatatacaccatggaatactatgcagccataaaaatgatgagttcatgtcctttgtagggacatggatgaaactggaaaccagcattctcagcaaactatcgcaaggacaaaaaaccaaacactgcatgttctcactcataggtgggaattgaacaatgagaacacatggacacaggaaggggaacatcacacaccggggactgttgtggggttgggggaggggggagggatagcattaggagatacacttaatgctaaatgaggagttaatgggtgcagcacaccaacatggcacatgtaaacatatgtaacaaacctgcacattgtgcacatgtaccttaaaacttaaagtataattaaaaaaaacaaaaagacttaagggtgggagatggagcctgcagtgagctgagatcacgccactgcactccaacctgggcaacagcgagactccgtctcaggaaaaaaaaaaaaaaaagacttaagggacctgtaaaccaaatgcaggtatgaatcttgtttggaacttgatttgaacaactgactaactaaaaaaatgcctttttttttaaacaggcaaaaataaaacatactctgtttattacatgttactaaggaattactggtaattttattgagttggtggtattgtgagttttaaaagtccttatctatttagaagcacttattaatgaattaatatgaggcctaagactctttaaaaaatactccttcaaaagaaaaaaagtatgtgtatagggaaatacgtgaaatcagaatggtaaaatataataattgttgaagcttggtgataggtttttgggggttctttacactttcctctactttgttatgtatggaaaattcacataataaaaacagtcaagtgttctatttgagaggcagaattttggcagaaggcctgggttataacccaatttgtatagcctggggagagtcactgctactccctccttttttgcctctttcctttcctttttactttccttctatttcttaagaaatcatttgctgggccacattttcccccagggactgtcctggtaccatcagccttccaagttacaggtataggtattattattattattattattattattattattattattattattttacagatgaggaaatcaaagcagagaagggactaagtttctcacccacaaatccaggtctgcctgtgtccaaaatctgagctcttttgttttattttatgctggctcccaggagtagtcctctgattttataatttttaagtttttttatttttaattttgtttatggataaattttaaacaatgagtaaattaagatagatcaagtggagtagcatttgtgttttttgcatgtgagaaagatgcaaggtatggttgttactgtaacaattacaaagatttcatcaaaggcaagcagtgataaaagcaaaatgtgtggcaactttcttcatattcagaaaagagtaaaagcctataaattgtaactttaagccataaaataacatttatttatgcttgttcttcaaaagcttatatttgataatcttttttgttagaagtcgaagcctgagaaaaatggctaatttcatttttcatgtgtttgtaaaatatttttaggactatcacaagaaattccctaaaaatgtcaaagcaaatgaacaagtgaaattctgcacatcccttgtgccactattttgtttacttactgaaaaaatgacattggcttttgtaaaacctgggtgtgctggtgggcatgtgcagatgtgtcgctgtcatctgtcatgtgtcatgctctggatgtcagaaccagacatcagtcagggaagagagtgagtagcaagccacctcgccaaactcttgctgcagggtgcacggggttcacatcctctgcttagatttagtgcgactttccaaaacacctgcagtgcggtacttcatggctggtcccacgtaacaatttatgccctagagatgtctgactagatcttaggaaattatactaatggttctgacgttgtttccttcaagaatcgaggcgctaaatatagtcaagctgaatgacaaaattttactcacactcagggcatgtcagtgagggcatcaaaaatggaaaaataataaatactgctgatatttactaagttttatggtatgacaggcactgcactaagtcttttgaatatctaatcatgtttaactctcaatgtcccattttatagctgaggtggccgcagcacagagaggttaagtgagttgcccaaggttgcacggttaataaatggcagagctgggctctaaacccaggccgtctgacccctgagcctttcctcttctaaccactgtgcagtctccaagcaccagcagaatgaagtgagcacgtgctaatccacagctgtcatggtttggccctctgtgggctttcagagcaccttaaaaccctttgttctgtgtcagagctgtttttcagctttgcagatgtctgaagtcaagcagaagagatggagagtctgataaagcacacgtggcaaatctctggccgagttgatattagaacacagagtcccagagtgatttactgtccagggggaaagccagttggcctggctaccttgcaagacggttaaaggacataagaatagatattcattcaagactgtcagaaagaaagtaggtcagcaatgaaataaaaacaaatgtcaaagaaacaccactttggtataaataaaaagtcgattcttcttaataaagagctgtctgttcttcattaattagaaaagtacagagcctgcttactttgagattccaaaacctcttcaggcacaactcgttattaatttgatcactttcctcaaaagaatgatattttgacaaatacagtttctggcttcagtcacatatagaaacattggaataagtacaatgttgtgttttgcttttttttttaaaataggaactatgtttgataatgcatatactccaaacacctctaaaaataattttcaattggcaagctattttttggtgtattttcctagtctgggagaggaagttttatcatttaatttgataaacttagtacctttgagagaaaggaggagaaaattttaccatcttatgtggttgaaatatgctttagtatttacataattgaaaatgattcaaactgatttcctctgacgaacatccgaaatgaaaataaaaattgtgtctactccaaagggtagtggcttgagtcacccactggtatgtgtgacctatgagtcactcactggtatgcgtcttcccgatcccctggcctatgggttagaagtcaaagatgctccactggggcttcctttgtagcttcttttccccttcagtattcaaccacagctactgctggcagctcctggcagaacaggaatgggagaccaaggagaggatatgtggaagctgagtgatttatttataggggacttttggcaaatgaaagaaaatagatgtgaagtcttagcagttccagcatgttcatcagaaatgcaagctcatgatagtcatttcaaagggaattgtggaagaatggtgttaccctacttcacaggccattaaatcatatatatgtttggttgccagtgagaatctgagtagcagagcagacaagaataaggacgtatgggatcgaggcctgtagcttgtgaccatgaacaagtcacgtgaccctttggccttaaattcaccataaagtcgtgtacttgatctcagtgattgtatcttacttcatcaaaatggtatgattctaaattcctgtgggatatacaggtaagacaggactggtggagcattaggtttggtttttcctttaaaagaaagtgttggggaggcagcagggaatagcaaaggtcacagactcaaaagcattaactgccgggcctatgaagacacgaatgatgtaggtttgatataatggaggtacaaatccatgttttatgcaaaacctcatatttctaaactttggcaattcattcatgtttatcaaatcactgttttaggccccctttggctggccagtgggccctctgctttagacttctggaataaactccacagttgagagatgaaggacagacctggattctaacagacctaaatttgaaccttagctctgccctctaaggaatgtgtaaacgtatacatctgtatttaacttctcaaagcttcaagtttctttatctgtagaaatgagaatgataatacctcttttgtaggatttcctgaagactgcgggtactatgtattaagtatacatagtaggcacatcctcaaagggaattccattaccttttctatggaggtagatcctgtataatttttaaatttttgtcttgatggccagttgctcacagtttttaaaagtgtagtagatgccagcgcttctttatagattctgaaatcccttcaatttacattttagttgttttaaaataaagatttctttaagagacaacattcagagggataagttttctacttgccagtagaggtagaaggcagtaaaaccaaatagatctgtcagttactgtcttgaggtagagcccctaaagcaataaaacccacctttgacaatgaggaaacacgagacatcattttctccttaggacaaaagtctagtgagtaatggcccttctgtgactaatggtaattctgtactttattcccatagaaaatctaattttgaaaacatttgctgcatgccctactatgtactaggcactatgccaggggaataatgtaaagatgaccaaaacataatggaattgttgcctacaagtatgtttcggctatttaaggatttatattgcagtttgtgcaaattgtgtatgagtccactttgagaggttatacatatcttccaataatgttgctattgctcaaaatatctttgaagtctctctttggaatttacttttagagcccttagcacattctgctgaagattttttttttttttttttttttttaccctagtggtatttattcttagaaggtggatttgatgtcagggactggccaagagttgttcatcactaagtcagcctcatgggtggtggttaaactggctagagtaatttttcgttaaaaacgagccaggactgtaaagtagtatgacagggtttttttttttttttttttttttttaatatcacatcaactgattgtagagaaaaagatagttccaaaaaggcattctgcacattttttgccccaaaccagtatcactggaatatatttgtagctccctaacaggctaactttgaaataagtggtgctcacatgtgcatgtgttgtagtacgtctgctgaaccttgtacttaacctcttagcaaactcagtgtctttgttttttcctttgaaatgttgttttttcaagttcagggatagattttctccaagaaaatgaaacaaataagatccactctcaaaggaccttaatggaaagaaatacatgcttataccaagttctttaaaactatccaaactggaaaggattgcctcatagctgactgtgattattctgccatgatttagggacagataatttcctatcagcatgtttaacatgagaattaaagagttctgtagtgtggcctattgacctcatttgttcattccacaaacatcttttggagtccactgtatggcaggcattatcacttaccatggtgaggatggtgaggccatgagcatgcttcacctaaggaagcctgatcttcaagaatgcaaactcactcaacaagaaacttgagagtaattaatagtagtgttggtaattatcctgtcttttccttgtaggattatttggaggttgtgaagtggtaagtctctttattgcatttgaaatatggctcatctcatgaccattggaatgtgtgtacgctctggaggaaacccatctctgccatgtcacctgtattagtctgttcttatgctgctatgaagaaatacccaacactgggtaatttctaaaggaaagagatttaattgactcacagtttctcaggctggggaggcctcgggaattatggtggaaggcacctcttcacaaggtggcaggagagagaatgagtacccagcgaagggagaaacctcttataaaaccatcagatctcgtgagaactcactcactattacgagaacaggatggaggaaaccatcctcatgattcagttatctccaccttgtccctctcatgacacgtggggattatgggagctacaattcaagatgagatttgggtggggacacagccaacccgtatcaacacctgaccacagtgtgtgtggtctctgaggcccagtggtggctctcagagcacctccttagcaaatgtaccactggacccttgttagaatgatgttcttgattttttaaaatttatttttgtctcttgactattcttgattcaggaatgttcttgattttaaagggagggtgtgaggtagttgttgtctagttgtctagatatcctccacctgagaacgctgtctggtgtcatagaaacagcaatggcattgggatcaaaagacaaactttccagccccagctctgcctctctttagcagtctcctgacctatacaaggttcagttttcccaccatttaagggaaaccaataccactgttttattcacagcactcttgtgggaatcacaggagacagggcacgggagagcctttggggaactgtggatgttagtccctgtcgtcatcagcctttccatagtggagcctgggctactctgaaatagaagcacctctccttcctttggacccctggagcactgtgttctacagttcttagctctttttctgtgtgcattatttgtatgtcttatccttggtggtcaaccacttcaaggtgagagactggggtggtggttccttttttttattttttaatctcccctgccccatctttctctttcccacttcctatgttgactgacaaaatcttcgtatttcccagagtaccagagtttttctgtgagaggctaggtcagtgtttctccccaagcagaggctaagaagtacctgatgcagtcatttattttcagaatgtgtgtagcttgcctccagcggattgcctgggaagctggagatgtgcttcaggggaaaggtggtccatccacttttcctgaacaggctgtgcatgcagccttgacatagccaactctgcaggagcatgaaagaactgaagatacagtattcgacttccagtatttctaatcactttagagacaggatgacgattggtttagaagagccaggggatgactaaggagcacatgtaaaacaataatgttcagtatagactttagtttctgatttgaaacattttctaaaaaatcatgtatctttaaaaaattggaagcagctcagtgtttgctggagatgaggcatagagtgtggtggaagggagggatgacaaaggggcaggcagagactttgagggatgaggggtgtgcacatcaccttgctggtggggactgtttcatggttggatacatgtgtgaaagcatatcaaattgcatgctttaaatatgtgcagtttcctgtgtatcaagtatacctcaataaagtagttaaaaatggtatacctttattatgctgaaagaagggaaaatttggaaaggagatgtttttctgtagaagatagcttctagaaaggaaaatcaaacacagtctaagttattctctgttttgttctcctccctccacagatgtcttgttgttttgggtcctcttatctaaaatttcacaatatgtgaaagtagcctgaactctaaaggtagtagttgtggttttgggaaactgtgtgttcgtactgcctctgtaaatggaacacaagcctctcctaccctctggggagcttgtcacttagtacagttttttaggaactcctaagaagtttaagttctggccacaggtcccagagttaaggatgttgtcaactctgctactcatttgaaaaatgtcttgtggaacctatagccgcagaaagagctttgtttctctgggtgaaaacaacatacattatcatttctaataactttaatggatgctgctgctttcttctttttggcccccaagatactcagagataaacttgaaactcaactataggtggggggagggggaagggatagctttaggaaatatacctaatgctaaatgacgagttaatgggtgtagcacaccagcatggcacatgtatacatatgtaactaacctgcacattgtgcacatgtaccctaaaacttaaagtattatgataataataaaaaaaaaagaaactcaactaaagcatggtctgcatacttgtgtgtatattttcgctggtctcaaatttctatttatttatagttttctggcttacagtctatatttgtgtaatatttatatggttttatatggttcttgatggaaatcccctaaaatccttttcgtagcgagtcagagaatgaaatctgtggtttaatccactggcttttctttaggcaagagacagctgtgctagaagaatggaggattataataaatttgaaaaaccagaacagttcttcaggtaagcatgatctgtactcctgaccttaggaattgactctaggtcccagattttgaatttcttatgagcataatcatctacttaaaaaaatcacttaattaacagtgattattgagtatctgcatctcctccaagaaataaaatgccatatacatgacacacacacacacacacacacacacactcttgatagtcctacagatgactaatcactccccaccccccgacttcctgccttttcattcatacattggggttgggatctctgctaccacaggagctgttgcagagaaaaagatttttaaaatactatattatgtaaattagtacaaccattatggaaaacagtatggaatttcttcaaaaaactaaaaatggaactatcgtatgatcaagcaatctcactactgagtatatatccaaagaaattgaaattggtatatcgaagagatagctgcactgccatgttcattgcagcatcattcataatagccaagatagagaatcaacccaagtgtccattaatggatgaagggataaagaaaatgtggtgcatatacacacaatggaatactattcagccttgaaaaaaaggaaggaaaccctgtcatttgagacaacatgggcaaacctggcagatgttacgttaagttaaataagccaataacagaaggacaaatactgtgtgatttcacttgcacgtggaatctaaaagagttaaactcatagaaacagagagtagaatggtggttaccagggctgggggttggggtggagggcaggtggaggtgaagttagtcaaatgtacaaaatctcagagaggagaaataagttttgagatctattgtacagcatggcaactgtagtagttaataataatgtttacttcaaaattgctgagtaaatccaaatgttcacaccacaaaaatataagtacacgaggtgatggatatgttagttagttgagttagctagctaactaaccataggtataagcataggtataagcatataaaaataccacattttatcccctaaatagatacaattattatttatcagtaagaaataataatataacataaatactatattgtttcaaaatagagggaagaaaacatgcaaatagtcctaatggattttttttttttttttttttagtctccaggctggcttccagacaaggctgtatggtggcccagactggttgaattttttcacttaactttttgttgatctgccttaatttccaataactagagattctgataagaactttaagaataggaatacttctgagaatcttaagatgttattagccatatataagtaaccatacattttataaaagcatttttctcttcacaatagctggaagtggaacatcctagagaataactcatttttgaaaaatagaatgtcttaggggagaactggcctgctaagtattacaggggaggactcaggacaaaatcaagttatcagatacctggggcttagaaagcaaggagttagaaggtagaagaggcttacagaaaggaggaaagaagatgctggagaccctctttcatctattatagaacattttctatggctggcctgtattcagagaaggatacctatcttgctgctttctgcaccaaatagttccaagatccaaaattcaagctagtgctcttagtgaatagtttggttatattacgggttaaatgggttttcctataaagctagccaccatttatggtatttagatctaccacttaggaagatttcagtcatattcatgattttcaggttgtcctctctcagaaccctggtgtcataaactgtaatagttgtaggaattgttgtagtggatatagcagtaatattttctatggaaaaatatagaagttaatatatgccaggtactgtttcagttatggacactcatttaaatatatgaagtagatgctattataatccccaattacagacgaggaaactgagagacagaaaagttagataacctcccaaggtcatgtagctactaagtagcaaagccttgatttgaacctgcactctctagatcccatttaggctcttaactgctatactgtcttaactggattgaggttttccataaaattaaagtttcccctgaatccacagaaaatgttaacaatatatagaattttctggatttaatttttttctgtctcaaatctttgtatctaggatcacagataactgaagattgaacaagttgcaaatttcttaatagtcacatatgtatcattatatactcagagtttagccagataacccaccataaattgctaatgaagcttaataatttatagtgaaaaaacaaaaatagaattgcaaaccataagcaactcaagacgtgcacgggggattatgcatccttcccccagtttacagaaattgcaaccatcagcatatgcgttccacatcagtgccaggcattgtgtggcaatcagacttcttatctagaaactctagaaatgtactacttttagtaatcctaaataacttacttaataagctatattacttaagctatattatgcacaaatataaagctagaaaacaaaaggtgaacttggacttcctctatcctttataaaaatggaaggacctgtgctttgctggattggtttgctgttcaggtggaaacccctcgtggtccattcagtgggctgtgggcgatagtttgagaatcctgctttaaaggaagaatacagttcatacattttattaaagacagtctgctaaagtgatggagctggaattttctcagtgagagcactgtataacagggttttctgttttccttttttcataacaaatagtacttctcacttaaaaacaattgttccttacaatgatgtctgggatttgcttcaaaataatcctgtgggtaaagagttgggaatgagttggggaataggtggaagaagtgggatgaggggcagataattgtcaaagcaagtgacatggggcttcatgatactgttttctctacttttctatatctttgaaaataaaaagttaacagcaacaacaaaaaccttccttgactactatcctacctacttcatttctctgctcttgttcacagcagagcttctaaaaggaactctctgtatatctcatttgtacatcctcatcctccattatttaagcaacccattcacttggctgtcctccccaccagccaactgaaattacctttttaagggtccccaccaatcaccatcttgccatatggggtggttaattctctcttatgttacttgactttcagcagcatttgatgcaataggtcactttttgtttcttggagcattttcttttattggctcatgtgcacccacatgttctcatttcttctgcatcttgctggtttccaacagctgacctctagctgttggaaagcctccaatgcttcatccttgggtttctctgtactctttctgagtaatctcattgggtcccattgctttaaataccttctggttgctaacttaacatctgtagccctgacttccagacttgaatctgagaggcatctcaaatttaatgtatccaaatcataactcttaatcccagccttactttcttcctttcttcctcacctcttggtacccccatctcagtaaataacactgttatatatctggctgctagagccccgaaccttaggcatcacccttgattgctctttttccctcatatcccacatccagcctatcactatgacctattgtcatatctccaaatttacctgaattcatctactttcctctcctctcctgctaccatcccagtccgaacctctgacatctctcactggacttccatatcacctcctaatccatctctgcctctgtgtttgcccctggcagtccatggagagaccagccagagtggtctctttaaactgaagtgccactcccccacttaaactcacccattggcatcccatagcacttagaaggaaagccgaactcctttgtgatgtacctgctgcctatgtctgccccaccctgccaggactcactactgctgtcacacagatcccttttctgttcttcaaatataccaagtgggagtcttacctcaaagcctttgcagttctcttctctctccctgctatacagatcaccataaggctggcttcctcttactacctaggtttcgtcttaagtcacctccctagagaggtttgacctgaccaccctatgtaaagtattcatataaccccaggccacactctatctcatagcccattttattttaatttatgtaaagcatttgtgtttatgtattatttttttgcccctacctataaagtccagaagagcagctaccttgtttgtcttgttcagtgctgtatccctggcacctagaacaatgtctggaacatatagaaggttaatgtttattgcatgaataaacaaatgaattactttgtttgtgatttaggatcaaggaacttttccccaaaggcgaatctgtgcagttttatcccacgcttcttccccatccctaagttcctgctcatctggactgtgtgcttgcaaactgtgtaaagacttgttcaacattcttaaataggttaaagaagtactgcactttgggctctttgtcattttcaagtcacattctatcctgggcaccatccggaggggtcttgtccagtttcctagtttctcagaaaggaatatttcatggctgctcgcacgtcctcttcccttacagtatttggactttacaccactcattggcagagccaaggcctaccccatctgagcaaagagcaacagagatctgttggctccattcactcctttgctctaagactcacttgtttcttcttatcttttcccaactatttttagttgtcaaattgctcctttctttccctttcccatctatttttcttttcctgtggaaaacaacccatatatttctagtttagtcagattagctgctaggaaggccctttctcaagcttatttatataacgaaaagctatacccaaatcctaatttcatgtgacaattgagcagcctcttgtaaaatagctagaacaagggcaaggatattaatttggctcttggactgagacacactagggatgtcccagggatttgaacaatttctaatcttctcagaggagggcataaggaaattcctaaccaaggtgaaatcttttgtcacatcctagagtagataagtacttcaagaatcttctagactggggataagttggaactgctaaatattatctacttatctaatgcatgtaataatagctatctatgtctattttatcaagtagctgggaggataagtttggtttttttttcaaggacttttgagctttttcttcaggtaatatatcttaagggaacactttatataaagctaagccattgggaaattttttctgccatagccaacagttttgtaattaacattcctttgcatggtataaatacaaatctgttcttttgtcaggatcattctttatgaactaccatataaaagtcatctgggctgggcacgatggctcacacctgtaaacccagcaatttgggaggccaaggcaggtggatcacttgaggtcaggaattcaagaccagcctgggcaacatggtgaaaccctatctctactaaaaatacaaaaattggcagggcatggtggtgggcacttgtaatcccagctacttgagaggctgaggcaggagaatcacttgaacccaggaggcagagggtgcagtgagccgagatcacgccactgtactccagcagggtgacgagcaaaacggtgtcaaaaaaaaaaaaaaaagccatctggataatacatattctttattagtattaagtatttacttttagatcaatgaaaacatttctatggggctagacttttccttgtcaagattataatttttcttatgagtttttacctgaaacccctattttctaagaccccatggttaatgagtctctttgacattaatcatttcaattttgctggttctgatgaccctgtgctatctattagagctctaaccctttgcaaacctctcttctgcccttgtcagtgtctcacgtgctcacgtgcatcttaggctggatatcacgtggcacatcctggtaccacctctgctgctttcactggccactgttgcatctgtttggtgcagctgcttcctccactgggaccaacccctcctcttccttacaaatattcggaggtggggaaaatggaaatgctatcattagaacatctggcatcagaatttgctttatgaagaaaataatcttgggggaaaacactttgatgagtgcttgcggaagaaaaggaaaccccaaaggcctgggtattgggagagctgctttgtgtaagccaagggcaagcatttactggttgctttgagagtgaggggaacacatgagagaaagaaagagaggggagggtggaagaatggcaggcatcaactaaatggcataaaattgtggggagggtcttgatgcacctgttcctcatggtctccagacttttctgtgaagtacagcatgtagtgtggagtggatttcagggggtgaacttggagatgcgttcattcacatcacagtcagtgcaggtagtgtagagacaacagtcatgggaaagggagcccaggaatgaaggaggccctgagaacatcatccctcaccaaaatgttaagacgggttttgggtttccagaagctatagagttggtggcagtttgagccaattttttcctacatcttgaagggcaataagaatcccacataatgtctgggccacatcttggtggtacctggtataactttgccaaaagaattttaaaaccaccgcaataggtaactcaactgctggtactgtattttatgtgtgcttggtatgtttatatgtctttaattctattacaatttttttattgcacaaagaacattataacaatgcataattatatatcaatagcaatattaaaaataaagacaaaaggacacattcagccaaatgtgccttcagtgtctggcaggcaagtatggcgtagaaagggcaataagaggcagttcctgcctttagggggcttccaggatcgagcctgcagtcccagcaccctattgaatcaactgtttctgtttttccattttagttgtgtcactcaggctttgggtgatttattaagagaaccaataagattttgctcaagattggaaacaatctctttccacatcatttaagcctcagttgaagcttcattttcctccttcagcttcacctgagactccttctggcaaaatcccgctgctcctccttgatcctgtagttttctctgttttaacccttggaacatgatttataattcgtgggatgactttttcttttttcccaggaaatgatacctttcttgaaggcaggaaactgtgttttgtctgtattttgtgaatccccacaaatatttgctggatgaatgttcttggggacactgccctagatatagtagaagcagaagtatttctcggtttttgtgtttttttctggaatgaagggtaaggtgaagggttatagacagaaataagactgattgagtcataattgcacctttgtcagtcactcttgtaagaattttacatatgttacacttcactcagtccttataacaaccctatgagatagcaattatcagctcctccctcctctccattttaatcatgacctctcagaaacagagaggtcaagtgacttactcaaagtcacagctagtaggtggcagttagatctgaactcaaataggctccagagactgggctcttgaccattattcttcctttccaaggttggaagagactgagagacctcagctcctgaacacctggaactgccaagccacagctgttactattactgtactgttactaaagagccaaaccaaaccacatggctggctcctttggcaagaacttcccctccagatgtgcctctacttagcactctgatagtgagcacaggtgagtccgaggaaagcaggccaagaagtgctgatgagtttctctctgaggcccagggatacccagccatgccaacaaccagccctcccatgccagtccacgccctgtagcctggctctcttactgctttaggagccctgggctctcttacacctgtgtggaagagggagggactcccaggaacataattaggagtgggggaagggaggagaagaagggagggaagagggggaggggagaaaggacatgcatttctaccagggtaactttggtttccttatattaatataagggacttgaactgtgttattctttctcaaattgggatttaaggccccaaggaatccaaaaattctatgagaactaggtatttttatgtaaatgattaactaaaacaacgaatgtaaccttattctggatcatcttccaatggagtcctgcctcttgattttactttctgaggttatgtttgtgactgtgatgcatgcaaatctcagtcacctacagtggccacattcagacaatttgaaatgcattttatattgtaacccagcacacacacacatgtaaatagaaatgcaccaggagtttcctaaagtattgctcaccctttctgcatagggagtaccctcttgtcacctctcttctattcccaggtagtcatgacccactatcagattacaaccttcaataaaaagatcatagcatgtaactgtaagcatgatcagtctgccgttttcttttgcagtggaaatgttccattgaaagacattttatagaatacatctttaccaccctaagttgtttaacaaactgaatctttgacttgagatcatgagaacaaaataaagatatgaaataatgactgttttattctgaattgctgaaaaaatacccagatagtttaaagctgtaaatcagaacagggcaaatcagagtctcattgctgtaggggtatagacagaaataagactgatagagtagtaattgcagctatacaattattttcatcaaaacaacctatatcaaagtagccgtgttatttactttgtaagcagatatagtgcatggatctcatctctgaatatgccagcttaaaattcattagcagaaaatgtggtaagtgtaccatgatgacttactttttcattaacttaacatttgggatacactgtattagggttctccagaggaacagacttgatagtagatagatgatatgatattaatagatagattgacacagagagagtaacagataggtagataaatatagatatgaaatttattgtaggtattggctcacataattttcgaggctgagaagttgtgtacaagatgcagaatcaggaaagctggtggtgtaattcagtatgtgtgtgtgtcggggtagggactgggggtgtatagggtggatatagtatacgtcccagtcagtgttggaatgtccaagaagagtgctgttgcccaaatgcaggagaggatggatgttccagctcaagaagagagaaaattcacccttccttgcttttttgttctatttgggccctctacagactggatggtacccacctacattggcaagtgatatggtttgattctgtgtctccatccaaatctcatctcgaattgtaatccccatgtgttagggagggacctggtgggagatgactggatcatggggacggttcccccatgttgttcttgtgataatgagtgagttctcacaagatctgatggtttaaaagtatggcacttactcctgctctctctctctctctctctggccactatggaagatctgccccttgcttcccctttgccttctgccatgattgtaagtttcctgacatgcatactgtgagtcaattaaacctcttttcttcataacttacccagtctcaggtagtatctttatagctgtgtgagaatggactaatacagtgagggtgatctttactcaatctgttgattcaaatgctactctcttatgaaaatacccttacagacacatccgaaaataatgtttcgccagctatctgggcaccccttaagcccagtcaagttgacacacaaaattaaccatcacatacactattaaagtggctgaatcatttattctggattagggtgattttatcattgtggtggtagttaatacacttttctgtttgctatatttcctgtaagctagtcgttgaatctagaggcttgattagattcaggttaaatatttcaggcaagaatatcttttattggtggtgctgtagactttcaaccataccacatcaggaggtacataaagcctgtcagtcccatgtgtaatgatcatagattgattggaggttttgacattttcaccttgatctttccattataaagttccttatcaacctttcacaatggtttaatgtttattgataactgccaaattccagtacttcatgaggtggaagcaaaatggtagtttcctaattcctacattcttctgcatttattagctggtattgatctctgaagaactttccctccttaactatttgattggccttagatgtagttcttaggccctattttattttatttttatctatttttttgagacgcagtctcactgtgttgcccaggctggagtgcagtggtatgatctcagctcactgcaacctccacctcctgggttcaagtgattctccagcgtcagcctcctgagtagctgggattacaagcacccgccactatgcctggctaatttttgtatttttagtagaaatggagtttcactatgttggccaggctggtcttgaactcctgacctcaggtgatccgcctgcctcagcctcccaaagtgctgggattccaggcatgagccacagtgcctggcctttaaaaaatgtttatttaaatagttttgggggtacaggtggtttttggttacatggataagttctttagtggtgatttctgagattttagtgcacccgtcacttgagcagggtacactgtatccagtatgttgtcttttatacctcaccccctcccatccggccacaacaagtccccaaagtccattacatcattcttctgaatcctcatagcttagctcccacttataagtgagaacatacaatatttgttttccattcttgagttacttcacttagaataatggcctccagctccatccaagttgccacaaaagacattatttcattcctttttatggctgagtggtattccatggcatatatacaccgtgttttctttatccattcgttggttgatggccacttaggctggttccctatctttgcacttgtgaattgtgctgctgtaaacatgcatgtgcatgtgtctttttcatatgacttcttttcctctgggtaggaacccagtagtgggattgctggattgaatggtacttctacttttagttctttaaggaatctctatacgttttccatagtggttttactaatttacattcccaccagcagggtaaaagtgtttccttttaaccacatccatgcccacatctattgttttttgacgttataattatgtcttaggctgtattttaaatcagggctctctgagcttgatctcatgtcagccatcatcatatcagtgtgaaaacagactagaaccaggtatcagtgatgcagcagccaggagaatttctgggccaggggccaggccacaagctgcatatcccaatggccaactggtcatggctacttcctttttctcatctagtgcaagctcaagaggtgtgggatgggacaatattccactgttctgcaggtaaatgtatctttgtggggcctctgaatgtcctcttcggtctgctagtctcctgacaaggggggaaaacactatccagaccttttctctgggaggccatttgttttcctgtaatctgtagaagaaaccaaggtacttttgtgggtgcagcatctcagttactgggggagcttctcagtgtgagctctgaatgcttcaggatgtcttccaatagccagcctttcctctgtgtaaaaggtttctctggagtaatggagatagcatgtgtgcaagtaggcaggagctccccttagtgtcagcttgagagcaaggaagggagaggagagctatgcctctgaaacaataccattttgcccccaatgccagttttatttcagagataaaatgccatgcttcagagccatcaatgataattgtttgagattgatgacctttggaagctgacagaatactaacttctgggagaagactagagtagatcaggatgatttcttggtatactctcagctgtttcccaccatgtgtttcctcttctttctgatatacagccaaaatacatttcccagtctgccttgcagttaagggaaactgaggtctcgtcaatggaatatgaatagagaaatgtgtaccacttccaggcctggcccatgaaaacctcccatatgctctctctctttcatcttccttttcccttcaggctggctggaggggaggcagctcctgggagagatttggaagttggcagagctgctattaagctgggttcctgaatgatggcaagaaagaggcccactcctctatcgtattcacctgccaagtattgtttgtgagcaagaaaaaaaatatctactgtagttgaggccatcttaaatacagtttctcttttaaagccattccacgtccaccatttggcattaagcgtctttaaaaaaaactgtgagtgccctgccttgccagtaagctgttagcaagtcttaactcgggagatctgtctctcctggcattctgagaagcagaagtctcaaattacttccagctgaaatggaaaagaaacaaaacaaaacagaaactcatctgtggtaggcagactaatgtccctcccaccgagatgttcatgcctgagtccttagaacctgcaaatatgttacctccatggcaaaggggactttgcaggtgtgattaagggtactgatcttgagattgggagattattctggattatctagatgggcccaacctaatcacaagaaaacattggaaaagggaggaaaagagtggatcagaccgatgcgatgtgatgatttgacccactgttgctgtctttgaagatggtggcaaggccttggagctaaggaatacagtctctagaagctggaataaacaaggcaatgcaatccccttagagcctccaaaagggagcacaggtctcagaactgttaagataataaatttgtactgtttgaagtcattaacatttgtggccatttgtcatggcagtagtagaaaactaatacaccatcccatacaaaacacttaaatgaaaaaaaaaatacatacatctgtagagtaggcacatctgtaggttcttaatgcctgtcatccttatctggaaacttgggtgtttaatgcattttggcaagagtgatgccagtgaggatgttccttggtagcttaaatatatccaggctattgcaatgatgcctgacattgaagggaaaatgcacacatttagtcagtcacatgtatgatttcaaatatctggattttggaattgtataaccaggtatataccagctacatctgaggggaaattttccgttttcatccagatgctctggtaagtgctgacatacccagactatgagagatttggatcaaactaaagaagtccccaagtctcaggagaacaatgaaatgtagtgcggggtgtctgccggagtcatggtgtactcatcagaatgagctgctgaacactgtggtcaggcccttggctagtgacaccattaagattttgtttccttctaaatcaccacccctcctctactgttgaaatgtggctgtttcatctctccattagagtccttccaatttacaccaagcaaaacagttggaaaataaaacttcatggccaggcagtgggtaggagtgagagggaggaggaaaggatgtagacacataattcagaatcaaacattgaatgaaggactcctcgattcagaccccatctcactttgcccatggactcagtgtctgaccttgcattaccctccctgatcttaacttcccagaactctgacagatgattaataatacctgctatacaaagggggtgagaactaataaatggtagttaaggatgatgagtaagccgagtataatagctactgctttcaagatttctcagaatccattagagtttctattgttttaatgactgtgatgagttcagtaagtcatttctgagttaggcaccacttatctttgtgtactgaatattcttaaagccacagttacttccttgctggggttataaagcaattctgaagaccaaatcatgttgcctttgtacatatccattgaggtttctctctcttactctacatggaaatcctgtaatacagatttcagccttacaccgagaaaatatatatttctgagtctttttttcttaatatatatgtgagaaaactctaaagtaagaataaatggaaaatcattagaagaagtatagaaattactttgaaagggtatatacagtctaattcatttatttttattttagaaatttgaatgaattatttcaataaatgtatataaaagattttacattacgttatactcagtttttctttttctttatttttttgagccagtcctccgagcctgtttcctcaactgcccttttctcctacccagtacatcgagctgttcagtgaaaaagaacagtgttttgtgtgtataaataaataaataaataaataaaaataaaaataaacagctaactaacgtaggaaaccctccttctccttccccaacaagttgcctgaagaaatatgtattagcaagactgctggaaatccacatttgttacatgaaattaggacattaaaactgtatcctgctgcttagtgcccagaccttgtaccccatgcagcagcctgcttgtcggccatggaacaatgtgtagcaaatgccttggtgatgacatatctgtcagagggaaagaaggagggcattgattatcataatgcggcatagagctcatttccttctgaaattacccagagatgcttggctgggcaaagtacagcaagtccctgaagggggctgtaatttctcaggcctgttgaaggaaagaagaacaatatgtgtgtgagttgctaagtctttagacgttggcagtggcagcaggctggtaatgagcagattaggtatttcaatatgtttctttgcctcgggaaatttaacaggtacacctgttttctttcagtggctgaaaatgtcagttaccatgagcctggtgtagttggcctttttgaaaaaacaagagaggtggccgggcgcagtggctcatgcctgtaatcccagcactttgggaggccgaggtgggcggatcaaaagatcaggagttcgagaccagcctggccaatatggtgaaacctgtctgtactaaaaatacaaaaaattagctgggcttggtggcgcatgcctgtagtcccagctactcaggaggctgaggcaggagaatcacttgaacccgggaggcagaggttgcagtgagctgagactgtgccactgtactctggcctaggcgacagagcgagactccatctcaaaaaaaaaaaaaaaaaaaaacaaaaaaaagaaaaaaaaggatggactgacacgtggtcagtctttgttcttctggtggcttggacattaacaaagtgttccctacccacttaagcttctcatctgcatctgcacatcagtggtcttcaaactttttttgttatatgccattgaaagaatgttttaaaaactgtgtaccatctcactgtttaaatctgacatctaaatatttccatcattttaaaaataaggagtagaagacattacatgtttcataaggtaaagattgatggtgtgtggaataaatattttgtgacatgatttgatgaactaggttttaatgaccttattgaataacatgttaaattggaaggaaatcagtaaaaagcttatatgtagactttatccagcacatcttgaaagatctgatgacttcagaaaacactgtggttatttaaagataatccacatcacttatatgtactactttgtcctgaactcagaactacccaggactggccaaccctactcttacagacttgcttgcaggacagggagagacagaaagtgctaaggcttcccccaaccagtatttggaatcatttagtgtagcacaccatattaagatttgagatatgagtggtgtgactttcttttgtagagtgggtgaaagaatattgttgatgcccaaaggctctcaggcagtttcagaattagtacatatggaaattgaggatgtagaaactcatttttgtgaaactgtccctgctctagtacctttgggaagtccatttgaagactgctggaatagatcatggactcaataaataccttttcataggagcacagagggatgaacaaggcagactgaaggagagaataggaatgctccccatgtcaggtgtgtggagggtgcaccaaggctcattctggtagaggtagaggagcttctcccaaagtagcaaactcagatcactcatggtctcagtccccttaattctttcaagctgctggatcaagaacgaggcagccagccctccagctgatgaccagagacatttattatctaccatgtgctaggcactgtcctaggtaccagagacatcctggtaatcaagacaaagttccacgtttgtgaagttggggatcagggaggtggagagacagagaaaataaacaaatctatgagaatctatgagaggtagagataaatgctatgatgcagatcacctgagtgatatgactggaatggcacctccagcttggctggtcagaagtggcttctcaaaggaagtagcagctaagctgagacctaaagccatccaaataaaaaccaatgagtacatccatcagtcagcaagtatttatcgggtgcctgctatgtgctaggcactgtttaggtacttggtttacattggaaaacaggcctggggatcttacattctaactgggtgagaaggggtctgacaggcaataagcattataaataagtaaattacctggtatgttagaagatggtaagtgttatgcaaaaaaaaaaaaaaaaaaaagtatagagcaggctaaggaacagaggtagcatgggggtagtgtgtgattttaattagggtgggtggggaggcccccattcagtgggtgtcctgggagtgaagacttgaatgaggtggaggagtgagctgtgtagaaggagctgtgtgaagggagagctcaggctttcgctctagctctccctcacacagcctgttctcatgctgctaataaagacatacctgagactggctaatttataaaggagaggtttaattgacttcacagttccacatggctggggaggcctcacaatcatggcagaaggcgaatgaggaacaaagtcatgttttaattgctggcaggcaaggagagcctgtgcaggggaactcccatttataaaaccattagatctctcgagacttattcactaccatgagaacagtatgggggaaaccgcccccatgattcagtgatctccaccgtggggattattacaattcaaggtgagatttgggtagggacacagcaacaccacatcagttctcattttattatcccatgagaacatccagctcccctttattgcagcactgtgcccacccagtttctcaaggaagccaatgagactagcagacattgtcaggtcacagtattttggagtgctctgcattgcctcttatcagtccagctctttgtggcttcagttgatacatttcagtccccaatcacctctgagtgagccaatgccgttgagtagctgcatgcactgagtactgcattgcttgcccaggtcacctctgaagatcccctgccttcctcagactgaccatgttcctaggaggtcggggaaagtagaccacagtggctcatctcaagcatagaatctttgtgaaggcttctttttattataaacatttttgtgaaatttgacttctttttttcttttttttgagattgagtttcactcttgttgctcaggctggagtgcaatggcgccttcttggctcacttcagcctccttctcccaggttcaagcgattctcctgcctcagccttctgagtagctgggattacaggcacacaccaccacacccagataattttgtatttttaatggaaacagagtttcaccttgttgaccaggctggtctcaaactcctgacctcaggtgatccacctgccttgctctcccaaagtgctgggattacaggtgtgagccactgtgcccagcctgaattttgacttctattcataatatattcatatgtgttttaatataaaatgtttatcatttaaatggattctccaggaaaatacaccaggtttattcttttgctgtgcatataattgtgctcagagagtagttctgcctcagtttgaggaacatcggtgttctggaagaaatcctggattgggggtaaagatatggggttctggccccatctttgccataaattagctgtgtgaccttgggcagatcatttaaacccattggtctccattttctttgatgtgaattgggtggcagtgactgatcagattagatcacaaaatcccttccttctgtcatgctataatgacatagagtcttgaatgccaggaccatgcctccccagtgcctgagtggttgtgcttcctagaccccaaggtccagtgtgtgccagtatggccttaccctctttactgcctcagagtcacagtaaggacttttctttataattgaatgaacacggaatgaatgggcatcttggcatagctggtttacacattattcttgtttcccttttctacatatatgaaaatgtgaactaaatccatagccctcccttggtggataaagacatgggcataatagttccatgaatttagcctctttttgtattcaacagtctcatcccttcccctcaacttgtgttctccttgatagaaatctaaccacttctacaagtggcagctaaagcattagtcttatataaccttctcgctcaacaactgaaaagttgtacaaaccttttaaagaatttaccatcagcaagggctgtgcttctaggcttgtccaaattgcgtgtaaagtacactctctaaattaaccagaccatattaactctgaaaacaagactcactcttcttaagctatgtctccagactgtaccaaattgtactttctcttgaagtaggacattctgtgccctgtttgaaagctggcgtgactaatgtagctggaattgctgatgagagaagacaggaagagaaagaaccgatgtgccttaagaatagggaatttcggctgggcacggtggctcacgcctgtaatcccagcactttgggagaccgaggcgggcggatcacctgaggtcgggagttcgagaccagcctgaccaacatggagaagccccatctctactaaaaatataaaaaaattagctgggcatggtggcgcatgcctgtaatctcagctacttgggaggctgaggcaggagaatcgcttgaaccctggaggcagaggttccggtgagccaagattgtaccattgcactccagcctgggcaacaagagcgcaaatcagtctcaaaaaaaaaaaaaaaaaaaaaaaaaaaaaaaaaaaaaaaagaatagggaatttcactaggccctttgcagaatgcagtatggctgatgtgtgtattatgacatggtaaatattactcctagcctccttgtgaaacgggctccatgtcatgcctcaaggccctactaagtcattgctagggctgagcctcaagcccagccccaacagtaggttcaacctggccttccctcccagcactatcactgcctgtctttcaacctatgctatacattgtgacaatcagttaactgaggtacaagtgtatttggatttatgccagactgagaatgagaaatattcagatcacacctggaaaatgcaatgcaaaactcccttgtcttgagctaaaaatctagaagcatttgcaagtgactaagtcccttagtttataggtatgagcctgtgataagttatctttagttgtttctggcttaaggggatgtcagtgacttttcccttagccccccctcctggaacagccggctgctggtggtctagttttttgaaagaagccctgaattctgaaacctcatgctggggttttgggttagtgtttgcattactgactgtggtttcatggcatgataatgcaaagtttaataagagcaggctgtctttgcctacagctagagttgcattgaggcatgactacttctagtgcctgctctgtgccagattcacagtgccttacagcccctccccagaactggggcagaggaggaagaaaaaagtgactctgtggttcaggggaaggagtaaagtttccaggctgtgtgataggacatttccctgatgcttggctttaggctcaggatggggacgttaatacattcagcagaggctggctacctatactggcaccattgaaggactctgccctggctcagtgctggttttgcttggtgatgcagtgtagtgtagcaggatgatcaccagctttaaagccagatcaacccaaatttgaatctcagcattagtcctcactctgctttgagacgtcgggcaagtgatttaatctcttgaaatctcagtttgttcatctgagtaacaggtggtaaaatacatacattgaaacgctgctaaaagattaagcaatgagaaggcaaaatggtacagcaactttgggagacagtttggcagtttcttatacaactaaacatactcttaccatatgatccagcaatccatctccttggtttttacccaaaggaattgaaaacttatgtccacacaaaaacctgcgcacacaaatgtttgtagcagctttattcataattgccaagactgggaagcaaccaagatgcccttcagtaactgagtggataaactgtggtatgtccatctgtatcttttattcagtgataaaagaaatgagctgtcaagccatgaaaagacatggaggaacattaaatacacgttgataagtgaaagaagccagtccaaaaggcggtatactgtatgacatctggaaaaggcaaaactatagagaaagtaaaaaagatcagtgattgccaggccttcggggaagggagtaagggatgagttgatgaagcataggggacttttagggcagtgaaactcttctatagtatctagaatactatattactctatcaatcatagaatgatactagagaacatactgtagtgatggacacatgtcgttgtgtatttgacaaacccttctttgtgttgtacacgaagaaggaaccctaatgtcagctatggactttagttagtaagtcttctaaaaagcttaaacaaggcaatgtgtataaactaactgactaactggcataaataaatagtggacttcaaaaaaaattcataatcctagcactttgggaggccgaggtgggtggatcaactgaggtcagaagttcaagaccagcctggccaacttggcaaaaccccatctctactaaaaaaatacaaaaaaaaaaaaaaattgtattctaagttccaggaatgtcatttagacatagtttcttttggggctagatgtatcaattttcattaaaggtgatattattatttaaaaatccagctggttgctaaatgagaattagctaccctttataaccagggattgtttcaaagaaatgtagttattttctcccctgtggcctatcttgtgcaaagttagtaatagtttgttgccaaatccaaggaaagcaaactctggctcaggcatgagatttatttttctcaccatgatttacaactggtgtaaaattcaggtctggacttggttagttataatgctatcgcaatataccgcatcttgagttgattttgccatatcctgtattgttatgtaaaatgctaactttaattgagaattgccccagtagaatatccttatttgtcctgcatgaagtttctcctcttttgtatcaattttttgtatggttcaaattagtgcgggaagaaaaggcaggaaatacaaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagaatttcaagtaatcagggaaagttgggacagaaacttcctctgtctttccatggccttttctttttcctttacggatctgtgatcctatgctttctctcacattcacattatatgtgtcagttggagaaatcttgatgcccagtttcatttgtttcttctgtcccacctgtaactaatttaggttgagttctccggctcatgtatcagagtgtgtatgacaaattatctcaaagcccagagggcctcggtggtccaagtcccagcaacaagggacacctgctgtcatgacatgggcttgacctgggttctgtggacattaaggaaccactgtcctgagaggggggtatggagctaagctaggggagggagcaggatgagcttagagctgccgaggaaacggaaagagtctataggctttaaaaaagaggagagaaagaaagaagaataaaagatgtttctggagactctgagaatagttaagagtccagggccagccagaatcaccctttcccccagctaccgagagtgccacagagcagaaattgacttggaagatattgctcctagaccaaaagtccaaattaaggggtataggcagttaagggcaagtgagggcagtagagatggttgtccgagtccagtggccatgagaggtttctcagctgcctgccaattctcttctgggacaatgccagccataaagtacaagccatgctttggtgtgggctgtagacatattgttttcccataactactgtcattcaaacaggatctagtttcttggcatgagcaaattgttcccgctgaatacacacactatgtccgctatggggcaaggcaaagcgaatcctccaaggaactggatggatttttcattctgagataagcagtttttttgtgggggcgggggaggtggagaggagccagcttcactctctgttcatgcgagttttgaatgaaatgagtaaagttcatgttccccccagagtacacaaggttcaagtgggattacccagtgggaatccagcccgattgtaatttaacttgttcgagggatctaaatatttaatctgccttcatcacgaatcctagaatcctatgtaagcagcaaaggccgagggtctgaaagtaaacactgcagttagaatcagaagtgttgcaactagcacaactgctgctgtgacgtcctacaaactttggagagtgccagaggaagctagcctgagagcacagaactggcagtcacgaggcctgcattctccagcttcgcctgccaccaactctctgagcctccaggcctcctttgtcaagtaaggacacaagcaaagcatctcagaagacaagtcattttcataactggaaatgagacagagccaacaaggatgcgtgaaaccagccacataaattgtgaaacctatgtgatcatgtatatgtacaatgttttcttaaaaaaaattaccattcctagatctaatatcaattttttgtatgattttgccccacattttgctcaaattatgcagtgtttgaaagagattctctgcagaggttggaatcacccccttgggtgctggtagcaatctgtgaaggtagctttttagatgtcacaatgattgggggtggggtgctggtgacattggatgggcaggtgcagaactgctaaacaatgctctgggcaatcccacaaagcgaccacctggcccatatctggcatgactttcatgtcccgccggacattcaaggaatccgactatgttttctatataaacatatagtatttttcacatctgaaaatatacactgaattttccaggactgtgtataaatagaggtaagattgtactttattttgctcagaactttaccaagagttattaataatctccaaaaaatcaaattatagcaaacactaatgatgtttgagtcactaagcaacacacctatatctgtctgcattgtgatatcacattcgtggttattctacaggtacaagaatctgagcctcccttgtcctttagtgcaatcaagcagagtatccacatactgaaatacacaacattttctgtaagctattttcttttcatttctcctttgtattacagttttcatgttatattaatttaaaaacatgggcaggttatatgatctatggattttataccagattagtagagtactataaaatgtttgttataaaaagtgtgttttatttgattgggttgaaaacttctgggccaggtaatcctaaagtctcttagcttttaaattttgtgagcctgtgagattatttagccaaatgccttcatttttactggtgagtaaactgaagcccattcagtctttcatgcattgtattgcattcagaaattgctgtgatcattgggaggggagaatgaaactaccaagcaaaagaatatgattttagtttattctctcctttcttttccaggattacaaaggcccaggaatagctagttagcttgccctggtgtcactgctcactcctgtgaagaataaggataaaccatgaggatagtagtggtaatggtgaaacagaaagaacacagaaagctgattctagagtagggctatctaatagaaatatcatgcaagccaccaattggagccacatatgtggtttacatttggaagtagctacattttaaaaagtaaaaagaatatgtaacattaatttgaatgatatattttatttaacccagtatattcaaagtattattatttcaacatgaaaggaatagattattattttttaaaggcttaattttatttatttatttacttatttacttattttttgagatggagtcttgctctgtcgcccaggctggagtgcagtggtgcgatctcagctcactgcagcctccgcctctgtggttcaagcaattctcctgcctcagcctcccaagtagctgggattacaggcgtgtgccgtgatgcctggctaatttttttttttttttggatttttggtagaggcagggtttcaccatgttcgtcaggctggtctcaaactcctgacctcaagtcatctgcctgcctcagcctcccaaagtgctggaattacaggcgtgagccaccataccctgccagaaaacaattattaatgagatattttatgcttcttttatactaagccttcaaaatctggtgtgcacttcacatttagagcacacttcaattcagacacagatcatttcaagtgctcagtagccacacatgtctagtggctgccatattgggtagtgcggctctagtgcaatggctttcagcagttcttctgtttctacccagttcacctgtctaggcaggagacttcccatccctgtagaatgacaatggatggggaacgggggtgcagcaggtggagtttaccatcacctactccctgcactcgtctgtgcactagagtcataggcttaaaaaatgtgagacggtttctgctaagacttacttgcaaggtcatgcgacgacgtagcagggttcaagccttggaagagaggactagtgatctgaaatcagaggtctgcctttggagaagtggttgcttgccaggaattagagggcttagtcctgtagaactttactgaataattttacaaatatagtatttttaaagtaatacctttttttttctcattgtatcttaatctcatttggctcattcatggtgcacaaatataaaaggtattagaccagatgattgtttaagtctctcctagtcgctgtcactgtctcctaatttggaaggaggtccatcggagactcagatctggtccttcaagagactgtgacttccagccaggtctctccccaagtggctctgaggtttttgaagtgtgttttcaatgcccaagagctgtctatgttcagctgtgtgtgtgcttgtgttgtggagtcgggttcgggacagggaacgtggagcttaaccaggcaaagtgctttacgtctatgaccctgttgaatcagtggaacaaccatttgaggtcgatgctgtcgttattctcattttccacaaaaggaaacagaggcaacagaggttaagcaactcctccaaggtcacagtggctgtcgccatttcattctttatggttggcgggctgaattttctttcttggtggaaacctgcctgccccttcttagtcatccttcttttcctcttcttcatgacatatttttcccttttcttcccctactcctcaaccacaaacacgcatcagatgaggagcacctcatcataaagcaggttggggccttcgaatccactctcggtggcccttagatttctcaactggttttccatttgatggctcacattccttcttcaggaagctcaggctgggaatgcatgacactctcctcgcacttggtcattctacagccagtcagggatcctgttggcctgccttctcttggggacccagaatatgggagctgttgctactactgttgcaaccttaacctgtcataagaagaaaagctgctttccaagaccagaggaaggctgctggccgtgcagcggtgccttgtggatgggcagggctctgccagggttccccccgccaggtctggtcctcagcttcgcaaaccaagggattcccagacccagagcagatcaggctcggaaaagagataggagaaacagattcatgaaccgatgtataaatcagaacacctgtttgttaatgggttaagataaaaattcctcctacaaggacacgaacatgcatgcttgcaggtcagcatatttttctctctgtggaaaaccttgtgtgaagagccagactattatctgaaggttatttaatgcacttggaaacagagctaggagacttagattattgctgaaaatctaagtatttatatttgaagaagatgggatacaaaaaggtacctagtgaaaaggcagcctctccttcacacctccccactccccactccctagccccttcccaggggcaacccttaggaccaatgtcttctgtaagttcagttgcctgaggcctccatttccttggcagggatggagctgctgtgcaggccaggtgacctgtgtcttctggttaggctcccttcctagacgggttttgtcttgacatactagcgggtgggaggtggggaggaacaaaaaccgtgggagtgatagaggccagttggcagaggaggcatgcaggggtttatgagttagaaatatctgcagagggggcaaggggtggggcgaggagtgacccagtgacaacagaaaggagtgtccccagacccctggcagggagcagacagtggctgttctctgacacttatcagcccctaaggaacaggacaggaaggaaaaccacagggtgagagaactggggagactctgtccctgagaaatcctcccaaagagacagagcatgatccaaaacctcgtgagaggcggcctggccccacagcattcgtgccatagcataggtcagtcctgtcatagagtgcaaccaggtaaggtgccttccagcttcaatgctgtgatctagagaccgcactggcgaagatcagcagcaagaaagaacaattagccaattcattatgttgacatttctagctacaaggccagtattttacaaaataaggccttttcccttaattaaggttgtgacagataaaagtatattcccagctgactcatgtcacccatgtgggcaggcctattatccctacttggcccgccctgtccgcctatgagggcttgctctgtgtgcgtactcttggcagctttataaaggattcagaaggaataaacacagggcctggttcctgcccttcatccagaagagaagactcattcatacacatggtccaagccagcaaactttagttgctcaagagcaggaaaataaggctaatgaaggaggggaacatctagaaaccagctcaagcaaggagcaggggtatttaatgtggaagagtgagaactaaaagtagccttgaataccatttctgacgtttgaagaggcagcaaagcttaatgtgtggtggttaaaggcatgactcagaagccagattacttggttcaaattctgattaaacatctctggcctgttcacacaaggcaagttacttcatctctctgtgcctcagtttcctcatttaagaaagtgaatataaagaaaatctaaaaaaagaaagtgaatatgatagctatccttcagggcaattgtgagaggtaagcaggctaacacatggtaaatactcagaacaatgcctgttagggcaaacactatagaagtacttgttacttggtgtgcgtaagagggcagggagctgactgtgggttgcaccacataaccgaaggagaatcagtgaaaaatcttcttcagtatatagactaactgtttcttttcatattagagttagccaacagaagacttcaaaaataacgagcaaagaatactccagatttcgaagggattgattctctaactcagacccatgtgggttctgcaaatctagtcattgacttgacgtttttcactctcatatcactcaggcatctcatgcttcacatgttcaaaagtcatctctgcttcccatgtctacctgctcctccttcagtcttttccataccagccacccagtcattcaaggtagaaactggaccatcagccccctttgatgcttccctctgtcttgcccctgtatttaatcagtcacaaacagatgtccattctacctcctcaatatctttggagcctgtcttttttttcctccacagccactgcctccatctgagttcaagaatcatcatcatccctcccctgtaggaactttctagcttgccatcttggtttacccctgccccatggctagaaaacctgcagggcaccttgatatagaaaaagcatgctccccaaggtcaggagatagagaccatcctggctaacacggtgaaaccccatctctactaaaaaagaaaaaatacaaaaaattagctgggcacggtggttggcacctgtagtcccagctacttgggaggctgaggcaggagaatggcgtgaactcagaaggcggagcttgcagtgagccgagatcataccactgcactccaggctgggcaacagagcgagactctgtctcaaaaaaaaaaaaaagaaaaaaaagcatgctcccctctgagaagacgcatcactgggccaggactttatgcagcccaggggccagatttccccatcgcttgccacttagctggtgctcatgtgtttgccacactggcttgaccaagtatagtggttcttcttttcagttcattcttcccacagcagtcgggatggatttgtgaaaatgtaaattggatcatgccccatttctctcagatatcacccccatgcccagtccctcttggtttcccgttgcccctgagctccagatcaaatcccagctctgtcctgtcacctgcagtcccacgctgtgtcatttctggctgcattatcaaatagccattcatcaggaaggagattttgctgtaaaaacatgctctagagtagatcataggatgttagctcttaaagagagcttagagacactgcctgatgcagaggccaaagactgtgcccctgagggctgtagccagcttgcagacacattttgcatggctcacagcatttaaaaatcgttttaattagttgacactattaaaacagagattttacctaaaatatagacccatggctgctcctcaaagattagcagatgtgaagacattggacccttctttcagggcgacagttggttgcttctgagctgccactgtcccctgagatggggcatgcctgccccagttctccccagcccgcatagctctgtgttctatactcatttatattccctaccaggcccctgtagacattggcattttcagctcctaagctcgttcaacctcttcattttacaggtttggaaggtgagaccagagagctggcacatcggtctctaggtcatgtactggatcatgaaacatctgatggcttctgactcccagtcccctagtccctctgttgaaccatagctacctctcagtggaaaactaaaaagaaacacaccatgtaacttgattaattatccttcctgctgtgactgctagccaacgtgccttttagttgttttgcttatatctgttgccacatgaaaattggaacatatggtctggagggccaagatggtattctaagaatatctcataccctgcatgaaactagaccaaagaagaaaggtagagaaacagagaggattgacaatgacagggaaaagaaaatctggacagcttttgagaggggcacagcctcttccttgtggtgttgcaggacggtagggagtcagttgggtttccactctttaagggatgtgaacatcaagatgtagacagcaggccaggtgtggtggctcatgcctgtaatcccagcactttgcgaggccaaggcaggtggatcatttgaggccaagagttcgagaccagccttgccaacatggtgaaaccccatctctactaaaaatacaaaaattagccaggtgtggtggtgggcgcctgcaatcccagctatttgggaggttgaggcacgagaattgcttgagcctgggaggcagaggctgcagtgagccgagattgcgccactgcactccagcctgggtgacagaggaagactcagtctcaaaaaaaaaaaagatgtagacagcaatgagtcagtggcacaaaaagaattgaaaggccttttcttctttaggcttgatgccccatcctaccctgccactcccttagaattactgtggacagccagagcactgcaaaaaagggaaatttgtcatttgccttggggaacaatggctttcaccaatcaagaggcaaaatcaaccacagtctcagagcctggagtaagatggaaaaatcttcctgttgtctttagaggaggaggttacatcatttcttacagaaatgagccttgacaacccccacatcccgatactgcatcctctttgtaccacagtgaattgttgccatgaagctgagacaaggcttggtatgggcaactccaggcatgggcaactccagacctcatcctagtggtgatcctgggctccttcttcataagcaatagagaagcagactgtttgggaggaggaaaaagtagtgatgggacaagttcccaaaaagaggccatgggagggagttcagtgttacatgcagtcaccttttgggttttgtctctattggattattctgttttttgtttctcattggagtctagaaatgtttaatgatacttgatggtacttcctttatccatgtaaaagtatatctaagaacttctgcatatattaacactctgtaatgattaagccaatgtaattagagtattgtatcagcaagagaaatatttttctctagacatagataaatcaaattttttctttcaaatctctgtgcaattgctccaaaatggaaatcagttttatgatttcatggattgtcatctccttacaacagcagactaatgaacatgatgatttatgcaaacaaaatatactcatttaagaatatgctcgcattggccgggcacggtggctcatgcctgtaatcccagcactttgggaggccaaggcaggaggatcaccaggtcaggagttcgagactagcctggtcaacatggtgaaaccatgtctctactgaaaatacaaaattagcctggcgtggtggcaggtgcctgtaatcctagctactcaggaggctgaaacaggagaatcgcttgaacccaggaggtggaagttgcagtgagccaagattgtgccagtgcattgcagcctaggaaacaagagcgaaactctgtctcaaaaacaaaaaaaaaaaaaaagaagaggaagaagaatatgctagcattgttgatttggtttatagactcccaaaggcctgttcctctgaccctcttaatgaatacaccaaaagagtgattaatggattaataagttagctccatcccctttcacttcctacccttagactaaaacaattttttcaaattacttctactaatgttgtactttcattaattggttggatcaacagggtagaaagctgttttctttttcttttaagaattctctgccactaagttcttccagccaaagaatgttcattcactataatacctcttcagttcaggcatttatttacttgaagtgtgaatccattgctgttctcatcgtgtctaactttgtctttttagaagtaaggtatttttccttgcctgtggttcacgcagaagtggagataatgattgtgttgagaattcagggagagcctgcaagtaggtaatagaggtgggaagtggagtgagtaatagtcagaagagaaagaagcaaggctgttggaatggagaagtctaaagagactgtactagaaggaactcgaatcattaaaacctagctgcacaggccgggaaattgtcaaatatcagagagtctacagttgaagcagcttgggaacaactctctgcagtaaaaatgctgagttgtggagaacacagtgacccaaactgacaaaataatgaaatacatggcgtttccccagtgaatggaaagctgctttttaccgtgttccaaaacactggctccgtttggtgtgtgttttgtttttatttgtaataccctactttgatgtttcctggaaactctcctttgagtctgtgagttttggtgtaagctcagtggcaatgttaccctcacctctaggctgctgtaggacacaccccggtctcattttcagtgtctcagcatactttccaatgcttccagtaatggattgtgcaaaacacaaagccaaaagcagatgggacatatgtagataagctgtttcatttttcatccctataatttcctaggtttgatagcacttcaattttctaaccataaaagctgcttctgtgctctttggaaaacacacacacactcatacacacacatacacacacacacacacacactaccaggaagcaggctaaaagaatattacatggggtttttgtgttgttttgcttatttctttccttttaaaagaagtaccttgctgctggaaaagaagtcaaaaaattgctttgaagagtatatttactagagttcagtttacttagggaactgtcgtgttaacaccgaagaatgcattagaatgcatcattctatgatacattatccgagctgaagctgaaacctagccttctgccgagtggtattcctgaagccagtcactcttagaagtgataatgtttatttaccagaactttaaatgctgattgtggtgtctgtgtctcctgcccagggggaatggcccttctgtccatggaatgtgatagcccagcaggaggtaaaagctgcccctggacagagtgaagcatgcagagggaggcggagtgaattacagctgtctctttggaccacccgtctttttgccaattaaatgtttacattatctttttgctcagatagttttcacaagtatatattcattaatacatggggcttgttccaaatcgatcatgaaaataagtttttgctgttggtattttttgttaaagtacatctaaccccaaaactatttgatgagggcagtttccctcaggctgtaaaatgaattaagggagcactcttctctgtagtcattttcttcccgcgttggttctaggctcaatcatttagatgtctctggtatctgcatagtctgggaattatacttgaactagcccgaaattactgcccagtaatcctctttctcactcaagagatttgtcaacattcatctaaccagagacttagcaagacatagagaatcatctagaagagcactgactctggagccagaaagacctggagccagacaggctctgtcacttactagtctgagtgatttggggcaagttattcagcttctccaaatattagtgaccccttgggagaagatgatggtgatacctatcttgtggcgatggctttaagagtaaaagtgtttcctttgttttcctttctccttgttttaaaatgataggaggagggagcacacttatttcaaaactctctgaactggaaggggctgtgttggaaactgtttctaagcttggaatggagcatgtgtcatatttgtcatacagcggagagggaaatgacttctcttatttctcttctctgttatccacccaatagctaggagataaaacatagggctggctaagcctaggagaagcacagcagtattaggctatgagaacctattttgcttaacctctttccggcaaaaggtggagccactgacaccaaaaaagggcaagcaggatgtccagtacctctctccctaacttttcagaccctttgatgccacagaggaagacaggcatatcggcaacatggcctcctccttccatctccctgatggttttgtcttccccattaatacaagcacagttccttttaaatgaacaaaaagtgagacaaatacatccctagaatctgacaagtatttttggaattctgtgcttttattttctcttctacctataaagtacatgaatggcagggctgaactgtcttcaggaaaatctgaaagcccggaacttattaacatgcttgacacctgcctctatgagggacttctgaagccagagatattctttgtaactgaggtccatctgttgcacagatttttaattcagatattcttccttctcaagccaaggctgagagagcagccaattttgtggaaagatttctttaataagaaatgaataaaactatcaatgctaaataaaatagaccgctgtgaaacttgggttaaatcccacagggaagagtatgtgagattaactgcattatataacaaaaccgcctttaatagctggcacgattctttttgttgttccaagggagaagcagccaagactagaaccaaagcacatgatattattttaaagtgctgcagcctctggaatttttcctcggagagatgtcaggatcccaagtcttcctgtgatttatagttgttttaaacgtttaatactttttacattttcaaagctatatcctctgcttccagcagcctaggggtgtgtttctgttgctttgaaagatgatttccaaatgggaagttttaaaactgtgcaaaaaggaggtcttacagtaccgggtgtttgagtgatttttaaatggatgaaagggagaaggctgtaaggcagggcccacggagtctttttctcagctccttatgataacccaacagagaagtggctggagagaactttcagagtatcaccatcttcacacagcaaacatcgctgaaccagacactcccagacctcagcgagctcactgtcaggtatggctggcaagcaagtgttaggttgagccatgtgaaactgccattgttgtagaccagaaatggtagaatattggcaatttcaaatgactcaacctaataattagatgaaaactatccacagtgatcaagactgtgatggccatcctgcagtattctgggagagtctagggaacaggacctaacccagtgaagtggggccagggacaagaaggggacaaaataaacccaaaaaaacccccagctttattgaggtataattgacatacagtaaactgcacaagttcttagtatgtaatttgatgtttccacacacttatacacccatgaaaccattgccacagtcagaatgatgaacctatccaacactcctaaaagttttctcatgtccctctataattccttcttcccatcacccccatctccaggcaaacacggatctgccttctgtcattatgtgttggtttcatttcctagaatttcacataaatggagttctacagcattctcttttgtctggcaacttgcactccgcataattatttttagatttgtccatgttgaagtgcatattaatactttgtccctttttaatgtaggacagtatttcattttgcagatatgccatagtttgtttatgcattcacttgtcgacagacatttgtttcgtcggctattacaaataaagctgccgggaacattcatttacaagtctttgcatggacatgggctttcttttctctttattaaacacctagaagtgaaatggctagactatatggtagatgtatgtttaacgtgttaagtgactaccaaatcattttccaaagtgtttgtcccattttatgattctatcagcagtgtatgagagttccgtttcttccatatctatgccaacattgtcttcagtcttctttattttaaccaattttattgtggtaagaacacttaacatgagatctacacaatacagtattgttaagtataggtacaatgttacagatccctagaaattactcatcttgcataaatgaaagcatacctgttgaacagcaactcctcatttcccccttcccccagtagtggttccctcctggcaaccactattctccgtttctatgagtttgactatattagatacctcaaataagtggaatcatgtagtatttgtctttctgtgactggcaagcattctaatttgagtagagtggtattgcattgtgattttaatttacatttctctagtgagtgatgttgagtgtctttttaagtatttatttgccatccatgtatcttcttagctgaagtgtctgtccaaatctttgcccatttaaaaaattgggttatttttgttaagctttgagaattatttgtatatatatatgtatacaagtcctttacaagatatgatttgcaaatattttttcctagtcagtggtttgtcttttaattttctaaacagtgtctttcaaatagcagaagttttaaattttgatgacatccagcttatcaatttattcttttatggatcatgcttttagtatggtgccattttaaagaagtctttgcctaagctaagcaaataattcatctatgttttcttccagacgttccatagttttaggttttccatttgggtctatgatccatgttgaattaatttttgtgtatgatatggggtatgccttaaattcttgtgtatgtctgcatgtgtgtatgcacatgtgtgcttgtgcgtatggagagtcagttgttttagcatcacttgttgaagaaactatcctttctccattgaactgcctttgcacctttgtcaaaaggtttccacatgggtgtaaatctatttctgaactttctcctgttttattgatctatttgtctaccttttcactaatacccactgtcaatttctatagctttaggatgtcttaaaatcagggagtgtaattattccagctgcattctttttcaaaattattttggctcttctaaggtcttcacatttctttataaattttagaatcagcttgtcaatttctatttttaaaaatatgtttggattttgattggaagtcattttgatcgggagtgattgagctttccagggggatgtgttcatgggaggaaacacatttttatatgtgaacaactggcattttaagacccatacagcatttaaaaaattttccacagccttgctccgaagtttattgaaaacccatctgtgaaaaatagtgttatttgatgccaaaggatacaaggaaaaataaaatgttctaattctggtccttatttcctatgatttcaccttttttttttttttcaatgtcattccagagagaggaaagacagttatctcaggcagtcttttacccctgggaaaagaccacagacacatgggagggtttgtgctgccttgagtgaaaagagtctgttttgttatgctctccttcccccagctggctggaggctcatccaccaagctttagactattatgctgtgtaggattttctaccattatctggtacaggaggcagaaatcaaacccctataaggcttgcaagttcctggacccgggagatcagctcagtgactgggctttctcatgcgtggtaggagagtggatgctgggggtagccaggatgaggatggctctggtgagctgacaagcaaagctacaaatctggaattttgtgaaacctctcaatttttaaatgctctttctgtagttttttgaactggacaggccaaatgaaacacatctacgggccaaattcagtccattgctaccactgtgcagcctctgatggatgggctcttttatttgcttttagggtcagctctttcatcagctccctaaagttttggttttttgttgttgttgttgttgtttgagatggagcctcgctgtgtcacccaggctggagtgcaatggcatgatcttggctcactgcaatgtctgcctcccaggttcaagcaattctcatgcctcaggctcctgagtagctgggattacaggtgcccgccaccacacctggctgattttttgtattttagtagagaggggttttcaccatgttggcagggtggtcctgaactcctgacctcaggcaatccgcccacctcggcctcccaaagtgctaggattacaggcatcagccaccacgcccggcggttatttcaacagttgcttatggagcactcctgatgtgccaggaaatgctgggtgcacaggaaattgaccagtggtggggagagcctgccacgggttctagaggctcctgcttcaatgtggagctcaggcgtggcagagagaggcatcccagtgccaccacctactctcacctgaatctgccccttcctcgaatcttcgctgtcacttatttcaggccctccaagaagaggatggctgatttacgcttggaaggctcccagaaagcttcttcgaagagatgacatgtgagctaattattgaatgtagagtaagaattagccagctgaatctgctctagaacagtgttggtcaaaccttgctacctgttagtggaacatgaaatcaatttaaaataaaagaaggtagcaggtagtgaaggtaagtattttttgttttgttaaactttttttcagtctctctcacacacacatgcacctgcttcttttaaaggaaacttttaaaagaaaattttggttaaacatatataaaaacagaatctggaaaactgtttgattttgagaatgttaacaaggagattaaaagaatatttattaaggataagcctatgttatttctgcagtcctttataaatatgccccttcacctgcttatttgcaacactaagtaggtactgaactaagtaggtactgaatacttgctaggataatcatctgcaaatcactctattactgactgagctccacagtaatcatgagactaagcaagtgactttaattctcttgactttatctccttcattgaaataagtgagttggtctagaaaaggtcgtgttgaagcctaagtttcacagagatgctttagacaatctccaaacaatttacagaaatagctaaatttgcccatttctgtatcgttagcacctaaaatgtacttggcaatatagcaggcctcaattaatatttgctaaatcaatatgtctgtcttcagggtgccattgtattttatgtgagattgggcatatttgaattcactaataaaattcttcactgaattctcactttaggcacaaaatttgaaacattgccaggcacattaacctgtgcctggagtcccagctaatcaggaggctgaggcaggagggtcacctgagtctaggacttctgggctgtagtgcactatgcagatgggtgtctgcactaagttcggcatcaatatggtgacctcctgggagcagggtccaccaggttgcctaaggaggagtggaccaccccaggccagaaaaggagcaggtcaaaactcctgtgctgatcagtagtgggattgtacctgtgaacagccactgcactctggcctgggcaacatagcaagaccatgtctctgaagaatgaaattttttaataattttttttatttgaaatattgcaaatcctagaaaattaaaaacatatcaagaatcacacaatttcaaagccaaatgggattcccatctgtgaatctgcatggcagcacctcctgtgcttcgtcaggttagttttgcattatgtgcagctgcacggggaatgcagctgctacccaaaatgcaactgctccacaagtgttttaaattactctcttaaacgatacttcttgggatctgcttcctaccagacattgtgctaggggctagctgtgaacaagaaagatacagctctcatcttcctttaactcttagttcactgcggtatatgccacatgctttcatgctgagttaatacctgcttgcaggttagcgtctttgggtagaccctgtgatcaggctttgcctgcatctgtctgtatcacatgcagtcaggtcactgatttggaagtggtctgtttgattgatgtggattctgtgagacagtcatcttccttgttcctgattccaaacttgtgtgttaatggaaccaagtttgctgtcaagtttttggttggttttgggttttttgctagggtgatagtgtatttgcagtcagtgaaaacatctgaacctttccttctgaacagcattatagccaggttgaaaacattgtatacatttatgattgatttttttaacttgatgatatcacatttatcccatgacaaatcttgttaggatcattccatcaatctaatgaagttattttgattcttaatatgtcaatcaccatatcactgccccttacagctttgggaagacagcaaatttaaaagcctgccttctctctctcttcctaggatgctaataagagaactgaaagtttcatttataagattgttgttgagtcacagctttgaaggattttgcttggtaaatttgcgtgacatccatacttttttcatttctttggtcttactgccaagccactcaacacagctgaactccatgaaagaaatatgcttttgatgcctgaagtcagctgccttcttagcgttactgataatcttacccttcttctaggcaggtttggcattaataaggaaaacataagtccatcagaattgttattttatagtttataatatgcaattgaagcttcttaatctttctctatactctttattacttagtaaacagcagcaaagataatatcaaggaaccataggccaccttgttttcttcagctttaatatctgtttacatatttatatatttgatattgaagatgaaactaaagttataagtatttttaaacaattttgaaaattttggagaacaatcatcagtaggaaataattacgtgattaaggagttcattttccctatttagaaaagggggaagactgaagaatgcaaaatattatgttcacatatacgacttctatataaaggaatcttaaatgtcttttgctaataacctgtgaagaagcagtgttgtcattaatgttgaacttacaatagttatctgagcattttggtaaacagacaaggcacttggaattttgtctctcaacatctgtactctgcttttaacttcaaaaggtagttttgaagtacatgtaatttttgccatctgccactgaatttgtgatttagaaatattagaagcagggccacattatgactttcttgggctgcaggctcttttgcctttgtggcaaaacttctcatgactttattgtgttacacaaatgctaagtgttcattataaggaatccaagggatgtagaaaagtaaaaagaaacaaatcataaattctatcatttaaaaataagcctcattaatattaaagaaacgttgtgttagataccaccctaagcatgtttgcagatgggaagatagatggatggagagatagatatgctttcaaagaagagtgatcatatgatacaggctaagtttttatttatatttatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgcctggctaattttttatttttatttttgtacagattgaggggtgtccctatgttgcccaggctagtcttgaactcctgaactcaagcgaccctccccccttggccttccaaagtgtataggcatgagccactgcctcagctatacacactaatttttaaatgtaaaaaccattacacttaattttacctgattttaactggagaaaactaagtgagaattaaggaattactgaactttgaacaaacattttttcacataaaaatgttattttttccccctctatggttaagtaaagagataagaacttgctggttttcattttgtgtttttttttccaattatgtttttgtggtaggcactgttgctgttcacccagttttcttcctcttctgggatataggagaatcatatttgctcagtctcttcaagttagatgtgaccttgtggcttgctttagtcacacaacatgagcagaaacgaccattatggatgaatgcatttaattaccgggtctccagtctcaccctttcttctatcaccttggtgagcctgggtgctcatgttaatgtggtgggcgcataagatcaacacagcacagagtgcagagccggcacgtgaaaggcacagcccttacccccatgggcctgcagtgcagggagtatgagcatgaaatgaactcttgatcggttaggtcactgagacttgggacttgtttttaaccatagattacttaggttatcctgatgctatcattttcatactagacagtatggacttcctttctgccatgataaataaggtcattaagaactttcactctttttccttccttccttccctttagattttagttagttacattgctgttttcacatagtcaagtatataatatttacattctattctataatctagctttgattttgattagttatgttattttcatatagttgaagtatataatgttatgttcagttgtttaaaattagtttggtttttttcttttttgagacggagtttcgcttttgttacccaggctggactgcagtggcacaatcttagctcaccacaacctctacctcccaggttcaagtgattctcctgcttcagcctcccaagtagctgggactacaggcctgcgccaccacatccggctaattttgtattttcagtagagacggggtttctccatgttggtcaggctagtctcaagctgcccacctcaggtgatccacctgcctcggcctcccaaagtgctgggattacaggcgtgagccaccatgcccagcctaaaattagttttatatttaaatgaattcagtgcccagtactaatctttttcctatggctttcctggtactgatattgaggaacagatcaaggggcttagtggagactgcctggcagaggggaggggtattttatcatttgcattgtttagaattgcctgcacatggtgatgtgaaaaacagacagacttttaatggttttgttactaatttaaaattctctataaacactgcatcctttattgcctgcatctgaagcaaaccattttcactggcccccccattggtatgcactgctgatagctttattttatgcattgcactgactagattgtcaagacttttcaaggagggctcctgaacgatgaattttttagttttttttcatgttcaagaatatctgatgattaccttacctttatacttcaatatcatccctaggagtaatatttatgcactatactttattccccttagaattttggaggaattgtttctttatcttttgcatttaaaatacttttgaaaacaatgactgactttcccctcattgtaggcaacttggcttgttctgcttgaagaattatttcttggaactggaaatttaattattgaaccagggtacatgtttcagttaattgtttcatattcattttttgtaaaaacgaagtatgctcttttgacttagagctctgttgcttgctcattttagggatattttcttgtattggatctttaaacactttggcctgggttctctacttcaggaatactcattaatctttctgatggattatattttttctcctctatgtctatcatttttctctgtaagttttgccttttatcttgatgacctgaaggcttcctaggatataaataattttgagccatgttaattctattccttggtgtttctcacttattagtttattccttggagattgtagatttttggttttggcccattttcttccacataatgctctatttttaattcatgtgttactctgatatgttactcacttgccatgctgtttcattccatcttgcatatgtttgggtgactgtggcctttggggctctgatccactggggtgatttctccttgacacccttctgacccctgtgtattaccccttgaggaccaggtatttcctgtcctgttcacttttcttcaggctataggcacatgtaagcaaaagagcagggcaggaaagtgagctcaccaagttgtttacgcgtaggccaccctataatgcctgtgctgtgcaatctctcctgagaacatgcagaatgtcttctcattctgccagggacagttagttctcgttgtccacattttttatctcctgtcgcttcatgtagcagttaccatctccactctgctgaaattagaggagaaaaaaatgtaagaaacccacttaattttttcctctttagatttggggatagtagagtgaatctcttagagttgagtttgggtgaataattgatagagcttcaggaaggtaggaattggaaagtggctctgccatcttttttgatgggcttcatttttattttattaccttttcttcattcccttaggtgttaggggatggagactctggggtcaggcctcactctgccatatttacccagaagccttcttggggcttgcctgtctttctcttttcaaatgaaacatggatgtgggaaaggggagttcattgtagcccagtttggcataaaaagaggtaacagcccacatctaaccttgacaatattttaccattatggagtttcctctctttttaattttctgttcaccctcagattatgcaatgtaatttctctggttttaaatacaaagtaaattaaaagtagaagcacttggtaatactgtagctatagagaataaagctaagtgagtatgttatcattgtaatgaatcattccttttcattcattcactcatccagcaaatatgtagtgagtgcctactatgtgcaaggcactaccctgggtgcctggagtacatcactgagcaggatggacaaagctcccctgcctgcgagacacttacattccagcaggcatgagtgtgtagggttgggggcaggcagcgacagtaaatacagcacatctataaaatatatcacacgttacaaggtgatttatggacaaagggaatgacagtggaatgggagttgcagtttggaatagggcagtcagggcagctgccctgagaagttatatttggtgaaggggtcagtgaaagagtgtcccagggaaagggaacagctcgtgcaaggctctctggttcgcagctggctgctgtgttcaaggaaccggatgaatgacaaattggtggagctgtgtctggtccatgtgagagaaatgaatggcccagcaaactgtaacattaattgtttttactgttttgaaaatttactgtaccagatattcatttcacgtttttgtttgtttgtttgtttgtttgtttttgtttttttttttagagggagtctcgctgtgtcgcgcagactggagtgcagtggtgcgatctgcacactgcaacctccacctcctgagatcaagcaattctcctgcctcaacctcacgggtagctgggattacagacgtgcatcaccacgcccagctaatttttgtatttttaatagagacaggttttcaccatgttggccaggttggtctcaaactcccgacctcaggtgatccacccgcctcggcctcccaaagtgctgggattacaggcatgagccaccgggcggtttccatgtgtgatctttaaaaggcagaaacaaataagcaaaaatcattactaaaggcccacgagggttgtttctatcttagaaaatgtgtaaagaaaagtgatacaacaataaatggtttgatttaatgagaagtcaaaaatcataagatctgttgaaaataacaaaatcacttctaaaaaagataatatgttttattgaaataaagccttagaagtcatctggttttaccttttacaaagaagaaagcagtctaagagaggccaaatgacttatcccaagctatacggctaggtagtagcagattcaaatttatactacccaggcttcctaattcttagcccagagctgtgtccaccctaccacccaccttttaattcagtgcgagctcaattattgctaacagttttattgttgaccttccatggactcgatagtcaaatcaagtcttccattacaataaatgggatttatttgtattttgcaacataaccttgttctttggagtgggtttcacttaatcatcctggaaatcggttttagaaagactaaacatgatttctccatctctctgtgaggaccaaattgttctctgtgattatctatcagaacaagcagaacaaggggttctaattagttttccttttgaggtttttttttttttttttttctttttccaggcagtcagtctctcagccaaagggatttttctgcagagcctttgtactcagggaccagggttaattcatgagtcctgggaggtggctgatcaggttagtttttccagcctggaacagccccgccctacccctgacctcctccactccaccactctactcactccactcactccactcacattagctacagagaaactggatgttgtcagccccaggggtaccgtgagacagctgggttcagagtgactcttgaccttccctctctcactctctccctccctccttccttcccttcctcccttgcttctctctttctctctcttttttttttttttcctttgcgctcatcagtttatggtctacttcactaattggtctgtgaaaagcttcttccttttccattcatatactcactcttgttccccctccctctcatagataaggataactattctgactgatatgtattcctttatttgtgtgtgtttttgtaagtggtgttttggacatacattcttttttgttttttgagacagagtctggctctttcacccaagctgaagttcgatcagtgacacaatcagggttcactgcagccttgacctccctggctcaggtgatcttcccacctcagcctccccaccgagcacctgggactacaggtgtgcaccaccacacctggctaattttttgtattaatttttttttttgtagagatggagttttgccacatttcccaggctagccttgaactcctgagctcaaacgatccacccgcctcgacctcccaaagtgttgggattacaggcgtgatccatgggtgcccggcctggacatatattcttaatttgcatttgtatagacctgattcttttccttacattttttgctctccactgcatttagtccatcccctctaactctgccagtattccctatgtgctgttttgtatttctatatctcttcccccagcaatgagcttttagattgcttccaactcctttcttccgacagtattacctcatataaacaacctcatagtgacccctcatggatctgtgtaggaattttcctgagatggagatatctatacctatatctatatctcccaaaagagggtttctggattataagatatacgtgtatttgctagcacaaataacgaagctttacacaaacaacctaatacatgtcccttacaggtcttttttagaacttttcttgggtacgtctaacagaacaagattggaaagtacattcaattttacccacactgccaacttgctggccagtacgactgtccgatctttatttccattggcggtgaacaacgttctctacatcacgtcccagcctaagcttggtattgtctagatttctatacatataaagtgctttatcattgttgtttacatttgtttcttaaatttctgcatttgagcatctctttatgtgctcgcttttgtgtttcctctaattcgaatcacctgttcatacctttgttctgtttcctgtggaggttcttacctttgctgttggttttcagaaacaccttacccagcctagatagtgtttcccttattggtcttagacattagccttggtcttagacatcagcttggatcacgtctccttcattgagcagaaatccgtaattttgatataaaaaatttacctttgggagattaattttaaaaaccacttctgaccacaggccataaagatactcctgccttattttccatgaactttatagttttaccttttacctttgggactttatctccatgggatccaccactgttcatggtgtgatgctctaggccagttttcttttcctctgtaattagctagttctcctcagtttggggaaagcctcttctttccccattatggaattttaattgtcacaataggaattggcatctttatattataacaatgtcatcccatctagcacaacagggactctccttttagtcagatcttgctttatgtcttttaataaaggcttaaaattttccccatgaaggtcttatacagtctttattaacttcatagatcctttatccttctcattgcttattgtatttttattatgttttgtatttgattattgtaagagtgttgaaatgctgctttgtagttttttgctttaagttgatcttgtatctggcaattttgctcagtcctcttactctaatagattatctgctaatcctgatatttttctatgtattaggtcatattgtctgaaaataatgttagttttatctcttccctagaaatgcttattatttataactaactaatttcttttttttttttcttctttttttgagatggagtttcactcttgttgcccaggctggagtgcaatggctcaatctcggctcaccacaacctctgcttcctgggtccaagcgattctccagcctcagcctcccgagtagctgggattacaggcatgtgccaccacgcctggctaattttgtaattttagtggagacgggggtttctccatgttggtcaggctggtctcgaactcccgacctaaggtgatctgcctgcctcggcctcccaaaactaatttcttttctttatagcactggtcaggacgtccaatactgtattccacagtattggatcttatacagtccagacaagtgtgcatccttgtctttttaaagagaatacatttaaagtttcttcaccaaatcaaatgcttttacaatcttaaccaaattaagaaagtttcccatattttgaatttttaaagaaatatttttttcaaattatagttatgtgtcaaactttatcaaatttttttctgcatctattaagataataatgactttcctctttggtggattgatatattgagttaagtggtagattttatgatgttgaaatttattgcaaacgtaggatacattctacttgttcatgatatgttactttcaattttttgattcaattacttaatattttatttataatttttgcttctaaaatcgtaactgaaacaagcctataatttttcctcttcttgtattcttaccctgtttggaataaaaactgtagtatcctcataaaatcagctagatagcttttgtccttttttgattttctggaacaacttacatatgataggaaattaagtgtttcatgagctttttctttttccccctttaacttgtccaaggtccacaggatccatgaacatttgatggagcttacctgtaaagccatctgggcctagggctctttgtcaagggagggctttgtttgctatttcagtgtatttcatactttggtctgttcaagtttctgttttttcctgcaccaatatccaacacttctgagtgtttagaggtcattgttcagcaaactttcactcctcctaccccgtgggaagatttaattccctttcctgttggtgttgggcttggccacatatcttgctttgatcaatggagcattagtggacttgacatgggcagaggacttaaatgtcctcacagcaggatttagccctgtcttctaaaaagcggctgtgctggaacgggacagtctcttcgctcagcttttttttctagtcccgcacacctgcagcatatgacacttacatcagtaacagtggttcactgcagccgtgagctggggtgactggtatattaccagaccctccggaggaatgtatatagtttttaaaagtgctaccccatgaccaacccagtcaccgtcgtaaataaaaaaaaatacctgcttacaacatctcctctcatatcacaaaataactgaagttgagaaaggaatttcatagttaaaaaacttttttgactcttccagcagctatttgtgtgtctgctgcacctcttcttagccgttggtcttcagcttctcaactgtgcttttgaaccctggagagttcccattctcagattacctgtaaggtgatcacatcattgaatgcaaggtgaaaacaggaggttgaccagacaggaccctgggcctgtggactgtccttcactcacagaacccacatccaaccagttattccagtgaaagcaataaggaataggtaggaagtactgctgcacagagattcgttagaagacatggctttttttctggaacagatgaagtcaaacagacagctagtggagatggtgagtcgggaacttgacttggagggcttttttgctttaagatgatcatcagctcctggaaaggtgtacgttgagttcccttttgtgctaggcaaagggctaaagactgaggggaaggaggtcacagaagtagaagagctggtctctgcccataaggagcttcggagtcagcaatgtcatatacaaaacctggaaaaattatgtgagaaactttcacaaaatgcaatagggattagagaggagatttttagttttgaggccaaaacagtgattgataggcatggctgagggaggaggaggtagctggagaaggagggagaatgctatgttgttttcattcacgtagtgaccacagaaatgagggatggaggggcgagagaataagttaagtcagggcgggggtgggggagagtagggggaggtgtttccattttcctttaagtggatccttggcttcattgcagtaaatggggttgtcagtatatattgccccttttgaaaccgacgagtttcactgagaatgggattaaaagattgcatgaaaaatttaggatctgtataagggagaacattttatacagccctgtatgagggccgtctaaaaggagttaaattcccatttgggattttttaaaccaggatgaacattctataccacaatgtctggtggttttaaccagagatagtactgcctcaccccagggtatgtgaacatgtgtgtttgtggtaaggtaggggtatcactagcaattagaaggtgcaagccagggatgctgatgaccccgtcatgtactggagaagctctgtacagcacattgcctgcctagaatgctaagggcacacttgtggagaaataatgcacttcctaagcttcagtcatttggggtccccttgtttaatttttgcggtatctaggtaccatttctaccactaatttaatgctttttttcttttttgtctttttattcttttttttttttttttgagacagtcttgctctgttgtccaggttggagtgcagtggcgtgatctcgctcactgcaacctccgcctcccagagtcaaacaattctcctgccttagcctcccaagtagctgggaatacaggtgcccgccaccaagcccagctaatttttgtatttttagcagagatgaagtttcagcatgtatgccaggctggtctcgaactcctgagctccagtcatctgcctgcctcagcctcccaaagggctgggattacaggcgtgagccaccgtgcccagcctaatttaatgcttttctttaaatttatttttatttatgtatttatttatttatttatttgagagggagtctctctctgttgcccaggctggagtgcagtgatgcgatctcagctcactgcaacctctgcctcccgagttcaagtggtcctcctgccacagcctcccaagtagctggaattacaggcgtacaccaccatacctggctaatttttttgtatgttagtagagacgaggtttcaccatcttggccaggctggtctggaactcctgacctcaagtgattcacccaccttgtcttcccaaagtgctgggattacagacatgagccaccgcacctggccctttaaatttatttttaactgacttttaagtttttagttgtcattctatatctgcattttaatttacttattgtgatccttgcaatcatgagtttgaaatgctattgatatttttctaatcatattaaaatagatgactattgcaatacagaatgttcatcttgcactccgctagtggcatgcatgctagctttgagaagtagtagccagatggtcgcagtggattaatttatggcttgacctgattttatgtagtatatccttgagagttgacatccttgggactctcatttttaagtaaccttgtgttcagcagaattcacgaactgaacgggtctcatgaggatactgtccctgatagaggtcagacagcacaaacagctgtgattgcctctctatatgtgcaaagatgtccatttggaaaggcttgatctgcttggtggggtggtgcttatgtgccaattacctttgctccggcctgtgtccacagactgctggccatctcccagttatgtggccctatttacaagggctaagtgaccctgaaagtgtggaagaatcagagcaaactctgtccttacttccaaataattggctcgaagcatatgttgcattcatgttggccaagaatgagagagaaggatgacagagtatagcagaaacacagacactcccttcccaacacccaaccaacagaacgaaaatgcagttagaaacaaaatcaaacccagccccacaggctcttgcagcaagcaaacaaacaaaaaacaattacagctttatttcaaccactttgaaaagtggcaggcaaggaagggtgcaccccaccgtagcccctcagaagcagtactggaaaaggaaggcgagaggaccagttcctgagggttcctcctaatacagatcaatatgggaagcagctggttgaggaggtgagtggatagacttggtaaaagttaaaaaaacaaaaaacaaaaaacaaaacccttggcagagttaggaaggcacctggggaggccatctcctagtctctgtgttgagttacaggaaagagaccataggagtgagtctgccctggtttggcagagtgggccctggtctaagacatttaactcccctccaaaagaggacagagtatagagcccccaaggacaggcctcatgactcctgcctctcctccatggcagaagtgttcatggaaagcagcagccaacctaaagttgtagctcagaggtagaacgacacctggttccctataaagtgaggagagtgtcaaaagatacatcagcttgctctgggagagcaaagagcagttctggacagagatgttcacgttataagtatgaacaagatggcagtgagtgtcatgactgttctgtgaaatgctgcagcagaggaatgcaagagaggagcacagcttgttggctgagcacagtggttcacacctgtaatcccaaaactttgggaggctgggtcacgaggatcagttgaggccaggagtttgagaccagcctgggcaacacagcaagaccctgtctctattaaatatatatatatatatttttaataaagaaaagaaaggaacacagcttgcaaaaataaacatacaaccaatctggtctataagaaaacccagtcctagaaaactcaacctcacaagtattttatgctatagaaagactcagcatcaattgagtagaaacaaaaactcaagatgtcatcatgataaaacaacaatgggattcttttaatttttatttttaattgtggtaaaatgtacataacatagaatttgccattgtaaccatttttaaatgtacaattcagttgtgttaagtaccttcacattgttttataaccaatctccaaaagtcttcatctttcaaaactggaactctgtacccattaaacaataattccccatttctccctcccccaccccctggcaaccagcattctgctttctgtatctgaattcgacaactccaagtacctcatatgaatagaatcagaaagtatttgtccttttgtgactggcttattttacttagtgtaatgtcctcaagattcatccatgttggatcatgtgtcagaatttccatcctttttaaggctgaataatattctattgtatgtctctgacattttgcgtatccattcatccagtggatactcagtttgcttccacctttggctattgtgaataacgctgctatgaacataggtgtacgaatttctctttgagtccctgcattcaattcttttgagtatatacccagaagtgggattgctggatcatatgctaattctatttttaaatttttgaggaactgccatactgttttccacagcacctgcaccattttccattcccaccaatagtgcacaagggttccaatttctccacacccttgccaacatttgggacttactgttttttgttttgttttgttttgttttgatagtagctctcctaatgagtgtgaagtggaatggattttttaaaagatagagccaagaaaagaaataaagaacaaaaacacaatacaacgttaaaaccagaacacacacacacacacacacacacacacacacacacacacacacgatggacatagctgaaaatcaaagagtgagataatcccaaggaggggattaaagcaataaggacaatataacagccatggaggagaggcacagccatccagcatatggagcaagaaaagaatgcaaccatgtgacccaggaagattttcccaaaaggaagaaacaactgaatctttggttagaaggttatgccagccaggcacagtggctcacgcctgtagtcccagcactctgggaggctgaggcaggcggatcacaaggtcaggagatcgagaccatcctggctaacacagtgaaaccccatctctactaaaaatacaaaaaaaaattagccaggcatggtagtaggcacctgtagtcccagctgctccggagactgaggcagaagaatggcatgaacccaggaggcagagcttgcagtgagctgagatcacgccactgcactccagcctggatgacagagcgagactccgtctcagaaaaaaagaaggttatgccacatatctgaaagtgcagatgtagaatggataacatataccctggtctaaagtttcagtatttagacctcagacaggaaaagcaagttacacaaaatactggatgactaagttggtatcagaattctccacatcagcaacccctaccataaagtacgaacaaggtctacaaacttttaagggaaataacattatttaaataatataatttaaaattatgaatataattttatattatactgttaagaatataaaaagataaaaataatataaaattgttctctaaatattaagttattattccagtgaaggcaataagcaggatgccttgacctgaaagaagtcaagagactatggcagtcatgagcattgcttgaaaaaaaaaaaaaaaaaaaaaaacctccctgtgatgaaattgacccaaatgactcaaatcagaagaacagacccaggagtagaaaagccacagatgaagaacagtaacaacagcaacaacaacaaaacactggtgagcattcaaccattacaatgccaccttaggactaaacaatggggcaagggggcatggatgattgttaaagaaatgtataactattaggcatctggcaaaataaaaattatgtaagtgaaaaaaaatcaagtgtgaggaagtggagaggaaatgtaaagtaattatagagtatttctataaaaacatgcagttaacccttgagttttcgtaacttttttctgtgcattaaattgtgtgtgtgtatgttttcaagtatgttaacttgtaaccgctggtcagaatgtcattttgtttcacttctgctttttcttctgttacatccaaacaaaattacatagctcttactggaaagaaaaggtcatatgttatcattttaaatgaacccattaccctctatctagccttctaccagtgtatgtgcatacagagatatccagaatgatggtcaccaactgtaaacacaatagcgggatattggatgatttcttttcttctttgcgctgttttctgttgctttattttttttttaatgagcctatgtttttatacaagccgtaaaatcattgctgttaatctcaactattgatcagtagtgtcatcagtattctaattgcgtcatagtcattgttttttaaattgtagtgttgacaaacaccagaaagagcccttgacaatatttttgcaactcatctctaaggtgctggccgctgcccagaggccaaagacatgggctgtggaaaacatcagctcttgtaataaggtgcctttgccttcttattgaatcataaatcaaaacacaatagtggactgatgagcatgaagtagactgacctgaatccctgtgatgctgatggatgggagtatagtgtactgtgctgtcaaacaaatgtctgaacctagcaaatgactttggatgtttggagtccgtctcaatctctgcacttggctgctgtgagtgcctttcacttcctccattgcgattctcctgcctctgggcctttgcacatgcaattctctcttctcgagatgcgccacgccctgttcctccttcatcacccagctcctcctcctagtgttcagggcttagctttagcctccttcccctggaaggccttccctaatgaagttaggagctcctctgtataaccaaaggcactgctcactggttttgctgggcacatttataaccattcactcaatgtcatgcttcttagcagactggcctcaggcaaataagaatctagttcaggaagtgtaaggtcagatttcctcgttgccccgtctcatacttcctgttcctcttctgggctctgccagaacggtaactccactcttgtggcctctgctatgaacaaaccccgctctcttcccttcctgctaccctatggcctcttaggtttattttgttctcagcagccctcttggctctggcttctgttagcagctacacgttttctcggtaatatttcaagttcaacctcatcggcgagggtagctgtttggtttagcctttgtcctctagcacgtgcctttcctgcagggaggggcattcccagccttggaacaggccccatcactaaggccacagacagtgccagagggagctggggtctgtgcagccattcttgaattcccccagaatgccttgcctggccttgagtaaaagggatagaagtgaaaaaagcctgttacaaagcagcatgtacgaggtaacccttcatgtgtgttttatatatcaaagaaaatagactagttattatcaatgagtttttctggtgggatttctagttatttttattttgttgctttcaaagtttctgtaacaggcagggtgctgtggctcacgcctgtaatcctagcactttgggaggccaaggcaggtggatcacctgaggtcaggagttcaagaccagcctggccaacatggtgaaaccctgtctctgctaaaaatacaaaaattagctgggcatggtggcagttgcctgtaatcccagctacttgggaggctgaaacaggagaatcacttcaacccaggaggtggagtttgtagtgagccaacatcatgccattgctctccagcctgggtgacagagtgaaacaccgtctcaaaaaaaaaaaaaaaaaaagtttctgtaaaaacattttcacagatacttaacagcattgaagccctgaatcatggcgttgtacagagcagcccccaggaagaagacaagagccaattggctctgccatttggaagcattgccttcttctccccacgattctcatttctgcccccaaatgatgtgtttgttgccttgctcatttcaccggggtgtctttttcctcctcaggtgacagattgactgggatcccctcgcacatcctcaacagctccccatcagaccggcagattaaccagctggcccagaggctgggccctgagtgggagcccatggtgctgtctctgggactgtcccagacggatatctaccgctgtaaggccaaccacccccacaacgtgcagtcgcaggtggtggaggccttcatccgttggcggcagcgcttcgggaagcaggccaccttccagagcctgcacaacgggctgcgggctgtggaggtggacccctcgctgctcctgcacatgttggagtgatggtgcctccagcaaccgctggggagtgtgtccctgagtcatgtgggctgaatcctgactttcactcagagcaggtggttttttgtgtaggtttgttttttatttttgatgatcttcagatggaaggagaaaacagggtttccactagacattacttgaaaggccagattactcagcagatctcccatgttggctcaacaattctttgtttttaattgcttgaagattgcattgttgtaattgttcagtttttaaatgtgtaatggcattttaatagactagtaaatcacagtggttcaaaatatatatccatatatatatatatccatatatatatctcatgtcatcacattacaggcaggtgtctcatatgtaaaacatttacctgaatgttgtctgaggactgaactgtggactttactattcataatgataaaataataaaatgcgaattactatatataatgtgcctcactcatgagaaagtaccgtgttgggtttttttttttctttctcattcctgtgttgcatagattaagggtgtaaaattacaatagtcttttttttctttttggaacagaattaatagtaacagtgaaatggttactttcccaagtcaggataaatagctcaggcaggatgtctgtattaaatattgtaagacactaaagctccctgcaaagaccagttcaaggaccagcatgcatacccgagcccttcatctttaaaagatcgctcgagaaaatcctgtgctgtttattgaaagcattaagtcaggggacgagagggggtgtggtctttccattgaagccagaatgactgaagtgttgtgctcctaaggagtatgatttagtcttctgtccttttatcaatagcacatggtgtttatagaatgctttactgttttcacggcttttcctgtatgtgatctcatttggacctctcagcaatgctgtggggcagtgggcaaggtggttcacctccttctgtacagagattgagtgattggcccagggtgaatgaggttgggtgccggctcctgagcctttccaactgctccacagggctcctccccttctctcttgcatgctcattgaagaagcttgaatcctgctccccgcctactaggtgtatggccttggacaagttacttaccctctctacacctcagtttcctcattggcagaatggggaaatgattgtactcacctctgaggtctttgtgatgattaaagcaataatgtccgccaacagcacatccagatgcagctcattgtcagctttcaggaaatggtagctgttaatttgccgccactgtggctgaaggtatggttagaccacaggcaaagctgaatagtggctgaaagctgagggcactgtgggaggagctactattgccacatttcttactaagctttaaaatgggatttgattttataaactttacaatggggccagtctgtgatctatccttcttaataattacggaatctgtttcctaattctaacataactcaggatttttcaaaagggagaaaaaaatcatgttttttatttctctccattccaagaataaatttatggaatggtagaattgagcacgaagtgggtacttaaaaagatgacaatagtgtgtggataacatcctttcaggcatcttgtaaccatattcctgttactaaaaaagagctgctatgccacagtttattcttccagtgaattcggttcaaaaggatagtctactggccttatcagttcaaatttttcattttgtagcccagccaataattcattatcttataaaattctcatgcttttggccatatcactgtgcccagtgatagactgtactgctgtggcatcttcagtgaatcacttgtcattttgaacctgggacttattacattgctgtcttccccctgggtttcctaatagagagttgctttggcttttgttctcacagctcagagtcacattcatggatgagtgagtagagctgggctctgctgcgtctgactagatggcattttagaagcaggtctgatgattagctgggtcatctttccgccattcaccatttgcaaggaatctgtcacgcataaagacactcgtgggctctgtcagcagtgagagacaattagtgaagaacaagcccacgatgggccagacagacagggccgagggggcccttagagacctctgacttgttgcccttcacaagcagagtgtcttcaccaccaaatggcggcagcccctccctggcctgctcacgtgcttgcagaagatttgcagagtggaagaacagagcagctgaatccctatcttggtactacctctggccatgaagaataatgctacatagcagctgcctacctcctaacagaactggggaggtgaagagcctgcagggatttcctgtgtttgtatgggagaagattctacaatttcagagactgtttatccccaagaaaactgaatgaatgcagcgaggtggcaagagcatttgccggcactgacagaaagtatatgaatatatagtcttgcaccactttgggttgggttggagtgtgtgtgtgtgtgtgtgtgtgtgtgtgcatatgcatgcatgagtgtggcccttcatgtttttaaaactataacttttattaattttttcaacatgaagtacatgtttattatggcagtttgaaaaaaaacacaataagatgaagaaaaataagaattacccctactcccatctaagcactgtacatcccaatttttatccctgtcctccaattagttttctctgcctgcatatccttttcataaaaagaataggattttctctgcatttccttataaaaagtgttatattttccaactgataatacacttatttttttttgtcgatgtgggactatttagagagactaaactgtgtaattaaaatgatgcatctttttaatattcctcaatggcatactccaaatgatctttatattcatggcttaaaattaactaaattaagttttcaattttattacaagaatgggattatattgtacctgctgctttacaagtggcatcttttatataacatcaaactgtctttctgtgtcattatttctctgtgccaatgatttcaatatcctttgtgttcacaacacactttcgagtcctataatttttgtggcatgtttgaagagataaaaggacacttagctactaaaaagatgacaataagtatagcaatgtctttcactctcaaaaccattgtcccactttttgctccatccccgtttggaaccatgttccaagcagtagagctgtttacggctcccctctatgcactcttatatcctcaaaaagcaaagtttagcacagtctgggctttattctgagattttatctcttcctaacagcaagatggcctctacactgcctgatgatccaatcagcttcgtgttccatttccacaagagtacgtgttctgggagggcaaatgaattttacctgttgatccaaatgtgatggcacgcttatgaagggttgatagtctacgtgttgccactattcgctgccgtcattttcaatgatgcacagctttccagtgtgtggatgcgccgtcatgtcttaaccacttccctgcgtggatctttaggtcggttttgccttttcattgttataaacagtgatgcaaggaagggagtgtttgtggttaaatctttacattcatcatatgttacaatgaactggatccctggtttgtttagcgccaaacatattttaattttgttctcaattagcttttttatatagcaaactacccccaagatgtaatggcttaaaacaacaaatgtattggcttaaaatttagcccacaattctgtgagctggctgggcttgctcttccgatctgggccagctcagctgatttctgctgggctctctcgtgtatctgtggtcagctggtgggttggctgaggcaggatgctctagggcggcctcactcatgtgtctggaaagtagtaggctatttcctggggcaatgggtcgtttgtgtctaggtcacacgccttttatctgtcaggttaccctgccttctttacttggtagtagtggcaggggttccccagacagcaagaaggcaagccgccatgtggaaacacctttcaagcctctgtttgcatcccttttgctgacatttctggccaaagccagtcatgtgccagctcagagtcagtgcgggagggctctaccaaaaggcatggagagaggagcggaataatttgggtccgtttcgtgcaatccaccacagccaatatttttaaattgagatttctgggccctattgaaaaacaatctttggctactctggatccctgtccttgaatcacagtaacaggcaagcctttcctagcatgccatggtccttcccatcccccaccccacagaatgcacatcctttgcccagctccttccacctgctcactacctgctcagccacatacgtttatggcctccagacatacagccatgatgatgcttagcataatctcctagaagtggaatcgccgggcttaaagtattaataacatatttttaaaaactattttgactttttaatactttttaaaaacttttaaaaaatattttagggatggatgtggtggctcacgcctataatcccagcgctttgggaggctgaggcgggcggatcacttgagctccaggagttcgagaccagcctggggaacattgtgaaaccccgtctctactaaaaatataaaaattaaccagatgtgatggccagtgcctgtaatttcagctactcgggaggctgaggcaggagaattgcttgaacccaggagatggaggttgcagcgagccaagatcgcgccacttcactcgagtctcggagacagcaaaactccgtcttaaaaaaaaaattaacttccgtggcccactgtgaaagttgctgttggacacacagacacacacacacacaggcctgaggcagcaggatgaatctgtcttcatccctttctctggggagttctccaggtgtggcagctttggacagagcctcacctcattcagctattcagcaaactctcaagcagaggctactgcacaccagtcactccgctaagcagggaggcgaaaagattactaataaatacacagttcctcttctccaggaactcactgtttgaccaatgagacagacatgaagctctaattacaacacaatgcaatcaggcctgcgcctgagtatcgagtctatgggaatgcagaggagaaatgatccatttgcctggcttcttgggaagtgagaggtatgggaaataataacactgtatctaaggctctgtcacttgggcaagttactccacctctgggtgccagtttccccacatgtaaaatgcaaacaaataacagtacccacctatggtcacagtgaggattccatgagatgaaaggtataacatgcttagaacagtgcctggcaaagatgttttgttaaaccattgagttgaattcttttggctatcagagtttttctttttctttttcttttttgagacggagtcttgctctgtcgccaggctggagtgctgtggcatgatcttggctcactgcaatctccacctccctggttcaagcgattctcctgcctcagcctcccgactacaggtgggtgccaccacgcccagctaatttttgcatttgtagtagagacggggtttcgccatactggccaggatggtctcaatctcttgacctcgtgatccacctgcctcagcctcccaaagtgctgggattacaggcgtgagccactgcgcccggcccagtttttctaatcttcttcaccctcccagggctctgagaagtgtgagggtagaatcacctcctgcagatgtttgtggtatagaaatagaaactgcatagtccctcaatatctttatcaggactctaaagataagtggctatgaactgtggcacacttcagagcatactcagagttggggtggattctgatctaacagttgtctaccattaaatgaataactacagtctttgagcaaattcttgctgattacaaaacactatgcaagttaccagagatacaaagatgaataagccatagtctctgctctcaggatctcagcctgctggggagacagctataaccaccagcaactatggcaagcacagagggagcaattaagttggccacagaggaggtaatacttcaactgagcttttgtaagtcctgcccaagttagcatgttggtctctttgggaggccttaatgtgtatgggcagcagaatcccatttaatttattttacatccagtttgacaaatggctctccttgccatggatatgcaagataaatatgcctccaaaatgtgatctcagagcaatttagaaactaagtggcaaatatcctatacatcaagatgacagtgacattgagaaacatgtggtttgttaatccacagtgggatcaagatcaggcttcaagttttaggtattaggcatattttggggttcttttttatgacatccctatcccttttcctctaaaactcccacatattcaaattagatgttgctggcatacaggggaagtttttaaatgtaataactgcctgtttacttcttggaactataaacaaagcttagaagaacagggatgtctatcttgttggcatttagtgttcttacaggaaaattaaagtctcacaaagacacagttcagtgagccaattaagccttgtctattaaacttatgcaaaatatatggcaataattctgatagctattgttaattcaaagcataggctatgaaatccaggtttgagcacttaaaaagtaaaaaaaaaaaaacccaacatcttggcaatactcataatgtttccatttcattttcatattctatctctaagcagggctgtttttgatgtcaaattacattcttaatggagaatatttggaggaaatataaaacggattggatttgatcaagtagttactagtctttcttctggtgacgtataacctcctacttgtcagcttctagaagatgaatcaattttgtgaggacttggccaatatcaaggtcttcagcacgactcatcagcctgttgctaattcaaggacaacaaatgcctacaaatgctttaagtaagcccagttacagactgctgatgaatttggtgctcctggtgtgtgccctggccaagaatgagggtgtctgtctaggaatatttctttgaatataaatagtaggtagtggtttatctttgtccatttagtgttgctacatgggaatacctgaggctgggtaatttataaagacaaagggtttatttggctcacgattctgctgactaaagactgggcatgtggtggaagccttgggctacttccacttatgacggaagaaggcaaaggggagctccctgttcggagatcacatggcaagagggggagcaagagcttgtagacaagtgatgtatgacagtctccatcttccagggacttctgcctccacatcatctctttacaaccagagcccccagacagaggaggactgagtcttttgtggctagcacattggagatagttgatttaatggacaaattatataaagtgacatttattttttatgctgggaaattacttccaacaatatatttttgtccaaccatctgcttgaatcaagtttctgtcagcctctggaagtaataattattccctgctctgaaactgagcttcatgctggttttctgctgagggagcagaccctttggctgtctgttatctattgtcaagagctcttttgtcactcattattgtcagctgctgatttcccaacagacactttaaggctataaataaaccctcccaacacaaatcccctccttatgaaagtgtgaaagacaaaatacaccagtaaattaggatatgatttttattcaggctgttgccataggaggacattcattagtaagaaatatctcaaagaaaagaatgagcctggcttttatggagacaaagagagtcttatgggagcatgacgaaggacggaggtgggtcttacttcagagtatgcaaagcctgtgtggtccttggcaattagccagttcctacaacccaaaagggcagaagatttcttaacatctctactttttagagtacaagacttagattaagttcaacattgtcagtcctcccttttgttgaaaatgaacatcattgccactgttgggactcagaaaacaataccccaaaatgaaagcctccaaagcagcctcagaagcaaagtctctctctgaccttctgctgcccgctctgtctctcacccctcattctccccggagataagccatagaaactgtaatccctcttccccaagatgggtcatagaaactagaactccttttccccaaagccagccataaaacctagaaatattattctaaccttccaccattcttctgtgtaacacttggccattaagaaactaagaccctcatcccagaggggtcctaccccatacctgggaggaaggaatgctgcatggagaggccaagaaggatctgaacagccaggccttgtaggtttccccacgcagtctatttccattagatcatagccttttttgtccaatcacatttccacatgactgtccctgcttcatcaaacctaagcataaaatcagagagcttctcctgagtctctgggtcttcgttctgaaggctcacctgtcatgtaaaactatgatcaaataggctgttcattgtttgaagcaataaagtgcaaatgaaacctgtctttacatgcacagtggggcatatgcttccataaatgcctgattgtgtgtgcagatgagtgtttaacacacccagttacctgtttgctatatttatatttttagggttaatgtaagtgctttcattttttaaaatgaaattgttttaaattgttttttaaaaagctataatcaaatacatttgttactttttttctggttaacttgtcttttgttatagggtgttggccatgatccttatgatggggaggaagggaatcaccaattttctaccccatcccactgagcaacttagagatgacctaaggcctcgttacctgtgtggagtaactgggaattggaaggtgaggtccaattatatccaagtcttggcatcaaactgtgaaagacaaaatgcactggacaattaaggatatgattttattcatgcccttgcaatagggagaacatttattaatgaagaataactcaaaggaaaggaaggggtcctggtctcccatgaatcctcatgggagccttgaggaaggatgaaggtgggtcttatcacagaatattccagggctgggttgtcctttgtggggatggctgtttcttttgaaacacaaaagggtgggagatttctttgtctctctctttttttttaagagacagggtctcactctgtctccccagctggagtgcagtggtgtaatcacggctcactgcaacctcagcctctcgggctctagtgatctacctcagcctctcaagtagctgagactacagaactacaggcgcaccaccccgaccagctaatttttttttttttttatatagagatggggtctccccgtgttgcccaggctgatctcgagctcctgggctcaagccatcctcctgccttggtctcccatagtactggtattacagacattggccactgtatttggctcatgtagggggtttgttaaccatcactgcttttagggaacaaaagccttggaggaagtttaacagtgtgaaaattcttcaacttttaagaggccaacgcaaatttgaaaaaaaaaaaagtttttataaggtttaggtataagatatcagaattctgacatcttaactgtttgcttgttcaataagaggtacttaagctaactccatatttaatttgagtaaagaaaaacaaatggcctgtctgaccaaagctaaacaacaggaaaggaaacacagctccttttactttcctagagaatcatggaccaattttcaatttggaccaatcatggaacctttttctgtagcttatagaaattcattcaaagtgtactttttgagcacctgccatgtgccaggcatgaatataggtggtagggatatagcagtcaatgtgacagtctgtaatttctccccttgagccccttgctatggagaaagagaatgcagcaaagggcaggaagagccaggcaaaggagtagtactgttgccaaaaggtcagccagagaagacccccacaagaaggtgacaggagtaaaaacccgagggagggagccgtgctgaggcctgaaagaacattttgggcagagggaacagtaaaatgggaaaaccctgagatgggaactgttaaaataattaatcaggaggacatttacatgagtcaccttcagcacctttggttgctacctaagcaaatggaaaaccaactcaatgtaaacagtaaaatgaaaccagcgtaaccaatcagaaactgccagctaacttctaactagagactttaccaatcagaaactgacctctcaccagggactttctgctttaaccaaatattttctttgtcttgcttccatgagcaccttataaaagccccctcctctcctcccctcggagcgccaggctgcttgtggtctggtgctgcccgattcctgaatcatttaaagctcaaataaactcatgacattttaatatgcatacatttatcttttaacagaacttggccaagattttcaaagaacggcgaggagttcagagtctctagagtgccgttgtaaagaggggaagggtagtggctgaggcctgagagctgagggagcagaggctgcagggtggtacagacaactgtgatgactttggatgttactcaggttgaggcaggaaagtactgacatgatggctttgagcagaggtgggacaccatctaacatattttcaaaggattaccctagcttgtgtgataagaggattgaagcaggcagaccagtgaggagctgttgcactgctcttgagaagagaggggctccaatcaagatggccatagtgaagtgtggtggaggatgcttaggtctccttcaggaattaaacatttattcctccagcagccaggaagctccagctaatggcctttggctgtcagccctcttcaagtattgcctctgctaaagacagttgtcttgcccagtgacacttcccctgcctggaggcttgttagtgagggctacaaaggcctggccctgcacctcaactcaggacaactcctaagggtcaccccagttcagagctcctcaaggagtccgctcaggccttccttgtgactacgtcacagcccagcttcttcctttccacaggcattgattccaagagtaccccctaataaactccccacccactcagctccatcccagactcagcctccaggggaacatagcttgtgcattgaggtggtgagcagtggtcaggttctgaatatattttatttcattttctttcttttttgaagacagggtgatatggtttggctgtgtcccgacccaaatctcaccttgaattgtaataatccccaggtgtcgagggcaaggccaggtagagatccctgaatcatggggtcggtttcccccatacttttctcgtggtagtgagtaagtttcatgagatctgatggttgcattaatgggagttctcctgcacaagctctcttacctgccaccatgtaagagaacctttgtttctcctttgccttccaccatgcctttgtgaggcctcctcagccatgtggaactgtgagtacattaaacctctttccttctccacagagaatctaagtggtcttacaaaggaacaaagctagccatcagcacgtccaccaggaaatgtttccagcagtatttttttctacaaggcccatggtgcaataatagactcccatgagaagttgaaaataggcaaactgcttacaaactacctttatcatacaccccgaggataattccaaggcaacattgaagtaatcaaagcgacatgacaccaccttgtatagatacagtttcacagtagaaagaaagttcgctgtagggaataggagttaaggagatgaatcttgagctggggcttgacgggagtgtggagtaagtggaaagcctgggaaaggtgtgctagaggaaggggaaggtgagagagggcccagaagtgaagatggttaggatgcctaggaggagcctttgttgtgagtctgcctctcatgaaaattacatctgttaagtaaggtggggtgagtcagctaatttttaaaaccaggccaagagtttgggtttcaccctttagactaccaagaaaacaaaagaaatctcaacacttttaaagtgccagtgtgaactgtgaatctccaaatcagaaatgtgtggtatttcccaaacttatttgacattgaaaacctctcttccatgacaccacctattaacatctttggaaagatttatcccacagacacattgaggtagagaacactcaaccttggggtgtaatgggaaaactagtgggtcaaaggagccagtaataaccaagatttttaaaaaggtatgaacagtatcttgagtggtatgcaaaaaacattgatttattctcctcctccaacaattcatgtttactgttagcagcatattatggggcacatggaaagagacccgtggttttctggaaccttcttttccttctttaatgattaataaatctgtcacattttttattatatgacttgtatccttgcaaaatatcccctggcttgatatcatgctgcatttctgttcaagcagtggttgtattgcctgttcctcaagaggcagtgggcattgtctctggtcgttgtcagatgccaggtggcacctgtaagacaagcaggaaggaactggtcttgccctataacagcagccccgagccaggaaagttctgtctatagccccaggcctctgcggtctgtccccacgcttgccaggacttctcatccctttgctatcttctcatttcggttctcatttgcttactgtggtgcctccccaactaagctgcttggtaattgaacttgagttttatcttcccttcattctacttcaaaaatacccgaacgtagcttgtttgtttttccagtggggcatctgacaagtctttagcttctgtttagcaatagttcccagtcagaggtgatactaaatccccccaggcctctactatgtggcctttgaaaatgtgtggaggcatttgtgtgtgtgtgtgtgtgtgtgtgtgtgtgtgtgtgtgtgtgtgtgtgaagctgtcatcatacattggcgggggttagggttagcattactgccatgtgatgggcaggggctggggataatcctacagaatgaagagttgccccacccaaaataccagtaacacccccaataagcactgctgtatgcttcacatgagtaccactttgctaattttcaatatctaaagcaccacctatgccattattagtttaatatatttctttgaattaattcacttaaattttttttatttattccaaacagcagtatactagaaatgatgggtcaatgttatttatatattttacagtacccataaaaataaatgcctaacacctaatacaaactattcttaattaatgatacacacatgaagtcgggaaacactgcagctatggccacatgcccagttagattttatttatgtatttatttactgttatatagagacaaggtgttgctctgttccccaggcaggcacagtcatagcttactatagcctcgaagtcccaggctcaagcaatcctcccacttcacctcccaagtgtcaaggattacaggtgtgtgtcaccacgcctggctcatttttatattttttgtagagatgagatttcactatactgcttaggctgatcttgaactcctggccttaagggatcctccatcctcagcctcctgaagtgctgggattacagacatgagccaccgtgcccaagctcctgttggattttgatgggaatattagccccacacacattttctcttctgaaccaggaatgtctgtgcaagtacaccacatagactccttagcatgagccatataagggcaaaggtcacatgtttaatgtcccataaacatcatttattttgtttaaagtagtctatcccaatgacaatgacagcattcttgacctgagtcaattctctttgctggatccaaagtcaaggataaaagtgagggtcacttggcatttgcctccttgaaatgtagctctctgagggcccacctgtgtcttgtgtcctcttctttcctaatgaagtgtctggcacacgaagtcatgattaacgaaggtctcagtgaatgaaggaaacacaaaaacgtatgtgtacccctcagtacggggaaagtgatggagaactgtaaatgctactgtcattgagtcaaaaaatcttacacatgtttcttatgcaagttatgtaacttctctgtgcttcactctccttacctctgaaagacagataatcatagaaccaacctcataacaccgttataaggaggcaatgagagagtatttgttgagtgcttagaacagtgtcaggcacggaataaatatagaaatatttgatgatgaataaacaaatgaatgaggggtgcctggcttttactcaggtttgcaatgtttgctgaaagagtgaatcaacaaatcctagaccagaacgttccaacactcacatccttggtgctcagctgttcccaggagtagtagtagatgctaaagtaaaacatcccaagctccggtgaggaggtcttgctatgggcagcacagaaaagcttttcataacagatagcctagggtgatgccccatgtatcaccttccccactcccccaacccctgcctagttacaggctgcacaggaactgcatactggtacagtcctcccttggtatccatggcagacttgttccaagacctctgcagaaagcaatacctatggatgctcaagtccctggtataaaatgatgtagtattggcatataacctaccacatcctcttgtatactttatttatttattttgagacaggatctcactctgatgcccaagctagagtatagtggagtgatctgggggtcactgtagcctcaacctcctcggctcaggggatccttctgcctcagcctccctagtagctaggactacaggcacatgccaccatgcctggctgatttttaaaaattttttgtagagatgactatgttgcccaggctagtcttgaactcaagcaatcctcccatctgggcctctgaaagtgctggaattatgtgagttaccatgccaggctatcctcctgtatactttaaatcttctctaggttacttacagtacctaatacaatgtttgctatgtaaacagttgttatactgtcttgttttttctttgtattattgttattgttgtattgttatttttttcagtatatttttgattcacagttggttgaatctgggcatgtggaacccacagatgtttgagagcttatatgtctggaaaagactttattttatttgatagcttggctgggtataaaattctataaaattcatttttctgcagaattacttctcgtttctagcattattgagaagattaatggtcattctgattttttattagagtctaaccaatttttccctctctagaagctttagaattttttctttgattccaatgttcttaaatttcacaatgatatgttttgactaatatgttttattcattttgctggacacttgataggaacttttatctcacaatgactttcagtttgaaattttcttaaattattttttgatgatttcatttaccctgttttctttttatctctttctatgactcatagtgtttggatattggacttcctggcttgatccttaaatttccttaccctttctctcttattttttgtcattttgttgtcttttgaaaggtttaatcaaatttcacttccaaccttcttactggatttttaatttataacataatgtttttaattgctaagactcttttgttgtatgaatgtgccatttgaaaatagcatcctattgcttcatgtttacaatatattctcttaactctctgatagtttttgtcttcttatctaatttctgttttctctaagttactttaatctctttgtttttagtctctgcctttcatgttagaggctttctttaaaaggtgatcattggctgttcatttatatttaaaattggggccctaaaaagctgaatgagactctgtattgtgggtggggcttcaagaccattagctcacttgtaggattatcaggctgagctgtttgttggataatcctaatatcagcatctttagatcttttcttttggcttgtcagatgttttcagagaagaatcttctaagatcctgcacagttttctgggaacctagtgatggaagagggccatgagctgtggcagagggcttcaacatttagtatgtagtcctcatgctttcaaaatgattgctgccttcaactgtgccatgtatcccacacttcagagaccttctgtttttgctgtctctaaaccacaaatttctgctgagggaaagaggggttaattttctgatcacacaaagtaagcattagaatttgggctggggagcagggaggatttgtatttgtgtctgtctgactcctagacttttgtcttcccctttactcccaaatcataaacccctgctacttctaattcttgaggctttgtggttctattttagaaaatgggctactacttagcttgctcacttaggacatagctgtcctagacctgctaggtcagttgtctttcctctttctgttttctaactcacaacattttacggctttcattttccctccaattctcctttcctccttcggtttccttcctgtatgttagttagtggggatccataaaaagtacaggaaaacatgtgtgtttaatatctgctatcttcaagttgtatttgacatatatatatatatattttttaaacttggaagtccaagatcaatatatatattttactgataaaatgttccaatatgtaatttgctctcttaatgactactttttttaagtaaggaagttaaggaagctacagcagtaattcttgaggcatattagaatatttcttactgacaaaatacttttgaaccaattattacagggatatggttcaactgaaattgtagtgacctaatttacaaagataaaactgtctattttagagattgcagtaaatttcaaaagtaaatgagggaatgtgaaaggaatgaggtaaattgcgaatacccatggtagaagaacactaggaaataaagccctggaccaggttgaactgggaatgatgcttcatcagtatagtcagaagcaacatgcctggacatagaatccaaattgtttttgagtggggggcccagagacaaaattgattttcctattctaagactgagccacaatgttaggaaattagaaagagaaatttaaaatagctcagaatcaagattaagaacagcaaaagaggacttgacaatttcacttttataaaatgctatgagcatgtttgtgtttatgggaaagatttaaagttgaaaacatccagtattgttaaaattatgaagaaataggcaatttaatttactgttggggagtatagacttattaagtagtaattggtaattatttattaaaattataaatgtggatttagtttgactcaacatttcaactcctacaagtaatcctataggaaagactgaaaagtaatgtacaaggatgttcattgcatcattgcttgtaataacgaaaactgaacacaaccaaaatgttcattatagaggattatttcaattcatggtgctacagactcaaatataactagtcttttgtggtccactcttataaggagattcattcaaaagaaactaatttagtatctctcaaagaacattgaaagagacctaattcataacctataactccatttataatttatccttgttttacagccttattattgaatacttggaacaccatatatcaggcaaaagacataaagtcagttaaaatatatgtatacaatgatatctaaaatatgttgttcaactttaccaaaatgttataaaatagaatatatggtataatttcattaatgtttaaaaaatataaaggcttccagttttgagtaatggcagagtagtttgtatcagactaaaccttccactgattatgaactcattcttctctctctccctctctctctcttgcacacacacacacacacacacacacacaagaaggaccaaaaataggcacaaactggaggagatattatacatattgaactggtttttcacctgcagacatccaccacctgcagaaaaagtagactttttcaactaaagaattagaggcttgagtacagggctgccagagcaactggaaattgaagtgggttgttgggggatcccaggaggttaggagtaatagaacagggaggtcccagaattatgtacaaaatcttctcaaaaccttggctgactctttaaccacaaatgtacagggcaagactccaaagagcatagcagaaaacatcagctggaaggctgagcagggatttcagcagctgcctagtactggagagatacagtttgaagttaaaatctcaccaaattagtggggcttgataaacatgtcttgaattccatcagtatgccagaagcatcatgccctagatataaggatcatatcccaaaactcagagttgtatcctaggagtaagagcaaaaataaaatataactagcttaacaaagcctagaaccaagcctacacaggattaaggttatccacaagaaatttacctgcctactagaacaaaaccaaatactcatctgatgaaaatgacagaatttagagtttctacattgtccagcatacaataaaaattaccagacatgcaaagaagcagaaatatatgccaataataaaaagagagaaactccagaaaataaaaggatacccacaaacaaagcaggtattggaattagcatataaggactttaaaattactattgtaaatatgttacagaatttacaggaaacaataggtgtaatttgtggagacatgaggatttcaggaaagagatgaaaatgctgaaaaagaaccaaatggaaatcagaactaaaaaaatgcaatctcagaactgaaaaatacaatacctgaaatgaaaaatacaatacctgaaaaaatgatggatgggatcaacatcagtttgaaaacaacagaaggaaagatcagagaacttgaagaaaagccaacaaaaatcaccaactaaaggagaagaatatttgaaaagaaattaacagagccttccttaccaatagggaaataataagcaatctaacatctgtgttattcaggagaaaagagaattaatgaggcaaaaaatatttaaggagacttggctgaaaattttccaaatttggagaatattgtcagtttatgaatctaagaagcccagtatacctcaaacagaaaaagatagaaattcatatctaggcacataattgacaaatggctgaaaaccaaggataaagaaaaaaaaatctttaaaacagcccaataaaagacacatttaatacgtggaaataaatataagagtcactgaaaatgattcatcagaaataaggaatgatttagaggtgggagcaggacttcccaggccctctcccaagcaaaacagaaatttaactggtgaaaagtattttttaaaaaatcattccaagtctctggaaattgtcctaaagacatacgacataacaacacatggagaagtatttattcaagaaaatctgctaaatattggtaagaacactgacagtctgtggcacttgaaccatgacttgctcattccatgtcctcacctctcctcaggtctgtgttatggaagctctaccctgagaatgtgcaactaagaaaatgaggacgggaccttcctctcccttaagttcccagtctggggctacagttttaccctcagaagggcaggctactgacatttttttgtccatcccagccccgtgttgcaggagctctattcctggtagacatggccaagaggaacaggtcttgcttccaccaccatgcaccgccaccagtagggtggaagctctgccccaactgcagcagccaagagtactggggctccaaacacctacaccccagccaactcatagggtggaggtttcaggctgagatgggcaagccaagaagaccagggactgctactcctcctcaaagcccgttatagagtggggatgtcaccccgggaaaagcaggtcctaaccccaaactccttttgagtggcatgggggttcttcccagagagaaaggcaggccataggatcaaccccacatatctgcctcagggggctgattatttggaagagaaaatggagaacaccatgtctaaagctattgtgaaatggagatgatagtggacaacaattaaaaggagtctggtaactgtgacataagcaaaatgggagcacagaagttttcaaacagatgaaaagacaagacccaactacatgccatatacaacagatacactataaatgtaaaagcaaacaagtcagaaattcagaatttttaatgggatgtatctgtatacctctctttgagtattcttgcttggcacatagtgggcccagaattattgggttttaaattttaacctaacgacttaatatttatttatttacttaggctagtcaaatgatatagtgggtgtttctctactaatgactccctgtcatcttatccatgctctcctataatttttaaaataaatgtgaatctttgtttatcttgcctcacattaaatggaaacatttttttaaaaattttgtgggtacatagtaggtataggtatataggtaggtaatggggtattcatcccctcaagcctttatcttttgagttacaaacaatctgattattctttaagttatttaaaaatatacaattaagttattattgactatagtcaccctgttttgctatcaaatagtaggtcttattcattctttctaactgttatttttgtgtccattaactatccttcacctctcccgcagctccccacgaccttcccagcctctggttaccatccttctactctctatgtccaggagtttaattgttttgatttttagaacccacaaataagtgagaacatgcaatgtttgtcttcctgtgtctggcttatttcacttcataatgatatctggttccatccatgttgcaaatgattggatttgcattacttttcattgctgaatagtactccattatgtatatgtaccacattttctttatccattcatctgttgatggacacttaagttgcttagaaatcttagctattgtagacagtgctgcaacaaacataggagtgcagatatctctttgatgtatggattttctttcttttgggtatatacctagcagtgggattgatggatcatatggtagctcaatttttagcttttgaggaacctccaaactattctccatagtggttgtactaattcacatccccaccaacagtgtatgagtgttcccttttctctacatactggccaacatctgttattgcttgtcttttggatataagccattttaactgggatgagatgatatctcattgtagtttaaatttgtatttctctgatgatcaataatgttgagcaccttttcatatgcctgtttgccatttgtacgttttctgttgagaaatgtctattcaagtcttttgcccattttttgaatgaattattagatttttcctatagagttggaatccttatatattcttattaatcccttgtcagatgggtagtttgcaaatattttctcccattctctgggttgtctcttcacgttgttagctgtctcatttgctgtgcagaagctctttaacttgatgtggtatcatttgtacctgtttactttggttgcctttgcttgtggggtattgctcaataaatttttgcccaggccaatgttctggagattttcgccaatgttttcttgtagtagaaaacatagttcaaggtcttagatttaagtcttgaatccatttttatttgatttttgtatctggtgagagataggggtctagtttcactcttcttcatatggatatccagttttcctaacaccatttgttgaagagactatcttttccccagtgtatattcttggcacctttgtcaaaaagtgttttcatcctaggtgtgtgtatttgtttctgagttctctattctgttccattggtctatgtgtctgtttttgtgctggtaccatactgttttggttactatagctttatagtataatttgaagtcagatgatgtgattcctccagttttgttctttttgcttaggatatctttgactattctggctctgtttgtagttctatataaattttaggattttttttctatttctgtgaagaatatcattggtattttgatagagtttgcatcgaatctgtagattgctttgggtagtatgaatattttaacaatattgatttttccaatctatgaacatagaatatttttctctttttttggtgtcctcttcaatttctttcatcagtgttttatagttttcattataaacatcttttgcttctttggctaagttaatttctgggtgtttaattttatgtgtggatactgtaaatgggattacttttttcatttcttcttcagattgctaactgttggcatatagaaacactactgtttttgtatgttgattttgtatcctgtaactttactgaatttgtttatcagttctaatagtttctttgtggagtctttaggtttttccaaatacaagatcctgttatctgcaaacaaggataatctgacttcttcctttccagtttggatgacctttatatcttcctcttgtcttattgctgtagctaggactcccagtactatgtttaataacagtggtgaaagtgggcacatccttgtcctgttctagagcttacaggaaaggctttaagtttttccacattcagtattatactatctgtgggtgtttcatatctgacttttattatattgaagtatatttcttctttccccagttttttgagggtttttaatcatgaagagatgttcaattttattatatgctttttcagcatcaattgaaatgatcatatagtttttacctttcattctgtggatatgatatatcacattgattaatttgtatatgttgaaccatccttgcatcccagggataaatcccatttgatcgtgatgaatgatctttctaatgtattgttgaattcgatttgttcgtgttttgttgaggatttttgcataaatatccatcagagatattggcctgtagttttttgtttttcgttgtgtgtgtgtttgtgtgtgcgtgtgtgtctgtgtgtgtgtctttggttttggtatcaaggtaatactggccttgtagaatgagtttggaagtagtccctcctcctctatttttcagaatagtttgagtaggattagtattagttcttctttaaatgtttggtagaattcagcagtgaagccattaggtcctgggcttttctttactgggagacttgttattatggattctatttcattacttgttattggtctgttaaagttttgggtttcttcctgattgaattttggtaggttgtatttttctaggaatttgtccatttcttatagattttccaatttattggcatttggtgcttatagtagccactaatggtcctttgaaattctgttgtatcagttgtcatgtctcctttttcaattctgattttatttgcatcttttctctttttttcttagtctggctaaagttttgtcaattttgtttaacttttttaaacatcaactttttgtttcattgatttttgtatttttttatttcagtttcatttatttctgttctgatctttattatttcttttcttctaccaattttgggtttggtttgctcttgcttttctagttctttaagatgcgttgttagattgcttatttgaagttttccctcttttttgatgtaagcacttatagctgtaagtttccctcttagtactaattttgctgcatcccataggttttggtaccatttctttcaagaaatttttttaacttcctttttaatttcttcattgacccactggtaattcagaagcatattgtttaatttctatgtatttgtaaagtttccaaaattcctcttgttattgatttctagttttattccattgtgatgagagaagatgcttgtcattatttcaatttttttgaatgttgtaagacttgttttgtgacctaacatatggcctatccttcagaatgatcaatgtgctgaggaaaaaaaacgtgtattctgtagccattggatgaaacgttctgtaaatatttactagatccatttgatctacagtgcagattaagtctgatatttctttgttgattttctgtctggaagatctgtccaatgctgaaagtggagtgttgaagtctccagctgttattgtattatgatctatctctcccttcagctctaatatttgttttatatatctggatgcttcagtgttgagtccatatatatttaaaattgttatatcctcttgctgaattgacccctttaacattatttagtgactttctttgtttcttcttataattttgggcttgaaagctattttgtctgatggcactatagcaactcctgctgatttttgttttttttccatccttttattttcagtctatgtgtgtctttagaggtgaagtgtgtttcttgtaggcaacatattaatgggtcttgttttttcatccattcatccagtctgtgtcttttgattggggagtttagtctatttacattcaatgttattattgataaataaagacttacttcttccactttgttatttgttttctggttgttttgtggtcttctctttcgtctttctttccttcctgtcttcctttagtgaaggtgattttctctggaggtaagatttggtttcttgctttttattttttgtgtctccattatatgtttttttggtttgaggttaccacaaagcttgcagatactctcttatgtcccattattttaacctgataccaacactgtttgcataaacaaacaaacaatcaaagagaacactaatacaagctctacaccttaactttgtccccttgctttttaactttttgttgttctatttatatcttattgtactgatgatgtcttgaaatgctgttgtcattattattttctattggttcatcatttagtctttctactcaggataagagtagtttacatatcacaattacagtgttaaaatagtctgtgtttttctgcgtacttaccattaccagtgagttttgtactttcaggtgattacttagtaatgttccttcctttctgattgatgtattccctttagcatttcttataggacaggtctggtgttgatgaaacccctcagcttttatttgtctgggaatgtctttatttctctttcatatttgaaggatatttttgccaaatatactattctagggtaaaagtgtattttcttctttcagcactttaaatatgtcatgtcattctctcctggtctatttctcttttcatttccactgtaaagtcttctgccaggcatagtggagctccattgtatgttatttgtttcttttctcttgctgcttttaggatccattctttattcttgacctttgtgagtttgattattaaatggcctgaggtagtcttctttaggttaaatatgcttggtgttctataaccttcttgtacttgaatgttgatacctttctctaggtttgggaagttctctgatattattcatttgaatacactttctacccctatctctttctctacctcctatttaaggccaataactcttagatttgtccttttgaagttatgttttagatcctataggtgtgcttcattgttattcatttttcttttgtctcttctgactgtattttcaaatagcctgtcttcagcctcaccaattctttcttctgcttgatccattctgctattaaaggactctgatgcattctttagtataccaattgcatttttcagcttcagaatttttgcttgattcttcttaattatttcaatctcattgttaaatttatctaatagaattctgaattccttccctgtgttatcttgaatttctttgagtatcctcaacacagctattttgaattttctgcctgaaaggtcacatatctccatttttccaggattggtccctgatgccttatttatttcatttggtgaggtcatgtttccctgggtggtgttgatagatgttctttagtgtctggccattgaagagtgaggtatttattgtagtcctcactgtctgggcttatttgtagctgtccttcttgggaaggcttttcagatatttgaaagaacctgggtgttgtgatctaagccatatctgcttcactgggcaccccaagcccagtaacactgtggttcttgtagactcatagaagtactgccttgatggccatgggacaagatctgggagaagtatctggagaaccaggcagagactcttgttctcttcccgtacttaaccaaacaaacagtctctccttgttcagagccacctaaagctggggtgtagcgacacaagaacctctgtggctaccaccactatgactgctgtggatcacacctgaagccagcacagcactggatttcaccaaaggcctgatgtaaccactactgcctatgtaaccactacgtggctattgcccatgttcactcaaagccctagggctcttcgatcacttgatgccaaaaccagccaggcctgtgaccttcccttcagggtggcaaagtcccccagacaccaggtgggtccagaggtgctgtacaggagtcagggaatacagtcaaaaaccttagaagtctatctggtattctgttgtactgcagctgagctggcactcaaaccacaaggtgcagatcagtgcacaagatgcagtccttcctcctcttcctttccccttccaaaggcagaggaggctcactctgtagccactgccactccaggccataaggagtactgccagactaccacctatgttttcttaaggctcaagggctcttaagtcagcttatggtgaatgctgcctggcctgggattcactctttagggccatgtgctcccctctggcccaggacaggtccagaaatgccatccaagagtcaagtcctggagttgagggctccaagagcctgcttggtgctctatccccctgtggctgtgctagtacctaagttgcaagacagagttccctttgcttttccctctgcttttctcaagcagaaggagttttgtcccacagccaccacaactggtaatgtcctgagtctcacctgaagccagccagtctcagaggcccacccaaggcccccaacatattacccgagtgttgctactggttattcagggcccaagggctcttcagttagtaggtgatgaatgctgccaggactgggtcctttccttcaagtaaggaaagtacaggagtaagtatgggaagagaacaagagtctctgcctggtaatccagataattctcccagattttgtccaagaccattaaggcaatacctctacgagtctgcaagaaccacagtgttactggggagtgggtccctcctggcccagggtatgtctagaaatgtcatctgggagcaaggacctggaatgaaggcctcaggaccctgattagtgtcctttcctgctgtggctgagctggtatccaagatgcaagacacagtactcctcactcttcccttttctctcctgaatcagaaggaaggggtatcttttggagccatgagctgtgtagcctggggtagggtaggggtgatgtcagcactcccttggctgccccaactggtgtctcagtaggtcacatgccccacccccagtccactctctttaggccttgttcagcactaggattcattcagtcttccagtccttatggcctagactgccttttaagtttatttagaaacacagcgctatagcccatggtggtgaggtttgtgggaactcaagttctgaccactgggattggcgattccctctggctagggctggtttaaatgcctcctccatgggtgggcgttagctgagtttggtcctgtttccctttctgctctaacctgacagcacactggggaagggtggcatcggcaattcaagactgttttttctatctcttcagtggctctttcatcggtatgaagataaaaccaggtactatgagggctcacctgatttttggttctgatgaaagtgttttttttctgcgtagatcgttgttaaattggtgtccttgctggggggaagataggtggcactttctattctgccatcttgctctgcctccaaatctcccacaatttttattaagcagatttttttcttctgaatcttctatattctttatcttttttcctcatgatttttttctgtagctttttgcactatgttcagggagaataccttgatttggtcttccaaatcactgttgtcttttcgattgtatctgttctgtacttcatttctggtattgagtttctataatttgttaatcatatttttagtttttaaagatttctttctttttctctgattgctactttttctacagctctttttttatggatctaataaggattttatctcaggaagcttaataaaattacttgaatgttctctttggctgcctgcatttgctctctcctcagaatttaattctctactcattcagctttcaggctataaggttggttttaaggtctggtgattctcagttattccttttcgaatataaattgatctgcattggtaactggtctcctttcctcaccaattgtttaggttcccttccaacatctcttgccacgtctgccccctaaatgtggtgactaactgtaacacatgtgttttactccaaggttcatgggcaggtgggggaggccagcaggttgccctcaaataaacaagtagggaaagttaccttttagagcacctcagggcatttcacacctgtcccaggttgtgtctttccttaattaacagttcaataataactggagcaatgctctacttttctctctggccctagttcttattctaagggtctcccgcgactgatcctttactcagagagcctgggagcaaacacaataactagctgctctatgtgccactgggagaggtggggcactggcctggcacttcgactatcttgtcaagcgtcctacaatacacttctaccctgtcctgttgaccttgggttgatttttctcttgagaaaattagcatattcagatttgacagtaatatcaaacacctactctatgccaggagctatgcaaggcagaaataatacagtaatgaatacaacagatggtgacttgtcccagtgaagtttacaggctggagaattatttatccagtaggcccctccttcactgtggtggactgtgtgtttctcagtgctttggtattcctgtcagcctgctaccatccagaaattcttcagctcccctcaactggcattttctaggtaatgtctaggacttagtcttatcttacggatcacatttcactgggatctggaaaggagaaagcatgttggcttagtgcaccaccttgaaccaacccctttttttttcttcaagtggaagaggaagagctagtggagttcagatgttctttatgagtctataaacaaaagaagtcatttccacccccaaaggaaggctttgaatacaattattcctacattggttctggctctgtaactggagtttctatggagattggcgggagaaatcagagtcctagtcatattctaacatcaaggagcaagtctaggaatgggactgcgcagctcaccgtcttgctttttcattttgcttcttctaacatttttcatgatcccctaatccgtgtgacttttaaaaatatggtttggaagtgccacttttgaagcatgtgaatagaagagcatctcatcccctcactctccccggtacatcccaacccctaccatgcttcgaaaggactgtctctacaaattttgcttcactccctgatgtctggagatcagtcagataggtggatttcttcaggtcttctttggaacccaaaagatctctttctgcctttcggttgctcccaagctttggcagaaaactctattttcagaatcggtactttttctagttgacctttgttgataagttccttcctcactctggtttcagtagatttgtttttgttagaaccaaactgagtgaaaggctttccttctcagaaataagaactaacacctcactaggcagcttgtttagccacccttaggcaaacaccaaattgagcatttagcaattccttttttgaagctggagggaagggtccaagaaagccaactcccagttccaagaaagtgcagacactatttgtgtacttttcttcagatggttgtcatttttaaccaagtagctacactgtcaacctctgatatctctgtgacaacatctatgtgacaaagtcaatcaaaccacccttggcctacctaccccaaagcaacaaagatcttatcttctgatgaggattaagaaagactgagtcctctcagaaaggaagaagttaaaaaaggttcaggcagcactttgtttgtttgtttgtttgtttggcagcagcagtattttgtggctggtttcttttaccacacaaaaaaagactgtggctaatagatatgtcacagctttttagaaacacgtcaattttttttgtgttctgcagctctcaaaaaaaaagtgtggggggggggtggggatcaatcctttgcagcttccaagaaaatggtttttcttttcttctttttgtttgtcacacatctaaatcctagaatcatttagaaagagggagggatgaacgttttcaaaagaattggctccctcactccacatatgcagttacaagcatgtgcagaagagaaggtactgttggtattactgggtcacaatttggacttttgatttaagtaaagaagacttgtactatatagtcaacatttattatataaagttgcccctgagactaatcttcagaaactagataaatagaactgtgtgctctgataaagtgtctcccttggagattatctcacgaggatatgaaaacattataccctacaccaaagatgtgagtgattgaaatatataggctgggcggggtggcttaccacctgtaatcccagcactttgggaggccgaggcaggcggatcactagaggtcaggagtttgagactaacctgaccagcctggtgaaaccccatctctactaaaaatacaaaaattatctgggcttggtggcatgtgcctgtcccagctacttgggaggctgaggcaggagaatcgcttgaacccatgaggcagaggttgcagtgagctgaaatctcgccactgcactgcagcctgggtgacagagtaagactctgtttcaaaaaaaattaaaaaaggccaggcacggtggctcatgcctgtaatcccagcactttgggaggccgaggtgggtggatcacaaggtcaggagttcgagaccagcctggtcaacatggtgaaaccctgtctctactaaaaatacaaaaaattagctgggcgtggtggcaggcgcctgtgatcccagctactcaggaggccgaggcaggagaatcgcttgaacccgggaaacggaggttgcagtgagctgagtctgtgccactgtactccagccagggcgacagagcgagactctgtctcaaaaaaaaaaaaaaaaaaacggaaaagaaaaatatatacatattatacacacatacacacactatccccccacccccgtgtgtgtgtgtcttaaacactcatacatagctaaatttgtatataaaagatttgtatggagggccttgtttttgagatacatcatgaatataatgtctatttatacctctttcttcttggctgggtaactctcacttttcttcttaatcacccttaaaataaatgtggcctctttctgatttaacgtttttgaacttttcaatacctatacataaatcagtggatcgacttctgaagacagcgttgtcttcaagggaaggagaggaaatgcacacaaagagggaagcaggtttcctggagcctttggctcaatgttaggtccagcttgagattccagagttaggagccactaaagatggaactggcctttgtggtttcctttccattctcttcctttcctttccatttcctttccattctgtgattcttaagggtaccctcagtctttggaattaacatctgactgtctcaggggattgcgtaattgagtaaaaacagacccaaagtggcaacacgaagagacttggaattaatatatctttggggccaaaatattcagcataattaagcataatttgattaatgtgggatataatttaattaggcatatggacaaaggagggagaaaatgttctccactgtgaagacgagatcactctatcatacatgctggaactaaaattagagggcaggtttgaagataatacaaaaacccatatttaagtccaagaggtttcttagacttctcttttatttccacatgtggacttattcagcaacctgtagtgtctataaaatttaatgtaaactgctacatttggctttctaccaaaagaaattcaaaccctacacttttgacatttaaaatatgaagtattactataagctaaatataaaactaaatctccttctttcttttactgaataattatttactgagatagtaatatgagtcaggtaccacataagacattaagaatttaaagacaagtaagaaatagtccatctcagacctcaaggactgagaaaggctgagcatgttgggtcctataattactcctgtaatcccagcactttagaaggccaaggtgggaggatcacttgaggccaggggtttgacattagcctgggcaatatagcaagatcccatctctaaaacaaaaacaaaacaaaaaaaacaccacattagactggcatggtggcacatgcctgtagtcctagctacttggaaggctgaggctggaggatctgttaagcccagaagtcctaggctgcagtgagctaggatcctaccacagtacttcagcctgggtgacagggtgagaccttgtctctaaaacaataaaataaaataaaaaggagcaagggaatgtcaagcaatgattcatataaagacaatgaagggtacgttctgagaatggaatcccagaggcctctccaggaggcttctcaggatgtggcaagagggtgatccaagagaaagagcagccaagatggaggctgcagagtcccagcctcagaagtgacacaccagcacttctgccatagttttttgatcacacagatcaaccctggtacgggtgagaggggactaaaaaagggtatgaataccaggagcagaggctcactggggactgtctggggaggctggctaccacagttctccagagacaggcagaggacataagtcaaataacaaagtactgcattttattaattgagccaccatccaataacctccattacaagttttaactaaaaatgaatagaagctgtaaggcctaagcagaatctcctacttcttcctgaatctaaaccttgggatcttagtaccttctagaaggatgcagagaggaaagataacaaaattgatagagacaggagacagccagaggtccctggcgaaaccctgccttcaagcctaaaacagcctgaaggctgaaaaaccgtactgctggtcccagatgaagcctactatttcccgactgattctttctgaataacgcccacctgcacacagggaggacggggtggggcctcgggaagttcacggaatttgcagcgaggaggaacctggcctctcctgttcctgtgtggtgagctgggattcaatctgtgaggtgggaatcctgctagcaggattttctctcactttgcagataattattttccctttttcctttttgcccaataaattcctctcctcacccttctatgtgcccgtgagcctaatctttcccagtcgagtgacaagaacctggttttagctgaactaaggagaaaattctgcaacaaaatgacagagaaaataaaatgacttatctccttagtcacttgtatgaggaggtggagaatcagagagggggctgagtgcacttgtccacccgaatgcatagagtgggagagaaggagaaccattcctaaggagggcatctctgtctactaactacaagttgctatctctggtcccacactctgaccaatcagattagcaactcctcttcccttgggttgggggcaggggtgctaggaagaggtgggaatggcctgggagaaggactgacaagtcctttttcctgtacagaaggtattgtcttccctgtttttcgtataaggaaactgagatgtggaaaggttaactgaagtttggtgaggcctgtttccaagaaaccatgactgaaaatcccaacttttaaattcagccatagtggtcacatcaggtcaaagacaccgtaattgctgctgaacttgtggtgaactccagatttatcttttaggcatttcttctatgtcacaggtatttgggctatgcattaaaccaaagatccacttaaagaaatacaaacacaggagggaacttggaaacattttttgcaatctgttctttgcagagataaagaaactgacatccctagggaatgaagcctaggtcctcgtgcccccgccaccccccagtctggtgctttttcctcagtggcactgtggaggggttgttgagtatgtgttccctgtgaggctgattggaaccttcctcttcctcaactgagtgagaggcaggtgagtgtcattgaaagaacagttcttggagctggaagcccccagtgaagtcccagctccattctgcataataagcttgtgtgatctgggtatattctcctcagtttcttcttttgaaaaatgggtataatgaaatttgccaccctctcgagatggttgtaaggatgaaagaagatcctaactatgaaagatctctgtaggggccaggcacagtggctcacacctgtaatcccagcactttgggaggccgaggcaggtggatcacttgaggtcaggagtttgagaccagcctggccaacatggcaaaaccctgtctctactaaaaatacaaaagttagccagggatgatggcacgcacctgtaatcccagctacttgggaggctgaggtaggagaatcgcttgaatctaggaggcagaggttgtagtgagccgagatcatgccattacactccagcctgggtgacagagtgagactctgcctcacataaaataaaataaggatctctgtaggatcccaggtgctgggcaaaggtaaggaatcagtctttatatctataagatatacaactgccaagctaagatggacatgcctctagctgctgatgcttttttttttttttttttttgagacagaatcttgctctgtcacccaggctggagcgcagtcacatagtcttggctcactgcaacctccacctcctgggctcgatcctcccacctcagtctcccaaatagctaggactacaggtgcatgccacaaaacctggctaatttttatattttttgtagaaatggggttttgccatgttgcccaggctggtctcaaactcttgagctcaagcgatctgtccgccttggcctgctaaagtgctgggattacgggtgtgagccactgcgcccagcctgcctcttgcttcttacatttcactgccttgagagtttatcaactccccacccataggcatttcactttctcctcctcacatgattttgtttcacctgacggtagtccagctgaattctggagataggcagttcaagtaatgggagaggtcagtgactcagtcttctatgtgggattaagttttcccttccccaggaccacaagaatgagcagagtatgtggatcttactttgaaggaacgaaaacaaacaatcctatcatttaataggagctttaaaagctttcgcagcatgggtgagtgtggccatcgagactgtctggcaactgcccctgctaacagtggagatttattatcatagaaaatcatttcaatctgcggaggttccaaagggaccattttatggtcatgggcataattaatagcagaactgtttgggaaggacgctaatatttattcactgcctaccacgcgcaagacagagagtgaggtgggaggctggtgccattctgattctgcagaagagaaagctgaagttcaaggaagttaggtgggttgcccacagttataagcctataaacagtagcgtgaagacttgaatccagatctttgcacttcctgtagtgtaacacagggagggttcagtgcattttgaatctgctagtttgtctcttttgaaaatgagagaaaatctgtggggaaatatgagaattacaatagcttacccaatcgtccaaaggtcacaaagccccagaatttggaaaccttggggtaaaagggagatcaaaacgatgattaaaaatgaaaaatcaaagtctcagcttctgctgcctcttgacaccaggcacagatacacttttaatgacaggcttttatcagatattgccgtcggcagatctcaatgccagggccgctaacgagtggagggtaaggaaggtcacaacacagaggatacaaaataaggatttgaagccatgtccgtctggcaagaagaaattaagcgaaactcaggaagttcttaaatatgtcgaaggagactgtgtttcacaacttctacaaacaaattccaaaatacgtagacttctaggaagcagagaagttagcaaatcgccaaggtgttaatagtcggttcttggtattgttaaagcacagtttgatttgcacatctgactgaaatacttgctttagcaagcacactctttcctagtagtgcctcttaatgcttctactaaaaggcaactcatctttttgatggcctgagcactttagtcacaaaaataaaatttactgagcacatactacgtgcctggctgtgactaaggcacaggggatacaaatgaaaacagaattacacgttaacgtttatggagttcatagctggatgggaaaagcagtcaagtcaacaaggaattatggcatgtagacttcatgtataacatgaaggcaggacaaggtgcccagggaaatgcagtagatgggtacctaactcagtcttggaaagtcagcaaaagcttcccggttaaagtgccacctgagctgagacccaaaggatgagtgggagttaatggagtgtattctcagtggaaagagaaacatgcacaaaggaatagggatgagagaatggggtgtgtttggggaactgaaagagattcagtctggacagactgttaaggatagagatggcaggccgggcgcggtggcttatgcctgtaatcccagcactttgggaggccgaggcaggcggatcacgaggtcaggagatcgagaccatcatagctaacacggtgaaaccccgtctctactaaaaatacaaaaaaattagcgggcatggtggtgggcgcttgtagtcttagctactcgggaggctgaggtgggagaatggcatgaacccgggaggcggagcttgcagtgagccgagatcgtgccactgcactccagcctgggtgacagagtgagactccgtctcaaaaaaaaaaaaaaaagatagagatggcagatagatgggtgggggctcaccttctataccatgtgaaagcattagggctttatcccaactgactgttgcaagggtttaagcatgaggataagatgatcatatgtgtgttttagaaaggtcatcattctgtgcatgtgtttcagaaagatctgtttggggatttggagcatgcaaggcagggtggtggggtgtgggatggggagggcaagaccagtagcaggagacccagcagctggagttgctgtcatccaggccagagatgggggtagtctagtccaagttaatccattagagctggagagaagtagacagattcaagagctccttaaggggtagactgaaccaaccacatcttgagattgttgtcagatgtgtggaatgaggtagggaagcagtcaagaatggcttccaggtttctgggctgtatggctgaggataccagctcctggaccacagaaccctgcagaaggagcaggtttcaaagaggtggtgaggagctccattttggaaatgctgctggaggagtggtggggtacagccaaggggagctgttccataagaaccaccgtcagaatctcaggagagagatccagatgggttgtggaattgggagtcatcggcacatggatggcagttgatgccaaggctgacatcatgtgacaaggctagctccagcagccctgtcttcaaagagggtctggaagctctcactttttcctggtttgtgcttgtcggaccatatgcaagtaattaaaacaggacattcattaacatgccactttatgccttttagtctccctatgtctccagggctagtgggtgaggtacatagagagatgccatgcacattttatataggaccaagttcatgcaatgccaagcagtgacagagcccagctcaggttcctccaggtgctcttctgaccacactgtaattcctctgaggtcaccctaaagaaaacactcaattcatagacaatcatgacaggactgaaattcatgatgacagataaaagggggcatcttttctaccaggctcagtggcttttagcctctgccatcctcaccccctcacccttgccctccactgcagcacttctcacctggtgttggcctgtctacccccagcgggtctcagaggaagggccgtggctccatggctcccaagtctctggacacttggccaagcgagggttgtaagtcatagcccaatcaggccccagctgctcaaagatgcaactggaggtgatgccgtaacataaagagatagccccggaagtgatgcaataacatagggatgtggtcagtaaattgggaatgggagaagaaggagcttttcctgctgaccccggaaatcatggtgccatggagagaaggtaaagtggagatcaccagggcttggggctttgttttggttttgtctcagagcagtgagattatttttctaaaagacaacttgaagggaactccagtatgtaaaatggtttttaaaaaaagacctgccctaacaaaagtaggagccctggggcctgagccagcttcctcttcctcaccccatacatactcagcccgggcctccgagccttcttgcaacacttttgaaaaccgatagtttagtccataccttccaggatggtgggaagtacataaatttgaaagcatggaattatagtcaaattcccctgggtttaactctagccaggctgtttattagctgtgtgtattttggataggttatttaagttttctgagcctcagatttatcatctgtagaatggggagggagtacagaattgctgtgaaggtttaaagagaaaaaataactaaaatattgagcactgtgctcagcattgagtatattctcagtacatgggaattattgttatcaattgctgaacatttagatatttctagacaagctggaaatctggattttaatagatgggctagaaattgggatttttataagaatctcccaatttttaaatgttggcaagtaattttaaaaaatgaaaaacattgtttgagctcaataagacacgctcccgcagtcagtttgggacctctgtccgtgcaggaaggaggttagatctggaggggaagggcaggagcccagagcttgggtccctgggcaggacttgtgggtttcagtcatgggtggagactggccctgccatcctgctgtaaatgcaaccaattctcaaccagaaaatttttcaatctacctatagcctgcttccagttgtcccaccttactgaaccaaaccaatgttttcttttgttgttgttgcttgttttttctttctttctttttttttttttgagacagagtctccctctgtcacccaggctagagtgcagtggcactatttggctcactgcagcctccacctcctgtgattctcatgcttcagcctcccaagtaattgggactacaggcacgtgccacacctgactaattttttggtattcttagtagagatggggttttgccctgttagccaggctggtctcaaactcctggcctcaagtgatccatctgcctcagcctcccaaagtgctgggattacaggcatgagccaccacgcctagcccaatgtatttcttaaatgtatttgattgaagtctcatgtctctgtaaaatgtataaaaccaagctgcagcctgaccaccttgggcacatgttctcaggatctcctgagggctgtgtcacaggcctctctcatatttggctcagaataaatcttttcaatggcgtgtgtggtggctcacgcctggaatcccagcactttgggaggccgagacaggcagattgcttgaggccaggagttcgagaccagcctggccaacgtggcaaccccatctctactaaaaacacaaaaattagccgggcatggtggcacatacctgtaatcccagctacttgagaggctgaagcacaagaatcacttgaaccctggaggcagaggttgcagtgagccgagattgtgtcactgcactccagcctgggtgacagagcgacactccgtgtcaaaaaaagggaataaatctcttcaaatattttacagagtttgattctttttgtttactctgggatggggactggggtatgcagggaggtgtgcatgtacacacttatgtgtgtgtgtgatggaaggggttaacacccagctgtttgcagaccacactaggtgctatgcacgtattacttcatggtcaatctattattatccccattttaagactgagaaaactgaggctcagagaggttggagaacaggctgaggttcagtaagctgtcatagctgagctgagacttgaatgccggtcagatttcagaatctgggctcctcgcacttctcaccacactgcctgtcccttactccccccgacctccttgtcctctctcctgccacttcttcccttccctttccaagaatatcctgttttacccactactgtaattaccagtattatggttatactttctgttatccatttcaaggatgtcatagattatggtttatcaaatgctcccatgaacaagatctcatttggtcccaacaaaccctgtgagatagacaggtgagtattaagcccactttgcaaaggagaacagagctcagagaggtgggagatatacgttgtgcacaaagacccctgctcttctgtctccaaatccagggcttctttgctcacgctgctttaccgagctccttcaaggaggccctgcaaagccaaagtcaagtgtgtgctgatcggcaggtacacccaatgtctgtgaaactggatcttgattttaaatttcaatattttgatattttgttcatcctggatttttgacaccaattttcacttaaaaatattgcattaaaatattatttgattattgcgtttatttggtgcccctaaattttgcaccacaggcagtgcccccactgatctcaccccgatcccagccctgcgcctgtctgtaccagtgtaaggattacgttgtgattgcaactgtgacgtaagcatgtgagagcgttttaccacagtgccgagtctgcctgccttttctgacccttctttgttcctttgtttggttcggagtgtcactcccctaatctcccttcaaggaaccctgtctgactggaatgatctagtaggagtgggtgggcacgttgggtgccaggacagtgatgcctggccttggaaggggggcccttgctgttagctggtgggcgctctcagtgctttgggcaagtgaacataatgaagccttgtttctggaagggatcattcgggaataaactttcatggataccttcttgctcaccccatctgctctcccgtgctccccctccagccctgttggccactagggaaatagaaggaacagcttgatcaaggtttttcctagaaaagcctttccatgggcccattatggaaaacgaagctgtttttgttttccttgattaatcacagtgtcttgtttcccaaagcaaatgtggccttggctcttccgaaagaacacaggctgtgctgtaaagaagggctgcagccgcctggtgcttgacaaggtccccaagacgggaagggacacatgtagccctgtcctccaggactcggctcttccttttttaccttccagggagctcaggttaccagtttcctttgtgtttttctgccagtgtgaacaggagaaatattagcctttagagatttctttacagttccttgaaagctggaggggtgaaatcagccagagaattatataacagcaaagctcatttaaagcaacagtgtctttctatagggctgtggtggttccttaccagtttttgttactaactataaagaaaaggatgctaattttgtgaataaaatagaggggcattcccttccctcattactttctgtttgttcattggacggacacaattcctagggtgttgatttaaaaaaaaaaaattgaagcctctttcaaggaagactaggggaaatcatgtacattaacctcaggcagacacggcatacttattcttgttagaagtcagaagaaaaaaaataaagagaaaagctttctaaagcatttgtttgttttaatttaagagtcacggggaattttataaatactcggctaaattcttcaaagggagccatgttctttaaatttaagcactaggctgggcgcagtggctcatgcctgtaatcccaacactttgggaggctgagatgggccgatcacctgaggtcaggagttcaggaccagcctggccaacatgatgaaatcctgtctctactaacaatacaaaaattagccaggcgcggtagcatgtgcctgtaatccgagctactctggaggctgaggcaggagaatcacctgaacctgggaggcagaggtagcagtgaaccacaccactgcactccagcctgggcgacagagcaagactccatctcaaaaaagaaaaaaaaaaaaataagcactagatcatctattcctacgttgtttgacctagagcttaaatacatctcaaagtgcaccacacacattagctcagctgatcgccatactcccttgatttgaccttctctttcttctcattttagagatgaggaaactgaggccaaaggattctgttacttgcctggcttcacagctcacctggagattctgaactggcatcttcctctctctgccatcaccccagaccctaccctctttcctctacaccagtggttctcaatcaagggcgattttgccttccaggggacatttgacaatgtctggaggcgtttttggttgtcacaattctgtgtatgtgtgtgggtgggcggggggcaggggattatgttggcatctagtgagtagataacagagatgctgctaaacctacaatgctcagatggcccctaacaaagaagtatgttgtccaaaatgtcaatggtgcagagggtgagaagccctggtctatacagagctcagcagtccagagcaattgcaacctctgggagttgccaagagctcctctgcccagcaacaggcttggcctctctcctgtggctgccacaagagttaaagccactgtctggaatgccctttggcagtggccaagtgtcccctgcagaactgactgcgggacatgcggtgcatcagccggagctgatgtgttttgtaatttatagtcacagggcgcctgtcttcatttagcagtaggcctgctggcagcttccctgccagggaggaagcaagttccacagaggcccacagcccccgccagctgccggcccgtggtatttggggacggctgttgctcagagacacctgggaataggccggggccgagatggcgctgagcactcggtctccccttcagacccatccatcagcagcggtccctgccagaagatggcctattgaacatttccagaaatagcacagccaagcccgtcaactgctttcttggaaatacattcaataaggatggcggtcctccagcagggagagcagaaagcctggcctggatcagtctgctgagaaacagcaatgcctggctacaggccatgtcggtgccttgggaaaggggagcggttctcatgggacttcccaagccctgcagcctctgaagtcacttcaaaatgttctcagtatggagggagagagtcacaccttgcagaaggccttaggccctgccgacttcttctaactcagtgacctgcacatcttgctgtgttcgttcagacaccccgcagacaggaaggcgattcaggcttggaggcaaggtattaactgtcagcagagagagacctctgcatcatctggggaacgtttattgcagtccctcctcttgtgagcttcactcccaagtagaaccaaaggagcatcagcagggggagtattttcttccccaatccttcggtcattcctgaggtacaggaaatacaaggcaaagatgtcatattgaaagaaaagcttataatttctactcctcccctccccacttcccacagaattaactttcccttaacttccctaacaggggcctgacattgcggtttgaattcagccaccctgggaatctgcaccctgagctttctccaatttctgggatggcacagtgatggcagggcttaagagtgcctcaagaaggccagctgcctttaaaaacaagctcctggaagatgtaggtgtcacataaaagcaagagaccaaaaactctctgcaatttggggtgttcaggaaatgttgattgatcacattttttaaattataagagactgctggacatggtggctcactcctgtaatcccagcacttcaggaggcccaagtgagaggattgcttgagcccaaaagttcaagaccagcctgggcaacatggcaaaacctcacctctacaaaaaatctaaaaattagccaggtgtggtggtgcacacctataatcccagctacttgggaggctgtgtgggaggattccttgagcccaggagactgaggctgcagtgagccatgatagtgccactgcactccagcctgggtttacagcaagaccctgtctcaaaaaaaaagtgtaagacagttaccaggttcatcataaaaaattcgtgggacctggttttatttgcaagagccactgactctcaggacaaacaagatttgaagcccacactgagctataggtggaggcagggctgtgagaatacaatacaggatgcccagttaaatttaaatttcaggtaagcaataatattttttgtataattgtattccaaatattattattatttatctgaaattcagatttaatgggcatcaggtgttttgttcaatctgttcactccatttggggtataaattgatctagtttttaaactgataacagggaacactgacacatattcaatacatatgaaagacgataccagttaagagaagaagaaggagattagcaatgaagagggaaagcgagagaaataccaggaagaaaaggagatgggcatagcgaaggagaaaaagttccaaatgaaagagaaacaggaagtgctgaggagagagaagaaaacaggaatgtttctgaaggaccaaaaatgtttgataaattatgactgttacacagagagccatctccctgggaaatgctgttgagttggctaaccactgttcctggatctgcagctctttgttctgtctggtaaaacacacagtgaccactagggagaaatgactctctaagccacagtaccattatctgggtcactattaccccaggctcaggttgttaaataaaatttataggaggccattgctttggacagagtccttccactgggctccaacagaccaaagcaaaccagaatagtgtcacttgtgctacctgacatgtgctcaaactgaactttaaaacgggccagttttccaaaaatcaggagatttacagcaaccaactgaaagtgaagtggtgtcattcatctggggtgatacctgaggttcactgcctcatgccaaagaaatcgaggatgcagacacacacagagtgagtttaacaggcgaaagaaagagaataggtctctctcctgcagagagggggattctcgagtaggtcttccggttccatggtgaaatgcacagggttttatagatgatcttgaggaggcagtgtctgatttacatagggcccaaaggttggttggaccaggtgtgtcatttacataacgtgcgaagaagatggctaccccaccctaatcttttattatgcagatatgtgccatattgcctgtttctttactgtacacgtggtgacaaagaaaagggaagatggagcctccatgctgaacatgcctggtccccaggtagccttttcctattggcatagctgccagcattcatccatgcaagcttccagtttgcttatctatgtttgcagctcaacttttcaggccactctttgttagaaaagaaatgattcgggggctgctttttattaaaagggtaaccttgctgaggactctcttaccctcactaactgcctaatttctttctagctcctgtatcaaaagggtccccatccacctgcacaggcatgagagggaagtcccctgtgtataaaccctttaaggaaagtaactttgaaatgaccaagccacttcatgtttcttgatcttgctatccccaggcttttctgcccatccatctgcttggttcttcaaagcaccttttctattttatagataagatgctgcctgattcacaaatcgataataaaagccaactggacctttaaattcaatgtgtgaaaattttgttctttgacagggtgaagccacatctaaggctgtgtccaactccaggacctaagggccctccctactcctcccacctccacccccccccgccttcccccacaggttgctgtcattcatggattgaggattttcgaaaaattgggatctaaacaacaaaatggatttggctgccacaattctttgaaattgttttgttgtggatgattcagaaaacccttcaacagcttctttcacctcagggtcaatgtgtttgaggaggagagtcatcgtaggcctgtgtgcagacaatcgaggttccttgaattataaacacccttattcccatccccacagatgggaggtcaggttggcttaacccaaagggagaagactatgtaggctgggggtaggtgtggtaagagaggaggcctcccaaggaggggcctgtagtagttggacctgccatcaccatggacgctacggaattgaaaagaggagacaagcagggaccctcctcttaggggcctgtaggggatggactggtgggagagggtcaagcatggaaataaaggaaagccttgagtccctttaagggaaattccaggcacctagctagccctgaggagcttagccccatgctaagaccctagtccagataacaactggataagcaagaaggtaatagtagcctaaaacaggctgggcgcggtggctcacgcctgtaatccctgcactttgggaggctgaggtgggtggatcacttgaggtcaggagaccagcctggccaatagggtgaaaccttgtctctactaaaagcacaaaaattagccaggcgtggcggcgcatgcctgtaatcccagctacttgggaggctgaggcaggagaattgcttgagcctgggaggcggaggttgcagtgagctgagatggcgccactgcactccagcctgggcgacagagcaagactctggcttaaaaaaaaaagtagcctaaaacaatagccaaggaagccagagtcacaggatgtttggttccctatagaaactaaagatagcatcttaacgtgagtctctgagttgtttttcagaaacctggactctcaccaaacccatcccccctacatatagatctcagataaggaggaactaggaactgaactctgatcactgtactttgttctaaatttcttcctgaagggcctagagaaagtcacacccaaagaggtagagctaacctttatttctgctggccccagatttttaaacaaagcttctctttcttaaccagttgcaaatcagaaaagctttgaatctacttatgacctgtaagccttctgcttcaagatatcctgcccttttaggcccaaaccagtatgtaacctgggtattggtttatgattttgcctgtaacttctgctttcctgaaatttaccgctgcctttaaaaactcttacctgcaagccatcagggaggtggggacttaagcattagttgcctggttctccttgcatggtgccctgcaaataaacaccttcctttctcccactgcaaaccctgatgtagatatctgatcttaccgcactggggaagtggaccccagttagattctataatataataaaggggctgcctttggctacctgggctggggagtaggtctccccataaactccagtgaggagcagaagagacacactaaatgtctcaccatgctaagacgtcattccagatacctggagatatctaggctgtccatttggaacatcatcattgcaacaataacctttatggagcatctactctgggccattgcatgatctgaattgatcctcaacaactgagtcaggaaaaattcagtgtggtcaaaggagaacagaaaattccaggcagtattttcacatgccttgcaaaaaggaaactcttgaaataactatagaagctgggggctgataagaccctggaaaaccagggtgtgggccaagctggctaagaccaactggacccaacatggtgctgcatttgacctaggtttctcccaagacctcattataccctcacccaccagtaccatgatgtttccaggaacacccatatttggtgtaaaaatgggtggcactacagttccaagaaatcctcacctttttccaggaatctttatgaatattccaccccttggttaaagaaatcaataatgataggaaccccaagctccatgtgactctgtcttttgagtacgccagcactcccttgtcttgagtgtgtatttttactttgcaatcaagctctctgtctagccgggcgcagtggcatatgcctgtaatccaagcactttgggaggctgaggcaggaggatcgcttgagtccaggagtttgtgaccaacctggcaacatggagaaaccccatctacacacacacacacacacacacacacacacacacacaattcaaaaactagctgggcgtggtggtgaacacctgtagtcccagctacacagtgggttgaggtgggaggatcacttgagcctgggaggtcgaggctgagatcatgccactgcactccagcctgggcgacagagtgagaccctgtctcaaaaataaaaataaacaaatctccatactttcactgttgttcagctcctccttgaattccttctcatgaaagtgtcaagggcctggacactagctagggtcgaggtcccaccattgtttggggacctctcccagcccaccagtgtcacagcgatctcatgttgtaggtataatattatttatattactacagcaatgccctaagtcaagagatggagaaattaggactgcaaaaagttaagttgttgtctaaaagtcaattgattagtgagtgttggggcagagatttgtctcagggatgcctctctcccagcccagggatcatccctaaccctccagtcagactgccgggttcaaatctcagctccatcactcacaagctgtgtggccttgggtaagttactgaatctctctgcatctgtttcactgtgtgaaaagtggtaataaaaataggacctagctcatggagatgctgcaaggatttaatgaaggctgggtgcagtggctcatgcctgtaatcccagcactttgggaagccaaggtgggaggatcacttgtgcccaggagtttgagaccagtatgggcaacatagtgagaccccccacctccacacacacacacacaaaattagccaggcatggtggtgccacctgtagtccagctacttgggaggctgaggcaggaggattgcttgagcttgggaggtcagggctgcagtgagctgtgattgtaccactgcactccagcctgggtgacagagaaggactctgtctccaaaagaaaaaaaaaatagatttaatgagtgagaactctgactttttttttctcttgcccaaattcctatctaaggggcctggagagtcacaccttagaaaccataaaatctcattagacaggctttattagccattttttaaaattttttaacttttttttattgtgatggggtctcactatattgcccaggctggtctcaaactcctgggctcaagtgacctcctgacttggccacccaaagtgttgggattacaggtgtgagcccccacacctggctgagttttattaatcttatataatatggcttactttacaacctgactcagatatagcatcacatgacagatagcataccctgaaggaaaccaaaatattttaccccaaaatatatttctttaacatattttgaaatggctgccacagggccaacagattgaaatgactttgcaaagccatcttttgtggggaaattttgcatctgtagagaatctccataaatgtagccaggactttccccttctaggtctttccctgattaactgagagtctgacacctttaaagtctgagaagagacattcaccatctattctctctgagggctgccacctataacgttcatctacatcagaaccttggcctccacaacctccttatcttaattcaggctttcctttctactgatttcaaggatttaaatcaagctttgtgatgtcacactttttgggccaatccaacgtatactttccacgtattgatttatgattttaactgcaattcctgtctccctgaaatgtctaaaaccaaactgtaacctgactagtttaggcttcctttctcagttcctcttgagattgtgcaacctgggatgaaggtactcacatcggcttggaataaacttctttaaatatattttggcagaatttggttttgccattaacataagtttataagtgtaaagtacttaggacatgtctgtcacatacagaacactaagtattagtgctattattattcctatcattgttagtgttcagttatttccaagaaatgatacgagcctgatgggccatcaacattgtccttgggagggtgcagcagaaggggctggttctgcctctgctctgttcatgttagtggtggtgaatctgtacggtctgtagcaacctcaattcttgccccttcagaagaaagaatttgaccaaggggcataagacaaagggagagaccagggcaagttttagagcaggagtgaaagcttattaaaaagttttagagcaggaaagaaaggaagtaaagtacatttgggagagggccaagtgggtgacttgagagatccaagtatcctgcttgacctttgacttggggttttatacgttggcatgcttctggagttttgcatctctcctcccttgatttttaacttggggcaggccgtccacatgcacagtggcctcccaacacttgggaggggctgcatgtgcagtgcgtttactgaagttgtgtgcacgctcacttgaggcgttttctccttatcagttgagcattcccagaggaaggtcatttaccaattaaactccatgattttgcctcttagtgtccatgcttgagcccacttgcccaactcctgagatcttatttggaagcggctgatcacgcacttcaggtgttttccatctatcaggagactgccaataggtctattgggtgctgtctgtgataaattattattttagagagacgttttagcaaccactcaaccattacctgatggttgcctgacattcctgaggggagggagccctctcctgccatgctcatgtctgcctaactgccaacttcaacagttttagtttttgtggtttacgcatgtgtcattgtccaggcaacattttaaatttcttattcttgtgaacaaggtacaggggcttccttaagtctaccaagtagttattcatagaaagatgattcagaagactcaattttctgaatttaccttttatctctgcttgttaataatgactctattatatgccggtgaggctagacaatgctgcagtaacaaataaagccctggagtcacaatgatgtatcagaacaattttttttcccccttcatagaatgtctaggaaagctttcctccatgcattgactcggggatctaggctgtttccaccttgtggctcatcaaaggctttcatggtcacagccaaatgaaatgagagaagtggagggactctcctagtgaactgcctttacctacatttacacactcctcctctgttcaaagtccattagtcagacttgtcacatggctccaaccacagcaggtgaggaagtaggaggaatacatggattttctctttccagcaccctaatggtctctacctcaatgcacaaacccagcttatggccccaagtgaagaactgctagttgctttgttaatcaagtaatgagaacctttttcttattaattatggtcatgtatttatttgattgagacatagttaatttattcactctttcaataagtatttgttgagtatttcctctctaccaggcacctgtgggccctggggatatgtcagtaagtgaaacagaacaaaaccacttccttcatagaactagcattccagtgggaaattgtgaaagatagataattaacccccaaaaataagaaagcaatatattaggcgttgatatgtgcaatggagaaaataaaacagggaagaggtttcaagatgcaagtgtgtgtatctgtgtgtttgtgtgtattgagggaggaacttaaaataggatggttagtgaagaccttcttgcaaaagtgacatttgagtagacgctcaaaggaggcaggagagctctggggtaaaagccgtctgtgaaggggaagaagggagtgcaaaggccctgaggcaggagagtgcctggcatgctgagggcagtgaggatgtcagtgcgtctgaggagagtggtgggatatgaggtgaggaaggtgatgaggatgtacgcaccctggagggccttgtaacctgtttaaggatgttgcttttactcttgcttaaaaacctccaattttcttcccacttcccaacatacatactgtacgtctgtcagttcccctgcagcagtggttctcaaatttcaactggcattagaatcacctagaaggttaaaatcagactgccgtggtttacctcgcagagtttctgtggtagggcctgagaatttgcaattctaattggatcccagatgctatggtctgaacgtgtgtgtcccctcaattcatatggtgaaacctaatccccagtgcaatggtacaaggaggtgggacttttgggaggttattaggtcatgacagcagagccctcataaatggaactagtgcccttataaaagaggctccagagagctacctggccccttccactgtgtaaggttgcaataagaaggtgccatctatgaaccaggaatagggctctccccagaagagagacccctattcctcactgcccctcaggatgccaggcactctcctgcctcagggcctttgcaatcactaattccccatctcagacggcttttacaccagagctctcctgcctcagggcctttgcactcactaattccccatctcagacggcttttaccccagagctctcctgcctcctttgggcatctactcaaatgccacttttgcaagaaggtcttcactagccatcctgttttaagttcctccctcaatacacacaaacacacagatacacacacacttgcattttgaaccaacaaccttctgtgttttattttctccattgcacttaacatgaaatctagccgggcacagtggctcacgcctgtaatcctagcactttgggaggcagaggtaggcggatcacttgaggtcagaagtttgagaccagcctgcccaacatggtgaaacctcatctctactaaaaatacaaaaattagctgggcgtggtggcgggcacttgtaatcccaactactggggaggctgagtcaggaaaatcgcttgaacccaggaggcagaggtggcagtgagccaagatcacaccactgcactccggcctgggcaatagagtgagacactgtctcaaaaaaataaataagtaaataatcaaatctgccagtttcttatcttggacttcgtagtcttcagaactatgagaaatagatattgttgtttcagccacccagcttatggtattttcttatagcacctgagtggactaagacaccaggtgatgctgatgctacagggaacacactttgagaaccactgctctagtgaaacaagccccctcttgctttcctacttccccatgaaaacctgccctgatttttggacaaggccagctacataatttttgaggctcagtcaaaatgaaaatgcaaggcccctgttcaaaaaggcagggggaaaaagggcagtataagatactaaaatatcaaaattatccttctaaaatattttctaggtggagcatccttaatccaaaaatccaaaataaatgttttaaaatccaaaactttttgagcactgatatgacactcaaaatgccctaatgagcattttaaattttaggtattcagatttgggatgctcaaccagtaagtataatgcaaatattccaaaatctgaaaaaaatctgaaattcaaaacacttttggtcccaagcattccagataaggtgtatttaatacactacatcacttagaaagtataatgagagtaataatgacacatgaataacaacacaaatttttaaatagccaaaaaatatttttggtgttgtaagtttatataacacaatacataatagtatcttatattaacgtgacattataattaatctggcttgctttgctgcatattcattaatttctgatgtgttttcttgcatatttatgtatttatttgatcataaaaatttgtacttttaacagcttaattttcaatgatctaattcaaagcaatgtcagttgctattggcaaatgtaagatcacgaatactttttgataaatttaattttgacaattagaatctactgatgcaactcttactagaataagtttattttttaggctgtaatgatattgggatacatttctgataaattatcttgaaatatgaattttagtacatctagaggtgatgattcctatagaaatattttctaaaaagatttaactcttcatacaaatcagtttcttataaatctgaatttaattgtacatgtaaattttaatattaattaatatttcctccagcagttcctgcaagttgtggcagttacacaagaaacaaaaaaaggcttcataatttttatataattcaaggcacttctttatgcattctatcactgcatcttcaaatataaggaaatttaacttttttttttttttcgagacagagtctcgctctgttggctaggctggagtgcagtggcacgatctcggctcactgcaacctctgcctccagggctcaagaaattctcctgcctcagcctcctgagtagctgggattacaggtgtgtgccaccatgcccggctaatttttgtgtttttagtagagacggggtttcaccattttggccaggctgttcttgaactcctgacctcaggtaatccgccagcctcggcctcccaaagtgctgggattacaggcatgagccactgtgcctggccagaaaatttaatttttaaattgtcttgctaatttttggtttatctgaggttttcctgcaaataataatgttcttttctgttgaataggataatctttacatttaatttctatttccaagcctgtggatatttggtttgcaatgttgcaatggttttcaaaaccctttgaagaattttaataactccctgatatgctttattgcaatgtctgtgtgtacatcttgttttataataacttactgacaaactttgctgcctgagtaccagcagttcctgtcgcagtgcttagactggagagttaatatttatgcagatgctgcaggaacaggctctggggacagactctcctggggctgcccctccgtggaaccccagtgctgctcctctctgccacagccactacttctgctacttccatgcatctgctgcttctgctactactgctatcaccaccaatgtaggccccggtcccagcccagctgccccctcagatacccctggtgcccaggacagccccaggtatgcccgtgcataccagatggccaggccaactcctggtgctgccctttgccatgcctgtaggcatgagcctgcacgtgtacactaacacctggaatctcctctgctccatgcatgctctattgtctgatctgacttcacaacacaaggtcaaaaataaaattgtcaagaatttcaagacagtaacagcagaacattaaaccaagcatgggattccttctgagagtaggccctgtgtgcacaggttgcacacccatgaagctggtcctgctttggattaagtgatttaccataacttttgcccatgtacctcttatattattttctaacaatgtgttacactaaattgtttaaggtctattttctccactaaatcagaggtcagcaaactatggcccaatggctaaatccagccatttgttattttttaaattgtttatatttagggtgtacaacatgatggattttgttgttgttgtttgtttgtttgtttgtttgtttgtttttgagacagggtctcactctgttgcccaggctggagtgcagtggtgctatctctgctcactgcaacctccgcttcctgggttcaagtgattcccatgcctcagtcacctgagtagctgggattacaggggtgtaccaccacgcctggctaatttttgcatttttagtagagatagagtaatcactatgttggccaggctggtcttgaacttctggccttgtgttatccacccaccttggcctcccaaagtgttgtgattacgggtgtgagtcactgagcccagccaacatgatgttttggtaaacatatacatggtgaacaatacatgatatacacatacattattactgtcaagcaaattaacatacccatcatctcatatagttacctttctttttgtgtgataagagtctccaaaatctactctcttagcaaatttccaatatacaatacaatattaactatagtcttcatgttccacatgagatttctagatttattctcctataggaaccacaactttgtactctttgacctacatctttccatttcccttattcaccccttcccgtggtcaccacaatttactctttgcttttatgtatttaactttttgtttctgcctgttttgtaataaagttttattgaaacacatgcacactcatttgtttacatattgtctatggctgctttcaacggcaggtttgagtagtgtgacaaggaatgtttggcctacagagcctataacatttgctgcctggtcatttatagaataagtttgttaatgcctgcattggactataggatccctgaaggcaggaattatatctctccagttcacttctgtgttcccaatgcctagagcagggcctggcatatagtaaatgctcaatcaacccttgctaaaaaaaaaaaaaaaaagaatgaaacaaaaacatgaatatatgaagagcctagccttttttgaagtaactcattttatcttaaagaaaatcatctttggctagagtcacagagtagaaaaaaaagtaaaagaaaatcctgtaaattttgattccttttctgttttgttttcacgtaaaaatgatgtttaaaattacttaccttatggtcaaattgactctccagggaaatcgaaggtgattgtcttgtagcttggcacgccctctggcacacactccagtctggagaggcacaggcgttgaatagaatagaatagcattcatcattcaacaactatttattgagcaaagcatggggctaggcatgataacagaaatgacaatgattccactatgtcttactcaatagacctgtagagcctacagaccaaagaaaaaaagactcacaaatatatatactcatatataactataccataaaaagtgttaagtaaaaaggaaaatgtctggatgaagtgctttgaattttcagagccaggacggattccttttggctgcagaatccagaaaggctttgtgccagtcattctctatttggtctcagatccgatccctgctcttctgcgttgctttgcaccacaagatgctggcccctgcaaactacatttccgtggctgccctgccaactggctctatctaggctctgtcagtgggaggccatggaaagagatcggaggactggacaaagagaggagaagtgccacggctcctttctttcgcgtgctccagagagaggagccatggtatttctcctctctctctgaacctcagttttctcacttttccaatggaaaaagcaattgtgtctatttcttggggtttttttaagagaatgaaatgagataaggcatgcaaaatgcttagcacaatacctgataagtaataagcatttaaagaatacaggctgggtgcagtggctcacacctgtaatcccagcactttgggaggccaaggcaagtggatcagttgagtcaaatagttcgagaccagcctgggcaacatgacgaaaccccacctctaccaaaatacaaaaattagccctgcgtggtggtacatgcttgtagacccagctgcttgggaggctgaggtgagaggactgctagaaccctggaggcagaggttacagtgagccgagatcgcgtcatgcactccagcctgggtgacagagtgagaccccatctcaaataaatacataaataaataaataaaatacagaatagagctgttcttgcttttgggcttgttcagggaagtgggaaggagtgcagtgatcggtgatgtctgctaaaggtgaaaggtgagagagtagagctatgtgcgaggaatatttagtaatgtatattaaaactgtattgatataaacagttaactgatattaatatattaaaactgtattataaagatagaactgaagggacctggcaaatggactggcagactctagaaagggattaggaaaaatcaaagacctggaatggtgataccaaagcacacacagtcaatacacaagaaccagtaggctcaggagaacagattatgaatttacttttagacaatggtgtgcaaacctttccagttgcaaaaaaaaaaaatgcctacagtaataccttcaagacactttaacaggtggggatttttgttagagatataaatatatgcagtgagttagcaaaacaaaaacaaaaacaaaacatttcagcagctgcacattctggcctcatggagaactggaaaactatccaggaaaccacagcaactgcagttcctagagcctggcctcctctgaagaggagaaaccattgttttttacttagcagttctaccttgcccaaggtgccttctgtttacaatctccctctttctggttttccctttcttgcctctgtgtctgtggctggattatctgtcttgcattcaagatgattaggtgggatatttaccacccaatatgaagcttcccaactgggctgcatcctcaggttagatgccctgggctcagcatagcagttgtggtcagcacagcagattcacctgaaacaacgcaaagacccacctttctcagaaggagctgcgtaatcagtaggttttatagccagactggtgaagacagggtgaattagagatgtcttttgtttgtttgtttttgtttttgttttttttttgagatggagtttcgctcttgttgcccaggctggagtgcaatggcacgatctgggctcaccgcaacctccgcatcctgggttctagcgattctcccacctcagcctcccgagtagttgggattacaggcatgcgccaccacgcccagctaatttttgtatttttagtagagacggggtttcaccatgctggtcaggctggtctcaaactcccaaccttagatgatccgcccgcctcagcctcccaaagcgctgggattacaggtgtgagacaccacggcctgcctagagatgtcagtgggagctccaaggagctgaaaaggttaagactggattgtgattgagggaatattgaggatacctaattacttttgatattctacatttcatatggatttgctcatataagatcaatatctgtccaaggtttagggcagagcaggcagaagttatttctggtaaagataattatttcaatgagaccccaaaacttagatgatttgcagagggaggaattttattactgtcccttataaggacgtaactagtttcttagaagaacaactttgagattggtttggaagtgggaatgtggtgaggttaagatttctttactgcattgagagtaaaatattctacagctcaggaaaacaaacagaacagcccaaccctctgtgattcttcccagaactcttctcatccatcatccctcttgatactgaagaaacccagagcttgcaacacacatattccaaagataagttgatacaagctcacttatgtgaatttctttaaaaatgaagagagagaaaaaagtggagagacagaagacaaaaaaaatacacaaaattaaaaatagctaatatttggaaaatctattattgatggagctctaaggggcagatgaatccttattcttcaaattccaggtgaggaaaaaacagaacaattgtttatgcagctgtacccaagaggtggtatgtgcacttttcctctaactcttaacagagaaacaccacagcactcaaaatcctcttttagaataatttgaattaaaaataaagaatttcacaaatatcactgaagaagtagaaatttttaaataaaagaaaaatagccagtatcttattatcctctaattctgcccccttattttgtaagtacatttataattctaattcacatgcatatgcaatttttatgtaattgtcatcagaagcccttgggctcactacgcagaccttctgagtctgaatgctgtctcagcacttggcatctatgtgatttggccggttacataaactctctgggcctcagttttctcatctgagaagtaggtataataataataatacctacttgaggattaaatgagacaacatctatagagtgcctagttcaatgcctggcacatgctcagtcaatggtaatcactcattgtccatcgttaaaatcagggagctttgtaagccagactggttggacaggagagcttagcagttaaagtgtgtttgctccctattttttccctccccacaatgatgcaatcctgtatctctttcctctggctgcccggccccacccaaaccaagataaaagatgtaacacacacaacaaacattacgtgagcacctgatacgtgctggaagggccctatgaggacttggggaaataaaatcctgctgctagctgctgctgtaaacacattgccatgccccaatgccatgttgagcacctcatatgcataatctaaaccagcacccataaatgtggccatagtgactctcatgcagttgaggaagccatttctcaggaaggttacagttatgggctgaagtatgttccccccaaattcatatattgaagccctaactcccagtacctcagaatgtgactgtattcagagacagggcctttgaagagatgcttaagttaaaatgagaccattagggtgggccctcattcaatcttcttatggtgtccttactgatgtccttataagaagaggaaatgtggacaccagggatgcacacacacaaagaaaagaccatgggagggcacagcaaaagggtagccatccgcaagtcaagaagagaggctcagaagaaaccaaccctgccaacaccttgctcttggacttttagcctccaggactgcagtttaagccacccagtctgtgatattttgttatggcagccccagaaaaccattatagttatataacgtttaaaagcttagaagggattcagccttaaaaaagaaggaaattctgacacatgctacaacatggatgaaccttgaagacattatgctaagtgaaattctaagcaaaagaacaaagccagcttcaaactatacttaaaacccaatttcaaagtatgctataaggctactggaaccaaaacagcatggcactggtccaaaaacagacacatagagcaatggaaccgaatagagagcccagaaataaagccacacacctacagccatctggtctttgacaaagtcaacaaaaacaagcaatggggaatggacccctattcaataaatggtgctaggctaacaggctagccatatggagaagattgaaactgggcccctacctttcaccatgtacaaaaattaactcaagatggattaaagacggaaatgtaagacctaaaatgataaaaatcctacaagaaaacctaggaaataccattctaaacactggccttggaaaataatttttagctaagcactcaaaagcaattgtgacaaaaacagcttgacaagtgggagctaattaaactaaagagcttctgcacagcaaaagaaactatcaacagagtaaccagacaacctacagaatgggagaaaatgttcacaaactaggcatctgacaaaaatctaatatccagaatctataaagaacttaaatcaataagcaaaaaacaattaactccattaaaaagtggataaatgacatgaacaggcacttctcaaaagcagacatacaagtggccaataaacatatgaaaaaatactcaacaccactaatcatcagagaaatgcaaatccaagccaaaggaaataccatctcataccagtcagaatggctatttctaaaaagtcaaaaagataacagatgttgctgaggctgtggagaaaagggaacaattatacactgttggtgggaatgtaaagtagttcagccattgtggaaagcagtttggagatttctccaagggctaaaaatagaattaccattcaacccagcaatctcattacagggcatatacacaaaggaaaataaattgttctaccaaaaagacacatgaacttatatgttcatcacagcactattcacaatagcaaagacatgtaatcaacctagatgcccatcaatggcggattggataaagaaaatgtggtacatatacaccatggaatacaacatagccataaaaagaatgaaatcatgtcctttgcagcaacatggatgtagctggaggtccttatcctaagcgaagtaatacagaaacaggaaaccaaatactgcatgttctcacgtataagcgggaactagacattggaaacacatggtcataaagatggaaacaagagacactgcggactgccagaaggggagggcaaggaggggcagagggttaaaaaaccaccttttgagtattatgctcactacctgggtaataggctcattcataccccaaatctcagattcatgcaacttagacatacccatgtagcaaacctgcacatgtaccccctgaatctaaaatgaaagctgaaatgagaaaaaagaagacatgctagtaaaataagccactcacaacagacaaattctctagtccactcatatgaggtacctagagtagtccaattcttagagacagaaagtccaatggtggttgccagggtctggaggggagggaggaatgggaaattattattggagagacacagtgtttcagttttgcaagacggaaagtgttctggaggtagatggtgagggcggttgcccaacaatgtgaacgcctctgaactgtacccttaaaaatggttaaaatggtaagttgtatgttgcctgtattttatgcaattaaaaattaactttttaacgagtttagggggctcctactctctgtaaagttcaatctcattgaattcttgactcattgcttttggggacgatgaaggcagggagttggaggagggactcggggaaggcaagagagggctcaggatgaggaaggcctgtttgcttttcctgttctgtgggaacatctttaagtgaatgctggcatcacaacagctgtgcagtgatcgccacctctgtcaacgatgatgatagaagagaacaggatttccaaatgagtggctgaattccctgagcgttttttatttttaatgaatttttctcttccttttttccaacttttgggcctgctctttatcgcgcacagaaagaaaacatttcctcagtggtggccaaagctcttttcaggttcttccacagcaacaataaatcagcacagcctctccttgtggccaccgtagatttgctgaccctctgcgtctgctccctgccaaacccaagagctgagggttgggccgtcagcatctgcccctttatgcaaagggtttctgaaatgacaagtcatgcccacaggaccctgctgtagaattcctcagggctgggcagggactgagtgggacagagagagactccagtcccccttcttagatgtgttctcagagagataaacatttctatttggtgggaaaggatcccaccaaaaatgggctgctggtatggtgtctgggcagaaaaaccactgaagtgtctcccacagggcaaatcaggaaaacgtgggcatcaaaataaataacaatgggtcaggcgcagtggctcatgcctgtaatcccagcactttgagaggccgaggggggcaggccatttgaggtccagagtttgagaccagcctggccaacatggtgaaaccccatctctactaaaaatacaaaaattagccgagcatggtggcaggcacctgtaatcccaattactcaggagactgaggcaggagaattgcttgaacccaggaggtggaggttgtggtgagccaagagatcacatcactgcactccagcctgggcaacagagcaagactctgtctcaaaaaaataaaaaattaataataataattataataatggcagcacattgaacccattaaatataataggaagccatgactccacctaactgaatacataaatggaaagtttaatgaagaataggatatatgtatgtttttaaactacctcaccacaaaatacttattaattactaagaatgacttattaattacaaagtctaaacaaaatacttattcattacaaaaagtacaagaaccagtggaaagcctgacagacgcttccttaagcaagagatcaaagtgaacactatcatgatgggacaagctgagctcatgtgtcacctgacaggatgcagcaagaagaccccgacatcccgttggtgacattcctgccaaagacacatagcctgaatctacttgtagggaaacacagacacacccaaactgagaggcattcagcaacacagctgaccttgaaatattcaaaagtgtcaggatcaggccaggcacggtggctcatgcctataatcccagcactttgtgaggctgaggctggtggattgcctgagctcaggagttcaagacaagcctgggcaacatggtgaaacgccgtctccaccaaaacaatacaaaaaattagccaggcatagtaatgtgcatctgtggtcccagctatcgagaggctgtggcgggagaatcgcttgagcctgggaggcagagattgcagagagccaagatcatgccactgcactccagcctgggagacagagtgagaccctgtctcaaaaaaaaaaaaaaaaaaagtatcaagaaagacaaagaaagactgagaaggtattccagacaaaggaagtaaaaaacacagccagcctgtagtctcagtactttgggaaaccaagacaggagaatcacttcagcctaggagtttcagaccagcttgggcaacatagtcagaccctgtctctaaaaaataaaaattaaaaaaaaaaaaaaaagaaccaaccgtaacttggttctggactggattattttgttgtaaagaacattattgggacaattggcataactcaaatgggatctgaggaatagacagcagggctatgtcaatgttgatttcctgattttgctggttaatgtggggtcatgcaggaccacatccttgtttggaggaattccaccctaaagtatttaggggcaatgggacatcaaattgcaacttaccatcaaatggtttaggaaaaaataattctttgtactgtcctccaatttttccataaatgtgattttgtttttcaaaataaaaaaaataaaaaagaaaagtaagaaaaaaaagaagtcagtgccttgtttagctgggaggaaggccatggtcttgggcacaagcctgagatgtttctcgaaattgaattgcctctttgctgactcctgtggggacctgggtggaaatggaggagggaggcctaagatatcagatgaataagtttgctcataatcttgctactcagttagaaggattcatgatgatttgttgtgtaatcttttaggaatgtgtgtgtgtgtgtgtgtgtgtgtgtgtgtgtgtgtgtgtgtagaaaccttttttttttaactggacaacatactatgcctaccgtttatgagcttgcctacttcatggtattcttcaacatcatttttaaaggttagctaatgagtatcccattggatgtgaatcatcatttagtttactaaccccagctggagttggatttgacattccttggtccaccctccatacctcatattttcagttcatgctgtgcctcaatgagaaagaaaagagggaagagctgccaggttctttctggaagaccttatattgtttcccactttcccatgaacagaattgggcaatgggaggaagttttgaggagagattaagatcatgctcagatgagctaggtttaatgaccaattctcctcttaccagccatgtgaagttggacatgttacctgacatctgtgtgcctcagtttcctcatctgtaaaagggggtgaaatgaaaagtacccatctcacagcgttattgaaagatgaacagactctaagtagctggcacatgtaagtgctcattggtgttggccattgttaatactatgaataaatgtaagaggcaacttttgaggtctgcagaaggttaaaaagacaccaagtggggcaacctcctctgccgaaggggaaatagtcctctgtgttggtggtgaggcataattatgatggaaaaaacattttccaaggtctggaactgacgtgtactccttgtgacattttaatctgtgagtaatagattccattgcctacagggctgcaatttttccatttattgctttttcctcttctctcccaaacctggattctgccttttctcagctccagcctgcctctagcaaccatgaactgtttctggataatccccttcccgcgccagcttctctactcaactcaggcaaggaagccgaaagccccagagccacactgcctttctcggggaaagtggagaggacctactgtttgctccattagttacattgctttccatgctcatgacaactctctaatgcagacactgcaatgatccagggtgcagcagaggggttccatgaatgggctttggaatcagcgagtacaggactggctttgcctctcatacactcactgtgaaacctgaacatctgaggctcagttttcttatctctagaatgagcgggacaatactaatgaccttacaggactattaggaagattgagttaaatcacacatgtaaagtatatgcttgtattagtctgttttcactctgctataaagaactgccttaaactcggtaatttatgaaggaaagaggtttaattgactcacaggtcagcatagctggggaggcctcaggaaacttacaatcatggcagaaggggaaggggaagcaaggcaccttcttcacaggcggcaagaaggagaagtgccaagtgaaggggggagagttccttataaaaccatcagatctcgtgagaactcactcattctcacaagaacagcatggggagaatcgcccttatgattcaattacctccacctggtctctcctttggcacattgggattatgggtattatagggattacaattcaaaatgagatttaggtggggacacaaagcctaaccatgtaaatggttaattaaacctatttccttcaatgatacagcccctagagcacaatggatgctcagtagatgctaattaccataattatcattatttggagttgaaaaaatgagccttggggtaatataattattataactataattaataattatactcttctcattacattttggaggtgcagaaaccctggtatacttatctctaagtttagtccttttcccactgtacacagcggcttgtcccactgtgctgaaaactaccattcccctatcttctatagtaatagaaattctagatgattgtatgaccaccagctaagattacatttcccaggcatccttgaggcaagatgtggccatgtgactagtttggctggtcgaatgcgcgtggaagtggtatttgaagcttcctggttaggtatttacaaggaaagggcctgctttcccttgtccctttccctcttgggttgactgagtggattttgacatagaaggatataaacttctatcttgtgtaagccattgtattttgagtctctttgttacagcagtcaaaccctcaaagagagggagtagcagtgttggtagtaacaggactcaggctaggagtcaggagacttggctctatccctcatttgcttcatggctaaaatattcatttgctcccttatctgacaacattttgccagcacctgtacaagacattagcaagagataaataaaacatagctccagaaattatctaatccatctgcagtcttggtgatgttatccatgttaatctttcaggacgatatgctcacttatagaggatatggagttcagttgcagatgcagaccagggctcttaaataattgctctgcaggttccaaacattttatgggttcagaatgggttacaaggctgttaatatactgagcaaaatgcttaaaacaatcatagatgttgagacacttactaattgcaaatcctttgcaagatatcgaacctcagttccagttgtcatatggaaataatggtatgaagggaattaaattagagaacacatataaagtacttaacactctatctgacatttaggaagcagtcaataagtgctgttgacaatgacaacaatgaaaacaatgacaatgatgatgatgatgaaggcataggcttgattttccactgccctggaaaatcggccaaccaaggccctcagaaaagcagtcatcaccaatactctgccacccatgtgtactctgagggccaaacgaggctgtctttgttaaaacactttttaagaagggagatgtgatagtggggggacatctttgacaacatccaaacctgcagcattccaccctacctaccttggtccctcaaattacttttcttgtctttgccaagctcccatctgatgactgctgctgcattgcaatgctttactattaactctgaggggttattctattgactagtgatcgtcatctagtctccatgtccactgggatctgtccacatacatgcaaaattcatcagataaaagtcaggaaaaggaaaaagttttagtctaatgattatattaaataacctctttacctttgaatactcataatgagttacctttttgaattctggaatgctgactctcaatacaaggtgctatacatggaatttcatatatattgtattgtatgttccttaattccacagactaatgattattatcctgactgcaggtaaggaaactgattcaggatgtaacttcctaggtacatagaggcaaatcaagaaactaataaagtttaagctcagcccccttgtttacacaatcctcttccaagaccctgtactgatctcgaatccatgtttgtgctctttttcttagagagccccccgaattttatcagctacaagccctacaaaatctggatctgtccctataagtcatatagatgctaaatattggagccagaatttgaacagcaattatttagtattttaattaagtgtaacttgaattctttgtaatttattaaaatagtggtataggcacataaagttgtgccaatgaaccaatgctggtccatgagtttgggattggaatctcccagtgatatgcccaaatgatatgctgcataaattttatggagtcaatatattggtatcagcacttcctattgcccaaggttctacacttgataatgaccataataccttggttttacagaacatatattctctaacatgctcagagactgcatccattattctgacgaggcagaattatctccttcacattgtaattgctaatcaagctgagaaaacaaacatcttaatgggggaaccagagtagaagatgaagggactgatcaggagcatataggagacaccctctgggaattccaagatatgactcagggacctgtcgagtgagggcactgggcagtttgtctttaaaagtgaagaaatacacctgactccagtctgtccccagacttgaaagttctaactgatctcattttctctttcacatcttcaagtcttggattcctgtattcatctcctccaaacaccgcacccccagcccccatccttcagacctagaattgggcatggcaggggagcatagaaaagagaagacagtcaccatcatccaacagtataagaatgtgaagatgggaaaaggatgtatgtggccaccttttttgttgctgtttttttcttgttttttatttttattttttattttttattttttttttgagatggagtctcactctgttacccaggctggagagtgcaatggcatgatcctggctcactgcaacctctgcctcctgggtttaagtgattctcctgcctcagcctcccaaatagctgggactacaggcatgtgccaccacacctggctattttttgcatttttagtagagacggggtttcaccatgctggccagtctggtctcaaactcctgactcagttgatctgctcgccttggcctcccaaagtgctgagattaaaggcatgaggcactgtgcctggccacatgtggccaccttttgcctcccattatgaacctgggttatgttgatggttgagctgaatgctcctgttgtgacaccaaccctatccttcaggatggttagccagagagaactctcagattctctttctctctcatctgccgccacagggtcttccctgcctaacaatctctgtgtatggtttaaatcacctccagagcttcacctggtagagaaaaacaaactcacctgaagtttccaattcttctaatttaattccaggaaaagtgccatctgcacatctttggtatcaagatctctgcttatctcatcaccaaaatgtcagcaaacaacagtaaaaactatgactcacattcaaaccaatctggtattaaagatagggaggcgtgactttctttatcccttgagaggagagataaaactaattctttctcatttttccaggaaagcagggtgcacgttgggtaaagagatgggtggaggataagccagaacttctgagtcctgtgccaactgctccaagcttggcaaaggcatgccaagaaaacaaagacatgctggaggtcaaggtccctgcgggggcctcagtggagacaatggaaatatgtggtgattcccttcgtccagcaccctcccttggagtcagagacggatgctatgtaatgtgccactttccagaacagctactggagggttgtttctgactatttgacaaggctttgaaatcctgaaccacctccattatagctagaacagctatctctctctttttttttatccccctacttctttaatattaaggctgggcactgtggctcatgcctataaacatagcactttgagaggctgaggcaggagaattgcttgaggccaggagttcaagaccaacttgggcaacatagcgagacccccatctctacaaaaaataaatataaaataattagccaggcatggtggtgagcctgtagtcccagttacttgggaggctgaggctggaggatcacttgagcacaggagtttgaggctgcagtgagctatgatcgccactgcactccagcctgggtgacacagtgagaccctgtctgtcaagaaaacaagcaaaaacaaaaacaaacaaaaactcccccaccaccacccccaagcaacaacaaatttaaataattaatacacacatgggggaaaattaaaaagttaagatgagtttgtaataaaaagaaatagtttcctgccttgcttcaccctagccaggtccctttttttgttttttgttgttttttttttcaagacagagtttcgctcttgttgcccaggctggagtgcaatggcgcaatctcggctcaccacaacctctacctcctaggttcaagcgattctcctgctcagcctcccaagtagctggcattacaggcatgcgccaccacacctggctaattttgtatttttagtagagatgggggtttctccatgttggtcaagctggtcttgaactcccgacctcaggtgatctgcctgcctcggcctcccaaagtgctgggattaccggtgttaagtcatcatgccgagccaacaggtctctttctttagataccatttctttttttatattttaaagttttaacttgtctagtggttgccttcatattgataaatacatttgctatactgacgtttcattatttatcaactttataatttaaacactgacttcctgtgaggataaattattgtttcactcaattcctcctctaatccccttacccttcacaaagttgcatcactgttttcagttcacagcttttgtatttcaaaatgttatctttgaaggatgatttatcttattatatcttatcacctaaaaccaattcttgccaatttattccaaaaaatgaggtgttttttttttttgaaggacagatacccataaaaatcaaagaaggtggctttgaagtcaggtttcagaaaagccagcagtaagagttgtcctgaaaatttcaggagcaagaattaatgcattgtctctttagggcattgcacagtgtaaagtaatggggatttaactttttatttctgagaaagatagagtctgattggcttacattgggccacatgctcacccatcaactaaggaaggtagggcaggttgacaatctcatgaagacttcatgtgttggggatggtaagtgacccaaataaaaactggagtgctgttactcaaagatgaaaataaggttgctgggtactcagctcctccctttgtgagacattatacattacatgatcaccacttccttccctttgcttttcctttcctatgtctctcacttaaatctatggtcttacactaagaagattcattatatttatatctttttttgtgcatactttgtgtttttgctgatttcaaaaattaaaaaatcattacacagggctgggtgtggtggctcatgcctgtaatcccagcactttgggaagctgaggcaggtggatcacttgaggtcaggagtttgagaccaacctggccaacatggctaaacactatctctactaaaaatatgaaaattagccaggcatggtggcaggtgcctgtaatcccagctactctggaagctgaggcaggagaatcgcttgaacctgggaggcggaggttgcagtgagccgagattgtgccattgcactccagtctgggcaacagagtgagactctgtatcaagaaaaaaaaaaagaaggagaagagataaaaattattgcacagtttttacagtactatctttttggagagaagaaaattgtgctatgattacattcattttcttatatctttttatttttcctggaatttctaattgccttcattttgtattctctgcctttatcctatgcttatgctcctaagaagtctcaagcacactgcctgttaaggaagctcttttctcccccagagccctcctcttggaaagctccatttatcactcccctcatttagactgactgtcttctgggactgatcataagttgtcattttccttcccttcctttctcccccaagttgggcacatcattccctaaatctcatgatttcatctttcttgactcatgtgtcttctcaagtaactccccagtgaagaatgaataagaagtaagcttttcaagtatcgcatgtctaaatatgtctattctgcctgcattgtttaatgatattttgtctgggatagacttcaaagcaaagataatttttcttcagttttataggtttgctccattttctttaagcactcagtgctgctgttcagaattcagatgtcagtctttttctttcttgttcctctatagagaaatttttttgttgttgttgttctgaagctttttagtatggtttcaccttggaaaatttatttgcattacttctttttctcccttttctgttttccctttttggaactcctattagtcagatgttggatcttctgcatcgatcctttatgacacttatttttttctctcagatttttgtctctcatctcaacattttggaagtttccttcaactttatctgtctacccctcccttgaaactgacatagcaggagcaccatcatctcagacaaacaccaccactttaagtgccagctccctttctggactcatgtatttcaaggaaatcacttctgttctaattacaagcagccagaaagagcagacagtaaaacacagataagacagctcgggcacagagggaggtcgggggaaagtctcttgggtaactgccaaacttcaccctcatacagtaaaacagtgggccttaataagcacattcatttcccttcaggtgcactaagttagggaagctaaaagcagactggggggatatgcctgcagctacagaaagatgtatggggatagatacataactcaccctcccggataagtacaacaaagagacacagaagcagcccaagcctctgataaactctcccaccctgaatccttacaatctcttagtctttaagagagtgggctctgacctaaaacgcccagaagcccctctcaggtttatttaaaataaacttgtccccgttgactgaaaagccaccctttgtgtttctcccctctttctttaattcttacagaaacttttattttggcaatcatatttctaattcctaaaagctcttatttggtatatagttgctcatttttcccagcataccattctaattttacggatgcaattgtttctgaagtttctttgaagacataattcaatttttaacatattcttgttttttaatatatctgtctcctcttggatcatattttttattttgttctttttcatcagtgttggaagcttttctgaaatgtatgatgatcttgatgttttaaaaaagaaagaggcaatgtaaggctgaaaggagtcttgagaatgtggctggagcttgccacataattggctccacattgcagagagggtgggaagaagaccatggcactggggtcccacagtgtcaaaacatagaggtgtttggtgtccattacccatattggttactcagttgttacatgacaactcatcaatttctttaaagaatagataaataaatgttactggatgaattgtatccctctaaaatttgcagtaagtcttaaaccccagtatctcagaatgtgactgtatttggagatagtctcaagaggtaattaagttaaaataaggtcattagggtaagccctagtgccatttgactggcatccttataacaagaggaaattgggacacatacaggaagaccatgtgaagatacagggaaaagacagtcatctaaaaaccaaggaagaaactgactctgccaatgtcttgatcttggacttatgatctccagaattgtgagaaaataaatgtctattgtttaaatcacccagactgtagtaatttatgatggcagccctagcaaactaatataacaatgcttcttttggaggcatagacggtaaacactggatatgtgatataaacagactggtcctgttttaggactcaactctcactccatccctgtgcccgctctgagcatagtctaggttttctgttctctactctggtggattggtcaatattatttcatctgattttcagaaatttgtttaaatttcaaatctgctgatagctcttctcttggtttctattttgttatgaaattgtagcttttattacaacatcagtgtcctctctggaggaaaaggacagaaatgtgtgtgcttggattgccgtatcaaacctccagtctaggtcattttacttccaccaccttttattaaaagcctactatagaccgggcatggtggctcacacctgtaatcccagcactttgagaggtcgaggcaggcagattgcctgagcacaggagttcaagaccagcccaggcaacatggtgaaactccatctctactaaaatacaaaaaattagctgggcatggtggtgcgtggctgtagtcccggctactcaggaggctgaggcacaagaattacttgaacccaagaggcagaggttgcagtgagctgagattgcaccactgcactccagcctgagtgacagagcgagactctgtctcaaaaaaaaaaaaaaagaaagaaagcctattatatactaggacctgtttagctactagtgatacaagatgaacaccacaaaatacctgcttttaaggaagtcaacaagtgaaggaaatagtgatgttatggcatgtggcagatgtaattgattggctcactcaacataccttttggctttccatcctctgctatagagactagcaaactaaaatatacgttttgtggaacctcttgcagatagggttcaggtatgtggcctgtgttcttctaatgagatgtactagcataagtggaaacagaagtgccacatgaggtggcagccacacacagggtgaatgaattttctgataagaagagtggtagaagtgtcaagttcttctgatatggctgtcgccatgcttatatcttcaggccttcaatgggtaattaatgatgaggatcaacagcagccgccgccatgtctcactgaagcagctagtgtggttgtgctctttcctagctagataacattgaaacctggttccctatccctcccaaacactctttgagccacccaatatcctttaacacatttatttctgcttgaactagccagagtaacttggttgtttgcatataagaaccttgacatggaggcacatactggatatatgggaatggaagcaaagaggctttcccctacctggaatgaaagaaagtatttcacagaatgaatggcaactgagcagagacttactggataaggagaagtttaccgagtgagcaaatgtaggcgatttcaggcaatggtacatcagtgagaaagctcatattcattcatttatgtattcagtactcatcagcacatattatgttctaggtaccgtgctagaccctaggcatacaacagtgagtaagacaattataattcctacccacagaatgtttacatttttccaaattgtgcatgcagattaggctaacctgtaaccttttagatatggagatccctgttcatccgaagtaactgccttttgagaggtgaagaaatacactttcttggctgccttcctacaagtaagtaagggtgagacaatcctaagactactgaaatatttggttatatccaggtaaaaatgattgtccttttctgaataaatagtcctgtctatctgatatagtttggctgtgtccccacccaaatctcatcttgaattgtagctcccattatccccacatatcatgggagggaccctgtgagaggtaattgaatcatgggggacgggttttcctgtgctgttcttacgatagtgaataagtcccatgagatctggttgttttataaagggcagttcctccgcacatgctctcttgcctgcagccatgtaagatgtgcctttcctcctccttcatcttctgccatgattgtgaggcttccccagccatgtggaactgtgagtccattaaacctctttttctttataaattacccagtctcgggtatgtctttattagcagcatgagaccagactaataatacactatcctgcctaatcagtgcccaaagtagtgtgtgttggtgcttcagaaagtcagggctagaggaggataggcattgacaagaggcataaaaacatgccagtgccatggcccacttttccatatcaggtctgatggagagaaaaatccaattgtcgaacctcaaaaccacttcagacatccactatcattatagtctcttggctttgtgtcttagactccaaatggccaagcccagtcatggaatgacaagtcccaaggaacagcatatgatggggttgatgttcctaggcctgaggaaatttgctgtcaacggccttctgtgtgctgataatccttttacctggaaggcttgaagctttggctgggtttttgatttataaatgacttgaaagataatgtcccttcctgattcacagtgagttattgtctataataccatcctcacttttccttggctgtctccctcttgagaattggctcagtcatatgctcattaattaaatccatgggaactgatgggaagccaatggcaatggcaatccaagaaggcaaatttcagattccaatagccagttgcagagtctaattttcaaagatttcattattagaacgttttgtgaaagcaatctataataacaatagttaacatttacagaatgcttcttatgtgccagtagctatgataagtattgacatgcactttcatctttaatcctcacaacctcactctgacattggtattcttattgttgctggattaagatgatgacattggggtggttaagtaaactgttcaaattgagtcagccaagaagtggcagaaccaagattagaacctggggcagtcaaaatctaaggcctgagctctaaaatacttcattctattgtctcccttttagagctggtgttttggttctgataatttatcctccattgccctcctacgcctccttggccctggcatagagtttaaacaaaattaaggtttacttaagccaaagatttgatcataattatgagccgaacttaatcaagttagtttcatgtataggcacagcctaaaatacagcattggaagtttcttctctgatgggtctaactggcatatgaattgcagcattcatggctccaaaacagttgggattttaactcaatagaaaaaacaggggtacattatttaaaatgtcctttctaaggtgccgtcacattgcaagttgttttatgacattcagtgataacccactggtgttactactacgtgtgtgtgtgtatgtgtgtatttatatatttatatttatttctaagatctctacatagaatattacagaaattcagctggaatttgatctttacaaatctggagataaccaaatcatttttcggatttaagtgaagacactctccctgctaaaacagcacttttcttagattcatttctagaattgcattggtaatgcatgaaagtagtataaatgtgttgctaacccatctgcagatggtggttctctttttagtaaacatgcaggggctgtaatagcactgtttagaacaaatggggcaggttctctgattaagactgatcgcaacgaatttaaccatttctctacattatgaggagatgggaattgaaagcaatcacttccttttgatatatttccttaatattatttagatttcacccttgagatacaaatgctataagttatttcagccttctgagcacaggcaagttagatggccagcatccagattggataagagaggaaaagtggcttaaatgcaatctcttccattgcaaactcccaaactgtgaaggacaaagtccagtttagaaaatacaaatggcagtttctctccaaagactcttggaggttttctaaatagatcccagaattccaggaatttataagaagaggacctcaagtatcgtccagagcacacaggagagcccgtgctggctctagtgtgaaaaccaatcacacctcagtacaatctccttcaccctcataatgaaaaggaatatgccctgactgccatttctcatttactttattttatcgtgttgttttttccttaaaaaaaagagagagagagaaagagagacagggtttccctatgttgctcaggctggtcttgaacccctgggctcaagcaatctgccagcctcagcctcccaaagtgctgggattacaggtgagagccaccacacccagcctgtgttgtattttcctaacaaaataagtttgttgtagaaaagtagaaaatagtccactgtgaaaagttagacaaaaagatacataaaacaaagaaaaaagaggaggcaaggagaaaagaagagagagagagaaaaagaaaaaaagagagagagaaagaaggaaggaggaatgaatgaaaggaaggaaggaaaaagaaggaagaaaggaaggaaggaaggaaggaaggaaaaggaaggaaggaaaaagaaggaaggaagggagggagggagggagggaggaaaagacccagtgattctaccacccagaggtaacctctatggattttgggtacatatcttttcagtgtttttcagtagatccatgtagtattttttctgagaggaatcctactctgaatagggtataagaatatgatgctgggtgctatggtgcatacctgtaatcccagcactttgggaggttgaggcaaacacttgaggccaggagttcaaggccagcctgggcaatatagcaagacctcatctctacaattttttttttttttaattaaccaggtgtggttgtgcaactatagtcccagctacttgggaggctgaggctggaagatcgcttgagccctaaaatttgaggctgcagtgagctatgatcacgccactgctttccagcctagacaacagagaaagaccctgtttcaaaaaaagagatataagtctaatcacttaggtaatttaatttatcttataagcctgtatttacttgcaggataaaaaagtaatttagttcagagtttcaccaccaccctttcccaaggccccaaaaggtcacatctttgtaaaccaaaaataaaattctaagccccaccacaaccatctgaatggacttcttcttcagtcagggcactcttgaaatttaacccgaaagactggttccagccatgatgggaagtcggggtcggacgtgtttcattatacctctccagcattaacatcaacgcagactctaagttggctgagaaacattgtacaacctattctctctgaagcctactacctgaaggcttcctctgcacataagaacttttgtctccacaatcctttatcttaacccagacacttcctttctattgatcccaggtctttagataaatacaaccaattgtcaaccagaaaatttttaaatatacctgtagcctggaagccccactgcttccagttgttgagccttgctgaacagaaccaatgtatttctttttttttttttttttgagatggagtctcactccgtcacccaggtgggagtgcagtggcataatctcggctcactgcaacctccacctcctgcgattctcatgccacagcctcctaagtagctgaaattacaggtgcctgccaccatgcccagctaatttttctgtatttttatcagagatggggtttcaccatgttggccaggctggtttcgaattccaggcctcaagtgatctgcccgcctcagcctcctaaagtgctgggattacaggcatgagccactgctcctggcccaatgtatttcttaaatgtatttgattgaagtctcatgtttccataaaatatataaaaccaagctacagcctgacccccttgggcacatgttcacaggccctgttcactcatatttggctcagaatagatctcttcagatattttacagagtttgactcttttggtcaacgtcttcattcctgggtccagatgcaatgtcaaggcatccaggacctgatgctgggtcctcacctcccatgtggtcatctccttgtctctccgatcctccacctggctggtgctcagaacacacagcactgttgagacctgccttgttctaactgctggtccctccagggccccctctctttcagctgtgtctgtatctctcttgagtcctcctcagctgcaagaaactcagtgagcttgtccgaggccctgctgattgcatagcactctcagatacataggtccatctgccacaaccaggccacactagggcccaggacatgctccctgattactgaaagcccttccggcacacaggcagctcatctctgggtcatttcttcttcccggtcttaccaagaaaatgcagccttcccttctacaaatgtccatgtatttgagaaaagaaaaacgctcagagcaatttgagctctgtgaggtatgccggcctggatagacataagtatgagacatcaatcatcctcccccggcgtcccccacttcaatcatcctcccccagcatcccccttcacttggcagacaattgtttaaaattcatgttcttggaagttgtggcacaaagaacagcatatcataaataacctaaccaatagctatgttattttcatgtaaattcttggtaaacaaatcaggaactgcctcttcctttcctttaaaaacccacttgtaactgtggctatttattcagagtatttattcagggcatcttgaatctatgctcctgggttgcaatcctcaagcttgacctaaataaactctctatttatattaattttgtctcagcttcttccttttaggtcagcatattcataagctctccaattattttacccctccacccagtatctgaaggcatgagaatctgcttgagcccgggaggcatctgaagaacatttataagaatcttttctctttctcataggatcttccaaatctattgttcatgctctgaatttttgttgtaattgttgttgttcttcccaagggctcaacttttaaaagccagggcttggcacagtggctcattcctgtaatcccaacactttaggaggctgaggctgaggctgaggtgggaggattacttgaagtcaggagtttgaggttacagtgagctatgatcatgccgctgcactccagcctgggtgacagagtgaggccctctcaaaaaacaaaacaaaaatgtcttcttgctgttcaatttaattgctcagactgaaacggtctttgcaaaaattataaccatgagaaaagtatgacaataaaaggcatctgatttaagcaacccttatcttgcctttagcctcccaattgcccttaatcattcctggtcttgggccaaactaactttgagagacatttagtttacagtgtaaatgataatagcccttccccagtactaaaccacctttgtaaagttagtgaaagaccacaaagttaggaggatgagaggaacctgaattctgctaaggtgtaaatgattaccagccgttaattccagaggtcacaagttttgcaacttccccaattactcctgcagataacatcactcttgtagaatctaagtttggccttttgagatgtcttctcaggtttttgcatttctgatgactgatggctccacctggacctgccaactgctcctgtggcccccacccagggtccagacttagcacccacaaggaccattctccacacccctatgattgcatccccagccaatcagcagcacccattccctggcctgccaaactattcttgaaaaaccctagcctctgaatttttggggacactgatttgagtaataaaactccagtctcctgttcagttgtctctgcatgaattaaactctctattgcaattcccctgtcttgataaattagctctatttgggcagtgggtgaaatgaacctgtttgggtgattgcaaggcaaaaactcaaaatggcctcattcgaagagtggaagggccataggaggaaatgaaaaagcaggaaagcaaaagaacaccagctacaattttagaatggagtccctcgagttgtgcttacaggactgtagctcctgtattactcctagggagttaactggcaccaaggtggcaacaggcacatatctggaggaggtgaaaagtagaatgacatttgctctaatcaaacataaaggaggaaagagctttctaagagaggctatggtgtcccttaggtgttgcttgtacctaagtcctgctgttgaagcctttgcttatgtagatgcaaacacacaggcacttccctggatctagactttgccctctaaagcccagaacaaaggtgtccatccatgaagaaccaagttttcttatctctcaccctcactgtggggatggagtggaggcgaaggaaaggggggagaaaaggaaagcccttgagcgcaataatctagagagaaatgtactttctaccagcaatgtaagtatgatttatgtgactcctcccagctaggctccttttatttcctcgagttggaaatgcagaccagaggtttgtacttattttctgtcccagaaggcaactgtcttggtagaggaaggtttgatattggtccaggatctgaggtagagatcacagccttgagacaatgccaaggcagccaattaagaaggtgttgacaacactttccaggaacaattttctagatgcttaactttgaccgaaggtttaagcttctaataatccccaggaaacacacattttccagggaatagtgcctggactcttaagaacttccaagaaacttgggttctcagaagactgcagccaccaagcacacacacccattcaagagctttatggaaaaaacaaaggtgatataaactagatttcctcacatgcccggggagagttggacaagtaaagtcacaaaagaagtgatttaggccactacattgtccttgggaaactagaacttaccctaccctcccttcctttaaccactggccataacaaggctggaaagccacagtctgtcagcccaaattgttcaggttagtgctggtcaggccttgcttctttcatctgggatttttctcggcatccttgctcagctgaatatcactcaaaattatcacatactgctactaaaagctgaagcatatatgcccatcaacccagcgacctcactggaagtcctgcaaggtaggcatccatctccatcttacagatgagaaaactaagactcagagaaactaagggatttgcccaaagttcagtgcaagtacaaattagagcctggttgttctgattcacacttgagaatttccaagactaggtaagagcaacagaagaccttggccagggtgctggggagggtcctgctgctcccagcattaatccttcagtgactacatcctggggaggcctggaactggctggagtgggaggaacagaaaggaggcatgtggaggtcttgggacagcagccttttatcaactctcccagaagtgtttctgtaattttacaatcagtgctgccaacgtggtgcccaatggctgaatatcagcccagtcataattacattaatcaagaaatagaatagtgggataaagatgggaggaatgaactccatttgggtgggaagtggaagcattaacaacagggtccaccagaccatcagaaccacagaggggaagggaagggcatttcagggagaaagaagagcacaaaaaggctggtggcaataaatgaaaacagggcctacaacctgttttctgtggtcaactaaggaggtgaagttaggggttcagagggtggggaggtcaaacatttatgacagatgagactggagggacgtagagacctggtacatgatgtcttgactgggaattctgataaaaccattttttgtttgtcttagacatgtagacattcttgggttatttcttcactctaaagcataaattattgaatctttgaataaaaattttaaccaagtattatgtataatgaacatcttcatcccacagagacctccattgtgtcctcagtgcctcacatgcccactgaggcacagggtcccactggccacttcctatcgggcttgtcttacaactgcatttcacctcccaacaatcttgctggaactggatttctttgcaaaacaccagactgcttagatgagtgcctgacttttgcctacatagtcccaggcctcttccctggggctggatacttgctactcccctttctcaaccaggggctgcagatttgctgtgaatgaaagtatcattcagaatcacaccatgaattcccaactgcctttaacaccactttcacctggattcccactggttccattgatctgctgatttggattcccttatattaccaaggcctgcaggtaggacacctgaggtcaacatgggtgctctaaaatgtgcttcctgctattcccctcagaggtcgggtgccataaccacgtgaatttcttcaactctccgttcctgtcttgcagaatcccaaatatccgaagtgccctgctctttcctgctcacccttgttaatggagagccatcatgcattgtgcaagagtcccatgatgtgataacaacaaagaaaagcaacttaagttgtgcttatctctacaagatgtccaactctcagtgcaaatatttagacaggtttggtcttcgtgaatttgatcgctcttgaaagagaggatgtacaacgctctagacagccaaatggagacacaagctcagtgcaggcaggggtctgctgagggggtctgttaaacccctgtatcatccgttctcacactgctataaagatattacctgagaccaggtaatttataaaccacagcggtttaattgactcatagttctgcatggctggggaggcatcaggaaacttgcgatcatggcagaaggaaaaggagaagcaggtaccttcttcataaggtggcaggagagagacagaaagagagagagagaacaagaaaatgcaacactttaaaaccatcagctcttcagagaacccactcactatcatgaggacagcatcggggaaactgccccatgatccaaccacctcccctgacacgtggggactacaactggatatcagatttgggtggagacacagaaccaaaccacatcagtccctatctgttttaacagattttgtttttcctgctcattttaaaccctggtgacctaggtttatcaactcaagagtagaaataaggcatagtagaaaaaggtcttgagggttgtgaggactgaattctagtcttgaccatatggaccttaagcaagctgggttactcagcctcaaataccttctccttctataactttagtttccttagccttaagaggggactgggggcttgaccccttactaagatggtgattctcattcttctagtgcttgcagcacactttcaaataaaagaatgtggatagcactattgaaaactttaaaagactgaaaacaatacaaaaatgtcagcagtcactaagtacaatgctgactgtaatacaacagtgtctcccagttaccataaaattatccacagttatggctcaatagctgaccagcttcactacttcatgggttctttgaatggaatggtttacagccctgaccatactctcttatataccccagagtcagaggtttcccacattctggaagctctgcaatccttcattagccttggcttgacaacacacccatatcccttagagcacatttgttccaagtcacgcaatccacacatctcattgttgtatcagacacatgagccgaaatattgaggactcagatgaacccagactggttttatatattaacaaaaattgggctaaatattgaagatgactgctccaagggcatgccagctaaaaagttttatagttctatgaattaaaacaataaaacattttgagaaaagaaaatctagttgaggtagagtatttaattaaggcattgagtctatgtcagttaaagaaggaaatccttgttgataagacagagagctctgagggcttaaaggggccccagtgaacctacagagtttgaagggcattgtcagaaaaatgaatggaataaatcacacagaatatgggtagtaatgagacagaagttcagcttctctctgtttctaacaggtatatattttttagaaagtagcatttaaagttttttttttttttgtagtaggaagcaattatttttatgttcttagagattattattttgggggtactaaactattggctccattgtattcctataaattatttttcatttcctctaatgctctttccaaacatctgttagtttattgttctgggcacagaaaattatgatcagtttagtagttgcataatacagattcagattcgtttgtcaaggactggaaaagatcacagcacttcagagccaggcagcaaatggatcaaaggaaatccttatttcgtatactatagggtgagatttatctttaaatatcaaaaaatggacatttggagtttatattattatcataaaaatactgttctgcttctgagaaaacaagctacccagctaacaacctgcacttgtgccaagaaatgaggtgggtgtgagtaacgaggatggtgatttttcttttcctctctagtgagcctcattcaatgggtcaatgagtttactttagtgtcttctctatgccagacatgtgctcgatgctggggacgcagagatgagtgaaaacagacaaggtccctgcccgcatctagaccagctgggaagacaggcaactgtgtaagcaattgccttaaattgtagtgagtgttacaaccaagagcgtagacacacagtggaaggcccataaagggagatttaacctggcccagacatccagaacacctcagtgaacgaacacctgggggacaagcagaagttaacgagtgaagtctgggccatggaagagtgggtcacaaagaaatgagataagggagggcatggttcccaacaggaagtgagtggcagttcagtctgggtgaaagacagaatataagatgatattgtgaagatgctagtactgagagggatgcagtaggcaggtcacacagggccctggaagccacattagtttatctaggaacaatgggaaatcgttgggaaactttagagaggacgctagcatgagtggatttgtgtttttgaagaatccctggagaggactggtaaaagtgtatgtgtctgtgtgtgcataatacacagacttttaccagtcctgtccgagatgtacatgctcacatacacactaggcaatcagagaatctatctacaaagccattttccctttccattatccatccacaaacttgatggctttcagttgaggaattgaaatagggttctccacttgaataagatgagtgagtaggggttccttgccaatagtaggggcttgatttccatttcacagatgttgagagacagttgtttcttcagtagcagtatattttttacgacactgtgcccatggcaggtgtttggccaaaactacctccagtgcactgcccggcatctgtcctcctcctgagaatccctctggaggcaccttgctcctttctttctaatcttccttttcttcctctccagatctggagactttcatcagccctaggcgaggggcaatatggacaacattggtgtttgggctccaagctactttttatgcccaacttctcttccttctgatttctttccattttatagcattctcatctctccagttacaccaactggccccacatctctaaatattatcagaagtctttaaaaaatgacccagagcatttttttcagcttctcctagttgtctatctcctctcttcttctgacccctgttagggttgcgtgaaaactagcattacaatatttctgttccatctatacctgattaccataaagtgcaatgactatgcacatcactgtgttggattaatctgggctaagttttattggtcactatgtcatattcatgtggttactgatgtaacctggctgtttttatacactgtgatcaaaatctagggcagtgatcataatcaaggcataaagtagggaccagtctgcctcgtatctcaaaaactgtgcagtattaagatgactgttgggcttctattaaaggtagctgttggccgggtgtggtgcctcatggctgtaatctcagcactttgggaggccaaggcagatggatcacctgaggttgggagattgagaccaccctgaccaacatggaaaaactctatctctactaaaaatacaaaattagccaggcatggtggcgcatggctgtaatcccagctactcaggaggctgaggcaggagaattgcttgaacccgggaggtggagattgcggtgagccaagattgcactgttggtggcttcctggaagacatcatgttgaatgaatgaagtcatgagtaaataaacggaatgtggagctgcactgccagaattaaccccctgaacaaaagtaaagagcatcccaagttcaatgaggagtaccctgggtaaacaaggaactcctgagagatgaaaaaatccaagtgcctgcgctctacactgggactttggttaacagggcaaggaagagagcttttggagataatacttgatgatgctatacagtgtccccttagtctctgagattcttatcccaagtaacccaaagaagggagataaaaaggaaagagcagtctcccatttggaagtcaaaaaggcattataatctcttaggagtacaccctctcctaaattccagggccttggcagggaaaacactgatattcatggcagccaaagaaaatgaccatatcaactgaaccaagaggacacagcagcagcagagatcaagagggacagtggcagttggactgtagcagtagttacagaggaagggagtaagccacacaagcaattctggaataaagggaaatggcttgagggccttgcaattgcaatgatctcctggggttgaagcttaagttcattcacattgtgactgtcaccaaggctttaggtcattcatttagttttagtacctcatttacataccatctgtgtgtcaggcacagtggctgtgttggcctaggccaggggtcagtgaaccttttttgtatagctccagagagtaaatattttaagtttcatgggccatatggttcctatcacaactacctaactttgctgttgtagtgcagacacaaccacagacaatgaataaacaagaatttgcttattggatgtgttccaataaaatttttcttatagaaacaggtggtgggccacatttggcccatgagtctgctgaggctcagaaaatgatccccagtgtgaaggcctcagaaacagcctcagaagtaaagtctcttttggaccttctcctgccctcctgtctctcgcctctcattctccctgaggctagccatagaaataagaattcctcttccccaaggcaggtcacagaaaccagaaccccttctccaaagccagccgcaaaacctaacaatattactctaactttctccctccctttttgtgtgggagttggccatgaagaaactctctgacctgggccggtgcggtggctcactcctgtaatcccagcactttgggaggccaaggcaggtggatcacgaggtcaggagatcgagaccatcctggccaacatagtgaaaccccatctctactaaaaaaatacaaaaattagccaggcatggtggtgcatgcctataatcccagctactcgggaggcggaggcaggagaatcccttgaaccagggagttggaggttgcagtgagccaagatcgcaccacagcactctagcctggcgacagagcaagactctgtctcaaaagaaaagaacttctctgacctgccttgtctgattgtaggtcataagcctcccattccagaaagcgtcctgtcccatatccagaaagcgtcctgtcccatatccagaaagaagcaatgctgcacagagaggccaggaagaacctgaaaagacaggccttgctgggtctccccactcagtctattcccattagctcttaccctttttatccagttgcaggcctacacagctgtccattcttcatcaaaccccagcataaaaatggacagttttccccatgtatttttgtcttcactctgaaggatcccatgtcacataaaactatgtttaaagaaatttgttatgagtttctcttgttaacctatcttttgttaaaggagtgttggctgtggcccttatgatggggaggagagggatcactccctttccacctttacaggcaagagtttgccaacccctgatttacaggaacaaagtgtgctagttattttgttgcctttcagatcaaatccacagactccttctaccctgccctttattccaagaggctgccctctgcagactatgatacccaggctccttgccttctggctcctggttaggcttgggtaatcagaagcatgagaaatgaatcagaagttgggaggagagaggggtggagaaatgttgtcactctacaccctcccttctgggctgggctgtggcagtggctgtgctcgtctatatctggtcacagctctgcctggtggcccatacccatggctacacctctcactccgttcccacaacagctccttcatcattcaccttcagccctagggggttggaactagtgtccccctgttcccagccctacatgcttctctatcctttgtctgtttcccttcgtaaaactctcttcaattgctcctttgagtgtgccatctattccctgccggacagtgtttgaatacgccctcgtggtggacattcactgtttttagatgtaacggtattgttccaacctcagatccaggacgggatatgtaatctagacatggccaattagggcactgaatcactcaagccacagtagttggttctggaatgttcacatgaaccaagttgtttctttttcttttctttgtcttgctctgtcacccaggctggagggcagtggcatcatctcagctcactgctgcaacctatgcttcatgggctcaagcgattcttgtgcccgcctcagagtagctgggattacaggtgtgcactaccatgcctggctaatttctgtattcaggtttttccgttggaggaaatactaatacttacatagaagccaccaagaagtgccatctattccactgaatttgaacctagaagagtaaatttgaagcttccagaagctactatgtgaagcctgaggacaaggcccaacatgaaagaaggcaaagtccagaggtggccttgtatgagtccttggaactggctgaagctagctctgctcatcaatgatttgtcaatgagacagtaaaattccttatttttttcctcaagaaattctgtcacttgtattcaaaagcaaaacttatttcttaaaaaaacaaaacccttaactactttataccaatgtattacattctctggattatctaagcaaggggccagtccgatgtcatctttggattagatacacactaaggcagtgtagttaaaccccactgaatttcagcagggatagaagccagagttggtttgccatcaacccacttccaaaaggaaatggcaggagtccagcagcatcatgtagttacaatctcccatgccaggaagaaacatctcccaagctcaaattctacccactttgacacttgaaaagtaaaacatcttcatacgaatgaatggggagatgggtgtgattgctggcagtgcaacaatgagttgaagcttgattgtttattaactgttgtaaacaaattatgaatttgtgccagtagccaaaatagagacaactgggcataataaatattaattctcaaggagatcatctaacaaactacctaaaagatcctttgtggactccaagggtgttaattatatgagactttattctctattcattaattcattcaagattttgttgagtgaatgtcagcctgctacagtacagggctggcaaattgtttccatctctagtgctaattgtggttatagctgctcagtgggctgtattgaaaaagactgagtccaaatctgggcttcatgagaaagagtatcatgaagatactcttcatgatactctacattagaggtgtcttctgtgaaagtggaacaaaggagtgtctgaggtatttgtcattcctgcaagttggaaaaggccttatctggcatgagaaggagtagatttggggtaaatcgtttccatcttatgtgtctttatttccttaaattggtaaatcgaggaagttcatctaataatttttaaggttcttccttcctactcttatttatttatccattattttatctgtccttgcatttgaggtgatttctcaccttgtgaatgcattcctccctagcataaaaaccaaaatctcattttcctagcctcctatgtagtaagaatacagcaatgggatctaggtccatcagtcagatacatctgtcctacatttgtttagaatattatgtaggagatgagactatttcaccccaaaatatggctgtaggtggccagaatgtgtaccccaaatatgcctctttaaaataaggatcactttgagctgattatttggggagacagtagacacaggagaagctctgaaaacagagtagaagttaagcttttgtaagagaaatttgcatctataaaggaaatctccatcgtaagggtgtctcatctctgtagaagaaaaagaatgagtctaagttactaaaaactcttatcaatagagaaggcaacttaaacacaagtaaggttttttttttgtatagttacccttgtttaaggtgcttttcctccctctaactgggtaggaactttctttgtttcagagaatagtatttaagcttgaagtcaaagctatgatacttctgagatttattcaaaagctttgagatatttcctgtattatttcatttatgttgctataaaggaatacctgaggctgggtaattcataaagaaaagaggtttgtttggctcacagttctgcaggctgcacaagaagcatggcaccagcacttgcttctggtgagggtctcaggctgcttcaactcatggtggaaggggaagggaagctggcacgtgcagaaatcacatggtgagggaggaagcaatgggggtgggggaggtaccaggctctttttaacaaccagttctcgagggaactaatgagcaagaactcacttattatgacaaagatggcaccaagccattcatgagggatctaccccatgactcaaacacctcccattaatccctacctccaacattgggatcaaatttcaacatgaggtttggaggcaatacacattcaaactatagcattccccctgaaggatcccagggaatttcacaccacagtatggcattctgatatgctgattgtaaaaaattaaagtaaaatgctgggagatacttcacactgatattgacttatttaccttaagaccagccctgccaaatagaatacaatcaccttccattacccttccctgaatttgattatctatcataggtagaagactgaagaatctacatctggatgaacttcttcacaagataatatctaattttgaagacaatcatttacaagctaatttctgtcccttggttcattcattttccctaagaaacattttactactcctcaaaagaaattcctaccattttccatccctcctctcccccttatgaagaagggtgtgtaatcatctggacctcattaggtatttgggtaatcactctcctgtgattttcccttgtgcattttaaaattaaatttgtattcttttgctcctactaatctccttcttatcagttcactttcagtgaaccttcggagggcgaaggggaagctttccttctttgaccctacacctgaatatctcccatgtgtacatacatgaggtatacatgttattaaactttgtttttctctcattttgttacagcagtccattccaaccaagagctcagaaaggggagagaaaaaattaattttttcctccttacactagtgatggtgcacagagtccatctggcaaggataaaggcagagacattctgttcattaaagcagcagtgatagggccagctctggtggctgtcccaagcagggggcaatgatgacttcactgagcagctctgcagcacaggttggggcactgttcctgtctgctagcctctaatcttttgtctctgggcctcccttggagcccttcagctgtttaattctttttgaaataaactcattttactgctgaaatgagtcagagtggatttctttgtcttcaaggaactcaaaaacatgatcgggactacgatcataagatcgtatgtgccttcaaatagaatttattctcctttaaagatgaaaaaattaattatgttttataaattatgaagaggatgcttagctaatggttttcaaaatgtattttatcataattatcagcaggatagttgttgcaaatggataaatatgtgttatagagaggttattctcacttgtatcgtcttcattattctaagtgcactagagaaaatgtaattccttcaatgtttttgtttcatagctttacattgagagaagaaaccctcttcttaatcgttgctagtgtgattttcaagagtttgcaggagtattttggtaggattttatagttttagtaattcctttaattttctaatgaagattagagctaagtatctcataaggataaatggccacagcaaagaaactcacttgactaattgcccttatggagagtttctttaaaggatgaaagaagttcttgagacttacccccaaattctgtgtacaagaaagatcacatagttttattttctttaataaatcaaaactccccctctacctccagcccaccatgctaaggaaacataggtgtttagtgactcgttgtaggctaatggggcttaaaatggctttacctctttcctattatccatcaacaaccatgctcccacttttcaaatagtcaatagacatattgttgactttttatgcaaaagtggtatttatatgcaaattcaagctccttctttgtaaactgttgttctcaaggtcttccagtgttgaaattttggagcctaaacaattaggtttcttccttctcttgtcctcccagccattcctcccctaggaaccttagacatttctggtgtcttacagcagcacaaagacttactggatacaacttctaattccggccatgagagaaaaatagataccagacttgtcttctcactttaatgtatttttgtgtccaagtgtaatgtcggacacaacatatgaagaagtggtttccaggcattataaaacagacaatagaggaatataattcttgagaggagaaaaacacacaaagagcttcccattcatctccatgaaaattcaatttataagaaaaaaagtaaattaactaggggcacattgcaaataaaggcaaagggaggtggaacccaaagagaataaagtgtttttctgggcaaagtaaagagagatcagagttcagaaatgctgaggctgcttggaattttcaaagtaggatacttgagaggagaaagtcccaaattttgcatatgggtttccttgagtctagctgagtactaagctgcatgtgttcagggttctctgatagagaacaactactagtagagtatgagctgaataaggggttcaagatattccagttttgataaaccagagggtaaagacttcactaaaaatccacagcaattagttgaccattataatgaccaaatgttagaagtagggctattctagccctagagtaagaacaactttagacttacccaataaagcctaaaatcaaaccctgattgccttaaaccatttgggctactataacaattaaacaatttgtgctactataataaaacatctaagcctcgatgatttgtaaagaagagaagtttattattcacaattttggaggctgagaaatacaagatcaaggtactagcaggtcagtatgtggtgagggcccaatcttttcttccaagatggcatcttattggcttacccagagcagaggaaaactgcatccttacatggtagaagaaaggggaaaagagggcagaatggtgactgaagcctcttctataagggcctaatcccattcatgacggaggagtcctcatgacctaatggcatcttaaagaccacatctcttgatgctgtcacactggctattaagtttcaacccataaattttggaggggacacattcaaaccatagcactgacagaccaagtgaagttgaaagtaaattaactgctagtgagaataaaactcagcactaattaaaggaggactgtcaaccaaataacattctaaagattcagcacacaataacaaattactagataaacaaataagcaggcaaatgtgttacatatccaggagaaaaaaacagtcaatacaaacagatccagagttgacagagatgtgagaattaatgagtcaggacttcaaaacagatataataaatgtattcaaggatttgttaaaatattgacattgtatacagaagagaaacctaaacaaggaagtggaaattataaaaaagaacaactataaattcccagagtgaaaaatgcaatatgtgaaataaaaaattctctggatgggctcaatggcagatgtgccattgcagaagaaaagttcagtacacttgcaaaccggttaaaataaattatccaactttgaaaaaggatttaaaaaataaatacagccttagtgacctgtagggccgtatcaagaagtctaacatattagtaattttagttccaaaaggagagaagagaaaaaccgggaaagaaaaatacatttgaagaaataataactaaactttttccaaatgtgatgaaaaataacaacccgcaagcctcaaaaatctgaacaaattccaagtggaataagcacacagaaaactatttctagccatatcatcatccaatttttgagaacaacaatgaaacaaaacaaaaaattcttaaagggataagttatcacaggagaatgataaaaatatgcactaacttctcatcaaaatcaatgcaaaccagagaacaatggaatcacattttaaaggctaaaatggtagggacaccctatcaacctataattctgtattcagcaaaaatacctttccaaggtaaagtagaaataaacatacttccatagaaacacacgttgaaaggattcattacaataggctacactacagaaaatgttaaaagcagatcttcaggttgaaataaaatgataacagaaggttgggctgggcatggtggctcatgcttgtaatcccagcactttgggaggccaaggtgggcagatcacttgaggtcaggagttcgagaccagcttgatcaacatggcaaaatcccgtctctattaaaaatacaaaaattaggcaggcatgtggtgtgcacctgtagtctcaggtacttgaaggctgaggtgggagaatcacttgaacccaggaggcagaggttgcaatgagctgagatcgtgccactgccctccagcctgggtgacaggaggagaccctgtctcaaaaaaaaaaaaaaagaacagaaagttgaatctacatggaagaatgaagaacaccagaaatgctaaacatgcaggcacatatataaaacatattcattgtttttttatttgtttaaaagacaattgaatatgtaatatataaataataatgtattgaggaggtttgtaacatatacaggagtaaaatatctgacaataacagcaaaaaggataggaggacataaaggagtgtatattgcttaaccatactgtgtatgcgtgaggtggtataatattaaattcatagtagactagaataaattaatggtgtatgttgtagttcctcttaaaaagacaaaataaacaggcatagctaaaagttaataaagaagataaagaaaatactaagaaatatttgtttaacccaaattaaggcaaggaaaaaagaacagctgtagaggacaaatgtattgaaaaggacagaaacagcaaaatgatagggttaaaccctatgttatcaataattacattaaggcaaatggactaaacactacaatcaaaaggtagagactgccaagctagataaaagcagggcacaaatatatgttgtttacatgtcctaaacataaggatacatattggttaggtgttaaatttgggggaaaaaatatgccgtgcaaatactcactgtagtaaagctagaatgactatattaatattagacagtagatttcagagcaaagaatactgtcagagataaacaggaatacttcataactgggtcaattaatcagaaatctataataattccaaataaacttacacctaataacagcttcaaaatacacaaagtgaaaatccgacagaactaaagaatgaagtagacaaatccgtaaatatgattagaaattgtaataccttttactcagtactttaaattatacagagtaagttgctgattacccagaattaagttacaaatcagtaacaaaaagatacctgaaaaattcacacatctttagaaagtaagcaacatacttctaaataatccacgggtcaaaaaagaaatcataagaaaaactttaaaatatttcaaaatgaatgctaatgggaaagtacaatatgttaaaacatgtgggctgcagctagagaagtggttagaatgaaatttatagttttaaatgctttattgaaaaagaaaaaatatttaaagtcagtgatctgagcttctattttaaaaatctacaaaaaagaacaaattaaagctaacataaggagaagatatgaaatacagagcagagaacaatgaaacgaaaaaaagcaaataataaaattgatatacctctggcaagactgatcaataataaaaaggaaacacaagttaccaacaccagaaatgaaagtgaaaacatcagttcagttacttcagacagtcaaaatacaaggtaatactataaacaattttgtgccagtaaattggacaacttagctgaaaaaaaaatttcttgaaagataccaacactgatacgaaaataaattaaaaatccatgtagtctcatatccattaaagaagttaagtttatagttgaaacctccccaacaagaaatttctagatttggtttgttccactggtgagtttgtcaaacatttgaggaagaaataaaatttaccttacacaaactcagaaaaaacagaaaaagcaaacactttccaactcattacatgagttggaacatgtaatgaattggaaagtgtttgctttttctcttttttctgagtttgttaaggtattatgttgaggccaacataatactgatacaaaaaccaggtaaggatattacaagaataaaattatagactaatattgttcaggaacatagtaggaacaaaaatccttaacgaaatactagcaaacaaaatctagcattagagaaaataatacattttgactaagtgggtttataccaggaatgcaggattggttaaacaataaaaaactaatcagtataatttaccacattaatgaaataagaaaatgtgatgaacttaataaattcagagaaagtatttggtaaaatttagtacccatctattatagaaattctcagaaaactaagaatggaaaaaataattaatcagtatgataaaggatttttatgaaaaactcagcgttattatgaataagtctgtttgaacgttcatagcaaccttatacatcatgcctctaatctggagactatcctaatgtccaccaacaagagaattaacatacaaactatggtttattcatacaatgaaatagtactcagcaacaaaaaaagataaattaccgatacatgcaacaaaattgatgagtcttaaaacactgtgatgaatacaggatgcaagacaccaaattgcacataccgtatgcctccatttatataaaatcctagaacagataaaacctatgcatgttgatagtaatcaaaacagtgcttttcttgatagtgctgggattgcagaatatggtgtctactgaatgcgtatcacatccacatcatcataaagttgaaaagccctaaatagaaaaatcctaaattggggtcatttaataccttttttttttttttttttgagatggagttttgctcttgttgtccaggctgcagtgcaatggcatgatctcggcccactgcaacatctgcctcctgggttcaagcgattctcctgcctcagtctccccagtagctgggattacaggtgtgcgccaccatgcccagcgaatttttgtatttatagtagagacggggtttcactatgttggtcaggctggtctcgaactcctgacctcaggtgatctgcctgccttggtctcccaaagtgctgggattacaggtgtgagctaccatgcccggcccatttaataaatattgatgtgtactttctaatatatgccaagtactatttctacgtaccagtcatagtaagttctgtaaaaaaatagtgcagaggaagggaagaaacagtgacggtggtgggcaatagagtgtgctattttgtgtaagatatcctttgagctgagcagagacctgcaaaaggtaaaagagtgaggcatgagggtatctagggagaaagctttgaaacagagggaaaagcatgtgcaaagactctgagatgaatgtgctgggcatgtgtgtggcacagcaaaaaggccaatgttgctaaagtggcatgagtaatagggacggtgggaagagatggggtgagtgagaggctgggagaacattttcattctaaatgatctgagaagtcatagagggttttccataaggaatgatggcagctgacattttcatgatatcactctgactgttttactgagaataaataaattactaagggggctcaaggcaatagtaggggcagttattgcaatcttctggacaagagatactgttgacttttgactaaaatagtagtggtggggtgttgaaacatggtcaaactctgatcatatttagaaggcagagtcatcggggtttgctgatggattcaatgtgggacatgagacagaagtcaaggacaactccaacgtttttctttgggaaattgtaaaggttaattttatgtgtcaacttgactgggtcacagtgaacccagacatttggtcaaacattactctgggtgtgtctgtgagagtgtttctggatgagactaacatttgaatcagcagaatgagtaaagcagattgcctttccgatggtgggtggccctcatccgatctgttgacggcctgaatagaacaaaaagtctaatccttcctccaggaagaggaaagtccttctgccagactgagctaggacactgattggatctagccttcagactcggaccgaaacatcagctccccttgggtctcaagcctgctggcgttcagactggaacttacaacactggctggaacttacatcactggctctcttggttcttagactcagactggactacacattaactctcctggtctcctggtctccagcttgccaacaacagatcttgagacttctcagcctccataatcacatgatccaatgtctcataacctctctctctctctctcagttcgtttatctggagaacactgaataatacagcaactaaaataatgcatttgccatttatgaagatagagatcaaggtttctgtttggccatgttaagtttgagatgcctcttagacatgcagatggaaatgttgagtaggcagttcaatatataagtctggggtctagggatgaggtcaaggccgaaactaaaaagtaggagtttttatcatttgataaaatttatatccactagactgaatgagaccacctagagaatgaatacaaagatgagaagtggtgtaaggactgagccctcagatacttcaatatttagagatcaagaagatgaaagaagtctagcaaaggccgctgaaagggagcttgtcagcaggaagactgagggacatcctagaagccaggagaagaagtgtttcgaggaggaacaagtgatcagcagtaccaaatgctactactgacttatggagaaacgagattgggccattaaactggcaacaggcaggttactgctgactttgacaacaacattgtcagtggagtgggttcaggaaacaatgggaggagagagtgaagacaaaaaaaaaatagaaaaatactttacaaagttttgacccaagacaattagaaagatggaacaatagcaagaggaattttggaagtcagggaaaatttttcaaagatagctacagcatatctggatattgatgggaatgatccaatagagaagaaaaattctatgacaatgtagacagaaaagggggagcattgcacgtatgaagtccttgtgtaggtgagagaacatggggttcagggattgaggtattgttcttaggtagagcctggaaagatcaaatatagtagtaggagggaagacagaacttaaggaacagatgcaaataagttagtggatttgatagtgggtgagtatgaaagttcttttcctagtgcttttattttctctgtgaaaatccagattacaccaacctgggttttaattccagctctgacaccttttaacagctgtgtaatatcggtcccatcacctcacttcttcattacaatctggctagatgaatttagaaaatttaactgactccacgatggtagcattgtacactgtgcaatttgcagtacatgtgatttatgatatagaccatggaaactatgccatagtagactatgtgatattgcaagctcaacttaaacttaaaatcataaattttcacaaattttataggtcaagcctcctcaccacatttaaataccttttcataattttctcctccaagttgggtgagtaagtacttcaactgttgtattagtccattctctcactgctatacaaagaaatacctgagacttggtaatttataaagaaaggtttatttggctcatggttctgcaaactgtacaggaaacatggctgggaaggcctcaggaaacttacaatcatggcagaaggcaaaggggaagcaggcacatcttacatggctggcacaggaggaagagagagtgggaggtgctgcacaccgttaaacaaccagatctcacgataagtcactctcaccacaacatcaccatgggggatggtgttaaactatgagaaactaccccatgatccaatcacctctcaccaggctccacctccaacattgggaattacaattagacatgaggtttgggtggggacacagatccaaaccatatcaaccctttaagctcatttcatttccattgaggagttcattttaaagtccccaaaatagctcctttttcctctttttgtgaattacatattagatacttctcccagtaatttgaacagtggaattgggttatgatcctctccttgttccaggcaatagcctctgctgatgatttctgggctgttggctcaacttctttggtgtagccatttgattcttcatacagacatcctggcaataagcatcttcatattttctaaaggaagttgtttgttaacagtgctccccaaatctgggttgatctgttctcagctttgattgctgcactcatgaaatcttctgtaatcatttatttaacctctgcagaattcagatatatttggctgtagcacctgccaagatccggctcattctttagtctttccctgactttaccattgtgagactcctggctgcccttcccatttgtctgcaaggattggcttgccagaactctgtggcctacttcagtgattttcatttttttggtttctctgtaagtttcatgttaacttgttatttggtcagtttcattgcttctttttatttgaagattattattttttaagttgctacttattggaaactttttatctcaagcctattaaatttgatgtagaaatcagattctggcttagtactctggtatatttctcataatcctcctgttctatttccccttctctcaatgaccttctcagctgatgtcatatttgggctggttaccccaagaaatggatggggttggatatgataacactaagcaagcatccctaggccatgctgaattgtagaatgacagaatgttaaagctgggaggatacccaaggttggttagttcaatttctctcccaatgcaagaatttattctacagcatccattattacctcctctgctgaaatccttctaagcagggaaagctaattagttggatagatacatttctcctttttttccagttctaattattaaacttatttttttctttcatcaaattgaactcttcctccctataacttcctcccattggttctatgtctgccctctggagggctagagaataagtggatttaatctcttaataatatgatagtaattgctaccatgtgttgagtatttgtaaggttctgtaccaagtgtcttatgcactgtattagtcatggttcttcagttgcaagcaatagaaaccaacctggccaactgttttagttatcttttgctacataataaattacccctaaaattagtggcttaaaaaaactaacatatactacctcagtttctgtgggtcaggaattcagaagcaacttaatgggtgcttctgcatcagtctttctcaaaaggttgcatccaaaatgtcagccagggctgcagtcatctgaaggctagactgggtttgggggattcacttctaagctgctttacatggctgatgacaagaggcctcagttcctcactagctgttggccaaagccttcagccttgttgccacaaggacctcaatatagagcaactctaacacagagagagagagagaagccacagtgccttttatgacctaatctctgaagttactgaatatctatatctatatctatatctatatctatatctatctatatatatatatacacacacatatatctcacagtaaacacaaggcttctgggtcagagacaaactgtttatttagttacagaatattttagtggcagttactcatgtcccatttcccccactccgggtaacatggtgagagccaggtggatcctgctcatgttaaagagagaatctatattttagaagaggaattatgaaatcatgaatctcaaatcttgtataggagctggaacatctacactttctcctctccaaaaaaagggacagaggacttggaatgtaaactgatatctcttgggggaaaggaggaaggtctctacctacaaatataagcatttgactctggggaagataagaaaggtattattattatttgaatgggagtagatggctccatgagaaaagaaacaagttgtctcagtctgtctcccttagaacgtgaaaagcaaatggctcttgggaaaaggaaaaatattatctatcttcatggcatgtcaatttccattgctcagaatgctctgatcattcagacacatgaaactattcatactgttttccaacagtcactaccattacttcttcatcattgtatgtattaggagcaagtcactaaatttccgtgatgaacacagatacaaaaatcttcaacaaaatactagataacaaaattcaacagcacatcaaaaagatattacatcgtgatcaagtgggtttcatcctggggatgcagggatggtttaacatacagaagtcaaaaagtgtgacacatcacataaacagaattaaaaacaaaaaccatatgatcacctcaatagatgcagaaaaggcatttgacaaaatcaggcattctttatgataaaaactcttaacaaactaggcatagaagagacttacctcaaaataataaaatatatatatgcaaacccacagccaacatcataccaaatggggaaaagttgaaagcattcctcctgagaacagcaacaagacaaggatgcccactttcaccactcctgttcaacatagttctggaagtcctagccaaaacaattaggcaagagaaggaaataaagggcatccgaattggaaaagaggaggtgaaactattgctgtttgcagatgatatgatcatatacctagaaaatcctaaagactccaaaaaaagactcctagatttgataaaggaatttagcaaagtctcaggttacaaaatcagtgtacacaaatcagtagcactgctatacaccaacaatgactaagctgagagtcaaacaaagaactcaatcctggctggacatggtggttcacacctggaaaccaagcatttcaggaggcccaggcatgtggatttattgagcccaggagtttgagaccagcctgggcaacaagggagatcttgtctctacaaaaaagttacctgggtgtggtggtatgcatccatagtcccagtgactccggaggctgaggcagaaggatggcttgagactgggaggtcaaggctgcagtaattgcaccactgcactccagcctgggagacacagtgagactctgtcttaaaaaaaaaaaaaaagaaaaaagaactaaagctcttttacaacagctgcaaaaaaataaactatctaggaatatacccaaccaaggaggtgaaagaactctacaagaagaactataaaactactgaaagaaatcataactgatataaacaaatggaaacacattctatgctcatgaattagaagaatcaatattgtaaaaatgaccatactgcccaaagcaatctacagattcaatgaaattcccatcaaaataccaacatcgtttttcacagaattagaaaaaacaatcatcaaattcgtatggaaccaaaaaagagcccaaatagccaaaccaattctaaggcaaaaagaacaaatctggaggcatcacattaccagacttcaaattctactgcaaggctatagttaccaaaacttttatagttctataaaagtaggcatatagaccaatggaatagaacagagaacccagaaataaagccggatacatatagtcaactgatctccaacaaagcatacaaaaacacaaattggggaatgaatactctatttcataaacggtgttgggaaaacttccaaaccacaagtagcagaatgaaactggctccctatctctcagcttatataaaaatcaactcaagatggatcaaagacttaaatataaggcctacaatcataaaaattctagaaggtgacattggaaaaattcttctagacattggcctaggcaaagattcatgactaagaccccaaaagcaaatgcaacaacaataaaaaaactaaataaatgacacctgatgaaactaaaatgcttctgcatagtaaaataaataatagagttaacagacaacccacagaatgagagaaaatacttgcaaactacgcatttgacaaagactagtatccagaatctacaaggaactcaaacaaatcatcaagaaaaagacaaacaatcctatcaaaaagtgggcaaaggacataaatagacatttctcaaaagaaaatatacaaatggccaagaaatatatgaaaaaattgtcaacgtcactaatcaacagggaaatgcaaattaaaaaacaatgagataccaccttacccttgcaagaatggtcattattaaaaaataaaaaaataatagatattggcatggatctggtgaaaagggaacacttatacactgctggtgggaatgtaaattagtacaacctctatggaaaacagtatggagtctccttaaagagctaaatgtagacctaccattcaatccagcaatcccactactaggtacctactcaaagggaaagaagtcattatatgaaaaagacacttgcacatatatgtttatagcagcacgattcacaattgcaaagatgtggaaccaacctaagtgcccatcaactaatgagtggataaagaaaatgcggtatatacacaccatggaatactacttagcgataaaaaggaatgaaataatgtcttttgcagccacttggatggggctgaaggccattattctaagtgaagtaacacaggagtggaaaaccaaaagccatatattctcacttataagtgggagctaagttattcaaaggcatacagtgatgtaatggactttaaagattcagaaggagaagggttggtgaggggctagggttaaaaaattatacattaggtacaatgtacactactcaagtgatgggtgcactgaaatctcagaattcaccactatataatctatataatttatctatgtaacaaaaaaaaaaaccacttgtacacccaaagctattgaaataaacatttaaaaaaggaagcaagtcactaactccagcccacgttcaaagggaagggattaaggctccaccacttgaagacagaaatatcaaaaaatttgggaacactgtaaaaccaccacatcctgccccaatttcacacacatgcaaaatataggcaccccctctcaagatttccaaaagtctcatcctattatatgtcagcttaatttacagataggtcatttaaatcaagaccaggtgcatatgaggttacttggttgtagctccctaagtacagttctttttttcttttttttagagacagggatctcgctatgttgaccagactggtctcaaactcctggcctcaagtgatcctcccatctcagcctcccaaagtactgagattaaaggtgtgagccaccctgcctggcccttaagtacagctatcgatccaaagatctgtgagctaaagtgaaagttatcttctccacacacccaacacacatggtgaggcaggcataggataactgatattgatacttctgttcagaaaagaataaaacaagaagcacacaggagtcactggttcatagcaattttgaaatccagttgggaaatattagaattagattaaggctcaaattatgggaataattctccataactcttagctctgttttttgagttcttagttctgccttcttagtcgtgcttcctttttcatgaagatattgggactcagaaaacaacatcccaaagtgaaggtgtcagaaacagcctcagaagcaaaagtttttctctaaccttctcatgtcctcctgtttctcagtctcattttcccttaagggtagccatagacatgagaatccctcctctctgaggcaggtcatagaaaccagaactctttttccccaaagccagcgaagaaacctaaaaatattactctgacattccttccacctttctgcataaaaactgaccataaacaaattacctggcctattttgtttgactatagatcataagacccttattccagacagcaccttgccccacatccagaaagaagaaatgaacactcagaaagaccaaggatctacacaggcaggccttgctaggtcttcctactcactctattagcagtagatcatactgttttgtccaatcatatttctaaaaagctgcccatactttgttgaacctaagcataaaaatggacaatttcccatgtatttttgggtgttcattctgagggttcttatgtcatataaaactatgatcaaataaatttgtatgccttttctcctataaatctgcctcttgtcagtgaagcacatttttgcagctgagcagttttgtcagcctgcttcctcctattcatagaagttcgggggtgcaaccttcattttgtattatctctatcccttttggtctaagctggtggtgtttctgtggatataattctcttaaaaacactgttaaccttattggggtttacttcacttggcaaaagccacactcacaaatcatttggagagaaactcttctctgccttgagcttttgctgagttgacgacataacaagacccttaagcttcttggaagtcctattatttgattgacaggatctgtgagacccacccttaaactctttagaagacctttggtctgagtggacagatcttgagatagacctttggtctttctgatatcttagaaaataattctagagtcatacctttggcctcatctttagaccaagctttcctgatagtgccctggatttgtatttttgcttggaagccatttctcaatgttagtattatttgctatattggcagactgagaatttgaaatcatcaagtcccagctcctccatgtttaacattacttttgttaattttttttatcctactatcacattttatataagtagcaaaaagaaaacaggtggcggcctcaatattccctctggaatcctctttacctaggtcatgcagttcattcggtatattttctactttccacaatactgcaggtgacagtattgctaaactttctaccactgcataataaacattccctttgatccagtttcccaataaatttcacttcactttcctttaggccttcaccacagcctcttgaaaggacaataacgcttctacaaacaattgtttcaaggctcttgagacttcctcaaatatttcagagcttctactcactttctggtttcaaagtcactcccagattttagttatttgttatatagcatcccatttctaggtaccaaaatccatatcacttatttttgctatataacaaattaacacttagtggcttaaaacaacgtacatgtattatttcacagtttctgtgagtcaggaattttggagcagcttagcttggcagttctggctccaggtttcatatgaagttgcagtcaagatgttggccaagacatgtacagaaaatagctatgggatcagaaccccagcctcccagatggaatccaggggaaaggccagttacacagtctggacctcacagtgagggatgaatgggaaatcctcccctccaaaatgacaaggagcccataggccaagaattctgattagaattaggagctgggggccgggcgcggtggctcacgcctgtaatcccagcactttgggaggccgaggcgggcggatcacgaggtcaggagatcgagaccatcctggctaacacggtgaaaccccgtctctactaaaaatacaaaaaagtagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaagaattaggagctgggtcaggctctggccggcatagggaatgcctgggactaagtctgtgagtggcagaactttggtgcccaaagccaggcagggataggctcacattaggagctgctgcatgacagccctctcagcatttggggttagttaccacataacataatattcaaattctttatccttcagtggcctttctccagccacgctctacttcatcaaagtccttctgattctgtggtagttaatgcctcaggcatagtctgtccagtgcagagaacagaggggccattaaacgcatccagaaactacgcccaaggggcttatttctgggatgaatcaaacaaaaggagattgtcatgacaagaacttgggtaaggattgagaaatgtctctagattcataggaacacgtccagtttaagttcaccattcattagaaccttttacagtcctagcccatcaaattagctcttgaggtacagacatgaacacccacatatatttcttcccaattgagaagcacccattcttgattctcaactccttcagccagcttctccacatcaacttcttatgtacacttgggatttatccactcctctccctctccttccatgtccaagccatcatcatcatcattgttcacctgaaagaccacagtaagctaacacatctctttcttacattcctgtgttcctccaattctgttctccccacagcatccaaagtagtctttccaaaagttgaatcagacgtttgtacacaatataaataaaagatcactcctctgcttaaatgtcttcaatcactatttaatccactttaattttgttgttgttgtttgattgtttgtttttgaggcagggtctcactctgtcacccaggctggagtgcagtggtgcaatctcggctcactgcaacctctgcctcctgggttcaagcagttcttccatttcagcctcccaagaagctgggtccacaggtgcctgctatcacacctggctaatttttttgtatttttggtagagacgcagttttgccatgttgcccaggctggcatttaattcattttgaattaaattcagacttataaccagggcccccaaagtcctgtgggagctaatgctcacttcagctaccttgtcttttcccgtgccctcttcactcactgtgccacagccacaccagcctccaggacctggaggtctcaggcattacaagtctttcacacctcaggacctttgaatgtgtcagctcccagctggaaggccttcgtcattctgatcacaccccaacacacatgtgtactctgttctttgcttgattatgtctatttcatcctctagaccttcatcaatcgtcctatctgtactattttcttactctccaatgaaggcatactttgtttccatcagataatgcatcacaagttgtaattatatgttatttacttgcttatatgctatttttctccaccaaactaaaagcttcttggggtagagactgctttgttgcccattgtgtacttaagacttagtgcaatgcttggccaataataccaggctcttgacagatacttgttaaataaatatttctttaagttatcattcacataaattacaaaaagaagttattaattaggatacacaatacatttccagatttttataaggattaactttattgttgtgaggaataaatgagatatgtgaaaacttaacagtttaccatctgccccttatccctccattactccctccctctttccatccctccatccctctatcctttcctccctccttccatccctccctcccttcatccttccactccttcctccctctttccatccctccatccctctatcctttcttccctccttctatcctccctcccttcatccctccactcctccctttctctttctatccctctatccccctatctttcctcactccttccttccctcccttcatccctccactcctccctttctctttctatccctctatccccctatcctttcctccctccttccttccctccctcccttcatccctccctccatctctccatccctctctccctcccttcatccctccctccatccctccctccctctttccatcccttcatctctccatccctccctccctctatactccctccctccatccctccctccctccatccctcccgccatcctttcttccctcactccatcccttcatacccccttccctccatccctccctccctcttcccatccctccatccatcccttcctccctccctccctctttccatccgtccatccatcccttcctccctttatccctccctccatctctccattcctccctccctccctccatccttttctccctctctccatccctccctccttcttgtactaagaaaaacatggaactctcttgactttgattttcttttctgcctaccttctctctccatgaagtttgactacaatgagatttttaactccctaaagaatctctccttcaaaggacatggattatagaggaaagagcattttcttaatgctctgttaaaaccacctataaagaaatcgctctataaaatgttgacgtctcctaagacctcacaagcaatttttagataaagtcatcacccagaattttgaattcactctcaaggatcaaagcatagaaccacacctgaagtaaatttagaaataacaaccaccacaactagtactcagtgaggttttccttgtgccgaggctatctcatctcttttaatctacccagcagcctggggagaaatgtactgtgattaccccatctcccggtgagaacctagagcttaagaagcaggactcgactgcaggactgtctgattctggaaccctctgacactttcctgcacggattcccagcatttatgcctctgtctctctgttttgtacttcaatctggctcaagtctaggcctctccctctcttgtcacagctctttaggattccttgtggcagccagcctggatgagtgtgcctagtttttctgtgaattctctctacttcataactgctgatctcgtcttcccaccttctttctttcaagttattctacattccacatagattaatgttgctgaatttacatgtttttgtatatcacctcaactcaaaaagttgtactaatccccctgtttaagatgtcagatccagttctgccttttattagctgtgtctttgagcaatgtaatgaatttttctgagtctcagttttcttatttctaaaatgaaaatgcacatctgtaatcccagcattttgagaggccgagacatgcagatcgcttgagctcaggagttcgagaccagcctgggcaacatggtgaaacgctcatctttacaaaacatacaaaaattagccgggcattgtggcacacacctgtggtcccagctactcagagggctgaggtgggaggatcacttgagcctgggaagacaagcctacagtgagctgcaattgggccacactgcactccagcctgggtgacaaaatgggactctgtctcaaaaactaaataaatacaattaatatgatgatatccactccatgaagtcattaagaagattagacaaggttgtcattctggacaggtgaggctgtgctgctgtgataaacaagccctaaaactccgttgttttgttgtaactcctgctacatgtgcctctcaagctcctcatctttacttcggggctcagactgacagagcagcctttatctgaaatgtgggcagatgtgggccagtgaatatgaatgctacaatctcctacagaaaatgcagagcaaacacccgcacagtgtctgacgcctggtacgtgctgaaggaacgttctctccttggagctcatcctcaagtgggaagtctactacaccaacgtctaaacctttatgggaagcctgttcctgcaagatgtgtgaagttcagacaccaaccattacaatcttctttcagcgggcttacactgttgaatgattaaattgttctttatgtctcctggcttcaaaaactgtgtgggttactacatctgtttcctggggcagccataccaaataaccccaaactcaggggcttaaaacaatggcaattgataaactcacagttctggaggccagaatcgaaaacgcaggtgttggcagggccacactccctccaggggctctcgggggaatctgttcttggtttcttccagaacctggtggccagatcactccaacccctgcctctgtggtcgcattgcctcttcctcttctgtgggtttcctctgtgtgtctcctataaggacacttgtcatggtatttagggcagactcaaataatccaggatggcctcctcaccttaagatccttaatttaattacatcttccaagactcttctttcaaagaaggacacattcacaagttctgggaattaggacatgggcatatttggggagggggacctccaatcaactcactactatcgtcaagtgcatactcttaagcagttcaaagttcgcaactcggttatttttcacctattttagaaagaggttgattttacacaccacattgttctttcagtgaccgacatcttataaaacccagaagtaagtaaagagcatttattgccatggtagccagttttgtcactgagaaacagcccaatgtatgttcacactgtcgtattaggaaagcaaaaagagtaattatattaaaataaaatacagcttcctctcttctttctttcctttattatttctgtgactgacagtctatcagatgaggctttttttttttttttgctgaggttgctcatacagaccatgttgatgtctctagaggttctgcatgtaaggaaagccagatttttcacctttgacaaaagtggaatttttccatttaattctgcattgactaaggtcttctgggagattctgtgcagtctctgtacctgaaatgcaaagtcattgtgaaagaagctctacgacagaataaaaattattacaattccaaaggagttggcctataattaattgtattttaaaaggagtttcatttgctttactgcttttttggaagaattaaatgtaatttgatctctgggagaaaataccaacctcttcatgtatatacttgttttgtttttttcctagcatttggtaaaagttaatgaggcacatttttttggtattgttagcacaagtccttactcttggtgtgaaaatatattgacatttgctaccgtttctatatcatgtgtaagtgatagaggaagggaaaaagagaaagaatagcaatttgttgtcatggaaatgaattaatacaaaactggtggtttgtactatgacttgagatgcttgggaagggggaggaggaagaatgataacatctatatgatcacaaagccaaaattcttagagaaatactggcaaatatctggagtgatttttattccccatctatctaaacccctcacatgttaaacctatgatgatctaacagaaccagacaaggccctaagaactttcacgtctctgagcaaggcacagccaagtgcagtgttggtagattctgcatccagtctccgcatttcttggacaagtttgactccaacttagataaaaataacagaggcatttttgggcgggcacagtggctcacgcctgtaattccagcactttgggaggctgaggtgggcagatcacggggtcaggagatcaagaccatcctggctaacacggtgaaaccccgtgtctactaaaaaaataaaaatacaaaaaattagccaggcatggtggcgggcacctgtggtcccagctacttgggaggctgaggcagaagaatggcatgaacccgggaggcagagcttgcagtgagccaagatggcgccactgcactccagcctgggcgacagagccagactccatctcaaaaaaaaaaaaaaaaaaaaatacagaggcattttcagcagctccccttcacttcctgcaattagattggctgcccaatttccactaatgccccattttctggcaagtaaaaccaccatcacgggattaacgagaattacaagtcaggttttaggcagaattatctttaggcattgaccagggcacattttgaccactcccttgcagttgctaactaagagtcatataatagcacactgactacctgcacccatctggaacccattattcctatagatagaatctctgacaatagaccattttacccatgaattgcttagggcgtttttcaaatccagcagaatggctgacgccaacaaatgtaaagaccctcaccaaggaaccaattcagcataggaatgcggtttcttcaatacgctgcctgtcccgtgacttcacccttcacttctcaacagatcaacaatccctacacgttagtccatcacctgtacagactccttagaaacagtatccccaaacctcttgcggagatggatttgaggttttttctcatcttctcctttagctgtcctatgattattaaactctttctctgctgcaacccccagtgtctcagtatgctgactcactgtgcatcaggcaatgaacctattatagttacagaaggactgtaaatcacagagttgtcccttgtggccatgtctggactattgaccctagctcctaatctacttccagccattggatcaggggtggaacctggcttaatttgaccagttgcagtaatttgctcctttgggcatggttcattggtcctggagtggccatctgagacaaaccaaattaaccacgattgttccccagaacttttcaaactggaactaagaaaagagagctggtttcattttggaggtgaagatgtgggctctgaggcctggaatctaaatgtgaccatgtgacctacctgttaaagagatcattttaagagaatgaagcatggagtggcagatgagagatggggagaaattctactggcagagaatgtaagttcccaattcagttgtcctcatagtccagctgcacttcacatcttcccgcagttatgagaatccacctccaataaattcccattgcctgactaaattatttaaagatgggtttccatgcatagaaatcaaaaaaagttctaactggctgggtgctgtggttcacacctgtaatcccagcactttgggaggcattggtgggtggatcacttgagttcaggagttcgaaaccagcctgggaaacatggtgagaccctgtctctgaaaaaaaaaaaagttttaactaatatacctctccttaccctttttgattgtgacttaaagtattctcagttaagttctaagcatcttaggagatgctagaggcatgggtgagccaaataaatgaagtcgcagagccccggcatattgctgtgttatgtgaggccagaggaaacccagggagttcttcaatgggaatattctattttgatttgctgagatctgctgaaggctccttcttgggttaaacacaagtattcccccagcttgcagagacgtttttgttttgtttgaaaaagtactgtatcaaatgcagtcctttggttggcagagctccttatatatcttctacatctcttgtggcactttcacatccattatcacatttttacctcttaagcgttcctagaggtgagtgaggccaaatggtacattactattttaaaaggaggaggcaactgcattccagaaggattaagtgttttgttgagagctactgagtttgtccaggacaaaatcagcctgaaaattgggtttcctgactctcaggatttaatccgtgccctacccacatttgaccaaaaacaaatgagtcttgcggcttctctggttcttagtctgagaaggcaaagacaaggggctgggaaatgcccctccaactggccatgtggacttgtaataagcatgtaaataccatgctgggacatggcggcaaggctcatttgctgccttctcacaaagtggaatgggagaattcgttgcacggtattaaccaattggttgcctagtagtctggtgaagtgtattaaggacattaccagagcaatgtaagctaaggccaaggaggacagtctgaccagaggaagaccacagagtatgtgtttctacatttacatatgactcaggagagtttggcatcatagctgggaccattttccaaactgaaagaaggaatttctctacttgcgagggtggctgggcaggctccatggagacagaagtttgcctgcagaattacttggctttgtgtatagctagaggtggtcaactacacttccccttccaacaggcagccaattggagagggctagggtttgcagatggctcttctgctcttctcaccatggccctggcaaaagcaaccattcagactccatttgtggtgaaaggaaacacagttgaagggtatgttttaccagggatgaaaaccaagtgaacccaggaatatatcgtgaggctccttttttcagctcaaggccctgaaaagaaaactgaactttgttgatagtatttgactattgttcgtgtttaagggcctccaaaatttggaaatgggggaaacaggactgactttttaagtgcttaactgtaataactgtagtattggactaaatgtgaaagatcaacggaaaaagacaggatgacttccaaagcccttggactagctgggagtgggaggatggtggtgcaaggggaggcagtggttgggatgggcaactgtggaaacagagaaaaaagacagacacagagacaaatattggtggtgctcattcaaacacttcccaatggaaaagaagccttagccaatggattttgggggtgcaatgccactcctagtgggtaaatgtatctagaggggtataatagctcttgtgtttgtgccttcacattctgtctgtaagactatctctgtgtgacatgaaagatgtactgagtagcttactttgctactgcatacctttggcttatccaattctctttgatctgatgtcacactcaacaagtaatctcctgattactgtttagctcctacagggaaagaatgtattgatcctagaaacttcggatattcttgtccttctaaagatggtttcttacgagaagtgaataacttggcattctgatgttttatatcagccttttgaatgtaattagcatgagcctgccctgagagacgcatggcatgatgtgttgacaaagtcaggtctgagctcaccagtctaattatccaactactgatgattgtaaatttgtaaggtaataaatgatacactgtcaggccatttgggagacggccggccaaccttcccacagtggggtatcctgatatcaccctgtaactgagaaatcacatttggaactttaatacaaccctctttgaggaagaaatagctacagcaaggtaaaaatagagtgttagtgataggaggtaggagtggtgctaaaaatgtttatggcatgaatatagtagccgtgagaatgtgtctcacagacttccaaccacagggaagtagctgtgctctgaaatctattgttatatttgcaccgaggccacacttccagtgggttgctcccagtgactgagcatagcaggaatactaaagcgggcccattcctgggaaacaaaagactcctctgatggctgatgttggcatgagaactccccagcagccttgccaaatctcttctagattgcctagcagtctagaatgcttccaatcaagcttccttcccatgctccttcttggggtcagattttcatcatgctccttacatatttagtcttgtcttttcaaattccctaaacaatcacaatgaaaaacattggatgagatgtgaaaggtcaatggaaaaagataagatgactgatgacttccaaagcccttggactggctgggagtagccaggatcttgcaggaaagagatggtatactcaaatcgggatactttgagtacagttaaataaaggaattgttttcaaagttatgggcagggtatagagaagccacaagggagagtgtagttgttcatgaatagctaggtacagctctccaccctaggcctgaaggagcaaggggagagagcagttactgaaatcccaagattaagagggctgtgggtagaagcttgccttaaaggcgctaggatctttgtataaggaatgcagcccatctgcagaatccccaaatggagttgctaaaggaatcaagacccttgcttccatgtactgtctctctctgatctcctgcttgcaattggcccagcccaactggaagctgcagggaaatgagcctattgatacctcatgcgttagcctcatgcatcctacacagggagagaaaggtggagagtggatctgtaaaggcaggtgggatgtctccagccgcaagacaatggtgcgcttttatgtggtagcagcgagccttcccttaaggctttcctatggcagcaatgacaaaagagagccccgacctgggaaatgaaagacacagactccactgaagatagtgttgcgtgaaagaaacagcaaagactgtgaaagaaattccagccctggtgttctgcctggacctagacaggacctagccctggattgaaaaccggagctattggtttttaggccttgggatatggtgctttcttcaggattggactcatgagatagtctccaaagaggtcagtaggtgggaggatatcttttcagcccagaatgggctaataagataaattcagaattaaactgcgacgactgctcaaaaacacagaaaagaaaaggaactggatggaaacaaagggagagcctgctgctggcatctttctttttaccactctcccctgggaggtttgtccctgtggcattgcagtctcagttggagacttcttggagggagcagcagagcttcttgagtctaaactgacattgaaaaaaggctctgtattacaagaatacatctgaattcatcatggaagtcaagaggaaaatgtgattgagggaattcctaaactccaccctgtctcatcatcccacgtccttatcaagcaccatgttttatggagccttcccctgtctcctggatctgcctactcctcttcattcccatggccactgcctgaggccaattcaccatcctatttgcttggattaccacaatggctgcctcaccagtccccctgcctctggcctgactgaaatgtcagtcaggatgctgttggctatgagaaaactgtgactaaaattggcttgctgttgcacataaccacaggttcctcgtaggggcaggctccagaacagcccaccaaggctctggccctacttctttctgcacctcttaaccttaaactcacccatgtggtaacttcatcaggctggtagattgataaccacatccattcctggtgtcatatccggtctctacaaagtccagaggtagaaaagtccatctcttcttgtgtgcttcacttatacaggaggaaacctttctagaagccctcaaggaaacccccctaatgcatttggccacccagaagagggggatttctaaacaagctgggagttctgttaggaaggaagaaggtggctgctacatccatttttctacacagcaaacttaatgatctttctaatgcagaaatcgatcatatcatttttctgcttaaagtccttcagtggccaccactactctcacacaaagcccaaatgtcttacatgagcatatgaggccatttttactatgacccctgtctaccgccccagccttactcctctccctaccctctgtcctgcagtcatgctaaactgcttgcattgatataaacaagccatgttctcccctcttatcagttgcttcttggcttctgctgtttcctttgcttggagaacaccttgcttcttctggcttacttgggtcattttgggaaactccatatagataccagttcttctcaggaggcttcccttggccctgctgtgtgcttacccttatactatcccttggcctaccttggccaagccttcccttggcccatcttgtgcctactcttacactatctggaggtattcagacgacctatttgccaacccgtttctcttcccggactccaggccacaggagggagaagtctgtgtgcctactgtaaggagctgtctggtgccttaggtaagactcagtttctagcatcagacagcccggatttggttcttgccttcaactactgtaactaatcatattcaattactatgagtaactaaggtcactaactgctttgagtactcaaggtagttagtgaccttgggcaagttatttaactcctctgaacttttgtttcttcatctataaagcagggacaataacactcactatctcatgcagtgattgtgagggtcacgtgggatgatttgtgtaaagcacttagcacagtgcctgacaccaagctggtgctcagtgaatgttaagctgaatggtgatttggtgaacagagctgagtctctcccactgttctggggatgttaaaagcactctgatacacgtacctggatacagggctgccaaggctaatcttatatacataattgaggaggatgtagggatatgttggcttctcaaataattattatactaggctatgttgctgaattcttaatcctgccattacagattgactatttcatgttagcaatcaatcaatatttactaagaaaaaaattcttgatagtgcagtggcaaactcactcatttcctgctccaaaagacatggccttgtccaactagtcaagctgtagacagcaagtgctcttggacttcagagaagatctctacattgaacttggaggatgatgatgacatttagacagatggagatgggagaagaggacccagacaatgagaagagaagaggctggagagctctgtgcatggcagaggatagcatatgaacctctggtgaccagagggtcttgcaggtacggacttggggattttcccttgaaaaatgtgaattcacttgaattgatattttatcatagaattgtagaaccagaaaggaattttaaatccccttatttgaagaaactggagctcagagaaactaaatactgggtccaaattcacccagttagttggtgagagagagagagagactataaaccaaggttatctgaccccaaatctagactttagagctcttttacccactaccaaaccacctcttaattagtttagttatatttcttcttcttcttttttgttttttttttttttttttgagacagagttttgctcttgttgcccaggctggagtgcagtggcgtgatctcagctcacagcaaccttcacttcctgggttcaagcaattctcctacctcatcatcccaagtggctgggattacaggcatgtgccaccacacccagctaatttttttatttttagtacagatggggtttctccatgttggcccggctggtcttgaattcctgacctcaggtgatccgcccaccttggcctcccaaagtgctgggattacaggcgtgagccaccgcgcccggctctttcttctaatacgatgctgagataatgaagtgagagaaattggggattcattgtgggtggagggggtgggtgagaagggagcacaagaggaaagagaagaggagacccaggaggaagtggggaggtgggaaacatgtgtctctaaccttcagcttcttccaaccctctttgccttctgaacagagcctaaaatgcattcacacaaaaacataaatcacccaaaagccagaaacaaaacatcatgctcaagtagcctgttatcaggaggggcctggagtggaacactatgttgcaagaaccagcacttctgaaacccaagttccaattccagtctgccactgactcatattatagccttggggaaaacatgcagccaatggaaccacatagaacattctaaaggaataattctgaagatacttgaagactgtcgccatcatccagccctcctcccaaggcttcaggtcttcaggctaaataccttccattctttatcagttctttaatttctaatttaccccgattgccctcttctggataagtagcaatctgtcaatgtctcttttcaaggcactatgaatgggacatagattccagctgggtgggtatatcagtccaattctctccttgccatgcactctagacttgtattaatggagattgagtgcggggcctctttggcactttgtcttaccagtactttcctcccatgtggatgcagatccactcagttacacacgcatccatccaacaaggctatcatctactacagactcctccattttctccagaaacaaattcagaaagactttgttaaatgcctggtggaaattcagatatgttatgtgcacagacatatcttgatttacctgtctgcagtcacaatcaaaacaaaaaattgtatttggtctttctgagcttatgttgcctcctgctggttgccatctcttgttccaaatgctcatgaatctttctggtctacgacctggctcaggtcacctccatgcttaccaatctctcattgtcaggacccacctgctttctctaaaaaaaaaggaaaaaaaaaaaacttcttccttacttttggttgtctctagttttccagcatcccctccatttttctgattactgagaggattacatagagcagttcaatcatctcattgcaaaatgcctgattatcctggcatgtaatttttatttatttattttagagatggagtcttactctgtcacccaggctggagtgcagtggtgtaatcatagcttactgcagcctctaacttctgggctcaagagatcctcctgcttcagcctcctgagtagctgggaacataatgggtgctaccacacctggccctggcatgtaattttgtaacatctttcttataaaagacacttctggtagaatttaggttataggtgaagatgcaacataatttttttttttttttttttttttttgagatggagtctcgctccgtcaccaggctggagtgcagtggtgcgatctcagctcactgcaacctccacttcccgggttcaagcaattctcctgtcaggctggagtgcagtggtgcgatctcagctcactgcaacctccacttcctgggttcaagcaattctcctgcctcagcctcccgagtagctgggattacaggcacgtgccaccacgcccagctaatttttgtatttttagtagagacgggtttcaccatgttggtcaggctggtctcgatctcgtgaccgcgtgctccatccgcctcggcctcccagagtgctgggattacaggcgtgagccaccgcacctggcctttttttttttttttttctgagacggagtcttgctctgtcgccaggctagagtgcagtggcgcaatctcagctcactgcaacctccgcctcctgggttcaagtgattctcctgcctcagcctcccgagtagctggaactacaggtgtgtgccaccatgccaagctaatttttatatttttagtagagatggggtttcaccatgttggccaggatgctctcgatctcttgacctcatgatccacccgccttggcctcccaaagtgctgggattataggcatgagccactgcacctggccctaatgtaattttttaatacctttcttataaaagtcactcctggtagaaattaggatataggtgaggctgtaactaagacttgtgataatagagaattggcacagagagaggatctctctgatgcccacacctctgtaacagcccacgtgtaagcagtcctgggctcctatggcagcatcagtgaccaggatcctttgatcttgctgttccatctctagagagttgcttttgcccatatggttcaagatggctcagcagcatcatttcataagcctccttggcagtggaaaggggaaaaagggaggaggaaggcgcaaccctgaacttgcatatgttgcttctatttatatcctataggcaagaacttacacacaggcactgagccgaaaggaagactggaaatgcaatctttattctgagaagtaatatgctcagctaaaagtctgcagttctggttctatgggaaaagagaagacagatattaaagaaaattagcagtctctgccacacttcaacttcctctgtaaatctcttacattccgcattttcccatatctgaaactgtagagtcacttctacttttcctaattcttttttagttactcacaaaatcctatttattttattcttttaatcaattctattttacctcctaaaatatttttatccatccgtttcttcctatattcacaatgatcgacatccagatacagacactcatcagtctttggttttgccagccccaacccagagtccacactggtcatcttccacctgctgggggcttagcaggaaaggatagaggatagctctcccctctggcaagtggcatgggacatagttttctgctgctctcaataccgatgcctatttggcattggactggggatggggaaccaacattcttccttcttagccccctgtcaggaggtataagaaatcactgcttctgccactgcgacatccttcccaggtccagctaattcctactgacattagttcagcctcactccccagagaacagtgctcctctagcttatgtcatctttttccccatcttttgggtgctgtgtttagccattttgtcatttaacaagacaataagagccttttaacttgtgtctctggaaacatcttgtcctcctctcaatcatcctgtgcagagacaaattaatctccttaaaataatgatctcatttttaaaaactctcctacttaaaaatttctaaagggtgggccatttgtcacagcagtggtagcaataagcaaatgcatgttgccttgctcaaggtcatttcactaattgatcaagatactctttccagctcaatgcagatgaagctttagaatcctttcccacagttggcactaccaaccgattagaattggcatggaagatagatcttgtttatcacccttagcctataaaattttttccaaaagttaggcttttgacagtgctctatctctgaacgctttttgtgtgtttcaaaccttgtttatcaatatatgcagggtctatttcctcaaataaaccacacattctttattctggttttcttttccccttaaatgtctgggttctgctcacagagttgtttacagctgtccttggtcaaagaggagatggtgaaggtgctgagggccgagccagtggcagaagaaaagaaggccagaaggaaaatctaaactctcatcaagaaaggcagtaaaaggctgtaagcagaaaactggtaccaggtgtgagatccagggagcgaggcaaggtcaacaaatggaaaaaccagagctcaggagccaaaaggatgggaagcaagtggggttgcagagtgcaagttgggacaaggcaaattgttcatacctaagtgtttcttggagctctcagacctgcctctgtgcagggtcagccattaaacagaactccacatgtaatatgcactcacacatgaataagcaaaaacataaatcaaagtaataccatctaaccctatgttgaaatgccatatcaaacatccattttctagtttccctcagtcttctacacccaagttcatacaaaaatattggcttagcaactttcctttaaattactggttcttctctaaatgtctttaacattgtatttaaaccacagtggaaaagataactcttggtaagtgcagtaataataaaacacatcattttaaaggtggcagatggaaaccagaaagactccatccagggatttttgcagattagattcacatgaagctttagtccccgctctgctcctgctaaagctaagtgatgggcttcttgccacaaccgcctttgcaaaaaataacatcttgctcctaccaagaaagcaggtgacaagctcagcagctgtgctttggtttgtttttctccacagcaggaacatgtgccccggagtgggcattgtttgtggaatcagtaggacagtaaatgcaaaggcaaggagataaagatcagtcaggaaggagaaagtggcacttgggggcagaacgaaacaccaaaaaagccaggtgatggaaacaaagcgaactatcattcgcccaagttaacagaagcaagttgactcaggcaactgtgagaaaagctaagactgtttgcatgcacgtggtgagtcatctaatgtgtaagtcaagctaccagctagaattaatcttgtgcatggaaacaaattcgagtattttgaacatgagctaatgagattgacctgtaggatcacgcagctctaatagctgaataggcatgtcaaggataaaggcaaaagctaggggtgccctcgggaagtgcctttctttgtggcctgtgcattcgctctttgagggatgccggctgagctgaagaagatttgccgcacccatgctgccctcaagttcctctttatttatagtactattccaggtaagatgtcttctggagtacaagtacaaaagctgtgtttatggctctttccattttacaatgaactttcctacaggttgtggaatttagcatgatgggatgaccaagtgctagttgctgttgttgtttagattggtaggggtcatttgttggttattttggcaggccagtgtccatcccacattcctttggtaatagtgcctagttccttcttgggatttgcctcttcccttggagacagtctggtaggactttgatcaagttgtgccactctccctcagtcaaggagcaggcacatgaactggggatctatgggctccctccctacacttttggccttgaccagaaagacaaacagattgaaaaagagtagacccattttaacaaggagtagctcccagaaaagaaagctgggtgttcctgacaccataaagatccataagtgttccctggtgcaaagcctggtgctccagccatttctgagtttggtctctgagcctattgtttttgctgtcctgctgccttccaaaaatctcccgttttgcttaagttagcaagaaagagttggtttctgttacttgcaaccaaagaaccctagctgctacagattcatgtactcaaagtttccactacagatgttcaagggagtggagactactggtaaatccaataagctgattatgtgaatattgattaagaaaacttctacatattttatgagggctattacacaataccatatcttgttttccttacatctccctgacctgaagtctctcttctaatttgttgtttatttcaactcctttatcaaacattccccaagatatagtgaatgggcgatatattacctaaaaccctgattatccacaatatctttcaccctgacagatcttatgggagtagaagggggtggtactttgatttttaaaaataatataaaagatatgtgtatttgactttcaatttataaaatgaaaggtaatcatttgtggaaaacaaaaatatagcaaaagattcaaaaataatgggagaaaaggggccatgtaataataataatgtatcttattgaatcgaagacaatatcagttgttggaaacactattatttaatgtactattaagaagaaaaaattgctaccaatgaatttacggcacactatccgctctaatctaaatttttgtgtatcccaaattcatctgttagatccttctgcccaatttgaggtagagcctttgggaggtgattaagtcaagaagacagaatccccctgagattagtgtccttataaaagagattgcatagagattgcatatgccccttctttctgctccttctgccatataaggttacagtgagaacaaagctgtctgtgaggaagcaggcccttactctgaatctgccagtgccttgatcttggacttcccagcctccggaactgtgagatctaaattgctgttgtttataagccaccctattgtattttgttatagtagattaaacagactaagataccattccaacttcagagatattgcaaaaaggcaaaaaaaaatgttttaaagtgatgaaatttggtaataaaactgatagctcaatgtatggagttctaactaaatggcaggccctgtttatttttttttttatactttaagttctagggtacatgtgcacaatgtgcaggtttgttacatatgtatacatgatggcaggccctgttctaactgttctacatgtattaattcatttaatactaacaatctaatggagtagtatgctatgtaagtatacaggtatgatatacaagtaatatccataattagccaaacaaatggcttagaactaatgtaaattcaaagtggagttattaaaagctttatttgaactgacaaatttatgtttcaatcaaagcaataattaaaattgtgtgagaaagcagtgctctgatttttttttttttttttttttttttgagactcactctgttgcccaggctggagtgcagtggtgaaatctcggctcactgcaacctccacctcctgggctcaagcaattctcatgcctcagactctggagcagctgggactacaggcacccaccaccatgcctggctaacttttgtatttttggtagagacagggtttcatcatgtcagccaggctggtctcaaactcctggcttcaagtgatctgccacctcaggctcccaaagtgctgggattacaggtgtcagccaccatgcccagccttgatgttttcttttatgaaatcaatatcaaaaattgtaaccttgttttttactgaaaaattcattcttagttttgtttcaatccttaaaatttaaaaacaaaatgccattgcttctaagctttgttttctaaatcttgaaaggcccctgggccaaaagcaatcaatattttgcttctttccctgtctctattctaggctgtgtaagtttacagtgttattcagcatttctctaaaggtattttgtggaatactggtgtggagatgttctgttgtaacttgaataaatcccggggcctacgtggccagtctcaacagggttagcattcaaagaaacagttcagtaaccaagtgtgatcactctctttcactttctttcatttctcaaagaatattaaagaagatccaatccataattcctaacttcatttcttaaatttttcttttcctcattcttctccttttacaattgtctcacatctcaaagctttctcaacacctctcttcccccattttttttcactcagctccacaccaaattatcttggacaccctctacctttgcaggatcttctcttttcttcctcttcctgtttctttccatcactttaaatttctttcaagaaagccctgaccctgtctgatgacaatccctcattccagataccctgagtcttccacttctgattagttgaggatgtagagtgaggaccatgagatgaatatcaaattgagggaaaggtgctgagtgaacaatgttagacgttttcattgagggtacaggtcaagaaagaggcaaaccatttgttcatacattaatgatattttgtttctttactttaaaaaatgccctgtggtcatttatattcatgaaaatttactgacacattagtatatcaaaggctctgagaagtcttgcaattaagaatctgaattatctttgttttatctagtatttctcaaacacgtttcaaaatgataattttcatctcccttccccactttacacacgtaagtacccatgaagatgattagggtaaagtggtcttaaataataaaagatataacaaaaacaattgaaagtatatttgtaacatacacatagctttgttggatggatgtttcaatgaggacaacagtagtttgaatgcagtatgcatttttcacataacatggaaagtagtgccattttgctctttgtcttgcagttggaatatgagataacccatgcagaatagctaccaactgagtctgtctggccagcatttacacagatacagttgcacaagtggccctgtacaacagttatccttgaatttgatttgtcaagatggtttgtgttattacctctgtggtatcttgatttaccttgggtagtggccagtcccttaagttaatgttggctattagcccattagctgttacatgagtttactgtcagtgggtgtggagggtatgattatttgccgatggacttgtccacagctagaggtaatatgtacctgggtgtctgaacaagttttcatgagggatcatctagaaacgattggaaaacagcacccgaagccacatgtgctcagtttggcatgcaaaaccttgcatactagattcagtagtgggggcaacaggtgatgaataatttgcaaactggtaaagttttagttggacctgataatattgggaatcttcctatataaagatacagaatattcattattaacaataaaaaaacagacaatagataaacagattttaggcaatctaagaagaaaatttaaatattctggctctttttttttgcctgttttactttggattgttggtatttggagcaatgctggatgccacgactcaaaatcattatcattgcttgagacttataatttgtttaagatttgcaccacttcaacataaatggctggttttactaacattccacctgaaattctgtatacttccatggacatcttaaaaaaatacatatccacaaatttgctcagcttaaggaaaaattggaaaaaacttagatgccctaaaatagggaatcctttattatattacattcatatatggtaaccattagtgctgtccaccaaatatttccaattctcctgctggacacatagtaggatttcatttctttcccaccttagcttaagtgaggccatgtgactagctttagccaaggaaatgtgaaaggaaatacaatgtggcatccaggcagaaactttaagagccaatgtatcaccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggctttaccattcaggacataggcacgggcaaggacctcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacatttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggaaaggatgtggagaaataggaacacttttatgctgttggtgggactgtaaactagttcaaccattgtggaagtcagcgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatttggcacatacacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagatcacatggacacaggaaggggaatatcacactctggggactgtggtggggtggggggaggggggagggatagcactgggagatatacctaatgctagatgatgagttagtgggtgcagcgcaccagcatggcacgtgtatacatatgtaactaacctgcacaatgtgcacacgtaccctaaaacttaaagtataattaaaaaaaaaaaaaagagccaatgtataattttttttcccatggtcagtttttcttctacctgggtcctggagtgagaacattatgtcacagagccgatccctaactgatctgcaattgacacatagagtgggcaagaaattaaaaattgttttatgtcactgagattttggggttatttgttactacagcttaacccagaccattctggctgataggccacaatgggacactaaacagttcacgaaaattacatagtagaaaaatgtcagatgataaaggacagatacaggttatatattcagtaaaaattgcaagttttaaacaagtattggttaatcattgaaaaatacatatgaaatggagtttcctgggatagactggatctttagaattctgaagctgaaaataattcaatgaaaaaacgtgtctttggtaagtgtccatcaacatacggataagcaaaatatggcgtatacatgcaatagaacattattcagtcttagaaaagaaaatctgacatgctacaacatatgaggacattatgttaagtgaaataaaccagtcacaaaaagataaatgttgtataattccacttatatgaggtataagtgtagtcaaaaccacatagacagaaagtagaatgatgcatgccagggactggaggagacggaaatggagagttggtgtttaatgagtatagagtttcagttttacaagatgtgaagaggaaaacaaatcattcccttttcctgggcttgggagagggctttgggtctctcctgcatgaaatggagaagcctgatgattcctggtgttgaagagtaagctcaccctggcctcagagatgtcagttggtggttgggtgggagccagcctcaacctatgattctaagattagtgtgggggctgaggcccttggtcccctaaaggtttgttgtaagatcactaacatgaagcagattgatgaataggagaaaaggcacacacatttatttcacatgtatacatgggaggcttcagaatgaagacccaaagaaacaaggaaaattgtccatttttatgcttaggttcaacaaggtatggacagccacgtagaaatatgattggacaaaaagggtctgatctactgtgaatagactgagcagggagactccacaaggcctgtctgttcaggttcttcttggtctccctgtgtagctttccttccttctgggtatggggacttttaccctctctggaatgggggctctctgcaatgggtgtcttctgacctacagtcaaacaaggtaggtcagatcatttatttctggcccgtttttgtatggaatatttttaggtgttttggctggctttcaggaaaaggggttctggtttctatgcctcgccttgggggaagagggattctagtttttatggctaggcttgggttgcaggggagggcgggagaagatcagagaaaaacttttgcttccgtggctgctctgaggccttcattttggtgtacagttttttcagccccagcattagccatttggtctgggagctggagggcctgtgttgccgtttagagggaagagccaaggaaagagtgtgtcccttcccaaggctctcatggatgtatgaggaccagtcaacagcgaagggtggctgactgtgacagagccagcaagagaggattcagtcacagagaaaaaaatgcaggcccccagccagggtcctcccgcaaagtatgacaattcagaactactggggatgatacagacaacattcagcctccagtgtgtgttcctgtctctccctctagaggacagttctcgctctcaaagtgcgctcggtgtgtcgtgtcgccatggtaaaaaggcaggagacagcaaacgcttgatccgagctgcaccatgcctcgttttcactctccctgaagacaaaagaaggtggcaagtaaggaaagctcaccccagggagttttctcggagaacacaagcggtcccaacagggtaaaggagaaaataattatctggaaaggttgcaattaatagtatcaggtttaacctttgtgctaatatgggaatctaaggcactaagtcatcgcctaagacctagtgctctctgtacgacaaagctttagtcttataatgtggaagtcagtgcttattacatccaatgcctgagttcccagcggacagagttccttctcaggcagccggccaaggacaccagaaattaagcaggggtctgtggctctgccgtctagctatgaccaaatttaaatttgtgctttttgccttgcctgccagtgaacctgctgctagactgagatgtaaatgccatttctggtgtacattaagaaaatgtgaaacaattagctcaaagccgtggttatggagcaaaaatattaaaaatataagttagaaaatccttgtgacaatgttcatgtgaatggtgagggtagggagtccattgcatatatgtgtgtgcatgtgtggaggagtacgtgtgttgaataaatatgcataaagagtgcatcagcagtagatccaagaacttatgtatgggggtgggtgtggaaatccacattttagtaacattttttccttcttcacagtcaagtgacgtttcttcaaacatctgttctgtgagcaaagtagggagggacgtacatcagtgttaagtgcttgggagaggaattctggaggaacactacccacttaatttagctcagctctatgaaagattgcagggtttgggactatttctagccacatctgagagtctgtgaaaagtggaagtaaagtcattaagcggaatgggcatttatacatttggtaatttgtcttgagtcagaaagtctagacactcccctgggaatggggggaatgtgggccatggttatgaccttcaggactctggaaacaggaatgacaaagacctggaaggtcctgaggcaaatgggctcaatagatctttttttttatttgaaacagagtgcagtggcacaatcttggctcactgcactctccgcctcccagattcaagcgattcagctacctcctgagtagctgggattacaggcacacaccaccacgcctggctagttttgtatttttagtagagacggggtttcaccatgttgcccaggctggtctcgaactcccaggctcaggctaaccacgtgcctcggcctcccaaagtgctaggattacaggcgtgagccaccacacccaccttcttggtgaaggcacataaagcaaaatgaaagcccactggtctggtgttcagacacaagccaggcctcacccgacttggagacaggcagccccagccagcaagagagttacagacctcagctagatctggggaccaccagtttcctaccagggcaacctgagaatgtactctctctgtgccgcaactctttcccctctcaaataggcacaaccattgtaacaaccagaagagctaacatggatgaagaacttcccgcgtaccaggcaccataataaatgctagatccatgtactcttcttgataatcctacaatgtagtattattatatttcattgattctaagatgttcttttttttatattttaacattctctgttatcaggatgaataattgataagaaagcctgtaagtcatggttaaatttttttttaagagacagggtcttgctatgttttccagtctggttttaaactcctggcctcaagtgattctgctgcttcagcttcccaaaatgctgggattacaggcataagtcaccgcacccagccagtcatgattaaatttatacttttaaatcttttttagtgatatataaattgatgatgtgttagattcagtgaggaaactgaggcagagatttgaaaactgaggcacaggtgggctgaataactcgcctaagttcacacagttagaaagtggtagaatgagagtttgactcaatgctgtttctagagttgactttcttctaaggtgctagacttcctggtccctccacttaccagctgtgtgatctcaggcaaattcctaacctccctgtgcctctgggattttttcatctgtgaaatggtgataataatattagcaacggcttcataggattgttgtggaggttaaacaagtttacatatgtaaagttctgaaaatagtgcccgacatatggcaagtattcaataaactttagctacaattactttttcttcttctaaagagaaaaccagcatcacttgttacgtatagaagacaactggaaaaaagagggttgtaactagcaaaaggagaataagttcatctctgtgtccctaaaatcgtcttggccccaggacaggtatgcttaccatattttgggaaatggctttttgttctatctctcaaaaattgagagatcaagtgaaagcgagatgggggaaagtggctgagagggagtggctgtgagaggtgaggagggaaggacaaacagaaggacaaggtagggcagcagatctggggctgccctgggtttgcttcagaaggtgggaacagcatggtgcttatgctggggtggccatagcagttggaaggagctatactgactggaatgaaaaagagtttcaatctgcaggttgcaattcattagtaagttatgggatgaacttggtgggtcacaatcagtatctttaaaactataggagcagaggccaggtgtgatagctcacacctttaatcccagcactttgggaggccaaggcgggcctgatcatctgaggtcaggagtttgaaaatagcctggccaacatggtgaaaccccatctctactaaaaatatttttaaaaatcagccaggagtggtggtacacacctgtaatcccagctacttgggaggctgaggcaccagaatcgcttgaacccgggaggcagagtttgcagtgagccgagattgcaccactgcactccagcctgggcaacagaatgagaccctgtctcaaaaaaacaaacaacaaaaacaaaaaaaatacaagggaaggcaggggaatgcaagggaaggcaaagtaaatatcagaggatatcatatgtaataacaatacatattgttttattgaacttgtatctcagttaagagtgtatagatgtgtgtaatgggttgagatgtaaaaggttctccgtgggtctcagtgcaaaagtttggaagccactggactaaagcaaagataagattaggtgttggctgaaaaataaatatacagtataaatttaaagtaatatgttttatattaacaaccagggacccctgctttctagtgtagctttctagaagcattcagggaccgtgacacaccacatgacatctgtaaaacactctccctttctgcacctcttggccttggggaaactactcacccccgacaccacccctcaaccctgcccagatcctgggctgactttgactttgcctctccttggctcagccactttgccttagacccaattcctgtccctctctcctgcatctttccagatgtccaggataagggccagcttttgttgatccacacagcctgggactccacacaggaacctagtcacctccagaggctgagctgtcctcttttgtgttttatgtaagtgttcttgaaatatatatgacaaggaatgacagtgaattggagaagtaacactccccagtagtgatagcagctcaaactcatgtggggcctgagtctgaataggctccaaatcatgggttgggtgatggatcctaaaccaagaattatggctcagattggaaccaggtaaaacagctctgaaagaatagatctagcttcatttatactaaaaagtaaacagaggcaagtattaaatctgaatcaagttaacattgtttaaaacatacacatgcggccaggtgcggtggctcatgcctgtaatcccagcactttgggaggctgaggcgggtggatcacctgaggtcaggagtttgagaccagcctgaccaacagggtgaaaccccatccctactaaaaatacaaaaattaaccaggcatggtggtgggtgcctgtaatcccaactactcaggaggttgaggcacgagaattgcttgaacccaggggactgaggttgcaggtgagcggagatcgcaccactgcacttcctcctgggtgacagagcgaaaaaaaaagcacacatgcaaatttcagaataatgggatcaaaatgccttccaaaaatttcggaagctttttctctgacaatactgaacaaggccaagtccaagtggtatgaagcaactctcaataagatgcctggcacaggaccagccgttgcttccttcctaatgtctatactcatcaagccacatgaacttgtggcttgatacttgaataactatttttaaattatttttgacctgcaggtaaaacaataactggaaatcgtcagtttgcatcatagggaggtccccagaagaaaaagaagtcaaatcttatcaatatgtaaaaatggaggtgatcagcctgttttgcaaaagataaatgaaacatagacattagcagactcattataattcattaaaattatctcaaggttaaagaaaagacaaaacctgggcatcattgaacatgataaagacttcacatgcaagaattcccataatgaaggcatttaaaacacagctactacatttgtaaacttatgttgtttgcaattcaagtataccttattattcagtggcttctttttggtcactattacataagtaactttttcattaactatttattcttcttattaatagaatatatccctcacttttaattcatttttgaactgatttttatataaccttttacaaatttcccagaatttttagaaacctaactattgaataaattgagacatgaatatattacctcttaagtcttgtagaaaaccaggtcaaagttggcaggagacaggagaagaggttggccaaatccctggggtctaaaagggataaacagcaaattggttttatcctgaggctctgtacccaggacctgagcttagaggaggcccaatttcttcacagccattcctcaaaagcattcctggaactccctacttgtaagctcctttagggcttgtgcacattctctgggattttcttggaagtagccaaccttcattcttttcaaaatggccaaaagtcagttggatttagatctggtggatcaggtcaaatgcatttaaacaagctatgactttgaagtgacaagtctgtctttctcatttagttcataaacagaccgtgtaggaataaacacatcagttccttaagggacatggaaaattgtgtggtgggtggggaataactaacagaattattaatcttaatggcatgcagccatgattagagctaataaagttgatgccaaagcttgactttaatgtttaacaacaaggaaaaattaaagataaggaataaattctatctcttctaataagagctagattccaggacaatcaaaaattccaaggagaagaaccgagagccagaaagatctcccagaaatgttcccttctgtaggtaattcctcttccctctcaggattgaaaaataaccaacctaaactggggaagggcgatggaaaaaggaaagaaaagttcagccctttctttgttgatgcaaatcacatgtataatatcaaaaattagaaaataaagccactcgtaagcctggcatggagagataaaccctgttaatatgtttgggcatattgccttcaaaatgctgatatataacatatttgtgtaattctgtatttacttatatatgtacatataagtagacatacacacataaaatatatttttcttttagatggtatgctatggatgctttttagtaattttgctttctgttaataaaatgaatattttacatgtcaacaaatatatacttattttataattttagatggctacttcacagtattttcatgaatagatcataatttatttaatcgaagcctaattttgaacatttacatttttataagtgtttatttactgtttataaatgctaaggtatccctattcaggcatacagctttaagcatttgctcaatttcttcctccccatggtggaagaaggtctccttgctatggtccgaatatttgtgtccctccaaaattcatatattgaaacctaacctgcaggtgacagtatcaggaggtggggcttttgggaagtgattaggtcaggaaggtggagcctcatgattggaattagcaaccatagaaaaagagacaccatgtgaggtcagagcaaaaagggtaggctgcctatgcagtagtaagcaggccctcatcagactctgctggcaccttgatcttacacttcccagcctccagaatggtgagaaataaacttctgttgtttataagctacccagtgttttgttatagcagcccaaatggactaaggcactcctgatataaatcaaacattgaaaattgtaaaataggaagtcctagccagagcaattaggcaagagaaataaataaaaggcatctaaataggaaaagaagaagtcaaactatctctctttgctgatgatatgattccatacatagaaaaccctaaagactctgccaacaggccccggaactgataaatgacttcagtaaagtttcaggatacaaaatcaatgtacaaaaagcagtaacatttctcttcaccaataacattcaagctgcgagccaaatcaagaatgcaattccatttacaataaccacacacacacaaaatatacctaggaatacaactaaccaatgaggtgaaagatctctatcgtgagaactacaaaacaccactgaaagaaatcagataacacaagcaaatggaaagatactttccatgctgatggattggaagaatcaatattgttaaaaaggccgtactgctcaaagcaatctacagattcaatgctattcctatcaaactaacatcgtttttcacagaactagaaaaaatgattccaaaattcatatggagctaaaaaagagcccaaacagccaaagcaatcctaagcaaaaggaacaaagttggaagcatcacattacctgacctcaaactatactataaaggtacagtaaccaaaacagtatggtactggtacaaaaacagacacacagaccaatggaatagaatagataacccagaaataaagccacacacctatagccatctggtctttgacaaagtcaacaaaaataagcaataaggaaatgacttattattcaataaacagtgctgggataacaggctagccatatgcagaagaatgaaactggacttctacctttcaccatgtacaaaaattaactcaaaatggattaaagatttaaatataagacttcaaactacaagaatcctagaaaaaaaactaggaaacaccattctgggcatcacccttaggaaagaatttatgactatgccctcaaaagcaattgcaacaaaaacaaaaattgataagtggaacctaattaaaataaagagcttctgcacagcaaaaagaaactattgacagactaaacagacaacctacagaattggagaaaatattcacaaaccaggcatctgacaaaggtctaatattcaaaatctatatggaacttaaacaactaaacaagcaaaaacagataaccccattaaaagtggacaaaagacatgaacagacatttctcaaaaggagacatacaagcagccaacaaacatatgaaaaaaatgctcaatatcactaatcatcagataaatgcaaatcaaaaccacaatgagataccatctcacaccagtcagaatggctattattaaaaagtcaataggtaacagattgtggagggctgtggagaaaaggaaacacttatatgttgttagttggaatgtaaagggaatgcttacacactgttggtgggaatgtaaattagttcagccacagtggaaagcagtttggagatttctccaagaactaaaaacagaattaacatttgacccagcaatcccattactggatatatatgcaaaagaaaataaattgttctaccaaaaagacacatgcaccttatgttaattgcagcactattcataatagcaaagacatggaatcaaccaaggtgcccatcaatgatggattagacaaagaaaatgtggtacatacacaccatggaataccatgcagccataaaaaaggaagaaatcatgtcctttgcatcaacatggatgcagttggaggccattattctaagcagaataatatagaaaaacaaaaaccaaataccacatgttctcacttaaaagtgggaactaaacattggatactcatggacgtaaagatagcagcaaaagaaactggggactattgtggggagggggaaggagaaaaagggttgaaaaactaactattgggtactaatgctcagtatctggatgaagggatcatttgtacccccacactcaacatcatgtaatacattcaggtaacaaacctgcacatgtaccacctgaatctgaaataaaagttgaaatttaaaaaaaagaaaattgcaaaataataaatacattaaggaaaaatgtaaaagccacctttctgagaaaacaacatttcagtgaccatttttccatgtaactctttctgcattatgtacacataggcataatatatgtgtgtgtgtatgtgtgtgtgtgcatgctcatttatgtgtgtttttatacccacacaagatttaagggggacatttttaaagggattggtgatatataattctctgtatcttaacaatatataatggaaattcctcaagatcaggtagtataggtaattaatttttaattcttggataaaattctactgtaagcattattatcattcagctattcttttactaatagagttttgatttgctatcaactttttgttattaaaaataatgctgcagtacatacacactcacacacacacacttatatatactggggcttttatttctatagtatagagtcccaggattgagattctgggttgaattgcaagtgcatttaaatttttaatagagatcacgaattgctttttcacatttctaccagtgatatatgaaagtgcccttgccctgactcccatctctgctaataataggtgcagttactctttgatttttgccactctgatggctatgatcatggtaattttcatttccctttctctgcctattggaggagattgaacattttatcatacttgctcttctgccaattgcctattcatatccccaacctattttgctattgggttgattatctttatcttattaaattgtgacatagctttttttatatatagatgcaaatttttatctatcatttgatttatattttttccagcttgtttacctactgattttgtttttggtatctcttgcactacaaataataccttgaagttttataaaggttaggttgatcacctacctttgtttaaaatatttctttaattcttaggtgtacagataataacctaattttttataaaatggttatttatttatttttactttcaagtcaaattcattaggaatttacttcataattaatataaactagggggtccacatttattttcttccaagagcatatccaattgtgatgagattattaattaaatttccccacaatgatataatgaagtatcatcttcatgaggtattacacaattctgagatctctttattattattttttactgatttttttggtagtcttgtgcctatattgtactgttttattatactggcttttaagtagttttaatactgtcattctttttgtttttgagacagagtctcaatctgtcacccaggctggagtgcaatggtgtgatctcagctcactgaaacctctgcctcctgggttcaaacgattctcctgcctcagcctcctgagtagcctgccaccaccctaggctaatttttgtatttttaatagagatgggctttcacatgttggccaggctaatactatcattctttattcatcaatttgaatattttatccaattaaaactgccagagattctatggaagttgtactgaatttatatactattttcaggagaacagctctatttatgagaaaaagtgtcacttttcaagaacgtggtgtaaatttctaattgttcagatcccatttttgtcctccagtacgattttattttttacatgggtcctattcctttgtcatataatttattcctattttatgatttttgttactattatgaatggaatagtttcctcattttcgtttgtatgtgggtatggcttatatagaaaaagctaatcatactatatctttatgttgtatctacccaatccatcaaattctttcttttacttctatttactttttttactagagtttcttgatgatatcaggtataaaattatattgtcagcaaaaagtttcacctctttctttccatatttatgctgtgcatattaggtttattgcatttactaaaatatctaaacaatattaaataataatagtaaaagtaggtgtgatttgtaaactatatatttggtcttcatcctgttttctggcatacaactcctaaaatccttggaatccccaaagtgataaatgtctttttgtatgctaataagttgactggtggctggcagcccctagatagcttcatgatgggggctggtcaccagaaaaaccaatggtcaattagagagtggggactttgcaaccctgctcctttgccaaaatgcacttcaaaacattttgcatttataactaacatttgggatttatttaatgcaaatctaatagtattcaggattagccagttataatcagactggtaagataattttcagctctttttttatatatactttaagttctgggttacgtgtgcagaacatgcagttttgttacataggtatacacgtgccatagtggtttgctgcacccatcaatccgtcacctacattaggtatttctcctaattttatccctcccctagctccccaccccctataggtccctgtgtgtgatgtccccctccctgtgtccatgtgttctcattgttcaactcctacttatgagtgagaacatgcggtgtttgattttctgatcttgtggtagtttgctgagaatgatggtttccagcttcatccatgtccctgcaaaggacatgaactcctcctttttatggctgcatagtattccatggtgtatatgtgccacattttcttaatccagtctatcattgatggacatttaggttggtttcaagtctctgctattgtgaatagtgctgcaataaacaaacatgatttacaatcctttgggtatatgcccagtaatgggattgctgggtcaaatgctatttctagttctagatccttgaggaattgccacactgtcttccacaatggttgaactaatttacactcccaccaacagtgtaaaagggttcctatttttctacaacctctccagcatctgttgtttcctgaatttttaaagatcaccattctaactggtgtgagatggtatctcattgtggttttgatttgcatttctctaacgaccagggatgatgagcattttttcatatgtctgttggtggcataaatatcttcttttgagaagtgtctgttcatgttctttgcccattttttgatggggttgtttgcttttttttttttttttttttggaaacttgtttaagttctttgtagattctggatattagcctcttgtcagatggatagattgcaaaaattttctcccattctgtaggttgcctcttcactctgatgatagtttctttgctatgcagaagctctttagtttaattagatcccgtttgtcaatttcggcttttgttgccattgcttttggtgttttagacataaagtctttgctcatgcctatgtcctgaatggtattgcccagattttcttctaggatttttatggtcctaggtcttatgtttaagtctttgatccatcttgaggtgattttcgtataaggtataaggaaggggtccagtttcagttttctgcctatggctagccagttttcccaacaccatttgttaaataaggaatcttttccccattgcttgtgtgtgtcaggtttgtcaaagatgagatggtggtagatgtgtggtgttatttctgttcctttggcccatatctctgttttggtaccagaaccatgctgttttggttactgttgccttgtagtaaagtttgaagtcaggtagcatgatgcctccagctttgttcttcttacccaggattgtcttggctatgcaggctcttttttagttccatatgaagtttaaagtagttttttccagttctgtgaagaaagtcagtggtagcttgatggggatagcattaaatctataaattactttgggcagtaaggccattttcacaatattgattcttcctatccatgagcatggaatgtttttccatatgtttgtgtcctctcatatttccttgagcagtggtttgtagttctccttgaagaggtccttcacatcccttgtaagttggattcctagatattttattctcttagtagcaattgtgaatgggagttcactcatgatttgactctctgtttgtctgttatcggtgtataggaatgcttgtgatttttgcacattgattttgtatcctgagactttgctgtagttgcttatcagcttaaggagattttaggatgagatgatggggttttctaaatatacaatcatgtcatctgcaaacagagacaatttgacttcctctcttcctattcaaatacctttattgctttctcttgccctggccagaacttccaatactatgttgaataggagtggtgagagagggcatccctgtcttgtgccagttgtcaaagggaatgcttccagtttttgcccattcagtatgatattggctgtgggtttgtcttaaatagctcttattatgttgagatacattccattaatacctggtttattgagagtttttagcatgcagggctgttgaattttgtcgaaggcctttcctgcatctgttgagataatcttgtgctttttgtcattggttctgtttacgtgatggattatgtttattgatttgcatatgttgaaccagccttgcgtcccagggatgaagcccacttgatcatggtggataagctttttgatgtgctgctggatttggtttgccagtatttcattgaggattttcacaccaatgttcatcagggatattgacctaaatttctctttttttgtgtgtctctgccaggctttggtatcaggataatgctggactcataaaatgagttggggatgattacctctttttgtattgatcagaatagtttcagaagaaatgctacaatctcctttttgtacctctggtggaattaggctgtgaatccctctggtcctggacttgttttggttggtaggctattaattattgcctcaatttcagaacctgttattggtctattcagagattcaacttcttcctggtttagtcttgggagggtgtatgtgtctaggaatttatccatttcttctagattttctagtttatttgcatagaggtgtttatagtattctttgatggtagtttgtatttctgtgggatcggtggtgatatcccctttatcattttttattgcatctgtttgattcttttcacttttcttctttattagtcttgctagtggtctatcaattttgttgatcttttcaaaaaaccagctcctggattcattgatttttttgaagttttttttttttgtgtctctatctccttcacttctgctctgatcttagttatttcctgtcttctgctagcttttgaatttgtttgttcttgcttctctagttcttttaattgtgatgttagggtgtcgattttaggtctctcctgttttctcttgtggacacttagtgctataaatttccctctatacactactttaaatgtgtcccagagattctagtacattgtgtctttgttctcattggtttcaaagaacatctttattttgccttcattttgttatttatgcagtagtcatttaggagcaggttgttctgtttccatgtagttgtgcggttttgagtgagatttttaatcctgagttctactttgattgcactgtggtctgagagacagtttgttgtgatttctattcttttacatttgctgaggagtgttttacttccaactatgtggtcgattttagaataagtgtgatgtggtgatgagaagaatgcatattctgttgatttggggagaagagtcctatagatgtctcttaggtccacttggggcagagctgagttcaaatcctggatatccttgttaattttctgtctcattgatctaatattgacagtggggtgttaaagtctcccactattattattgtgtgggagtctaagtctctttgtaggtctctaaggacttgctttatgaatctgggtgctcctgtattgggtgcatatatatttaggatagttagctctttttgttgaattgatccctttaccattatgtaatggccttctttgtctcttttgatctttgttggtttaaagtttgttttatcagagaccaggattacaactcctgctattttttgctttccatttgcttggtaaatcttcctccatccctttattttgagactatgtgtgtctttgcatgtgagatgggtcttctgaatacagcacaccaatgggtcttgactctttatctgattttccagtctgtgtattttaattggggcatttagcccatttatatttaaggttaatattgttatgtgtgaatttgatcctgtcattattatgctagctggttattttgcctgttaattgatgcagtttcttcatagcatcgatggtcattataattttggcctgtttttgcagtggctgatactggtcgttcctttccatgtttagtgcttccttcaggagctcttgtaaagcaggcctggtggtgacaaaatctctcagcatttgcttgtctataaaggattttatttctccttgacttatgaagcttagtttggctggatatgaaattatgggttaaaaattcttttccttaagaatgtttaatattggccccaactctcttctggcttgtagggtttctgcagagagatccacttagtctgatgggcttccctttgtgggtaacccgacctttctttctggctgcccttaacattttttccttcatttcaaccttggtgaatctgataattatgtgtcttggagttgctcttctcaaggagtatctttgtggtgttctctgtatttcctgaatttgaatgttggcctgccttgctaggttggggaagttctcctggataatatcctgaagagtgttttctaacttggttctgttctccctgtcagtttcaggtacaccaatcaaatgtagatttggtcttttcacatagtcccatatttcttggaggctttgttcgtttcttttcactcttttttctctaatcttgtcttctcactttatttcattaatttgatcttcaatcactgatatccttttttccgcttgattgatttggctattgaagcttatgtatgcttcacgaagttcttgtactgtggttttcagctccatctggtcatttaagctcttctctacactgtttattctagttagctattcatctaaccttttttcaaggtttttagcttccttgcgatgggttagaacatgctcctttagctcagataagtttgttattcctgaccttctgaagcctacttgtgtcaacttgtcaaactcactctccatccagttttgttcccttgctggtgaagagttgtgttcctttggaggagaagaggctttccagtttttggaattttcagcctttctgctctggtttctccccatctttgtggttttatctacctttggtctttgatgttggtggcctacagatggggttttggtgtggatgtcctttttgttgatgttgatgctattcctttctgtttgttagttttccttctaacagacaggcccctcagctgcaggtctgttcgagtttgctgaaggtccactccagaccctgttttcctgggtatcaccagcgaaggctgcagaacgacaaatattgctgcctgatcctccctctggaagcttcatctcagagtggcacccaactgtatgaggtgtctgttggcccctactggaggtgtctcccagtcaggctacacaggggtcagggacccacttgaggaggcagtctgtccgttattggagctcaaacgccatgctgggagaactactgctctcttcagagctgtcaggcagggatgtttaagtctgaagaagctgtctgctgccttttgttctgctatgccctgcccccagaggtggaatctagagaggcagtaggccttgctgagctgtggtgggctccgcccagtttgagcttccttgccactttgtttacactgtgagcatagaaccacctactcaagcatcagcaatagcggatgcccctcccccccgccaaactcctgtgtcccaggtcgatctcagactgctatgctagcagcaaccaaggctctgtggccgtgggacccaccgagccaggcatgggaggggatctcctggtctgctggttgcaaagaccatgggaaaagcacttgggcaggagggtactgctcctctaggtacagtcattcacagcttcccttggctaggaaagggaaatcccccgaccccttgtgcttcccaggtgaggcaatgtcctgccctgcttcagctcaccctccatgggctacacccactgtccaacctgtcccagtgagaagaactaggtacctcagttggaaatgcagaaatcacccttcttctgcttcgatctcgctgggagctgtagataggagctgttcctattcggccatcttggaagcaactgataatgttcttttccgattcagcttcagtttggttattaaattatgctagtttcatatgaattgggaaatttttaatgtttacatttatgaattacgatttaccagaattctctattcttaaagctagctaaaactcaggtttgaaattacctgatcctgaggcctctaacacaatagtgtattaactatctatcccaaactttttgtgacaaatgatctcttaaaattttctactacttaggccacttttgagaacttaaaatttataagagaatcctttgtgtattataggttttcaaatttattgtcaaagagttgcacgtacattttattataatattttttattttgagagcttgtttggaggtttgagcagggaaacacagctactcatatacccttaacctaagtccttctcgatcaggaatggtcatcatcttcaactgagcatgcagctttgggaaggaagcacatggagtggtgagggaggaatgggacacctgcctagccagcctgatcagcagccctggcaatcagtgggtgatggatgtcccagaaagttcaccctcacatccaccttttttattttgtatctgtgattatgtctttttgttcattccaaatgtgcaaatttttatacttttttcataatcactcctgtgatttacatatttatttcattgatcaagaagtagcttttgaatttagttcaccttttactattattttattttctgatcattaatttcagcttttttctttataactttcatttttagcttatttccttgttcagattttaattttttaagaaaagtactaccattttgtaaatgttcgtcttcttaaatagcagagataattgcaactataagtttttctttatcagtctttcatgtcttatggtgtaaatggactcattttcattactttctatttatagaaatttataatatatattttgtcactgctccacactatttatcttcagacacataaagttatggttctatattctctttttggttgatctcacctactgctatgatttaagctaccacttttaagctgatggtttccaaattttccagaagctgcaggctctgatatctaccttgcctcgtgtatataactggctcaatatgcttaaacttgtcaacgtttccccaaatcagcaataactatatatttttctcaattatttgtatcattatccacctagtcactcaagttagaaatagaaatcatctttcaactctgccttgcccctcacacccatatcctaccaaacaccaaatcctgatgactttaccttctgtataaagtttatcttctgctgttgctgccccagttttaaccctcatcatttatggtaggttatttcaaaggtgcacctttgatcaaggacttttccaacacaaaccctacacagcctacaaggctctttatattccctgctgaaaagaaaagcaactaccaacataaataacagtgtgaaccatttaatgagttattctattaatgtgcttttgtattaaaaaaagatatgtaaagcactgggtagagaaaatgactaaaatttattctctatctcctgtgagcctagtcttgtgctacggtgttatcatcttatctcatttaatattataatatgcttgtgggttgggcagttaggaatgctttcagctgcaagtatcagaaaatctcactgatggtagtgtaaatcataaagacagttcattctcttctgttacaaaagtccagaagttggtgtttccagctcaaccatgccatcgaagactcctaaactctatttttccttttgctgtacttaacacattgctttctcaaccttatgcctgtttctttgtagaagcatgagggctaatgaagctctagctttcacagggaaaagagaaaacaggtgttgctggtgtgctctctttctgagtctggccccttgacaaggaagcaaaagttcctccagaagcctccaacaggtttctatttacatctgaatggctagactaggccacctggctcctcccagttgcatgggagatgagagagcaaagacttagggtttccagtctctatggtgaatggcaatcagggagagggggaatgggagtggctaccagatgagcccaggatagagacttcacatctgcgattgtagatgtggtcaaagatgcccgaagggctactgctggtaattggtggaacgtggattgggaattaagttctgtttccaaagttaatgctgtcttctctataccactcagtctctccaaatacactttctaagaatagaatttcagatatttagacatgatttgagtgacatttcttggcacctgctgatttctccaaaatcacacaataatatgttctcagacattggatagaattatgctagaatgttctaaagatgaaaccaccctcttacttctttgatgaagccacatgtaaactgtgttccttttgtaaactgaaacattagggactatactaaacttgtcttagattgactttaaagtatagaacttaaaaagaaaccacattcaaagtatttaaacttgtatggtatgctttctctgacctttagatccccagttgggaatccttgccaaatttaatcttttagttgtgaataagcttttgaacacagtcatcctgacctttggacatgtcaccttgcctaatgaatagcttgtcacttaattaataatgatggttaaacctcctctaatatattggagaaaaaagttttaaatactcactttacagttattcatttcaacacagaattcataaggagggaaggtctgcacatgaaactttatatcttatactccttttctctttgacttaataaatgagaatccacaaggcaaaggttcaatgttttgctgctgtaaaaaagatttaaaccttttactagttactgtgtcacaattgtgaccttacaatgagaagattatgactttgggtcataagaagtggaggaagtacatatataaacagtaaaaacataaatgtgtactaattctgacctcattggaaatcattctttcctaacagtaattttcagttccacctgctgaaactcattttctataaaaatgaagccacaggcaacttaatagtcaaggttacaataaaaaggggtctcaaaaacatgtcattggtgaacaatttttttttgcaaatctcaaatctttttcttttgaagctaaccaatcttgaccattaaaatggactaaaaagacctgcatccaccatcaaagactggatgatcaagaacattcatgtcactctcttagcaccattaggttaaaaattgctatattgtttccagacttcctgatagttttaatgatgtcttcatttttcttttaaatgtagacagccaattttcctatgatgggagcatattactactggcgaaataagacatcttgcatagaaatgtttgatgtctttgaacaagggacagccatttctttacacagtcttcccaaaagcatttgaaagacttgcatttctgctgctacatgagttttcagaaaagaaaaaatgttagcaaaaacaattatgtatatttataacaatatagattagatgtatatatgtaatcttgagaccctctgtaatttatgttcatagataaaagaaatacatcacagaggcaaaccctcaacattcttcaaatttagtttatgctacaacaagtgttgctatagaaacattaaatccccaacagaattcctggaagttaaagatctgcctgtagacttgcttccagatgctgacttgctggcttgttaaataaaacttggcatttatcatatgggagattttatctcgaaacatactatgaggactacctgggacattgagtgccgtgctcacaatgggagaagggtttatataatcagaaggagtctcaggacttcagatgtaatgcctattagcctgatcatttttcctctttctccatcaatattccctataaataagcagctctaaaataggaaactccctaaatgaccagatgatggaaaatcactttattaataaaaatttttcatctgtgttaagcaggttaagtctttctggataccagtgagaaaatcacgttttcctatagacattttgcagcttctctttaagagcaatttccccctggtaattatacagcagtttgctctcagaaaacagactgattaatgaggaagcagctaaatgagttctttaaaaatgtctaaaaatgttcttgcttctgcttttctaatcttcctcaaccaaattgacagctttttaaaagaatctccttagtgaatgcatgacaattacattggaactcaaagaattaccacaagccttagtttaagaagacattttaaatcataagagtattcattaaaaggccatctgtcagatgttctccatcactgacatcacccacatctctaccttcttctcttcctgttattttaacctcatttgacttttttgactgctttggaagaaaatcagcctttcttggccaggtgcagtggctaatgcctgtaattccagcattttgggaggccaaggtgagaggatcacttgagatcaggagtttgaggctgcagtgagctatagtcactccactgtactcctgcctaggcaacagagtgagactctgtcagaaagaagaagaagagaagaggagaggggaggggagggggagggagggagagagggagtaaggaaggaaggaaggaatgaaggaaggaaggaaggaaggaaaaagaaagagagagaaagaaggaaagaaagagagagggaaagaaagagagaaagaaggaaagagagagagaaagagagagaaagaagaaagaaagaaaagaaagaaagagagaaagaaagaaaaagaaaagaaaagaatagagaaagaagagaagaggctgggcacagtggctaacacctgtaaacccagcactttgggaggccgaggcgggtggatcacctgaggtcaggagttcaagaccagcctggccaacatgaagaaattccatctctactagaaaatacaaaaattagccaggcatggtggcaggcacctgtagttccagctacttgggaggctgagacaggagaatcacttgaacctgggagatggaggttgcagtgagctgagatggcaccactgcactccagtctaggcaacagagtgagactccaagaaagaaagaaagaaggaaagaaagagagagaggggaaggaaggaaggaaggagagagagagaaagaaagaaagaagagaaagaaaaagaaagaagaaagatgaaagaaaggagaaagagaaaggagaaagataaaaagagagaaagaaagaaagagagagggagagagggagggaggaaggaaggaaggaagagagagagaggaaagaaagaaagaaagaaagaaagaaagaaagaaagaaagaaagaaagaaagagaaagaaagaaagaaaagaaagaataaaacttgcctatctccattgggccatttgtcctcaggctgtgagctcagccttccactgagatgacttcctgccttgccagccagggctcattagtcacatttccacatttccggtttttttgttttttttttttttttgaaacagagtctttcttgttctgtcacccaggctggagtgcaatggcacgatcttgactctctgcaacatctgcctcccgggttcaagtgattctccctgcctcagcctcttgagtagctgggattacaggcgcctgccaccatgttcggctaaattttttctttttttttttttttttttctttttggagatggagtctcgctctgtcgctcagtctgaagtgcagtggtgcgatctcggctcactgcaacctctgcctcctgggttcaagcgattctcctgccttagcctccctagtagctgagactacaggcgcatgccaccaggcctggctaatttttttgtattttagcagagattgggtttcaccgtgtttcccaggctggtctcgaactcctgagcttaggcaatctgcctgccttggcctcgcaaagtgctgggaggcgtaagccactgtgcccggccaatttccaactctttttttttttttttttttgagacagactctcgctctgtcacccaggttggagtgcagtggtgcgttctccgctcactgcaagctctgcctcccgggttcatgccattctcctgcctcagcctcccgagtagctgggactacaggcacctgccaccacgcccggctaatttttttttgtatttttagtagagacggggtttcaccgtgttagccaggatggtctcgatctcctgacctcgtgatccacctgcctcggcctcccaaagtgctgggattacaggcgtgagccaccgtgtccagccccaatttccaacttttaataaatgtatataaatatagtagaaagtaatttatcttgtggcccttaaaagggtggttggggtagggggaagcccactccttaagtatgagctgtacatagtgacttccttccaaagagtacagtatgggaaggaggaacaaaagagtcattttacagtggagacagctgataaatatgacctcagccaggtgatcatggccaacattggcagtcataaatcatgttaatagtttgcacctttgctatgatgtgaagaaaactgcacttcacctctgatcttccccaaaatccataactcaagtctaatcatgaaaaaaaatcagacaaatctcaaggagacatctcatgatatatctgaccaatattcgattgtccagatccttaaaaacaaaagtctgagaaactgtcacagccaagaagtgcccaaggaaaattgataattaaatataatgtggtaccctggatgggatcctagggcagtagaaggacatcatgtaaaaattttatttatttatttatttagttttgagacagggtctcactctgttgctaaggctggagtgcagtggtgtgagcacagctcacggtagcctcagcctcccagagtcaggtgatcctcccacctcagcctcccaagtacctggtagtacaggcacatgccaccatgcctggctaattttttaaataatttgtagatatagggtctcccaatgttgccctggctggtttcaaactcctggtctcaagcaatcttcccacctcagcctcccaaaatgttgggattacaggtctgagccaccatgtctggcctaaaactttaaaaatctgagtaaactatggactttagttaataataataatgtatcaatattagtttattaattgtaacaaatataccatactaatataagatgttaataatagaggagactgtgtgtgggtgggggaactgtttagggcaactctgtacttatctgctcaatttttatgtaaatctaaaacttaaaaaagaaaactctattaataacaaaaaaggaagaagtggatgaaggggttcaaagtattccacctgaaatatgccatgctgatataaagataattttgagctaaaggaaagtgagaagctgcaaataactctctggtctcctcttctctgcaagaaacagcagaatttttaaccaccaaagacactctagactcagcagcacagagatggcaccagaggaatctacatagcaaaccttgctaaaacaatccttatccgtctccatgagttttccaatatattgaccttcccatggttggccacacctaaaggcctaaactccttctcccttgtcacttctctacaaatttattgctctttgttaagatgctatataagccccagttaaccatgcctttgagttactcattgatgtggtttggctctgtgtccccacccaaatctcatgtcaaattgtgatccccacatgtcggggtaggggcctggtgggaggtgattgaatcatggggtcagacactcacttctcatgatagtgagtgagttctcgtgagatctggttgtttgaaagtgtgtagcacatcccccttcaccctctctgtctcctcctctgccatagaaagatgtgccttgtttccctgtcaccttctgccataattgtaagtttcctgaggcctctcagtcatgcttcatgttaagtctgtggaactgtgagtcaattaaacatctttttttcataaatgacccagtctccagtagttctttatagcaatgtgaaaacagactaatacaaaaaactggtgttaggagagtggggcactgctataaagatacccgaaaatgtggaagtgactttggaactgggtaatgagcacaggttggaacagtttggagggctcaaaaaaagacaggaaaatgtgggaaagtttggaacttcctagatacctgttgaatggttttgaccaaaatgctgatggtggtatgtaaaatgaagtcctggctgaggtggtctcagatggagatgagaaatttattgggaactggagtaaaggtcactcttcctatgctttagcaaaaagactggcagcattttgcctcttccctagagaactgtggaacattgaacttgagaaagatgatttagggtatctggcagaagaaatttctaagcagaaaagcattgaagatgtaacgtggctgtttctaaaagtgtatacttacatgtgtgaagaaagagatggtctgaaattggaatttatatttaaaagggaagcagagtataaaagtttggaaaatttgcagcccaaccatgcagtagaaaagaagaacccactttctggggagaaattcaagctgggtgcagacatttgcataagtagtgaggaactaaatgttaatacccaagacaagggggaaaatatctccagggcatttcagagatcttcatggcagcccctgccatcacaggcccagaggcctaggaggaaaaaatggttttgtgggccaggctcagagccctgctgctctattcaggctcgggacatggcgccctgcatttcagctacttcagctctagccatggctacaaggggccaaggtacagtttgggccattgcttcagagggtgcaagccccaactcttggtggcttccatgtggtgttgggcctgtgggtgcacagaaggcaagagttgaggtttggggacctctgcctagatttcagaggatgtatggaaatgcctggatgtccaggcagacatctactgcaggggtggagccctcatagagaacctctactagggcagtgcagaggggaaatgtggggtcagagcctccacacagagtccctactgggaaactgcatagtgggtctgtgagaagagggccactatcctccagaccccagaatggtagatccactgacagcttgcactgtgcaactggaaaagccacaggcactcaatgccagcctgtgaaagcagccacaggggctgttccctgcagagccacaggggcagagctgcccaaggccttgggagctcacctcttgtgtcatcgtgccctggatatgagacatggagtcaaagaagttttttttttggaacttgaagatttgatgactgccctgctgggttttgaacttgcatggggcctgtagcccctttgtttaggtcaatttctccctcttgcaatgggagcatttacccaatgcctttacccccattgtgtcttggaagtaactaacttgttttttattttacaggctcataggcagaaggaactggccttgtctcagatgagactttggacttggacttttgagttaatgctggaatgaattaagactttggggaactgttagaaaggcatgattggttttgaagtgtgagaagggcatgagacttgggaggggccaggagcagaatgatatggtttggctctgtgtctccacccaaatctcatgcagaattgtaatcccctggtgttgggggagaggcctgctaggaggttattgaatcatgggggcatactacttcccccttgctgttcttgtgatagtgagtgagttctcatgagatctggttcttcgaaagtgtgtggcacttcccccttcactctttctccccctcatcctccaccatgggaagatgtaccttgcttccccttcaccttctgccatgattgtaagtttcctgatgcctgctagccatgcttcctgttaagcctgcagtcaattaaacctcttttcttcataaattacccagtctcaggtagttctttatagcagtgtgaaaaaggactaatacactaatcactgagtttctcccaagtatatgtcatgctgcatgtgttaataaatttctgtttgtttttctcttattcatctgtcttttgttagtttaatttgaagggcctcagttggagaacctaggagggtggaagtaaaagcttttttctcccctatgtgggaaagactgaggaacatgtgtagctaattaggtatacaaagcttggtatttgctgccattgaatttgggagcaaaggtggacccccatatgggaaggatataaggcacaaagcccccacagggtagccggcctggttgaagtagcctggattcagtgagtacaggacctatgcttccttcatgtccataacttcatgccaagctcagcatcttcaacatgagcactgatattcatcaagtatccactatgggcctgatactgcactaagcactttaggtacgttatctcaaatggtcttcatcttagtctgtttacattgttataaaggcatacctgatgctgggcaatttatgaagaaaagaggtttatttggctcatgattctgcaggctgtacaagaagcttggcactagaatctgcttctggttagggcctcaggctgctcccactcatagcagaagacaaaggggagccagcaagtacagaggatcacaagggaagaaaggaagcaagagagtggagatgtgccaggctccttttaacaaccagttctcatgggagctaatagaatgagaactcactcattcccctcccaggcagggcattaatctattcatgagagatctacccccatgacccaaacatctcccattaacccccacctccaacactgaaggtcaaatttcaacatgagctttggaagcctcaaacaaactatagcaaactataacccaattgtacacacgagggaaactgagggaacaaagtagtttacccaaggaaacacagctagtaaatgacagagccaggacttgaacccaggcagtctgacttcctagtatcatcctgtgtaccaccacaagcagatactaaatacatactggcagtatgacatgattttctgctcttacaggttacatttcaagtttgaatcactggttttaaacatctgaaattctcaagctgtgtttggcagacccagttgatccttagctttggagatttatggttcttggattggcatatggcggagccacctaagagtccatgacatgtagcaatttataatactattgagacacgaaccagaatcaccttcctgtgaggctggtttaacagcagttatttgttttgagcactctcagaggtaacccctgcagaagctggatggccaggtccaacctctttggctgcagcatgtccagcagctcagcatgctaacagagggttactccttagtgggaggacttgggagtgataccaatgacaatcttgtatgtggatttcttaccttgatgtctaattggcagccctacagtattgactggacatgtgattaaatagggatcactctatttgaacatatcactaaatgcgtttcctgtatgcttagacaagattgtttacccaggacagtcccagcttacaactattgtccccacataattatcaatagagtcctctgtcactctcaaaagtgctccagtttgaacagtgacttgtacagcctccatatttataacacaaacagttgtctgctactcccaagctaaaacctctagagaccacactaactgtgattgtagaatatcagtgacagctgggactcctgttcctagaggtttggtagagtgagttcatctggaaaaaaaaaaggtgattgtgaaagaaaccatgattttcagaagtgtgattattcattcattccaaatgggaactattttgcaactttcataaatttcaactacattttatgcactaaatggtgaaactgctgcaaaaaccacacgtgttttaaaataaatatacatgtgactatcacctgagttccaaagccagacagttgcctttaaggtgtgacagatggcatcatcctctaggaggacagtcagcatgatcacatgtgatgccacactgagcatcagggcatcaatagctatcctgttggaacagggcctggagcaagaaatgcaatagttcaaccataattgtcttgtcattgaaaatctttttgtagttctcgcccttgacatacatcatgaacttcttttcaggtccgatataccttgtcatacactgagtgtacaaaatgtgacagtgctgccacatcacctgtcatcatagaactcttctataatgcttttacatttctctctctctctttttttttttttttagatggggtctcactctgtcacccaggctggagtgcagtggcacaatctctgctcactgcaacctctgcctcccaggttcaagcaattctctgcctcagcctcctgagtagctgggattacaggcacccaccaccaagcctggctaatttttgtatttttaatagagatggggtttcaccatcttggccaggctggtcttgaactcttgagctcgtgatccacccgcctcggcctcccaaagtgctgggattacaggcgtgagccaccgcacccggccacatttctcttctatctatgttgttttgttgttgttgccttgtccgtttccttaccatttgtgaggtcaacacattcactgaaaaatatgggatttcacttccaaaaccttctaaggtaagtatcagctattgattcctattattttctttctctcaagaattctgatttgttgcaaaattttctctcatgttcacaaatttgtagtaacctccaaaaatccaaatatgaccttgattctaagcttcaattaaggctgttgatgaaatgtggtctcctgtctggaagaagctactcttagggactgtagtgagaaattttaaaatatagaacaaaccaattactggagatggatgatgatgatggttgcaaaataatgggcacatagttaatgccactgaattatgcacttaaaatggttacaatgggaaattttatgtcatgtatattttaccagtgttaaaaaaaaatagagagaatacatcagtcagaagcattcggggacaaaatccatgaatatgtatgcagatgtgtgtagatgctacagggcttggctgacaaaaaaaaaagcaaccaagaattagagacgagcaaagcttcctggagaatgtttgcccattgttggatggtctgaacatgcagcgaactttcataaggacagatatggatgatgccttactcaccagagcacacaagtgactgcataaaggctgtccaggagctgcaaaagaccgaagtggaacagcagcatcctaaaagtgaaattggtggtgaacacatttatttgttcattaaatacttattgcactcactaccatatttcatcaaatctaatataatacaaactattaagttagttataaagcatgtgtgtttattagatgattttctatttcttgggtatctaaaatacttagctatttaaaagctctaacatcatcacaagtaccttaagtactggtatgatgtaaacatactttattcccatagattaaaaaaaatggtgcatagaagatcacaaagacaagaaaataaacagaagctctggctacagaacagagaacaactgaaaggggactcggggagaccagtgagaagatggccattgggcttagtatgaaatgataatggtggtcgcttccatgtgctttgtgttgatgctggaaatgaagagaagatatatctaagaataagctagaagaaaaaaaaaagacaattttgtggtgacacatcacaacttaagctgctatttgccagatggaagggaacactttctcccctctgcctacatttcttcacctcttctcccagaggagcagagaggaatctgattgatcatgtttcatgacagtgattgggtcacacttgtttacttgtgtgttgaaaggccacctgtccaggtgtggagaggatggagtaagatcacttgggtttgtagcttgccactgccatttgcatgtcatgtgacattgggcaagttatttagtctagtgaagcttctggtttttcattataaaaaaataaaaataaaaatttctacttcggccaggcgcggtggctcacacctgtaatcccagcactttgggaggccaaggcggaaagatcacgaggtcaggagatcgagaccatcctggctaacacggtgaaaccccgtctctaataaaaatacaaaaaattggccgggtgtggttgcgggtgcctgtagtcccagctacttgggaggctgaggcaggagaatggcacgaacctcggaggtggagcttgcagtgagctgagatcacaccactgcactccagcctgggcgacagagccagacttcatctcaaataataataataataataataataataatagtttctacttcaaaacttagttgtagattaaataatagtatctatataggtgcttagcctagcacctggcacatagtattcatctaaaaaatgctagttcttgttattatcccatgccatcagcagacccatcttgctcactctcttttattctgtttccttatgtacccaagtgtgcaccttatttcctatttcataacccataattaggattaggtttagagaaatagaggcatacacctagctttcattctaatcaggttgctccagcccagctttgaccaaggctctctagctagagtatcagcaactgtccttgataaaaatgaagtaacatttaattatcatttgtttaattagcacactgcctcttgccagtatagcttcattaagaactttatgggaaatatgtacacctactatgtacccacaaaaattattaaaaattgaaaaaaatgaacttcatgggatggagtagagttagaaggacaaggattcctagatctctggcctaatattatctgttcaacatgatttgaacatatactatgtgcttgtcattgttctaggtcctgggatttagctgagacaagacagattttatcactcatactccttacttgatctttcatatatatcttattatagtccttgtcatattaggcaataattatttgttttcttgtctgtctccctctgctaagccattgagtcctgaagggcaggtactctaacttccttcaatgtcacctaagagtgggaaagatgtaggtatagaactatcaaggaagaactggctctcatccttgcttttcctgtctttttcctccctgtgttgtgatctcagtaattccttcaggtctgtcttctacattactgattctcatttcagctgtgtctaatctgctgttaactcatccattgagggtttaatcttagcaattttgtttttctattccagaaatcctatttgagtcttctttaaatcttcctagtcttttttgatagtgtcatgtaaagaaacatgacactatctttctttcttgtgttcttgtttcttgtgttttcaattccatattttattttaacattttaaatataattaatttctatattttataatgattatcatttcattgcctgatgttcttgaggaaaggatgtgggccacctcctacttttcgtttctgctgatactggcttgcttttatgtgtttgcaattttggattgtgagcacaaatttaattgagctttatccgtgggtcacttctgaagcttggattgaaagtttatctattcaggaaggattattttctcctctgctaaatgcctgggagcattataaacctgagtttactttatattaatttattgctttggaatttccaggcctatgcaaatagtgcaagtttaaattatgtgctaacatgcctttggtcactaattttgagggaatatttttattcattcagaaccttggccaagacaaacacgtttatttctcattttccattatgggacaaatttttcctacccctgtctttcactgagtgtgtacctttaagagttccagatttctatggcattctcaattcgtttcccactttttgcaggactaagatctttcagtccccatagagtcactgaaaccctgtttcttggttatgaaattgggaaatagcttccgagcttaagttttcagcttaagttttgggcactccagaatttctcctactttttttcactatcacctttccatttgagaatatgtttatgatattttttccaatttttccaagtgtgttgtaatgaaagggctttcaaattaccaccatattgcagataatggaggttaataatgtaatcagagaagtatagaagttttgttattgctgcctttgtggaatttacaatcttctgggcatttatttggaactatctctagaaagatacaaaggaatattttcaaacagtcagatcctacagatactgctcagttggaacaaacgtgatgaatttcactgctctttcaatcccagcattacaggcatgagtattgttactgtcatgtggggttaggcggatacaacaccacacccagctgaacagcaagaatttagtgaagttcatctgaaagttggaacaagaaaaccacctaagagaaagacttttgagtaatggaggagagactttcaaataccgtttagaccaggatatgtttatttcccaaccaaaatagggaaatgctatcgaaccttcacatcactgggagggcatcagataaggaatgttttccacaaaggggttgcctgaccaactacctcagaatcatctcaaaagtttgtttgaaaaagcagatttctgaatttcactcttggatattctgattcagtagtctcaggtggaatctgaaaatctgcatttttaaccaggaccctggtgtctcttacgtacactgaggtgggagaagctttaatgtagggtatgttttaatttgaaaagagtctgttgccataattttaggggctcactgagttatgcagcaggaataaaaatgccaaaggaaaatctgcttcagctcatgagattgagtctctaagtctctgctgctttgagccactgtcgagacagatagagagagacaaagacaggctgatagacagacagaaagctctctgtagttaaaccagcagccttgacccaaatacatgcctatctggactcccatgacatcatgcttggatgactgtagaatgcagaagtgtctgaaaaagagagaaatagatccaagaccctaaaagaagaagagtttctagagccagaaagaaactgaaacttcactccaggccctcctggagagaatctttcacaattgtaattcaggaagggattggtaattactgccagaatcacactgtatataaagacatgtgttacttgctgtctatagtatataacatattttatttaaccattacttaattatatacatttcttcccatattgtgggtttaattcttatccctaagttaagtctttgtaaagcccaagttaaaagaataccttctagaaagtttatatagagacactggaatcacagtcctgctgctcagagcaggtatgtggtacacatgtactaaaatggtgaccaaacagggacccctggggcactagtaggaaaaaacactacctaatatggtgtgagtgtgtgtggcttggcaggagtgacccataatcaataggattaggcagaggatttggctcagaaaatataattgcaagtgcaatggtcctttaaggaatgccattaaggtaaaatattttaaagaataccatccacttggaatagttttggggaaagaatttaaaggaatttcaaatgaagaaccttgctgtgattgttgctttaagcaccatttttggtttacaaattacatgccattttacagacaaccaaagaaacatgatccaactgtattattcttttaccccatgttttcacagttccatatggttaacatcagttgggtggtttctttagaaacaattaaaaatcttgccagacacacaagaagaaaccatgtgagcatgttttctgcttgctggtgacattttatcccctccctatcccttttgtctttaaagaattactcagtctgctggagtaggatcccttaaaggctgggaaatgacagtcccttcttaccacaatccaacttaggtctttaggcaaacaataatgcagaaggacatctgttttgtttctgtggctcccaaatgacagtattagaaaatgaagccagtatgaaaaatgctcaaaatgcagtacaccatcaagggaaaggaattgactataaatcaatagaattttgaatagaaatttgaatagaacctccaaatagaacccattttggagtttgcattgataaggatagtctacgttttgctgcagtaatatctacccccaaatcttagtggcttatgatcacaaaggttcatttatccctcatgctgtcagctggggtggggatgagcccaggtcactgccaaagtcattgctctgagactcaggctgaaagagatggaaccatctggaaagctatcaatcgacatggcagaggggaaaaagaaagtgctaggtttgctgcatacactgtcttattcaacctttctgacatccaatgagataagtagtaatatccctatgttatagataaggaaacaagctaagagttgttaaagaacttattcaagtaccacctagtgaatggcaaagagagaattcaattctaggtctgtctgaatgtggcaggcagactctaaaatggcctgcaataatactggtattcaggtcctcatgtaatctgctccccttgagtgttgactggacccagtaacttgcttgtaatgagtagcatatggcaaaagtgatggaatgttgcttctgagattaggttacgagagatagtaatttccaccctgctagcagaatctctttattgacatgctcccttgctagctttgatgaagcaagttgccaggtttgatgaacctacttggcaagggactgagcgaaacctttgtccacagccctaaatgaatggaatcctgccaacaaccatgtaagtgagcttggaagctgatcattccccagctgagctttcagatgagccccagccctgtttgacacctggattgtggcctcgtgagagactttgaagtagatgacccatctaagccatggttagatttctaacacagagaagctatgaaataataaatgtatgttgttttaagccactaagtttttagtggttcgttacacagcaatagataatacactgactacagagtccatactcttcccactaaattagttagcctcttttttgcagaaaacttgttccttatcccacattctttgttatggtttgtggcattctatacatcaacactcttaagccataagcttgaaagtcatcctagatcccacctcttctctcattttcacacaaaaagagttatcaaattttatgaacactggattctataatctcaaaactctattgtgtcctctccaatctctctgtttaagtcaggcctcggtggtctttgcctggactgtttccatagctcctgtctccctgcatccagacttgctccactccagtccattctcacacccatcactgtctcccacattgcttccagtgtaggtctacactgtatagcatcttagtatgatattgtcatctggtgatattttgctccagactccctgttgcctccagaaacttcttcccattcaggccccaggttaattgctccatttactgcttcatggaaaggttgttgatgcagaaacagaaaagtaaaatcatgaaaacctcagcttttacatattaagattgggtaaaagcctggaaggactgagggcatatatttcatgccatgtaatttttgaaggatgtatgatcagtcgcaatgttttcctcacctgagacttgaccaaggttctgtgagctggggcacaagaaggatgcaaggagaacatgagacctagatatatgtgtccctgagaagaggttttgcttcccgaccacatgccccatcccagtcttggggagaggaacgacagaaaccataggtgggtttcggagatcagagaatggagaaagacctgcacctggcttctggggccaagaggaaaaagaaagtgcagggaaaacctggcagagttccctggtactctgtgaggctcggctgtagcattagagacccagctaagtggggcgcctaggcagacaggtggccatctgagtagactctcaatgggaggccagatgagaaggagggtatattagtgaatgctagcatagacaggtggggatgaaggaccagctccttcccctcttctgaccctctgtcaatactttagcatgttggaagcccccagctggacacaactaagggactggaaaaaggtctttaattaatggagacttagcatccattgctggacagatgagagatcagaaacacaggtttcaccctctcaccaagtttccctctaaaactctttctatgcttcccccacttgaagagaaagcatttgagaaactaaatgtcatcctaaaagtttggtacattgaataggaaagtgattttttagtagtagtagtagtagtattttgagacagagtcttgctctgtcacccaggctggagtgcagtggcacgatctcagctcactgaaacctcgcctcccgagttcaagtgattctcctgcctcagcttcctaagtagctgggactacaggcgtgtgcaaccacacctggttaattttcgtatttttagtagagacagggtttcaccatgttggccaggctggtctcgaactcctgacttcaggtaatccacccgcctcagcctcccaaagtgctgggattacaggcgtgagccactgcgtctgtccacatgattcttaataactatgagattacacaagatctcagtaacagaatcaccaccaaggttgagcccacacacccttgtctcctctggccctttccacagtatcactgtctaattttccatcaagttttctctaccacatcccttccctgcctgctcatcctttgacattgaggactttctccatgaattctactccactagatctgcagagtcgtggaaagaagcatatccatgaaactatttgtgatcacactctacttgtcactcctatttggtataacggtcaggagatgaaagggacacttatggtttccttctatttctctttttacccctcactataaatctctctgttgcccatgctgtgactggcaagcatgatctcccctggacagcaaccccaactcctaggctgccggtggacttctgtaagagtctagaatcttagggagctggagtgaaattttctggattggggaagttgaaatgacaacctttggggacttgtatctattggtgtttgagtgtgattacatgtccaaaggcaagggacagaagagcttttgggcttgtaaaaaatagacaagtagaacaaaaacaatccagataattactctttcagaacttaattgactgggtgtgatggctcatgcctgtaatcccagcactttgggaggctgagccaggaggattgcttgagcccaggagtttgacaccagcctagacaacatagcaagagttcaactctacaaataataaagaagttagctgggcatgatggggcatgcctgtggtcccagctacctgggagactgaggtgggagagcctgtggggtcgaggctgcagtgagacatgattgcaccactgcactccagcctgggcgaaagagcaagaccctgtctcaaaaacaaaacaaaacagaaaaacttaattgccaattctcctaacccctccatccaatgtagacagggactctccatagaagaagagaatgacagaaacactgattcttcacaacatgatcaacaagcacagtgagtttcagtgagacattcaatgcttggtcttttgatctggtcctaacaaatatttagaaatgcttgtgcgatgataaatctgggatcacagaggaaaccatggagaataaaaaaaaaacacaggtttgttgttgtataaatgtgctctgtgtgtgtgtgtgtgtgtgtgtgtgtgtgtgtgtgtgtgctgtccccgtgagctaaggaaatctaaccgacatgtcagcctcgggtgcaaggtaacttactgttgtttttgtttcttcctgtcatgaaactgatttcctttttcctctcccctcccatctgttgaatctcctccacttcaaggcaaatacaaactttcctctccacattctcaaccagttttcactcatttcttctagtctctctctcttctttctcatcacttttgggggaatgaaacaatccttcctcactccatccccggccattaaaccatacacactgtgccctgtaaggaagggcacaaaaggaggagggcctgcacggggctcttaaaagcaaggccaccccagtatggtcttgggaggactgcatcatcataatccaggagctccttagaagtgcaaaatcccaggccccaccccacacgaactgaatctgaatctttggaagtagcggggcgaacgtcaagtatctggggtgggcgtcaagtatctggggtgggcgtcaagtatctggggtgggcgccaagtatctgggtgggtgtttttgcaaagctctcccaagttcctttgcatgcgaaagtttgagcatcactgctataaagcttgggtcctagaacagggaccctcctccttttgtacccttgcttacagggtacagtgtctacggtttaagagcctgttacccatccacagcctagactcctccccttcatctagaattctagccaagatggagtcagttatgttggagttttctcactgtgataattttgcaaaggcagttttagtttccccatatgtaaattgacggtacctcactgggttttgtgatgaataaatgagttgcatagatagagcacaaaaaaacagtgtgtggaaaatttaaaaaaacagtcttagtgtttatcttgcttttatctccttcaggttgcaaggacagaaatgatttatctccccctctgcgacatgttgcctcttacaagtccggaagcaacatccagctcctctgttgcttctgtgaatgaaaatcaatttctaatttaggacacttttggcatcagtaccttctcattttcccctctgtcagggtattactatgaactaaggatttatatagcaattttcatctgagggagctccatttttttttaacagagtgaatttattaaatcaccactaaccatcataatagcccttcagatggggcagatgcattcatttattgcatttacttattctgaacatcaaattgtagtagccttcaggagcctctactcaagctgggaagaaacaccatggagttcaggaaaactggaaagaccatgcttgtcttttaggtataagaattagggaacccagttgaatggtcccttttggggaacagggaaaaggggtttgtttcagcttcctcaatctctttctggaccacaaactccttcggaatggaactggtcaattccaaaaaggattgtccctggaatagaattacaagtccctggtcccagttcaatcagtctggatgagcatgattttgctattgtaacaaagagcaccccaattctaagtgttttaaaacaacaaaggttcatttccagctcatgccacagttccagcatgtattgccagtgttctctgccccacggcatcccactctaggactcaggctgatgtctccagactggcagccaaagaaagagaacatggaaaaattgcaaaacagcccttaaacgtttttgccaaaaaagtgaccaacctcacctctgctcattttttgttggccagaccacatctcacaccacagaatctgtccctcccatgtgcccaaagtgaaggggaactggatagatatcagatatcgatgaacatagtaatgtttatcactctaattagctttggctgctttactaacttggttctgatttatttgcttccctgttagcatttggaacatgatgtaatttccttccacttcacctctctcctaacttgacaacatccctaatattctctgaaatctgtgcatgggaactaagctcctcagcagtacaatttttttccctgaaatctaaggctttctgcaaagaggcaccttcagtgttgtcaagattaagtttgtttttcctcctgagttttccacctcacccagcccccacccaggtctagttgtaaaatgtatctgcatgttttaaaagctcattatgtaaatgtatcagagtccttatccatcaacagataatttaaaagactctatacatatttatgagttcgcttaatatggctttaatgaggaggtttactagaaataccaaatcaaggaggcaagaagaaaaacgatcacaaagatgagcatgagttttcagccgttcttggtagttctgagagctgtcagaacattcaaagagctgccagaactgaggcttcctgttagcctaccgtatatggtaaaaagcagctggggaaagaggtaagtcatgtcgctcaatatttctttgaatctaaggctaaacttttttggtttgtttcaaactgaagatatttgatgagccaaagtctcatgtttccaccacctctagaagcaaagtcactgtgggagatggtcaaaagtctgacatagcccccagcaatgtcaaatacattcagagagagagtcacaactctagcccatgtggctccattgtggtaattagatagaggtgcttcctaggcgatgaggaaaacttgtgtctccctccagcagacaaagctctaaaggtacttggcttggtgaggagaaggtgacagagaggtaggtaccccttattccaggtggataaagtcagtgaatgaagcctagtgccaggacaagcagctaggtgagtgggacgtgggctagaatttagccttcatgtgccctgacagccaggcacattagtttagtgcataatctgcatagtggcagtcctgtcagaaactcatgagttctcaccaacagctggtcaaagtctgtaggaacagaagacttttcctcattctaccaactactctctcttgtttacccaaatgtctgctcaaccccacctctggggcctcttaattgcacctctcttcattatttacacacattttattggccagacctcagtcacatggcaccaccaaagtccagagaaaaatgggaagtgttggctcactgagtgaccagaaagaaaaggaaatcaggtttgatgatcacatagcattgtcattgtctgccacaatttacctatctgatcaccaaacattcatttcactcctttcccctcatatagaacacatgcatcccaaatgagacaccctatttttagggtcttttgaccatgtagatactacaatcatctcaaagtccaggatctcagggatgttgtacagtcctccccattgggtccagattggctccctgtgatctggtgacttgtgaactagaagacaagttatctgcccaccccaccccctacacactggtggattagaaagaggatatccaaaattaaaactcccattcagtcaagggaaccaaaaaagaagctgtctttgcccatagcaattctgaaatcctggctgtgggggaagttccttgatttgacctaatgctggactctaggaagcactgccttgtgtgtcactctcctttgcatgtccaagctggaatgctgactagtgtgttctcttgggaagctccaccgctatgggaccctggttcctcctggagcaagtttagaggtctaaggttattttgcaagttcaatagttgaaggcttttttttttcttttaaattcacgcttgtcagttcttggcttaaacatagtacatacccaaaggaatataaatcattctattacaaagatacctgcaagcatatgttcatcacggcactattcatgatagcaaagatatggaatcaacctaaatgcccattgacaacagactggataaagaaaatgtggtacatatacaccatggaatactatgcagccataaaaaagaatgatatcatgtcctttgcagggacatggatgaagctggaagccattatcctcagcaaacaaatgcaggaacagaaaatcaaacactacatgttctcacttataagtgggagctgaacaatgagaaaacatggacacagggaggggaacaacactggcgcctgttgggggtggggttggggagggatagcattagaaaaaatagctaatgcatgctgggcttaataactaggtgatgggttgataggtgcagcaaaccaccatggcacatgtgtacctatgtaacaaacctgcacatcctgcacatgtaccccagaacttaaaataaaaataaaaaataataaagtgtatagttcaatggcttttagtgtactcacaaatctgtgcaaccgtcaccacaatttattttagaacattgctatcatcccctaaaagaaactctatgcccttagctgtcactccccaattcctcctctgtcccctatcctagcccaaggcaatcacaaatctatttctgtctctgcagattttcctattctggatattacaaacaaatggaattatacatgtggccctttgtgactggtttctctcacttggcataatttttaaagattcatcaatataatagtagcatgtatcagtactttatttctttttgtgcccaaataatattccattgtatggatataccacattttatttttccattcattagacagtgtacatttgggttgttcccactgttaactattatgaacaatgctgctatgaatactcgtatacaaggccatgagtggtggcccatgcctgtaatcccagcactttgggaggccgagacaggcagatcacttgagtttaggagtttgagaaaagctgggcaacatggcaaaaccccatctctacaaaaaatacaaaaattagctgggcgtggtggcatgtgcctgtagtttcaactacttgggaggctgaggtaggaggatcacttgagcccaggaggcagaggttgcagtgagccttgatcgtgccactgcactccagcctgggtaatagagcaagaatttgtctcaaaacaaaaacaaaaacaaaaacatgtacaagattttctgtggacatgttttcatttatcttggccatatgcttatgtatggaattgctggatcatgtggtaatctatgcccaactttttgagaaactactagacaattttccacagtggctgcaccattttacattcccgccagctgtgtatgagcattccaatttttccacatcctcaccaacacatgttattacctgtctttttattatagccatctcagtgggtgtgcagtggaatcccactgtggttttcatttgcatttccctggtcgctaatgcaagcccttcttatgctcactaagaactcactatctgacgaactctgggcaaattatttaacttttctgtgcctctgtttcttcatctggaaaatgatgataatagtattctctacctcatagggttgttgtggtgattaaatgggtaatttgtgtgacctgtgcctgacacagtgcaagtcctcactagatgttagctcctgtttatagaagaacagcactggaaatttgagccacctgtttctgtgagttacatcttaaccactgacaagaccccagttcctgatgaaaaatagaaagtttcgcaggcttagatttttagaaacaaaatagacactagttctgacatcccaagcccatcaaaaagtgtttatgatacataatgaaagttgagacttattccagcacagatttggataaatgggtaccatctaggcattccagggatgcactggcagtgagattgaaagggagaaaaaaatctgatagctctggattgaactatttaacaataaatgtctcttcttgagagtaagccctctgaagatcagcttctaattgccaacatcattttctaccttctgtacaaagtcaacccttccacatagcctaccaagcagggcttgctgcacatctgcatcatgactgtgcaaattagaaaagggcgcttttacaatatgagccagggtggatggcttggtgagttgagcatgggctgaattttacccacaccagcccgcttggttgggcacccttttgcagtgcacaacctgaacaaccatatatgagcagccctgctaccaagcactctgcattccagagagtaggtaactctctgtatattaataactagatagtcctagtcctggtgaatataagaatcttggcaatcaggaagttacttgccataaatcaaataatgagttgccaaaatctcctcactcttcataatctagaggaagaaacaactataggagcaataaatgactgatagagcctttgtctggcataatggagatataagccaacaaaactcaggtatacacaattcaagccaaagccagaattcaatgccgaactcattcatctccatttcagtacctaatccagaaagcctggatgcccttggaatcccgcaagatagaatatagcaccaacaaagaactggaggtttgcagctcagagctgcaggcaaactgcataccatggggccaaaccatcttccagcaacacatcctgcttctttaggcacttgacagagccaactttaacacagactttgagaagtggccctgatgaaaccctggccaacagccagccagccactacccaaaaatgtctgcctgaaagcagctccaggaggcaggccatggggagtggaagtcggggagaaactggaagaggcgccaagcagctgtcaggggaagtgatgacacggagcaacaccaactcttattttcttttccccccagcttcaaatgatgtggcacagtggtggcttgccgagaaactgcagtcacagatggaatagcagtgttcagaaagaaagatggtacatgcacagaaaggaaaagcaatagattacagcaggtagtacataaacatgggcacaactctaataatggtaataattatttataataaataaatagactaataaagttactaataaattgctaaacctgtactgtgccctttacttatattatctcacttgcattaataaggaacccaacaatcctaagaggtgagtgttattaacacaagtttcttataggtgagaatgctgaaacacaaagaggctaaatgacttatccaagatcccacagctcccaagtagtggagactgaatctggagccctgtggtctgaattcaaaacccaagctcttaactacagccctatcttgtttctcaaaggactatctatgggtagacatgaggtgtagtaacgattggggtcacctgtgagtctgtgagtcacaatcacacaccctgggcacattttccatctgcattacgccattcttgcgttgctatagagaaatacttgagactgggtaatttataatgaaaagatatttaattggctctttaggccaattaagcctctgcaggctttataggaagcatgatgctggcatctgctcagcttctagaggggcctcgggaagcttacaattatggtggaaggtgaagaaggagccgacacaacacatggcaaaagcaggagcaggagagaaagagcgagagacaaattggatggggaaatgccacacacttttaaatgaccagatctcatgagaactcactatcaggaagacagcatgaagccctgagggattcgcctccatgagccaaacacctcctaccaggccccacctccagtactgggaattacaattcaacatgagatttgggagggaacaaatatccaaactctatcaccatccatctatccacaaatgaatacatacagttatttaaggaatatttgttgtgctcagctctttgtatacattgttacattaaatattccccaaaactcttaagagtttgggaaatacattaagaataaaacacggtccctgcaaaaatggttgcaatagtatcttccacccctcatgtattttgcaatgtgactctgtcaatcctctcattaagaggtagaatctatttaccctcaccttgaatctgagctggtgtgtgacttgctttgatgaatacattacattagaggggatattctgagattcaaagtccaaggtttaagaggactggcagctttcacttttcttatatcccagctaccatgtattagtttgactactctgaggccaccatgctgcaaagaagcccaagctagacgtgtaaagaaggagtggtcatatacatatacatatatacagagagagagagaggtttaaagaattagttcatgcagttatagagattggtaagtctaaaatctgcagggtgggccagcaggctggagacccagggaagagctgatattgcagttcaagtccaaaggccatctattggagaattccttcttgttttggtaaagtcagtcttgtatttgatttgggccttcaactaattgggcaaggcccacccatctgatggagggcaatctgctttattcaaagtctactaatttaaatgtttatcatgtccaaaagtaccctcacagaaacaccaggataatgtgtgacaaaatatctgggcactgtggtccaggcaatttgacacataaaattaaccatcttatagtccaacccaatcactagcataatatatttgagtgacccctgctgacaccatgtggaacagaagaaccacccagctgagccatgcccaaattcctggcttataggatcatgaaaactaattaattgttggttttgagctactaagttttggggtcatttgttatacagcaacagaaaattgaaaactgccttaatgaaggttacaatttagtggccttaatcaacagtaagcatatagatgtataattatataatttgatacatattaagaacacttcattgcatttattaaaaacccactaggtaaaattttccatggtagtgtcagacaaggctatggtgacaagatcttccttttacaggctctgactaatttgtagtggtggctgagcaaaccactgaccctttctggaccttggcttctccatctataaaatggacatggcagcagacagcctctctgcctcacaggctcttatgaaaattaagtgggacaagaaacaaaagtgctatcaatgctgaaaagtcctctgcaaactacgtcataaccgaataaatgatcccttgtgccaaaaatgcaaaaatgtttcacaatttattgcttaagcggaaacatctggctaaggaaacttgaaaaaggcagcaacctttccgaccaaagcaatttcatctaatagctggtctctggagtctccccttcagctctgatttgtccgttgctgagaatttcactttaaaatatgtgagccttgcacttttttttttttttttttgcacttctgctttctctatatttttgacaaggttagaaaaggaaaaccttaaacatgataaatatccattgttgggcattccagctaacgtataggaattgtgtccataaatttattcaccaatgtcttttaattgtagagcaaactggagggaaccagaattacataggaatcttagaagcaacctcagcaggctacaattagtctacaatgaatgagtttcccacctggcttacaagacagtgaacccagaagccaaatccaaccacattttgcacctgtttaaaaacttgttaatgacttacagtgccctctttataaagaccaagctccttggcatagcactgaggtccattccagtctgaccgttccttacctctccatccctgctgctcaccgctcaccttcttgggcttctagtgttaatgcaactgtctcatctctggcctctgtgtatactaatctcccacctagtacactttcccgcatccatccttgcctagctaactcctttgtccttcatatctgactttagatgccctctctgagaaatcttccctaaacccctaagactggatttcatgtttcttgtcttttaccccttaccactaaggtggtcttacctctaaggtgtcagatgataatttccaaaaagttaaaggtgtgactctcatgcaaatacatcaaagtctatgccaaagatttatttaactcgttaatgagagaaccagcaggatgataaagttggattgaaggaacctataagaagctgagtatatacagaatagtcagtgaaagcaaggatgctgaagtaagactgctgacctaggtacaaaactgaataatgtcctagaagcaacacaattataaccctttggaactgtttattccaatggagagaaatcatttacatctctgccagacaaaaatcatttgcaacttatcaatttcctacaaattaagatctaacttttcaggatctagaccataagaatttgtgatagtgagccaaatcaaggatttcagatgacgcttgggctggcccattagacaaggctttagaatgacactgaaggacacacagacatcttgctgggtaatttttaatgtgcgtgtgtgtgtgtgtgtgtgtgtgtgtgtgtgtgtgtgtgtttaccagtgacatcaatactcctttgtaactacctgttatcttgtctgaaattcccagtaaactgaaagcatctagggacaacaattgtgttttgtttactcttgtagcctctgaccctagtttagtgcctaagatatagtaggcactcagatagttattactgaatgagttaaaagacttctctttcagcattgaggtccccccttcaaggagcctaccagtttcccacagatccagattatgaatgatgaggattctaggcattgattccagcccaatctttccccaactccagccaagtgtcccctgtgacccgcatcccctcagtcatttctcctgctttgttctactgcacaagccctaatagtcacctggatgatcaggcacagaaggcagcaagaaagaagcatgtctctgtgcaagaagcagggtctcgcttttcagggccccctgcctagccccagtcccagcagattggctagaactgaggcctgatgcctggtgctgcctctgggagcacaagggctccttctgttcctggattcaactcctcagggacagctactggggctccaggcacgttgctcatcattctaactggctcacagggcagccagattttctcacagataatgagcctgtataatttacatcaagactaaattatgcatttaacaacgtgttgttcagcagggataaactgcctggtttgtgaattgcttttcttcccacaggagggaggtacaacagagggagtggagacggggtgcactccacacaccttccagttatgaggggtctggaaaagtctggaaagaaaggaattgaaatagcgtgagtgagagtgacattacccacttcgtatgttgccattgtcaatcctgtaatggtctcggaaagagctcagaaagaaacagggagttgtctgggttcagacaaaaaccacagggaagagtttcagacttcttggctaagtcttaggctccactcaccccaggggtgttggtagaaagtggattaggactgtgtgaaaaggcagcagagaaagatcagaaacacaccaacaaaggctctgcgtgctcttagaagcagggcaggtcactggaaaagctgggaagtgcatgcagtttgcctttagagctccaagtttgctctttctgggcctcctccctactctagggaacctctttcatggcaagtgctccctccagttctgcctaccccaccccccaaaccctggggttcaccatttacccttttattgtgaatttgaaagctgtgtattttctctctctctcttccagagacatccacactgaagcttttcctctgaaaaaggaaaataatgtgaccaaataatttatcatccatccaagaacatttttgagtactcttaaaaattacaccagaaccacaggaataaaccacagctgctctggaagggtcctgggcaagctggacctaagagcaccccagaaatgaaagtctttgtttctttttaaaaaattgttgacatcactgaacaggtgaaaagggctctctgattctttccaaaggggagagtaatgagaaaggatgaaaaggagcagagatgtatcagttaagatgctttcaattgcacataactgagtagccagagataatgggcttaaattaaagggatttctttgtctcacataacagtggtccagtgacaggtggatcaatggctcaaccatagcaggtgtattagtccattctcattctgctaataaagacatatgcaagactgggtaatttataaagggaaaaaagaggtttaatggactcacagttccacatgggtggggaggcctcacaatcatggtgaaggcagaggagcaaggacacgtcttacatggcagcaggcaagagagtgtgtgcaggagagctcccctttataaaacatcttatgagacatattcactatcatgagaacagcatgagaaagacctgcccccatgattcaattacctcccaccgagtccctcccaccacacgtagggattattaaaattagaggtgagatgtgggttgggacacagccaaaccatatcatcagggcttctcagagactctccctcactactgcaagatggctgctaaggctgcatatataatgtcttgacaaatgcacatacaaaatgctaggaaggaggagtcatggcttttcctcttatctatttcccttatcacatggaatatatcttgcccaggctgggcgcagtggctcacacctgcaatcccagcactttgggaggccaaggcaggtggatcacgaggtcaggagttcgagaccagcctggccaagatagtgaaaccccatctctactaaaaataaataaattagctgggcgtggtggcggatggctgtaatcccagctactcgggaggctgaggcaggagaatcacctgaacctgggaggtgaaggttgcagagagcagagattgcgccactgcactccagcctgggtgagaaagtgagactccatctcaaaaaaacaaagggaaaagaatatatcttgcccagaaactctccagcagagctctcctctggtttaattggccaatattgggtcacatgactattgtcatagttgcaagggaggctatggaattgagaatctgcattttctgcctctatgggcaatgaactgtgctggcctgagaaagggtaagaaaatggctacttggtgagcaaccaacagcatcctccagaaataacctccccctaggccttatactaaatcccacgagtcctgcctagaaaataacattcaactgggctcccagtgagaaacacagagtttcaagcagacaatcttctataagttaatatccccaatgagatcctgagaagttagctatgaatctactcagatgtccccactgattgccatggtcttttcagaaatgcttggtcttcattctggttctctgctgcccttggtttctaagcctttatctgggagttgttgtcctcctgagtctgacaagaagtcagggatctctaagaggggactggaatatgccagagggggtcggggacaggcgagtgctatctaccatcaacacttgggcctccaaagggtacacttggatggagccttgaagtctgacgaggaatttcaatctgaccagatttaaaacagattttaatagacaacactttctgcaaaggccaatgaggaaaacaaatcatcttggaaaagcattggctgaatcaagagatgagacccaagtcctgtgcctgtcctcctccttcctctcaggaatagccactgttccctgggagctaactctgagccagatttggagctaaattcatttaatcttctcagcatttccatgaaaggggtacattgttatcatcacttagcagatgggaaaactgagttttagcaaatttcaataacttgcccaaggtaactgtttcctaactcttaaggtgaataaagggcatagtacaggtctagcaagttattagcaatttgattagcaagtttattattcataattatcattaatgctattgctcccaactccttataggtcctatgtgatttcctctttcctctgtccactcttccccttggtcactatgcatcagtgatacaggccttatttccatttctccactgtctcaaaccctgttctgcctcaggacctttgtacttctttccactgcctgaaatgttctttacctagctccttcctttcttcaagccttaactcaaaaagctttccctaaccaccctaaggtccccccttattttctgtaacagcaccctgactatttcttttgttgggtttatcattgatattgtcttcttatttgcttgttcatctctttcaaactctgccaaagcctctctgaggtcaatttattatcagttatcacctttggttagaacaatgcccaacacataataggtccttggtaaatttgctgaatacccttggccgggtgcagtggctcactcctgtaatcccagcactttgggaagctgaggcaggaggatcacttgaagccaggactagcctgggcaacatagcaagaccctgtctgtacaaaaaaataaaatttttttaagctgcaacccgaatccaagtttgagtagctcaaaagcctgtagctatgatcacctaactaggagtttcttggaacacaaattagaaaaccgtgatctaatctaacctctcattttaaagatatgaaaataaggccaaaagggtttttttccccttaagattataaagtaaattagtagctgagttaaaaaaaaagaaagaaagaaagaaaaaagaacattggcattggaaactgaagactccactttacaagtcaaaccgcccttgaaaagccagttaatatatctagcctcagttttctcatttgtaaaatatcgataaggcagcctacttcacaaaacaattttgaggcctgcatgaaatcaggtaggcaagaggccagcacagtgcccagtccacagtaagcgctcaggaaaggacagcttcacttgaatcccaggctagtgttcttcatttccaccatgttctcacagtgagtgaaccccttcacaacatgatacattactctcaacagatcacttttgcacgggcatgtttttgcactcagtttcctttatttttttcctttttttttttgagatggagtctccctctgtcgcccaggctggagtgcagtggcacgatctcggctcactacaagctctgcctcccgggttcacgccattctcctgccacagtctgctgagtagctggtactacaggtgcccaccaccacgcccggctaattttttgcattttttagtagagacggggtttcaccatgttagccaggatggtcttgatctcctgacctcatgatctgcccacctcggcctcccaaagtgctgggattacaggcgtgagccacggcacctggcctgcactcagtttcttatggcaggactacgggagactcatcaaacaatacatgagtagagtcctgtctcagttcgtttctgctgctataacacaatatccaagactgggtaatttgcaaagaacagagatttattttctcacagtcctggaggctgggaaatccaagatcaaggcaccaacacattcagtgtctgctaagggctactctctgctttcagatggtgccttattgctatgtcctcgtatggcagaaggcaggacaaaagggatctagttagttcccttgagctcttttataagagtactcatcccattcgtaacaggcagagccttcatgacttactcatctcctaaaggccccacctcttaatgttatcacattggcagttaagtttcaacatatgaatttgttggggggaggggagagggaacacattcagaccacggcaggtcctaacaacttatttgtgaattcctggttcagagctcagtgtgcagcccactgtatcaagtcctagaccagccaacgaaagctgcgttgaacctatcctgcagcagaaacactggtgaagaagcctggagaaacagaggcctgcagtacccagtaactaaccaggtagaaaagcagccatctggtgtgtcaggactggggtgagtggggtgacagagagttgtgaagggaaagtggaagtggaggcaggtgactacaccttcagctgacctgaagtcagctgacgtgacttcagctgatgtgatgaaatccagctggtttcccaggctgggatgccttttgctttccacaataggaatggccagtagctgccagcccgtggtggaaagaagcaactggagattgcaaactctcctctgctctctcaacaggcaataggatattggggttgccactgcaggttctagggtcacaaaaacacaggttcaaattctacctctgccccttaccaactgtgctacattgaacatataacctgaatttctccctgccttggtttcctcctctatgaaatgggaataacaacatagcactgagttatcgaggttcaaaagaaataatacctgggaggctccctgcatagtttttggcataaacctggcttcaatgagattagcaattgatatcaatttacacagttctaaatagagaaatttttcaaagtaaaagactgagagatagggatacacaaaggcacacaaagacaggtaattttgctttctctgcttgcctttttgcactttgcaagcaagaaggcaggcaagattcggcttgtgctcagcttttatggccgcctcatttcaaaacaacctcaggctacagagatggaacctgcagctttctcagaaaccaaacttttctgtttcaggctgcacgaatggagcatgagaacaccctacagcctgttatttgctgcatgtttctacgggcaccagcaaagcacaacttctagtaatgggatcagtaacccaagtgacggaactgaaaaggcaagtctgaatttatctccatctgtcatgttccagtgaacaatgaaagcacagtaaagggaaacgctgcttcttgcatgtttgtgccagtccttccctgctaggtactattattagcagcattaataaatgcctctgacttgcagtaaaggttcagaatgctggagagttacagggcatgccaaacacataaactgcctgccctcagggctgatgggcacgaaggctataagatgaagcccaaatggcagaaacattctgaccagggaggagtgattgcaggtgaggtagggagattttttttccagggctgtgctggaaatgaaagagacaagccttcgcgcccactatttggctgctcatcctattctattcttgggaaatcattggagagatgagagaagacaagtgacagtccactttgaatgtcacctctaccatcctggagccttgggagaaagctaaagatgtgtccagccttatggctaaataaggttaagctgggacagagactgctcattgttctccagaggctatactctaacttttagaaacacagctctgagttagcagggaactcttaagacatgggactccccaggggtgagctagagacacccacccgggactctgtggccgtaggtgtggtcacaggattgggctctggccaacgggttgagcacagaatcgatgagcacaacttccaaatcacagtgtttttggtggtggtggttgttgttgttgttgttttaatacagaaacaccaagccttccattcttacttttcccctcccactggctggaaaattggaagaactgaaggagccacctcaggcccaggaaaaaaaaccacattctgaaagttgcacgtctatccagccagcaaccaaccacaccagctctaaacctctcaccttcctctgctccattgcatggaataaaagcaaacttctctcctacttaaggcactctgttttggagtccctttcttatagaagcttatctgataccacattcacagatgtggctttgaacttgagtaagagagaagtgtcctgtgtttgtaaaaggttaaaagtttatccacattgccttcctcttgttcctctctccgtccctcacctgctgggctctagctggaccggccacttttctgttcttgaactccttcacttcttccccacctcagagtcctttgccaggaactctctgtcttgtcactcttcccttggttgactcctcaccctcagtttacaagtcacattctcagagagactttctttgaccaccctatatatattcattttctatggtacataaccagtgactgtaaacttagcagccgaaacaccacaagtttttttttttttttttgagacagagtctcaccttgtcgcccaggctggagtgcaatggcacaatctcggctcactgcaacctctgcctcctgggttcaagtgattctcctgcctcaacctcccaagtaactgggattacaggcgcacaccaccacacctggctaatttttgtgtacctttagtagagacagggtttcaccatgttggtcaggctggtcttgaactcctgccctcatgatctgccctcctcggcctcccaaagtgctgggattataggtgtgagccaccgtgccaggccaacaccacaaatttattacctcacgatttctgcagtcaaaagtatatgccacatgttatctgggtcttcatctcaggatctcacaagcctgcagtcaaggtgtcaactggctgtattctcatctggaggctcaatggggaagggatccacttccaagtttccttctggctgtgtcaccaaggtccctgttcccttgctggctgtcagctcctagaggccactcttggctttttgccacacagctcccttcaaaggcagctcacaacgatatggcaccaatccaataagatagactcttatataatgtaacctactcaagggtgactatctcatcatattcatgggcctgcccacattcaaggggaagggattgtacagggcaggaagtgggtggagggaaccagctcttggcagccatcttagaattcagcctagcacatgggcaacgacttcatgactaaaacaccaaaagcaatggcaaaaaaagccaaaatagacaaatgggatctaattaaactaaagagcttctgcatagcaaaagaaactatcatcagaatgaacaggcaacctacagaatgggagaaaatctttgcaatctacccatctgacaagggctaatatccagaacctacaaagaacttaaacaaatttacaagaaaaaaacaaataaccccatcaaaaagtgggcaaaggatatgaacagacacttctcgaaagaagacatttatgcagccaacagacatatgaaaaaatgctcatcatcactggtcatcagagaaatgcaaatcaaaatcacaatgagataccatctcacgccagttagaatgtcagtcattataaagtcaggaaacaacagatactggagaggatgtggagaaataggaactcttttacactgttggtgggagtgtaaattagttcaaccattgtggaagacagtgtggcgattcctcaaggatccagaactagaaataccatttgacccagcaatcccattgttgagtatatacccaaaggattataaatcatgctactataaagacacatgcacacatatgtttcttgtggcactattcacaatagcaaagacttggaaccaacccaaatgtccatcagtgatagaccggattaagaaaatgtggcacatatacaccatggaataccatgcagccataaaaaaggatgggttcatgtccttttcagggacatggatgaagctggaaaccatcattctcagcaaactatcacaaggacagaaaaccaaacaccacatgttctcactcataggtaggaactgaacaatgaacagctgctcacaccaatatccagtcttcacttctccgccccctctccaatgtgatccttgcggtcatccttgatgactctctctcttatccctcacatccaatccatcattcagtagtggccacttctcacctcccccagctcccatcttgctctcttgccccttcaatttattctcttcacagtagctagataggagcttttaaagcatgaacttagtcccctattcaaaaccctccggaatcccccttctcatttggaggaaaatctagttttgcaaagcctatatgcacttgggcactccagtccccacctgtccaccctgagcctgccctggctctctctatggcagtcttactggtctccttgtggttctttttttttttgagacaggctctccctctgtcagctagacaggagtgcagtggtgtgatcatggctcactgcaacctctgcctcctagactcaagcgaacctccttatctcagccttctgagtagctgggactacaggtgtgtaccaccatgcctggctaattttaagaaacaatttttttttttgtagatatggggttttgctatgttgcccaggctggtcttgaactcctgggctcaagcaatactcctgcctcagcccttgaaaagtactgggattacaggtgtgagcctctgcacctggccttcttgtagttccttgaacacaacaagcatcctctcccctctgggacactcagtgttttcctgcctgaaacaccctttccctcactatctgcttgacttgcaccttcacttcttccagtcctgtgaaatgtcaccttaccagtgatccctaaccagccctttctcccctcagcctgccttcttgttctccagtgcatatatcaccatcctttttaaaacaaattatttgcaattctgtttatttgcatattgtctgcatgccctgtattggtttgctggggctgccataacaaagtaccatagactgtgtggcccaaacaacagaattttattatctcacagtgctggaggctagaagttcaaaattaatatgtcaatagggttggtttcttctgaaggctgtgaaggaaagacctgttccaggcctctctccctggtttgtatgtgtccatcttctccttgtgtctcttcagatatgagtcatactgggttagagcacaccctgatgaactcatttttatttaattacttctaaagaccctatcttcaaataaggtcaccttctgaggtactgggggttaggacttcaacatataaattttgtgaggacacaattcaacccacaacattctccgagaaagaacatgaacatcattcatctggtacaaagaaagcactcgttaatctttctcgaatgaatctgtccaaatattcaccacttttatgatcatcaacattattatcattatcaaccagaaaactttaactggcatttctatacttctataggatactgatgattggtattaatcatggtatcatgaaattctgtaaagattcccagacatcatttgactaattggataaagattacacaaaggctataagctcagtatacttttaatgttgtctattttgttgtattctacccaaaataaaatttggtcattcatagataggattttatattacttgccaaatatctagaatatttgtttttactctagtctaaaagaacttgagggtttaagtaacataccaaaaacaggatttcaataaaatgagaataaaaacagataaacctggattaagcaaagaaaagcaaatgtacttgtcatgggagtcactataattgctctatttcagcacacactcacattaaaaattgggggcaacacagcagctggtaaaaacaatatctcagctgtagatttatagcagtccttcaggagacagaagattgtgccttgtgtgaaactcaaagaaatctccacgtcgggcagctatagggtacaactgtctgctgcatcatttcaatatctttcccaacagcttcactaagaattcagaagaatccacgctgtttcttgcatccagcatcataaaaggcaacaacattaaaacattagttcaggtagtttttgaggtctgtgatgcaaattaagaatagcacatagactatgtagtggactaaatagataccacattccttaaattctttcccacaaatctcattgcttttcagctgggctttatgcaggaacgggctctagcacaatcgttaagggagtccgattctggcttttaatccaggttcctccacctctgagctatgtgacctaagacagttacatatctataaaatgggatgattataatgcttattttgtaggtttgtggattaaaggattaaattacataatgtatgtgaagcttttaacacaatgcctggcacgtgataagcactcagtaatgttagcagtgattcattgtagcgtatttttagaccacaggggtgtgtgtgtgtgtgtgtgtgtgtgtgtgtgtgtgtgtgtatgaaactacataggtgagtggtagagttcacattccattatgaaaaccaaggtgcccaaatggtatgcctgcttaaatggaaggctacactctgttcacatgttcccatgaaagagggatataagggaatctgttctagtttcactagaacaccctgttctctgatagacaacagtgtgttaacaatatttataatttcccaaaagtaatgttctcattatgaccaccagtttcatttcttggtattaattcactccattaaatggaaaacaaagagactctaattacccaactctaattacaccaccaaaaacctttgtacggacaacccatctgttgtataatcaagcatttgactggcctttgtccctggcttctgggagggagactctaagttcctggaatttcccaggtaataggtgtgtctgttattcatatgtctcttgtatcacacctgagtgtaagagatgaggtagctcagggtgggatacgatctcagaaagaccaactatgtgattagaagattggagctatgagccagctcagtctctggagagaaggggagggttaggggttgagtttaatcacatggcccatgattcactcaatcatgcctacataatgaaaccccagtaaaaactctggacactgtggctgggcacagtggctcatgcctgtaatctcagcactttgggaggccgaggtggttggatcacgaggtcaggagatcaagaccatcctggctaacacggtgaaaccccatctctactaaaaacacaaaaaattagacaggcatggtggtgggtgcctgtagtcccagctactcaggaggctgaggcaggagaatggcgtgaacccgggaggcagaacttgcagtgagccaagatcatgtcactgcactccagcctgggtgacagagagagactctgtctcaaaaaaagagaaaaactctggacactggacaccaaggctcagtggagcttgctggctgctgaacacattgatgtgctgtcccctggctccatggggacaggacatggaagctctgcaatcagggcccttccagaccttacttatgtgtgtcttcttttggctggtcctgatgtgtaccctatgtaataaaactagaatcataaatacagcacttttctgagctttgcaagtcattctagcaaagtgctcaaaccaagggtgttgtgggaagccccaagatttgtagttcactggtcagaagtgcaggcagccttggtactgaaggaggggcagtctttttagaaaccatgccctcaaaacctgtggagtctgatgttaactccaggtggttagtgtcagaactgaattttaataagcctgttgatgtcaaaataccatctgagtgctcttggggtcttcagaacccctaatcctggctgtggaatacatacctgagagagaggagaggcctcaggatgtttggggtctccagagtcctatttcaaagctgtcaacaattcctcttttccccaaccaccaccatcaccaccaccagagggatcgccattggcacatggcagtcagcgctctcaacagcatcacttcctgaccccttgtagcaagtcctctgttcatggtgaggcagaattcaccaaaccctgggctatccttccatgaggagggaacttgagaaagtttataaggctgatgagacaattttcattcaggttataggttcaaatttatgatgatggaatattattagtatctttcttatttttaagacagagtctcactctgtcacccaggctggagtgaagtgacacgatctcggctcactgcaacctgtgcctcccaggttcaagcgattctcttgcctcagcctcctgaggagctgggattacaggcatccaccaccatgcctggctaatttttgtatttttagtagagatggggtttcaccatgttggccaggctgatctcaaactcctgacctcaagtgatctacccacctcagccttccaaactgctgggattataggtgtgacccaccacacccagcctattagtatcttacttacagtaaaaaaactacaaaataaatagttactaattgctgcagattgtagtagttatttccttgttcaactgttgcattcccaacagattttttctctcctctttcttctcctaacagactctgcctgtcttccattgctcagtcataagaacgggcatgagagtacctgtccagtcagagtatttgttttagttagggtaggttaattgctataacaaatcagccacaaagcataagggctcaaacacaataaaagtttattttttgctcacataaagagttcaaagctattaaggtcagattggggaggaagagggctttgttccacatattcattcagtgatcagctgtctagcagctccttccacgcgtttccatgatgtctttggacaataatttccagctggtggaagggaaacatgagggtgaaagaccatctgtttcataatctccatgagccagaagtaatacatatcaatttcatttgtattgctttgataagaactagctaaatggcctcatctaggtgcaagggcagctcagaaatgtagtccttgcctggccttctgcttcccagaaagatccctctaatgtggaaaagacagtacaaattttggtagatggttagccatcagaaattgaataaagggtggaaccatgacccaaactgaaccaattaaagtacatttgtgggactgatacttaaaagatgggagaaaaagagaaatttccttcccagccaagttgcatcactgggaggatgcaaatctggacttctgaggccacattctccaccatgaggtgaagtgtctacaaagtgaagccagggagtgggagatggagagagaatgaatgggaaagtgagcgagtcctaatggcctcgtctcccagttctgatcttggagggtcagcttccctttttggtcctctgtttatggtgaggcagaattcaccaaaccctgggctatccttccattaagagaaaacttgagaaagtttataagactgatgagacagttgcactcagattacaggctcaaactaagcccacatttatgatgatgggatattattcccagctacacaagccaatgagttcctctctttaaggatcaaatttagtttccgtcacttgcatcattctttgagcctcagctatatgccaaaagctactaggcattttatataatttcccaaatgaatccttaaaacaattataggtattattagtttcattttatagatgagaaaacagaaataagaagtaagtagagaaacagtccaaaatctagatctaatggtacagggcaaggattgacaaacattttctgtaaggggaagagagtagatattttaggctttgtgggccatacgatctctcacaactgcttaactatgccactataacacaaaagcagccacaggaaatagtatattaatggatgtagctgggtttcaataaaactttatttacaaatcaggcagcaggctggatttgacccatagggcatagtttgctgacccttgatatgatggggtttggggaatgaacaatgctaacctgaaagtcaagacaactatggttttgtctgtaactaaatttgtgattttgaacaaattacttgacacctcagttgctctccatttccttattcatttcaatgccctcaccagccttccattctatcgcgtccttttcaattcccacatgcataatgcataattaattcacaatttaagctggagttcaactgagaactactaatgtatttttattttaagtttgccttatcacagagtatataaatcattaattaatcctttttcttgatgcccctagttcatggaaggtgtctgtgattcgtgtgatttcgtccctcaggtgcccctgggatgggcagggccattggcccccatgctatgtgccgtgaggtcagccatcagtttgtctggtggcactgcctgttgcctctgccatcacttctcactggtgctaatctgctccctaatgaatactcatttgcttagatcaaggtccaagaatgtgtccttgttcatccctccttcgagtaaactacaactatgcccatagagaccattccctttgacttcaaattccagggcctggggggttggcattcctagaaacatgatcctggaggaacagggcattgtttaaatgcctgcctggttaacttgtttagccaaaaatatgacactcaagtcataagactaattttacaaactactcttttcttaagcaattaggcttccagaagtctctggcacatgaaaattttccatgaactctgaaagccaattagaacagaggaaaacaaaagttggagactccatatccttcatctcagtaaggtcatggacgtcccctcagggctctctggagaaagtccattgtcaacatacttgtgtactgtcagtgggatcaaaagagcatcaaatcttttgggaatatttggaactagagatctgagggttagaatgagtcaaggaaggtgaaatggtaaatgttcatagactaggcctccctccctgataaagggcagatagcagataggcaactggtgtttagaagagggccagatagtaaatatttttaggctttgcaatctatatactctgcacacggtctccgttgcataatttttcttttctttcctttcttttttttttttttttttttttttttgctttttagcttttcttaacaaaaaaattaaaaatttaaattagaaaaactattattagctcaagggttgtacaaaactaggcaaatttggcccacaggctgtagtttgctgaccattgcaacaggaatcctggctttgccatcactaggtgtatgatgggggaaggaataactatccaatttgtttgtttgtttatttgagacagagtctcactctatcacccaggctggagtgcagtggtgtgatcttggttcactgcaatccctgcctcccaggtttaagcaattctcctgcctcagcctcctgagtagctgagatcacaggtgcatgccaccatgcccagctaatttttgtatttttagtagagacagggtttcaccatgttggccaggctggtatcgaactcctgaactcaagtgatccatccgccttggctgggattacaggcatgagccaccacacccagtcctagggaatgaataactatgcattctaagtctcattttcatcatgtataaaatgagaatgccaccacctatattgtaggattgttgactgggatgctgcttcacagcactagcacatagctccattcggtccatgaacagtagctggcactgctaatttctgaatcatcatacagtctctgttttcatgtggctactactttttctttgtctctgccttctctgaaaaggcccttaaatgttagtcttagggttttaggtaagggttagatttatacacaggtaggccttgaggaataagatggtgttatagttcggatgttctcaaaacttcgtgttaaaatttgatctccagtgttggaggtggagcctagtcaggggggtctttggggcagatccctcttgaatggcttagtgccatccttgagctaatgagtaagttcttgccctattagttcccatgaaagctgtttgttaagagcctgacacccctcgctcttactctctcactctctctcctctctcttgtttttcctctgaccacgtgaccttgcacacatctcctccccttccacttccaccatgagtggaagcagtctgaggccctcaccagaagcagatgtcggtgctatgcttcttgtacagcctgcagaaccatgaacaaataaaccactattttttaataaattacccaccctcaggtattcctttatagcaacacaaatggactaagacagatgcatttaagactctgctaaaaataaaaaataaattaaaaagagagtagttctttaatatctttcctgccagactgccaaaggcatgaatttccacctgcaaattgcccttttgcagcacaatattcagtctccatagtctcctgttacaatacaaatctatgactagaagagacaggggccacctggctggcctcactaataccacagcacaaggttgcttagcaaattagctcatctttgatcacatagcctgaaggaaatgcccacaatgaagaccacactagccagaagacagtctgtagaggagtcactcaaaggctttacaagaaacaagggctggagggagactcctagagaggaggtgagagaagacaaactttgtgatctgatagcctgtgtatttcactgtcctcaaccgtctctctcccgattcctaggttctggcacctactccctccattgttggtgcttgaaatttgtttgctctcctaatcccaagttaggttagccacagcctgcctccatgacttcctcaaaattcagcccatgtcccttgccaacagggcagcttgcatttccagaaattcctgtgtgcttaagtgaggtgaaagtggattttacgttaaattgtttgtctttgtgattgtgaaatctaactaatgtactgaaaagtacatggagatgaacctgcatgaaaagaaacccattgaggcctcctgttcctatgcacacttcgtcccccttcctggtcctaacaccctctctcccccctcacagtcaccactgtcctcagcattctggtgctcatttcctctgccttttaaaaatagttttatttcctcattatgcacacctggacaatatgtttaaatgttgtctgttttcggattttatgagtggaattgtgcagtgtgtattattagatgcctaacctcttgctcaatgttgtctttaagaagcatacctgttgtggtgtgaaacggcacctgttttgatagctatgtaggattccactgcttgaacacaccccaactgtttacccattctactattgatagacactcgggctatttccatgttgggacaattacagtgtggctacgaacctcttaaattgtatatactggtgctgtaagcatgcatttcttataggccctagggaattggggtcatagacatttgtaaccaataatcaattgtagccaagtattaccaatttttttccaacaatttttttcctaggcttttcttgcaattttcaagaaaatatttcaattcatataccaagaagaaagaaagtgattttttttccacaatagtcttttcaatttttttaatttttttagccacagtctcaccctgtcacccaggctggtgtgcagtggcacaattacagctcactgcagtctcagcctcctgggctcaagcaatcctcccacctcagtctcccaagtagctaggacttgggacaacaggcacgtgccaccatgcctagtgatatggtttggatctgtgtccccacccaaatctcatgttgaattgtaatccccattgttggaggtggggtctggtaggaggcaattggatcataggggtggagttctcatgaatggtttagtaccatcccccttggtactgtatagtgagtgagttttcaagagacctggttgtttaaaaatgtatatcacctcccccctttttctctcttccttttgctctggccatgtaagacgtgcccacttcccctttgctgtccatcatgactgtaagtttcctggggcctccccagaagaagatgccaccatgcttcctgtatagcctgcagaaccatgagccaattaaacctcttttatttataaattacccagtctcaggtatttctttgtagcagtttgagaacacactaatacactcagataattttttttaagagatgagggctcactatggtggctggtctagaattcctgggttcaagcaatcctcccacctcagcctcccaaagtactaggattacaggcatgagccactacgcatggctttttttttcacagtattcttaaccagctcttatgcttacattgcaccacagtacctttatttcatcattcactcaccaaatatagtaagcatctatcatatgcctagtactatgcttacagtcatgaacaaaacaagcaaatacctccaaccttaaacagctaacattctagtagtgagacaattacaaataaataatacctttttaaaaatacaccagatgcagaatatataaagaactcctacaccttaacaacaacaaaaatcctaatgaaaaaatgagcaaagacttagacatttctccattgaagatatacaaatgccaacaagcctatgaaaagatgcttcacatcactaaccattagggaaatgcaaatcaaaaccacaatgagataccacctcgcatccattagaatggccactgccaaaaagaaaataataagtattgatgagcatgtagagaaattggaacccttgggcaaagctggcagaaatgtaaaatgttacagccattgtggaaaagagtatggcagttcctcaaaaactaaaaatagaattaccatatgattcagaattccacttctggataaatacacagaattgaaagcagggccttgaggagacatttgttcacctatgttcacagcagctttattcacattagccaaaaagtagaagcaacccaggtgctcattgatggatgaatgcataaacaaaatgtgtatatataccatagaatattattcaggcttaaaaaaagaaggaaattctgacccatgctacaaacttggggacattacgtgaagtgaaataagccagttacaaaaaggcaaatattgtatgattccacttatataagtagtcaaattcacagacagaaagtagaatggtggttgccagaggttggtggggggaggtgagagcagtgaggtagggagtagttgtttagtggatgcaaagtttcaattttgcaaggtcaaaggactttcagagatggatggtggtgatggttgcacaacaatgtgaatatacttaataccactgaactgtacacttaaaaatggttacaatgggggtggaggcagagcaagatggccaaatagaagcctccagcaacagttctccccttccccagaagaacaccaaattgaacaactatccacatgagaaaacaccttcattagcaccaaaaatcaggtgagcaatcatagtacctggtttcaacaacatatcaaggaaagaggcactaaagagagtgggaaagactgtcttgaatccctgacatcacccctgcccgatcccttgacagtggccacctggtgcagagagaaaatatgtgtgcttggggaagagaaagcacagtgatcgtggaacttttgttggaactcagggctgccctgtcacagtggaaagcaacacatggcagaattcagctggtgtccacagaggaaacatttagaacagccctagccagaggggaaacactcatcccagcagctggaatctgatttctggctagccccaccaccacaggctaaaaggctttggggtcctaaataaacataaggttgtctagaccacaaggactgcaattcctgggcaagtcctggtgtggtgctcagctggttagacaccaactgaggtggccaagtgaatgcttgcatcacctctctcccaacctcaggcaatgcagcttacagctctaggagaggctccttccttctgcttgaagacaggagaaagaagagtaaagattttgtcttgtaacctggataccagctcagccacagtagactaggacaccaggcagagtcctgaggcccccattccaggcccgagctctggtcgacatttccagtcacaccctgagccagaagggaacccgctgccttgaaggaaatgacccagtcctgggaggttcatcatctgctgactaaagagcccttgaaccttgaacaaacctcagtggtacttaggcagttctcactgtgaaccttggatgagatccagggctgtgctggcttcaggtgtgacctagcacattcccaggtgtggtggccatggagacagactccttctacttgaagaaaggggaaagaagagtaaaggtaactttgtcttctggcaattccactactggatatttagccaaaggaaatgaaatcagtgtgtcaaagagatatctgcactcccatgtttaatgcagcattattcacatagccaagatttggaaggaacctaagcatccatcaacagacaaatggataaatgaaatgcagtacctacatacaatggagtactattcagccacaaaaagaatgagatcgtgtcatttgcaacaacatggatggaactggaggtcattatgttcagtgaaatgaagccaggcactgaaagacaaacttcacatattctcattcatttgtggaagctaaaaattaatacaattgaacttatgaagacagaaagtagaatattggttaccagaggctggatatggcagtaggggtggcagggggaaatgggaatggttaatgggtacaggaacatagtttgatagaatgaataagatctagtatttgatagcacaacagtgtgaatacagtcaacaataattcattatacatttaaaaataacaaaatagtataatttgaatatttataacacaaagaaatgataaatgtttgaggtcatggataccccatttaccctgatgtaattaatatgtattgtatgcctgtatcaaaatatctcatgtaccgcataagtacacatacctattatgtacctgcaaaaattaaaacataaaatttaaaaaatggctaaaatggggggtggtccaagatgcccgaataggaacagctccggtctgtagctgccagcgtaatcaatgcagaagacgggtgatttctgcatgtccaactcaggtacctggttcatctcaatgggactggttggacagtgggtgcagcccacggagggcgagccaaagcagggcagggcatcacttcaccagggaagtgcaaagggtcgggggatttccctttcctagccaagagaagccgtgacagactacctggaaaaacgggacactcctgccccaatactgtgcttttcccaaggttttagcaactggcagacaaggtgactctcttccgtgcctggcttggtaactcccacacccatggagccttgctcactgctagcagtctgagatcaatctgcaagatggcagcctggctgggggaggggcgtctgccattgctgagacttgagtaggtaaacagagcggcccagaagctgaaactgggcagagcccaccgcagcttaacaaggcctactgcctctagactccacttctgtggacagggcatagctaaacaaaaggcagcagacaacttctgcagacttaaatgtccctgtctgacagctctgaagagagcagtggttctcccagcatggcgcttgagctccaataacggacagactgcctcctcaagtgggtccctgacccctgtgtagcctgactgggagacacctcccagtaggggccaacagacacctcatacaggtgggtgccactctgggacaaagcttccagaggaagaatcaggcagcaatatttgctgttctgcagcctccgctggtgatacccaggcaaacagggtctggagtggaactcccacaaactccaacagacctgcagctgagggacctgactgttagaaggaaaactaacaaactgaaaggaatagcatcaacatcaacaaaaaggtcatctacaccaaaaccccatctgtaggtcaccaatatcaaagaacaaaggtagataaaaccacaaagatgggaagaaaccggaacagaaaagctgaaaattctaaaaaccagagtgcctcttctcctccaaatgatcgcagctccttgccaacaatggaacaaagatggatggacaatgactttgatgagttgacagaagtaggcttcagaaggtcggtaataacaaacgtctccaagctaaaggagcatgttctaacccattgcaaggaagctaaaaacgttgaaaaagattagggcttaactttaacttaaaatgcctaactagaataaacagtgtaaagaagaccttaaatcactggttggagctgaaaaccatagcacgagaactttgtgatgcatacacaagcttcaatagccgatttgatcaagtggaagaaagggtatcagtgattgaagatcaaattaatgaaataaagcaggaaaacaaggttagagaaaaaaagtaaaaagaaacaaacaaagcctccaagaaatatgggactatgtgaaaagaccaaatttacgtttgattggtgtacctaaaagtgatggggagaatggaaccaagttggaaaacactctgcaggatattatccaggagaacttccccaacatagcaaggcaggccaacattcaaattcaggaaatacagagaacacctcaaagatactctttgagaaaagcaaccccaagacacataattgtgagattcaccaaggttgaagtgaaggaaaaagtgttaagggcagccagagagaaatgtcgagttacccacaaagagaagcccatcagactaacaacggatctctcggcagaaaccctacaagccagaagagagtgggggccaatattcaatattcttaaagaaaagaattttcaacccagaatttcatatccagccaaactaagcttcttaagtgaaggagaaataaaatcctttcagacaagcaaatgctgagagattttgtcaccaccaggcctgccttataagggttcctgaaggaagcactaaacatgggaagaaacaactggtaccagccactgcaaaaacataccaaattgtaaagaccatcaatgctatgaagaaactgcatcaattagtgggtgaaataaccagcgaacatcataatgacaggatcaaattcacacataatgatattaaccttaaatgtaaataggctaaatgccccaattaaaagacacagactggcaaattggataaagaatcaagacccatcagtgtgctgtattcaggagacccatctcatgttgcaaagatgcacataggctcaaaataaagggatggaggaagatttaccaagcaaatggaacacaaaaaaagcgggggttccatcctagtctctgataaaacagactttaagccaacaaagatcataagagacaaagaaggccattatataatggtaaagggatcaattcaacaggaagagctaactatcctaaatatatatgcacccaatacaggagcacccatattcataaagtaagtccttagagacctacaaagagacttagactgccacacaataataatgggagactttaacaccccactgtcaatattagacagatcaatgagacagaagcttaacaaggatatccaggacctgaactcagctctgcaacagacagacctaatagacatcaacagaactctccaccccaaatcaacagaatatacattcttctcagcaccacattgcactaattctaaaattgaccacataatttgaagcaaagcactcttcagcaaatgtaaaagaaatcacaacaaactgtctctcagaccacagtgcaatcaaattagaactcaggattaagaaactcactcaaaaccgcacaactacatggaaactgaacaacttgctcctgaatgactactgggtaagtaatgaaatgaaggcagaaataaagatgttctttgaaaccagtaagaacaaagacacaaggtaccagaatctctgggaaacatttaaaacagtgtatacagggaaatttatagcactaaatgcccacaagagaaagcaggaaagatttaaaatcaacaccctaacatcacaattaaaagaactagagaagcaaaagcaaacaaattcaaaagttagcagaaggcaagaaataactaagatcagagcagaactgaaagagagacacaaaaagcccttcaaaaaatcaatgaatttaggagcggttttttgaaaagatcaacacaattgatagacccctagcaagactaataaagaagaaaagaaagaagaatcagacacaataaaaaatgataaaggggatatgaccaccgatcccacagaatacaaactaccatcagagaatactataaacacttctatgcaaataaactaaaaaatctagagaaatggataaattcctggacacacacaccctcccaatgctaaaccaggaagaagctgagtctctgaatagaccaataataggctctgaaattgaggcaataattaatagcctagcaaccaaaaaaaagtccaggatcagatggattcacagccgaattgtaccagaggcacaaagaggagctggtaccattccttctgaaactattccaatcaatagcaaaagagggaatcctccctaactcattttatgaggccaacgtcatcctgataccaaagcctggcagagacacaagaaaaaaagagaattttagaccaatatccctgatgaacatcaaggcaaaaatcctcagtaaaacaccagcaaaccgaatccagcagcacatcaaaaagcttatccaccatgatcaagttggcttcatccctgggatgcaaggctggttcaacatatgcaaatcaataaacgtaatccatcacataaacagaaccaaagacaaaaaccacatgattatttcaatagatgcagaaaaggcctttgacaaaattcaacagcccttcatgttaaaaactctcaataaactaggtattgatggaatgtatctcaaaataataagagctatttatgacaaacccacagccaatatcatacggaatgggcaaaaactggaagtattccctttgaaaatctgcaaaagacaaggatgccctctctcaccactcctattcaacatagtgttggaagttctggccagggcaatcaggcaggagaaagaaataaagggtattcaattaggaaaggaggaagtcaaattgtccctgtttgcagatgacatgattgtatatttagaaaaccccataatctcagccccaaatctccttaagctgataagcaacttcagcaaagtctcgggatacaaaatcaatttgcaaaaatcacaagcattgctatacaccaataacatacaaatagagagccaaaccatgagtgaactcccactcacaattgctacaaagacaataaaatacttaggaatccaaattacaaggaatgtgaaggacctcttcaaggagaactacaaaccactgctcagcgaaataaaagaggacacagacaaatggaagaacattccatgctcatggataggaagaatcaatatcatgaaaatgaccatactgctcaaggtaatttatagattcaatgccaaccccatcaagctaccaatgactttcttcacagaattggaaaaaactaaagtccatatggaaccaaaaaagagcccgcattgccaagacaatccgaagcaaaaagaattaagctggaggcatcatgctcctgacttcaaactatactacaaggctacagtaaccaaaacagcatggtactggtaccaaaacagagaggtagaccaatggaacagaacagaggcctcagaaataccaccacacatctacaaccatctgttctttgacaaacctgacaaaaacaagaaatgaggaaatgattccctatttaataaatggtgccaggaaaactggctagccatacatagaaagctgaaactggatcccttccttacaccttacacaaaaattaattcaagatggattaaagacttaaatgttagacctaaaaccataaaaaccctagaagaaaacttggcagtaccattcaggccataggcatgggcaaggacttcatgactaaaacaacaaaagcaatggtaacaaaagccaaaatagacaaatgggatctaattaaactaaaaagcttctgcatggcaaaagaaactaccatcagagtgaacagacaacctacagaatgggagaaaatttttgcaatctacccatctgacaaagggctaatattcagaatcttcaaagaactcaaccaaatttacaagaaaaaaacaaacaaccccatcaaaatgtgggcaaaggatatgaacagacacttctcaaaagaagacatctatgcagccaacagacacatgaaaaaatgctcatcatcactggccatcagagaaatgcaaatcaaaaccacaatgagatatcatctcatgccagttagaatggcaatcattaaaaagtcaggaaacaacagatactggagaggatgtggagaaataggaacacttttacactgttggtgggcgtgtaaattagttcaaccattgtggaagacagtgtggcgattcctcaaggatctagaactagaaataccatttgacctagcaatcccattgctgagtatatacccaaaggattataaatcatgctgctataaagacacatgcacacgtatgtttattgcggcactattcacaatagcaaagacttggaaccaacccaaatgtccatcagtgatagactggattaagaatatgtggcacatatacactatggaatactatgcagccataaaaaggatgagttcatgtccttttcagggacatggatgaagctggaaatcatcactctcagcaaactatcacaaggacagaaaaccaaacactgcatgttctcactcatagttgggaactgaacaatgagatcacttggacaaagggaggggaacatcacacactggggcctgttggggggtggggggctgggagatggatagcattaggagaaatacctcatgtaaatgatgagttgatgggtgcagcaaaccaacatggcacatgtatacctatgtatcaaacctgcatgttgtgcgcatgtaccctagaacaataaaaaaaaactaaaatgctaaattttgttatgcacattttaccgtaaattttttaaaacagatatatatgcagatatagacatatagttctatatcagacatatgtctatatatgtcaaatattgacaaataaaatgggaagagtagggagtgttggggggcgtagttgtaaatcaagtgattgagaaaggcctccctaaggagatgtttgagcaaaggcctggaggagggagggagggagccatgtgggtttggtgtggcagagagggagtgttctgaatagcaggtgtaataagtgcaaaggtcctaaggtgggagtgtacctggggcatcagaaggctcgagcagagccaatcaggagacgatgagatcaaggaaggaaggagggtgcagttataggtgcacaagggcatcacaggccactagaggtgcttgacttttttttttttttttttttttcgagacggagtcttgctctctcacccaggctggagtgcaatggcaccatctcagctcactgcaacctcttcctcccaggttcaagtgattctcctgcctcagcctcccaagtagctgggattacaggcactcaccgccacacctggctaatttttgtatttttactagagatggggttttaccatgttggccaggctggtctctaactcctgacctcaggtgatccgcccgccttggcctcccaaagtgctgggattacaggcatgagccactgcacccagctgaggcatttgactttttgctattgtggggttttgaacagagtggtgacaagagctgacctatattttaacagattcactctggtcacagtgtggagagtagaccatggtgctaaaggtgggggccaggaccctgtagggggctacagcacttatccaggccagggatgagggaggagtggatgagggtgaaagcataggtggagactgggttggattagggacatactgtgaagctaaagtcaacaggatttgctgaaggattgcatgtggagtgtgagaggaagacaggagtcaaagattgctaccaggtttggagctgagcccaatactccgtggtttgtgtggcaggttcatgtcaataatcttatttcctgctgatcgtcaaaccctcatagggttcacaatgtcagggcttgggtttgggagctaccaagcctgagtctggtactcatttgcagggtggcccaagccaagccccttagcctctctgggcctcaattgtccacctgcaaaatggacctactgatgtttgatagatttgttattgtgaggatcgtggcacctgctgcatagggattgttcaatagtggcagctgttattattgatgagcacagctggaattagaacatggtcctctgttcccagttctgtgttcctttcctgatggctcttttctcaatttctagacagcttctggtcaattgatcattcttgggaatagcatgtcactttccaacattttaattatgcttggtctcatttgagaaaagttttcttcgaccattagactcttttctaagagtctgacagttcctgagttggggtatggtcttgtgtgtgactgtgggtgtgtgggcggcagttctttcaattactttttcttttttctgagacagggtctcactctgttgcccaggctgaagtacagtggtgtgatcatggctcactgtagcctcgatcatggctcactgtagctttgacctcccaggctcaagcaattctcccacctcagcctcccgagtagctgggactacaggcacacacctggctaatttttgtgtattttttgcagagagagggtctcactattttgcccaggctggtctcaaactcctggcctcaagcgattctcccgcctcggcctcccaaagtgaggggattgcaggtgtgagccactgctcctggcttaagtgattttatttggtattgccccctttcaagtaggagccttgtgatccagagcccctcttctcacctggcttaatacatctttttccccagactaaactgactagaccttttaacatttattaagcaccctctcactctagctaagatttagttctagaacactagaatagggaaacttttcctctccccctcccataatttagcacataaacaatgaaatgggaagaaatgttgagcacatcacacagtagaccacgtggggcttgaaagaggggcaggaggggctgccagagcactgcacgaggagcctgaacacctgggtctctactagctgtcaatcacagatcactacctctctgaactttagagtctttgactacaaaatacaaataacagcatctgaccctgtacctcatggagttattaggaggatcaaattagagaaagcatgggaattaaggtgtcataggtcatgaattacaatatttattaaattcaaatgcataagccataatcccactcgccttccactgtgtcccaaagtgtggttcgtggacttccctcatcagaatcacctaaggttgcttaatgaaatactgaattctgggtcctacctcagcccaagtctctccctccccacctcccaaccagccaagtgattattaagcataataaagtttggagctgctggtccaggaactaagtttgatgggataaaaaaaagaagataaaggataattatttaagtgcccatagattcttggcattcacataggtgccaacctataatataaatgactggccttatccatcatgtttgaatattcccaatgggtggcacattgtgttccattaaaaatagctgggtaaggccacttgacagaattttaaataggcaatataaattgttacacacgtcccttctgaagggacatttttaatgtagagtcttttgtctaaagataaatttctaatgttctttccacctgtctcctatgcccccagaacacccagtcttggcttttcttggtactttactaaatgccacgaagctgaggactcactgcttttcaatgccagcatttctgacccaggctcctctcccacagccaacccatcactagggccaaatcagcaattgtacctgccgtaacaatctgggtgagcgcccaggggacagcctgttctggttgaagcaggacctgaagttcttacggcacattgactcagcaggactcagatgcttccacaagccagatgggcagtgggggtttccatatcctcagcctgcaatctctttagcccagataataggcccaccagctggtcatccactcccgaagttttcagctgggcatttctccatccatttaaaagtacagtaagctttatagatacatagatgctccagaaccatttggaataaattgagcatgtggcagaggaagagggcaggggatttccaagaacgaccagcagcacttggagatttgtttcttaaaaaacacgactccttttcttctctgatcctgtggtctattgtgaaatgaccagagatttctcccaaggatcttgagagagagagagagagagacagagagagagagagagagagagaaccaagtgctatcggcaaagaggccatacttggatgccatgatcatcagacatttctctggcccctagaatgagttggaacagagatgcggcgtgcaaaagcctgagcctggagcccggggtgattttagaaaagcaacactccctcacctgggagacacagaaaccttgagaaaagtgtggagcatgtgcttgtgctgaggtgatctatatatctggggcccaaggtacctgcatggacagctagttaacattcttatttttgccattattacttttgttttcctaactcccccggactcactctgcccacccccaccaatgttgtctccccatctgaaatgccctccctcaaagctcccctcctccacgctgtctttcctgaccagagttctcactgacctcccgctgctcagggcgctcctaacagtcatctacccacgttattctgtgcgtatgaatctgacattcccaatatgattgtgcgtcaggcgccaagcctgggcacccttcgttattccacctcactacccagccaaagcgggtgtctgctaaatgcctgctgactcgttggcagtgggctgggacatagaaataatctttaaaaactgaattgggtaatacaatagactttgtgaaaaacagatatacctgaatgatgagaaacaagtttggcaaaacaagacagtagaattattccatcattctgcatctaaaaaaagttagagggagagagaaaaatgaaaagttcccagtgacatcagctttggcagtccctaatggaaagtggccttgccagagccctgctccctcgctcaattgggaacgcttttcattaatgctattaacctggccccacagtcagaggcacagcctgctgggccaaatgtgctcggttccaattgctgaatcatctccatctcttttgcccttcctaataccttcaagaactaggagaagcaaaggagggcagcaaagaattagaagaagcaccaagcactatcaacattagcaaatcagtactaggaagtagcttggccgcttccttccatttccttccaaccctgggaactctttccattaaaaacatttctccaccacatccatgttttagacttctcactgtatcagcccaaaggaaaactcagctctccatccccaaccacataccatgagcgatttccttctaagggaggaaagtcaccctttgcagtttacagcttaattgcttgacatcaatcaagaaaccctagtaacatcctgggaattctgggaccttctgaaagcagcctggaagatcagaagtctttccagctgccccctagactcagcatgattaaaaggtgcggaaggacccccagatgggagatgtggagaaaaacaccaagaaggaagtgaaagtcagacataaccaagaaggaggcaaatttaatcttctctgagctggaaaattaaagccaagagaattctattattaggaacctctgttccgaaggctgggtgggggcgggatgcaaaaaaggctgcactgccctctattgggacctaacagcactcagctaagggctcttcattcatgatctcagttagtcattgcacaacttttgggagctattagtaatggaaaaaagaccagagaaatcaagtaacttgctctagctcatgcaactaggaaatggcacaagcaaggatactaaaccagggacaaatggctttcccagtttattttcttgccattcatctttatagccaagcttttcctccttggacccagaacatggcatgttgtaagcgtttgccagcagttctctctggcatgatgggtctcaaagctagctgcctattagaactacctggagacatgctctaacctgccaagtgttcaagccccacctccagtgattctgattttaattgatcttatgtagatcctagcttaagtaggttttaaaagttctccaggtgattctaacatatagccagtgctaagaattcctgttctagctgcagaagatatagaggcaaaacacatggccccttccaaacctgggacttgtatttaatagaatttaatacgtttagagggcttcactaaagaaaaatcacttttgaaggctgtaggctttctagtggaatgttagttctgctttatggtatggtaggctgaataatagtcccccaaagagcttcacgtctcaatcctttggaacctataaatagattactttacacagaaaaagagactttgcagatgtaattacattaaagatcttgagttgaggagattatcctagattatctggatggcccagatataatcacaagggtccttcgaagagaggcaggggagtcagagttagagaagatgtgatgatggaagtggaggttggaatggtgtgaggaaggaatacaaaaaatgcagtggcctctagaagctgaaaaagggagaggaaacatcctcctttagatccttcagaaagaacagtcctgcacaggcttgactttagcccattgagactgattttgaacttctgacctccagaatcataagaataaatttgcattgttatgagccactaaatttgtgttatttgttacagcagcaaggggaactaatacagatgtggtgcagctcgcttcagccatctgaggcttgggttcctcacctctaaaatggatactcatacctacttcaataggactaaattcaataattataaggaattcttgtggctggcacacagtaagtgttcaataaacggcacctactattacactattacacctactactactacagctactattacactcatccatagaggaacctgggattctcatctcctgagaatcccaggttcctcatgcagctctgagtcaaaacaggtggggcacaaagtggaaaaaatataataagatgtgagaagaaagaggcttttagttgtgcccaaatacatttctacaggacaagggatcaaggtgaatggaaaataaattagcaagagagcagtggcagcagaatttctcagccagctggcctctgggggatgtttgcacacgctggttctgaacatgctatcagattcctggcactattgggtccacttcccaggaactcagccccttattgtaagaattcacaaagagaaagagaaaaggaattagaatcatcataatacctaaaggacccagaaatatacaagttcccctgtccaaatacagctagccagtcaatttctgagcagttggacaatttcaggttcttaagctctcacaagaataaaacattgttttctatctatgtagtgttggttggattgatagtattaatggacattctaccatgtatgagacttatgaccttaggcaaattactctgttcttcagcttcttcacctgtaaaacagggacaagggtaacacctagttgtagggttgtcatgaagattaaatgatttatacatgcaaagggcatagtaaagtgcctggcacacagtcaagtgctcggtaagttagctattaacattcccagcagggttatttttattttggaaaaagacatgaggctaggtgaaggaagccaccgacttagaatacttttcatgaagaacagtatttttgttgttgttgttgagacaggttctcactctgtcacccaggcaggatggggtgcagtcacgcaatcatagcccactgcagcctcaaactcctgggctcaagcaatcctcccacttcagcctcctgagtagctgggactaagacacaatccaccacacccaggtaatttttttattctttgtacagacagggtctcaccatattacccaggctggtcttgaattcatggcctcaactgatcctcctgccttggcctcccaaagttctgagattacaggtgtgatccaccgtgcctggcagaaagacagtaatttttaatgtccttttattgttttatgtagttttgtttttaaaggagcttcaagagaaagaagtccaaaataggagccagatacaggcacgtattcactcagccaatatttattgactgtcaattatataccaggaacttttctaggaactggggcctaaagataaacaaaatctgttccctacacataaggagtgttcagcataatggtggaaagagagatggtagattcctagcacaagacagcaagacacatgctgcaataagagtaggtagggcatggtgaagagatacataggagaaaatctgatctgggataggggacatcagggaggacttcctggaggaagcaacatctaaattggctgagtaggtttgcagatggatgataaggatgtggagagttttagaggaaaccagctcttccgaagttttgagggcaagagcaagcagtgttttcaggaaactgcagtcaagatgaacccaaggggtggggccaggcctgaaacgggaggtgagagattcagcaggagttctaaatgccattcagatcacagatcacaaagatggagaaccatgataacgagtttgtattttagcttgaggacaatgaggagctgttgaaaggctttaagcagggcaatttcacaataagatttgagctttagaaagatcactctcaggagagtagttgaaagacaagatcaaagtcagaaagacaagctggaaaactattgcaataattctggtgaaagataaaagaagacagagtcaaggtactggcagtggggaatgattaggcatggacagatgttagaatggcagacctgcagactctgtgatcaggtgagaaagggaggaaaaaaatctcatttccaggtttctaacttggatgaaaggtggtaccactcactaattcaggaaatccaggaagcagaagtttgagaggcaggtaatgagctcagcttttgacaccttgatgtggacacattgaaggcctgtggggaccttcaagtggacatgcgcagttagcagctagatatgagccttgagttcaagatgaagacttgagatttgagtcattggcccatagttcgtctatttgaaaccatgggaatgggtgagaccacccggggacagtgaggagttcaaggtggaggcatgatgtcctctggcaagaatgctgtctaaggagacacagagataagacagtaattggaggggagcaggaggtaaagggagatagtgttttgctgtttttgtgttttaacaaacacttgagattgttgaaatgttgctgatgaagaggaatggggtgggtggggaaagaaaggattaaagtagagtctatcttctttgttcacagattttgtatttgcaaatttgcctactcactaaaatgcatttgtgaccctaaaatcaataatcacggtgctttcatggtcattcctggatgggcacctgttcagagtgtcaaaaaactggatcctcctgatacacttgtccccagctgaggttaaacaaggcaatgctctgccttcctgtttcaactctcatactataaatgtgtccttttcgcagaatatttagcgtcacatttttcacgtttgtgcatttcgttggtgatttcgctgtttaaaattgcctgaagcaaaatgccgaagtgctgtctagtgttcctaagcccaaaaagctgtgccttatggagaaaatatgggcattcaataagcttctttcaggcatgagttagtgccattggttgggagtttaatgctaatgaatcaagagtatatggtaaataaggtatctctagacagaaatatgcataaaataggattatgtgccgatctgttgatgaaaatgttgtgaacagagcctcaccggaaataaccctgtatttcctctaggtgcaatgatcccatattcgctaattagtgttggcagtaactttataaaatgcaactactacacataatgagaatcaactgtgtaagagagagggagagtcagaggccccagaggaggatttgggtggcgtgctttcaggtaatggagtagtctgctagagtccctgatcttgtcatgcaataagtgtgctagaccaaaatattccttttaactgaagacaccaccaggagatagctttcagctggctttgctctgaacaagctgccctggcacatgaagtgtgggaggatgggtaggaaagggaagtgagatcaataaggagacattgaaaataaaatacgggtggagagagaaagagggtctccttttgttgctctctctctacattgcgcaatttataaagtttaatgggggagccttttctgatgatttcttagggactcacagattttacattcctgcttcttctggtgataccgaactttattttgatccctacccaaaactgtacagtttaatcttcactttgcctatgccttggctcaaaaggaagttagtttcaggcaattgagatttggcattacacagtaatctcttttttattaactcatctcagcagctgaaagcattgaaaaaacactccaacaatattgtaaccaaaaaaaaacaaaaagccaaaaacattgtaaccaagtttatatcctgagggaaacactaagaacaactttccctcttcatctccctttaccctatatgagaaaagcaaggcttctctattcccaaagtgagttcaaagtaaaggaaaacattgctttgttttacgtaacatgcatattttgaagataggaacaagacttcaggagaaaaacaagttctcaaacactgaccgtccttactaggctaggtgaagttacaatgaaactctgatgttgggggggaaactgacacctgttctatttccacgtcaggtcacaaaaggcagtaccatctgttgccaagtatcagaaacctctctcatccagcccctgactccactgattgctaatttataactgtttagagatggctgggccaaagctcacttctgttctatctgaacaaaagaggctcttagctgactaacaaggtaaacaagttcaatttatttaactaaacatacttttttgcagattataaatttaacagagtttgctaacactagtgaaattttttttttattttttatagtctattaattaatagactatatttttgagtagttttaggtatacagaaaaattaagcagaaagaacagagtcccatattcctcttttccatgcaccccacccccccccacacaccaaaatttcccctgttattaactcttgcatgtccaaatgtggtacatttattaaaactgatgaaccaatacattattattatttacagtccatagtttacattagggttcactctttgtgtacaaaacataattttaatatgtgttagaggcactgaaatcataaaagtaaagctaccacttgtagagaaatctccaggtcacaatgctttgtcacaaaaaaaacccaattttttcctttatttcgaactcactttgggagtagagaaagcttgcttttctcagtgttacacgtaatgccaataaccactgtcacaaacataatattcatcataacagtcctgaagatgggctgaaactcttacttatagaaaaggagctgacgttcagagaggcaagcagcctgccaaagctcctacagctgtaaaatggcagagacaagatgggaacccaggtcttcttagttctttgccagttatgttaatgctaatttttaagaggccactcttagccccatgtcttcctcacattcagatttctgtttctaagcagaggattaagatgcacactgctcatgtttccactgagaaacaaactgtgacaaggcaaatcagatggcacttggtcaaatacatggctggttaggggacacaggtattaattattcttttgggcttggacatcaagtctatacttacagctaatttacttgtctgtcttccctctagacagcaactctagaagaaaaagaactatgtctacttgcttgctattgtctctttgttgcttacttactgcctgggacagaatagcaattaaacagcagttactaagcatgtcgatggaaggatagctaaccccatcggtaaggagtactaaccatacacactgcctctggaatcactttctgatatcttcccttttgcttttctggtagttttccaactactctttcacattgccttttctacttctatattttgggccttataatttcaaccatatcctataattacaagatcatttgaaccaacaccaaacgtcccaatcattttcctttccactacataacaagactcagacagcctaccatttctcttaagataatatttacatctttggtctgcgtccagtacccaggtccatgtgcctgtggatgtgtcagtgcaaatagctcttgccttgtcccttctcattaacatgaatggcaaaaaggatttgagagaaggaatattgggtattccaggaaatctaagctctaaatctaagttctgcttgcaggtctttatgtaatggaaacctgtttcgctttgagtttcttagccacaaaatgggaataatatcatgtgtttttaggacatctcaaaaactgttttttatacatgagcaaacaaggaacgttaaaatgtttgtacatttcattaagctgtttattagtatttgtaaatatcgcattcaaaggcttgaggcaaaagttacaaactggtaacttgagggaccacaatgagtcaatagaagtgttttgtttctccagtgatgttatttttagaatttaatccagttactaagatgtttcacattgggagacttcacattaaaattttggcttccctttaaaaatctcaggattaggcatcctaagcccactgatatggtttggctctgtgtcactacccaaatctcatctcaaactggaatccccatgtgttgagggagggaggtgcttggatgaagggggcggcttccgccatgctgttctcatggtagtgagtgagttctcgtgagatctgatggtttttaaagtggcagttttttcctgcacttgcacttctccctcctgccgccatgtgaagaagctgcctgcttccccttcactttctgccatgattgtaagtttcctgaggcctcccctgccatgtggaactgtgagtcaatgaaacgtttttcttttataaattaccagtctcaggaatttctttataggagtgtgaaaatgggctaatacacccccactgctgtttggcaggaactgaccaaagctgagcaatgatcacttccaagtaaagccataagagcattcgagtttgccacagtctccaccactccctattttatcacatgtaatctgatatagtttagatgtcccgtccaaatctcatgttggaggtggggcccacgttggaggtggggcctggtggtaggtgtttgagtgtttgggtcatgggggcacatccctcatggcttggtgctgtcctcacaatagtgagttcttgtgagatctggttatgcaagtgtgtggcacctccctatcactccctcttttgctcttgctatgtgatgtgtctgctcccactttgccctctgccatgattgaaagccacctgaggccaccccagaagctgtgcagatgccagcaccatacttcctgtacagtctgcagaaccataagtcaattaaacctcttttctttatcaattacccaatctcaggtatttctttatatcgatgccaaaacagcccaacacataatctttgccatagtccctactacttcctgttttattacagccagtctgctggactcacttaagttactgtctggttcccagaggcatttgaatttgactacccctgttttaaagaagtattacagagcatatagttgatttatcagtctgcagctatcagattgatcctgttcacaaatagttctaaagaagaaaatccatagtattttgcaagccattcaaacactaaacctttctcttctatccagaaaattttcccctcactataaataggccaataagagcaatgtaggcttagaactaaatggcatcttatagctcatctggtccaaccaccttatataacatttgagaaaactacaggcctagattgtgaagatgcccaatagctaacagggacgagaaccagcttcccactggaaagcttcctggaacttctcattctttccaaattaggcatagaaaatagctgcttattttactttgtgaaagcattttaggcttggactcaagggcaggaagtgtttttttctcttgttttagattctcaggaaacttattttcctaaccttaattaccatgaagattatctgttgaaccctctattcatttcctggggcttccataaccaagtactacaaaccagttaacttaaaacgatggaaattcattctctcacagttctgagggctagaattctgaaatcaaggggtcagcaaggccatgctcccttccaagtctctcagggaggaccctactttgtctccccctggtttctgctggctcctagccacctttggcattcctcaatttgtagttgcatcactccaatctctgcctttatcttcacatagtcttcttccttgtggctccacgtttctgtatcctactctctgtctcttataaagacatcagttggccaggtgcagtggctcatgcctgtaatcccagcacgatgggaggttgaggcaggtggatcacctgaggtcaggagttcgatacgagcctagccaacatggtgaaaccctgtctctactaaaaatacaaaaattagccaggcatggtagcaagcgcctgtaatcccagctacttgggaggctgaggcaggagaattgcttgaacccaggaggtggatgttgcagtgagctgagattgcaccattgcactccagcctgggggacaagagtgagactttgtctcaaaaaaaaaaaaaagacgttagtcattgggtttagggtccaccctgacccagtatgacctctgagatgctgagatggttaattttatatgtcaaacttgcctgggcttacggatgcccagataactggtaaaatacgattctgtgtgtgtctgtgagggtgtttccagaagggactaacatttgcattggtgaactgaataaagcagatggccctccccaacgtgggtgggcatgatccagcagaacaaattggggaggaaaggtaaatccactctcctgattgggctgagacatccatcttctgccctaagacattggcccttctggttcttgggctttcagatttggactgaaactttattagtccattctcatcttgctataaagacctaagacggggtaatttataaagaaaggaggcttaattgactgacagttccacaagctatacaggaagcatagctggggaagcctcagaaaacttacaatcatggcagaaggggaaagggaagcaggcacgtcttacacggccagagaaggaggaagagagcaaagcgggaggtgctacacacttttaaacaaccagattgcgtgagaattcactcactatcttgagaacagcaagtggagagtgtgcctccatcattcaatcacctcacaccaggcccttcctccaacactgggaattacaattcaacatgagatttgggtggggacacagccaaaccacatcagggactggcaccattgcccttcattctcaggtcttcagctttgggctgaattacaccaccaacttccctggttctctaacttgcagatcatgggactccttggcctccataactgcatgagccaattcctatactaaatctcttcatatatgcacgtatatatatacagctggccgtctatgtccatggattctgcatccatggattcaaccaaccacagatcaaaaatatttgagaaaaaaatgcatctgtactgaacatgtatagacttttgtttcctgtccttattccctaaataaaacaactatttatgtagcatttacattgtattaggtattataagtaatccaaagatgatttaaagtatacaggaggatgtgcatagggaagatggcaaatactatgccattttatatcagggacttgagcaactgcagattttggtatccaagggagatcctggaaccaatcccacacagataccaagagatgactatatatatagaattggttctgtttctctagttttttgttccactacacacagatgagtaattggaaagggaagagtatattaacagccttttcagatcatggtgaagattctgctgtagattataccaaaacttgacaagttgtagtttcttaaaggaaaattgccagctgggcacggtggctcacacctgtaatcccagcactttgggaggccaaggtgggcagattacctgaggtcaggagtttgagactagcctgaccaacatggagaaaccccatctctactaaaaatacaaaattagctgggtgtggtggcacatggctgtaatcccagctactcaggaggctgaggcaggagaattgcttggaaccaggaggcggatgttgtggtgagctgagattgtgccattgcactccagcctgggcaacaagagggaaactccctctccaaaaaaaaaaaaaaaaaaaaaaaaaaggtaaattgccatatgaaatctgaaaacatcaatgaatgtttcatactcaattactttttcaaattttgtaacattatgcactggtcatttggaaaatattgttttaatgagttgtgcagaccttccagatgttgacacatttcaatatataatataaaaatatcaccttccaaaatatcaccaccaatttcattctaatttcctttgaaagcttgaattttatcattggcatcaaatattatcttccttgacacgattaactcatattgtcatattgttttccttcactggaaaaactcatttcattttctgagaccatttctatcaaatacccaaacttgaataactataatttgtctgtcagtttttatttcaagcaaaaataatgttctgtgaaaaaaaaccaaacagctaatttagctggcaactcaaacaatcgcataagtgcttttctgcaagacaaccatcatagcctatgcaggagaaatgctttatgtgggccaggcgtggtggctcacgcctgtaatcccagcactttgggaggccgaggtgggcggatcataaggtcaggagatcgagaccatcctggccaacatggtgaaaccctgtctctactaaaaatacaaaaattagctgggcatggtggtgcacacctgtagtcccagctacttgggaggctgatgcaggagaatcgcctgaacctgggaggtggaggtcacagtgagccaagatcgcaccactacactccagcctgggtgacagagtgagactccatctcaaaaaaaaaaaaacagaaagaaagaaagaaatgctttatgtgtactttccaaatcaagggttgagatgtaacaaaattaacttttactgcaccaagggcatctcagtaaaatgctttcttgtattctgtggttgtgaggaatacagtgactacagtttggtgtcaggatttgtgctgagccaccagcagtttttcccgccatcgcttttccaacatcagtgcaaatgactatgcagtaaaaaaggcaaataatatcttgaaataattatatatgtatatttcattagatatagatattccccactgaatatataaaattttgaaaataactttgaccttgaaaacttatgaaagtgtctcagggacccctaggtatctttacacttggagaactactactccagatgaacagaaagataggacaatgactatctgaaatttagctcctttctttgggaagcaggctctgctagccaggaagaaggaagcaaagaatagctatttgttagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaacaccgcatgttctcactcataggtgggaattgaacaatgagaacacatggacacaggaaggggaacatcacacactggggactgttgtggggtggggggagaggggagggatagcattaggagatatacctaatgctaaatgatgagttaatgggtgcagcacaccaacatggcacatgtatacacatgtaacaaacctgcaagttgtgcacgtgtaccctaaaacttgaggtataataatattaaatttaaaaaaaaaaaagaagaatagctatttgttggctaccaacagtacatgccgtcacctttaaagcacacttgacacagagaaagcactcattgatgttcactgttgttgtgttattattttgtatatgagcagttgattttccttcccacttgcctctctagcatgctttttaaaaagcgactaatttatttgattttctcaaaatcttgtgagatgcaacagacattgtttttagagaaataggttatgtgacctaagatttcacccaaattagggggaaaatcacaatatcacccagtacaatgctccagggcccctcaccaacctgtgtctcacaggggcctcatatgtatccactggactcaggaagcatagctggtgaaatcatatcaactcagactccagaaagctacttcagacagtttgatcacagaactatgtatgagattctcagggattttttcttctatggtactatatatccttacccagttagctaacaactcaaatgaacattctttaaattctatccatgttcttatgtcaccagagagcttacattctatagtatattattttatgtccctacagaaatgtattcattgaatggttaccaccatatatcactgatattataatgtgcccttttgtcattttaacatcttttaatttagaatgaattttatagcctatggaaagtcatcatgtatttggcagtgttttccttttcttactgatacataaaataatgatatatctattatcaacgatgtcttcaattcaacaaagtatggtatttaaaatgtgactctatcctgttccaggactgatataagaaataactacagtcctacatggcttaacaacaggatacattgtgaaaaaaatgcattgttaggcgatttcctcatgtgcaaacctcatagagtgtactcacacaaatctagatggtacagctactacacacttaggctggctgtaaggcatcacctcttgctcctaggctgctaacctgtacagcatgttactttactgaacactgcaggcaactataacacaatggtaagtatttgtgcatctgaacatatctaatcacagaaaggtacagcaaaaatatagttttataatcttatgggaccaccatagcataggcagtccatcattgaccaaaacatcgttatgtggtgcatgactgtatttaaagaccacctccatgctttctacaaaactattatgatacatcatgcattctctggtttaatgcccctaaaacaaaactggcacaataaatctctagttccctacttttagctcttttctatgtccaagagggtgagttgcacaccataatggctccacaaattgttcctgaaaatcattgaaaataatttaaaattaagaatacaaaaccaggcataaacatttggaagggactccagcaactgaatggctctgaggcttaaacttcactaggctctaggtgtggccatgtgtctggccagtgaaatgcgaacagaagtgtggagtgagacttatgggaagtctctttacagagagaaaagaggcctctcttctttccttcctccatcccacaatctagaactcacgtgtggtggcctgggctccagcaactatattggacaaagaaaataaaggacatagcccagatggagggacagaaagtctaaaggaatctaagactctgatgactgtgaagctgcctgccaaccccaggctgcttccctcccagacctcttgggttgtgaaggaatgaagcattgattgctcaaaccaccatctgcggtttctcttgttatcagccaaacacagtccaccactgacacagcatcataaagtatcttggtccatacaagaagggcatacgttgcggcaaggatggaggtcatggaatgagcctaagactgaaggtcagaaactctctttctagtctttgctactccagtcctgtctttagcttgctccaggaacttaagaaacccacttaagctgtatttactttaagtttcctcatttaaaaaaaaaaaatacaactttctcccatggagttatgctagtaaatcatatacaaataagaaaggactttgagatggtgaaatcacacatctttgttctggttaatggtagcagtgatgcactgagagagaatcttttcatggtcccgttcctgctgaatgagttcagatctagacccccatatcctgggcagtgccaatgttaaaaatcaaaccataaatagtggttcatggagtaggcacttaaaaagtcttcaaattatgaggcagttgcaaagagtgatcagtcagttcccacattctccaaggatcgtgattaggaaaagaatttcctatttgggtatcatctcagagatggttccctaggaacagagcctatgaaattggtattctcgtgtgaacggatttcaggagaagtatgtaaaggagttagggaagcaggtgagacagaggaagaagatagagatgtgagttcagctgaagtctagcctcagccccatcccacagggagctctggagcgtgaccggcaccaaggaattgtccgacctcaaggcaaggggaccaggcctttataaccctgtgcctgccagtcactggtgcagaccacccctgagggtgaggggttctcccaagcatctctggctgaggaggttcccactggcggaggacgattctccagaaagagcgtgcctgagatcaggcagcagccagcactcccagtagctgtgtggtggtgcactagtctaataaggggacctgggtgtgcatccccgcatctaccacaggaacagaatgctggagtatttggggaggaagctcctgaccacttctctagaaagtattattcatacctttcaagacttcccaacctgctacgctatagacctctgtttggggcaacaataggtgtgctctcagtgataaattctgagcttgttctttaataggcaacaggcaaggaaaacaaggaaagtgttactgtcattcaggcttggcttccaggatttctccacagccttggggatttgaaggtgttggtgaatcctactttttctcttctttggattccaaaccaatggagaaatcatccaggaggatcaaagatcgcacgaatggcattcttgccctgaaggctggttttaagacttgtcctggatccaagaccaaagggagtatcttctcgttccccttgatttgaagttgcaccctggtcacagagcaagcaatggtggggcaggcactctcagctgagtggaggggagggggatgggtgccattgggggcaggcagaaagtgttgaggagggggacttcatgccctctccccattttcccaaggaagactagaaagaagagctggaattgctcctcccataatcttcctggggtggagggccaggagggttcctgtagggatcatgtggactacagcccacagcccctcccacagcttccctcccacagactgctaaagacaaaaagaaaggatgctctaagtctggagctggcttggaagccctggtggacacactaagaaagaaaagccatcccagacttctgaatcacccacacccacttcaccattcagctgccccagatctccttttttgcaccaagaaccggactagttttgtcactcttggctgaatagctggaacacatcagcacctattgatacaaatcacttctgccggtctccaccagccagtgcccaacagctgtttttctatgtcctttctctgaaagcattatgcagccttatgtacaggttgacatcgtgaagtattgcttcttctgaatttactgcattttctgttcttggaggtaatagatggcccactcagcttcccttcactgcagacactgctctgtagtctccatagctcccaaatgcattagtggatcaggcaggatgagaattacagcatcttgtgctccaccatggcttcctgcttggtgtggtgttttccaatctgctgacatctcacaaacaaataaacattgtagttacttttgttttgttttgagatggagtctcactctgtcacccaggctagagtgcagttgtgcattctcagctcactgcaacctctgtcttctgggttcaagtgattctcctgcctcagcctcccgagtagctgggactacaggcacacgccaccatgccctgctaatttttgtatttttagtagagatgggacttcaccatgttggccaggctgttctcaaactcctgctctcaagtgatccacccaccttggcctcccaaagtgctgggattacaggcgtgagccgcctggcccattttagttacttttggctataccaacaggtcatatttttctctgtcttatctcctccttggctcccaaacccctgtgcatcatcactgtgatgtctgctgtaatgaatgacatacttccagttataagaagcatcacaggaagacaaggaaagggccctgcctttaaagcatcttctcccaagacctccaggtcttaggatgttggcccttgccctggtggccttgggtgacggaagagtcaacgatttctaaaggagacttgatttgcaagttgggttaatctgatcttctaccccgtgtaaatgatctcttacttaaaatacttgcgcattttgaactgtctggttgccgaagcagggtggaatgttccagaggaagccacataactgcagaggtttaacacacggtgggttccgccttgttgtgcaatggctattttcctgacagccgaggctgctgccaggagtcaaggagagccagatcccacaggagccaacaagaattgtaggcaaatatcctcaggctgaataatagcgatggtatcttgaaattgactcgcttccaaaaactccatcgaacagaagagtattttgcatatatgtgatctctgcttcacagggttttcttttgttttaatggaaaaacatcttttcataggtctataaaacatcccttcagcccacccaagttcaagtcatcactgtctctcacctgaattgacctcacgtcttccttctcagctttgactttctgtcttccctcccacagctgccagcttccatctcctagtgcccagcttttatcgtgtttttcttcagttaaaacttgtcaaaggctctccttattgaattgagtacaagtgcctcagtcgtcccaggcctgccatgaagtagacctgatttaccttcctaagtgtggcttgctcttccctctctccaaatgagaggcaccatgctgcctctccttgctcctgcatgaacagcccccagccacttctaccagaatcttgccatcgttcaaggccaacccttaatgccatcttcttcaggaagcttaccctgatctttctaggcaaacatactttctctgggtgtcgtgatgtggacgcacaatttcctgttctgctctatccatttgtgtgcttgtcttactcttctctttgagggccatttctctgtctgttcatcctgtatctcccacagtatgtagcagtgtcctacacttagtagttgctcaataaattgtaatcaaattagagttagagtaggtactgttattatgcacactgaaatactatcttcctgaaattttctattctatgttcagaaattataacactcatttccaaatatggcatcaagatggaaaacttgtgcttttcactgttcagaacaatttctgttcatcaaattttagaaagcatagaggtctgcagctggggacaggaagacagggcctaccagcttagaaattcccaaggttttggagttaggtttgaatccctgttccatcactgacaacttatgtgaacttaagcaagttcctcagtctcactgaacctcaatttctcatctccaaaatgaagacaaaactacctattttataagctttttgtaagaattaagttagaacatttctatgaagcacctaactcagtgcccagtaatagtaggtaaatcgtagttctcataattatatttctcctagtagtaaatcagcttccatcatcatccttatcctacccatattttattcagaatgaaatattaaagcttttaataagtatatagctgacccttgatcaatgtgagggttaggggccctgactatctatgcagtcaatagtctgcatgtaacttttgacccctaaagacgtaactactaataatagcttactcttgaccagaagccttttcaataacatgaaaagttaattagcacatattttgtatttgtatttgtattagtccattttcacactgctatgaagaactacctgagactggataatttatcaactaaagagatttaattgactcacagttccacatggctggggaggcctcaggaaacttacagtcatgatggaaggggaaagggaagcaaggcatctcttacgtggcagcaggagagagagagagagagagagagagagaaagtgagggggaaccagagtgagaaagtgagggagagccaccaaacacttttaaaccatcagatttcataaggactcactcactgtcatgagaacagcatgggagaaaccgccccccatgatccaatcacttcccaccagatccctccctcaacatgtggggattacaatttgagataagatttgggtaggaacacagagccaaaccatatcagtacaatatactatattcttataacaaagtaagctagagaaagaatatgttattaagaaaatcagaaggaagagaaaatgcatttactattcattaagtggaattggatcatcataaaggtcttcaactttattgtcctcatgttgagcaggctgagcgggaggaggaagaggaagggttggtcttgctgtctcaggtgtggcagaggcagacgaaaatccatgtacaagtggacccaccaatatacagttgacccttgaataacatgggtttgttaacaacttaacaatttgtaagttcaagcccatgttgttcaacagtcaacttatgttgagcacctactaattccctggcatgctactggggagaagaatgagggtgagtagacatgggacttcaaatattgaataatacaagattataatctgattgtacgaggatattggcaacaagaacatttactgaactgccatagacaggtgttcaatgtatgttcaaaggtaaaagagatctacttaaatcaaagggagatgcaatgtacttgtggcaatgagaagcccttggacaaggcttgtgagccccactgtccagggctcctctcccaaggctgtcaacagactgattccagcatttttgccacccatctgaccactggagcagggctggcttcacaggcctgagacctgtgcagttttataagccccacaaaccccaccgccacacttagaaggcccttgtggttggtttaattctctgctgctgttgccttgaaattcttaatgattctctaacatgcatcacattttccgtttgcactgagccctacaaattatgtaaccagtcctgcttttggagtgtgagaggtgatgcttaattcatttttgttcccagtgcctgacacagcatgtgctcataaatatttttgaaatgaatgaatgaatttcacttttataatcatacaggtggcaaatgcttgtacacccactgtattagtcagggttctccagagggacagaactaataggatatgtgtatatatgaaagggagtttattagggagaattggctcacacaatcacaaggcgaagtcccacgatagatcatctacaagcaggggaagaaagaagccagtagtgggtcagtccaagtccaaaagcctcaaaagcagggaagctgacagtgcagccttcagtctgtggtcgaaggccccggcaaaccactggtataagtccaagagcccaaatgctgaggaacctggagtctgatgtccaagggcaggaagcattcagcactggagaatgatgaaagctagaagacccagcaagccagcttatcccatcttcttctgcctactttgttctagccatgctggcaggtgatcggatggtgcacgcccacgttgaggatgggtcttcctctcccagtccactgactcaactgttaatctcctctggcaacaccctcacagacacacccagaaacaacactttaccagccatctaggcatccttcaatccaatcaagctgacacctaatattaaccatcatattcacctttacctaaagtttaacacttaaaatgtactaatgttaggtgccctgtaccttggactttgaattttttgaaataggacttttgcaattttctccaaaatccacatgtggaggaaataaggagaacagcccagcagctgggtgccttcctctccacctcagtttttaacacctcggttttacctgttctttttatacacagttataacctagatcctcctatactctaacacacacacacatgcatgcaccttttgctgagattgaaaccaacttgtactctcaagtaaaactgatagcatacattaaaaagaaattcaagtatgatttctgaaaactggtgcagtaacagtagacaaagtggaaaaaaatttaaaaagagattcagattgtttttattgttgtaacatgtatataacataaaatttaccattttactggaaaagacatttcttcaaagaggatatacaaatggccagtgagtgcatgacaagatgcacaacatcactaatcattagagaaatgcaaaccaaaactacaaggagataccatttcatatacactaggatggctactattaaaaaaacaaaaaaaaaacaaaaaaaaaaaaaacagaaaataacaagtgtgggcaaggatgaggaccccagagaaattgggacccttgagcactgctggtaggaatgtaaaatgattcaaccactgtggaaaatggtatggaatttccacacaaaactaaaaatagaattaccatatgatcaagcaattctgcttctgagtacatacccccaaaaaactgaaagcacggacgtgaagctcatcgcaactttatttacagtaaccaaaatgtggaagcaacccaggtgcccacagatggatgaatagaaaaaataaaatgtgaagtatacatacaagaatattagacagccttaaaaaggaagcaaatcctaaagcatgctacaatacagataaacctttgaggacatcatgctaagtgaaataagccaatcacaaaaagacaaatagtgtatgattccactcctatgaggcacttggagcaatcattgcctctatctactccgggaccctttcatcacccccagctgaaacctcatacctcatattattattaaacaataactccccattcctctctcctccaccctgctaaccaccattctacgttctgtctccatgaatttgaccattgtcagtatctcacatacgtggagtatttgtccttttgcatatggcctgtttcactcagcgtaatgtctgcaaactccatcatgttatagcatctatctacgtttcattcctttttaaggttaaataatatttcattgtatgtatataccatattttgtttattcattcatatcaattgacatttgggttgtttagatgcatgttttaaagacagggtcacagtattccccgagagtttttaaattttacaatatgcaatagaaagtctttttgatgatgggggttaatttctcccagcgccagcaagtcagctggcccctctttcctgaatagcctcggaggttttctgtgatcacaaaagaatgctgtcagggaaaaaaaaaaaaaaaaaaaaaaaaagcctctccagagataactcttcggtcaaaccaggtttattaagggatgtctcctgccgggcacggtggctcatgcctgtaatcccaacactttgggaggccgaggtgggccgatcacttgaggtcaaactttcgagactagcctggccaacatggtgaaaccctgtctctactaaaaataaaaaaaattagccaggcgtggtggtaggcgcctgcaatcccagctactcaggaggctgaggcaggagaatcgcttgaacccaggaggcggaggtcacagtgagccaagatcgtgccactgcactccagcctggatgacagagcaagactccatctcaaaaaacaaaaataaaaataaaaaaataaaaaaggatgtctctaaatgtctgttcaatatggaacaaagccagtgggtgctccagccttacgaaaaagacacagatgctaaaggctttctttcatcaacagcctcacacccccaaagatcatttccacataatgcaaacgagccccagtcaggtctgccatgaagatgactcaggcatgtgaaatctcaaacctctcactcttaggaaaagcatattttaaatactggagctcctggtgtgttggggatggagctgggacacaagagttgatataaatgtctcagcttatggcttatctgttgtggaacacgccaactttactaccatactagatttatctaagtcagtgaaagccttcaacaaacctcagacttcagaccttctgacttcagttagagcatggaacagcatctttgacagagttggaaagaatttatccttctttcctattcagttcatctgtcacaaatttgcagagcatgtgtgacaccgttcccagacatctttttggtcactggggctagagaagtgagcgtgacagacaaggttcctttactcaaggaggtcatacacttacaaagagccagcaagcaaacaaacgagatggcttcagattgtggtaaatcctatcaaggacacaatcagggacctgacacagtggctcatgcctgtaattccaaaactttgggaggctgaggtcagaggatcgcttaaggactggagttagagaccaacctgggcaacacagtgagactccatttctacaaaaaatttaaaaattagccaggcgtggtagcacacacctgtagtcctagctactcaggaggctgaggtgtgaggatcgtttgagccagggagttcaaggctgcactgagctatgatcatgcactgcactctaacctagatgacagagtggaccttgtctcttaaaagaaaaagacataatcaggaacatgagagagggagtgactatgaggctatgtaggtggcagagccactgcccaccagggcttgagggaagggtgctctgaggaggtgatagatacttgaactaaggcctaaggtggagatgcacaagccatagaaggagctgcagaaagggccttccaaccagaggacattgtgcatgcataggcatagctttaggaagagcttggcgtgtgcaagttgcagaaagaaggcaggcgctacagccagagtgcgatgagcgaggagcaggtggtggaggcaggcagggcggtgggggttgtgggagggcttctggccagttatggaaagccacaggaagatgagaagcaggataacgatctgaatgacatatttcaaagagtacgcaggctgcagctgcggggtggagaatggattgtgtgagtctcctctttctcccccgtctttcctttgagaatatcacaggaagggcagcaaagcgctcaccctcacctttcccttactcagtgagactctggactgtggactctcatgatagagataaacttttattttctgtcttgtttaggccactgttaggctgaacctcttttatcctttgacctaattatcaatgtctgatcctagttaataaagctctcacttttagctgctcataaaagctcaaactctgggaaccactagttcataccctccttggcctttggcatattctattcctccttttgtctctaatgttttgcttgcatccttggcacaaaacacccacccaatacctaggaggtgttccataaacactgaagaggaggaggaggatgcagcgcctagaggtgtcttgttgttttcagaccttgttagtcatcaggtgtcagaagaaatctgtaatgtggacttcatcatgcaaaatggctcacgccttgccgagtggcactcagcccaggagtgcgaacggggagaggagatttcagccagaccctgactcttgttacctcacctggggatgtgcagccttgaatgcactgactcaccatccgcttctgggaggctattatttttatcagtttgcagcagcaggaagtgagaagagagcttctaggagggaaaggatgcctgagattcagctgaggacttcagctggttccctgttgcagcctcctccagaagtctctgtttttcctgtgtagcgtttatcttaggtatgaccaattaacgtgtttattcaatatatcttcccttattagaccatcggctccacccaaaccaggaatcaactctgcctttttcaccctggtacctggcacacagaaggtactcagtaaaatatcggttgagaaatgaataaatcaaccttttcatgaagaggaaagagataaatagaatcggttaagcttgacacaggaaaacccgtttgtttgtttgtttgtttgtttgttttttgagacagagtctggctctgtggcccaggctggagtgcagtggcacgatcttggctcactgcaagctctgcttcccaggttcaagtgattctcctgtctcagcctccgagtagctgggattacaggcacgagccaccacgcccagctaatttttgtatttttggtagagaccgggtttcaccatgttggccaggctgctctcgaattcctgacctgaagtgatccgccggcctcagcctcccaaagtgttgggattacaggcaagagcgaccgcgtccgcccccctttgcaagctttaaaggaaattatttgtctcatagataggattattccctttgtgggtgagccctggcgagaacctccgtcctgagccaacttccttagcgggattctcaccctgccaggtaagatccctctgttaccaggagctccataaaatgcaaataagtttcaatattcacttaggaaaataaaaatgagcagtaagtcagctaggagcaaaaggaacgggacattcaaaggctgtgcccaatgtcagacagaagtagctttgtaattctcccagtgtagggctgcaggcacctggcgctggagacccggcctggacgaggcagggctcagggcgcggctggaggggctcgcccggcggggcgctggagcgggagaagggcgccctctgccgggggtgaggaagatcagtccgcacgcgcggtgccttggtcttgcagcctgttcgaacctcgcgcgaggacatccacttcttccacggggaaagtaggagggtgggggcagaaaaaccaaactcctgccaagaaggtgctttgcacgagcattttgcgaccccatcccttcagccccgaacctccccctggcataagtgaaaggactgtagtcaattgcagatgctgtcaggaagccaggtgcgtcctcactccccagccctaaaatccaaagaaagaagagattgtttgagacgatctgaagaaaggtcaggtcctaacagatccacgggaccttctttttcaccttccttgtcttgggttctggagcacgggcgctgaatcagctgaatgcggcctgggcatctggaagtggtcctgagggacacctcgcggtgcagcccccgggacgacccaggacaccctggacaccctggacacccaggccgagagccgggacccgcccacgcctcctcactgctgctcgagggtaggcaggagcacgcggaccccgtgggggctgaagcggggctctgctgcccgccctgcgcaagctcccggctctggttgctggtccacaaaatcgggaggctgaattagccggtcgggtggcccccagccttatagcttcgaattctgtgatcctattttagacccagacttgtccgcgaagggaaatgaagaggcgcggaaggcttggagcgtgaaccaaaaaacaatgggtggggatcgtctaaccagctcccttccctagaagggcggaaacggctttcgaagcatccgcgattctctttattgaatcttgagtgacacctagtggcccatccgcctcaccgtcacggcgatgctggtttcactgggcttttcagaaggcgtgctggcctgcccatggttctcggctaaaagactttggagcgtagggtgccgatgaagtttcctgggaccttccggaagcacttgctgtcccgtcaacagccctgtacctgcgatgcatgcaattctaatgaaaatgcccttctcgtctggagggcttgcttgagcacatcctgagctctcaggcagcaaatatagagtcgggtgctattccgggagctgggcacacaaagatgaccaacgcttggtttctgatctcaagaatctcacagcccagctggggggaaatggaccagtagaagagtgtgtatttgatgctgtggggtagagggggtggacctagctcggcctagagacatcaagaaagtcacccttgagctgagttttgaagattaggcagaattctaagatgacccctgaagattctcagcccatccccctcgcagtgtacacacacctttgcccagttattcaatcaaacaatttaggtgcttctgtgaagagaatttgcagatgtaattaaagttcccaaattaattgatcttaagatctggagatgatcctgggtaggcctaacctagccaggtgaacctttgaaagggactggattgtcctggcagaagagatttgacaagcggcaagaactcatcattggcaagattttctttgctggctttacagatgaaaggggccacgtggcaaggaatgcaggctgactctaggagctcagaacgacccctgcctgacagccagcagagaaaccagccttcaatcctaccactgcaagagcactgaactctgccaataagcagggagtttggaagggatccccaagctgtatgagacttagtcccagctgacaccttgattttatctctgtaggaccctgaagagaggacccagtcatgctgcattcaggcttctgacctccagaactatgaactaataaatgggtgttttaagctgttatgtttgcaatgtgttatgaagtcataggaaactgatacagatggtcatttcaaagaggggaaccacatgacaaatgctcagagccataaagaagcagagaactaaagtcattcagagaactaaagacattcggcatagctggaccatggggagcaaaggagacggtaagatgtactcacgagaacttggctttggatcagagagaatgtgcccttgggctagttaacttagctctctgtgcctcagttttcccaaaggtaaaatggaatcataattatagttaaaacatagagttgttatgttagtggcccataggcatatagaaagttcaacacagccttgggatataataagtgttccaaaaatgttaggtagtaatagctttagtaattaatcatgtagttaatggactggaataagaagaggacaagtcatgtggtttttacagagtggtctggggaccatctgcactggatgattccagcggtgagcttattaaaaacccacatgcctggattgtaccttggtcttaccaaatcagactctctgggggtagagcctgagaatctgcactttcaagaagcttccaaagtgatctttgtgataaccaccaagcaagaaataagaagacttgtaagtaggtcactgtagtagtccaggcaggagtggctgataaaatcaagcaaggcactggcaatgagaacagggagcgggtgtggcactctttgaggcagatggaaactacggaactgagtaatcagacaggggtggtggaaaggaaggagggcagaggatgagctggaatcaccgtggggaggtgagttcggggaggattgactcagattgggtcatgagagtccagacatctgtggggtatccaagtggaatgtcacatagacagttagaaagactaaaatgtaggaggtacattggtgctaaaaatacaacgttaagtgtacatgagtccatgaagtaatgggatgatgctggcagaataggaagatggtcaggaacagaacttcaaatgtaccagttttggccaggtgcggtggctcacgcctgtaatcccagcactttgggaggcccaggcaggcaatcatgtgaggtcaggagttagagacaagcctggcaaacatggtgaaaccctgtctctactaaatatacaaaaattagctgggcatggtggcacgtgcctgtaatcccagctacttgggaggctgaggcaggagaatcacttgaacccaggaagtgaaggttgcggtgagccaagatcgtgccactgcactccagcctgagtgacatagtgagactctgcctcagaaaaaaagtaccaattgtgggcgctgggggacctaagagactgagaaagagccaccagaatggttgactgggtgttgggtggacagaagtccgagggggtggccgtcagccagccttggagcagttcaaatggaaaaagtctgtgcacatgcctgacacctagtcaccagcagatcaatggtgggctcagcagggctcctttcagtaggatgaggaaggagggagccagactgcagcctgggaatgtacagaaggcaaggaagtggggattgttctttagcaatgtggctgtgaaaaaaggaaaaaaatagggcaggaattagagattcacacagcccttcctctcccattgcattggtgcaaacctacacacgtgactgaaaaacatggctgagccgggcagccatgtggtgcctgctgaacccagattgtggcagaagtggaggggataggtagggagggtgaggctctcagagaaggaaggggagcctaggtgctgaagaccagcggtgcaccgatgtttacaagtgtagggctggaccacgaggccaagaagaagctggggtggggatggggtttctctgtggggatggaggcatggggaggatggcggtcaacgggccaaaggatcactgagctgtgttgagggcccaaatggggttaggggataagaatccagtgtggagaaatggtgcaactttggggaaatgtcctcaattattctttgcctcagttagctcatctgtactgtcttagtccattttctgttgcttataacagaatacctgaaactgggtgatttataaatagaaggaatttattcttacagttatgaaggctgagaagtccaaggtcgaggggccacatttgctgagggcgtccttgctgctgggagctctctgcagagttccaagatggtgcacagcagcacagggccagggggctgagcatgctagctcaggtccctcttcctcttcttataaagccaccgtcccactccctggataacccattaatccattaacccatatataaattaatccattcatgaagcccaagccctcatgacccaatcacctcaaggctccacctctcaatactgccatgctggggattcagtttcaacataagcttggaggagacaaatattcacatcatagtatgtgccatggaaataatagtaatgcctccctaagaacaccttatagaggattccctgagatgacattcaagtgaccggcacatagtagcattaacaaatgacagctaccaagaggattatggttactattttataagtcagataatgacatgtctctgtttagaaccccctggtcgccttccatctcacccaaagtggaagccgaagtccttaactaggaccatgtggtcatgcacaatctggcctgacacttacctttcccttggttccctctgctccagccaccctgacctcaatgctattcaccaaacacattcctctaccagcaacactcttatcctagttggccttgtgggtcattccctcccttccttcaggactttgctcagtgtcacctcctcagtgagaccttccttgatctcctcagtttcaatttgaaccacccttgccccatccccaagggcttcttgccctcttccctgctttcttgcacttcccactgtggccatgctcagggttttatttatgtgctttctattgtctgccgtgcctaattagaatgcttttcttttgctcactgaagtatccctaagccctgcaacagtgcaaatagttggcactcggcaaatctcgatcatgcactaaagtcttggctcaaatgtcccctcttttagagagcctcacctgccattctatctaaagtagccccccaatcaccccttatcccctgactgctttgattttcttcatggaaccatacctggtattatatatttgtctattcactcattgcttgtctccccagctagatgcagcaaggtcttagttgaattgactggtacatcccaagtgcctgtaataacaccaggtacaaactaggcacatgatacatatttgctgaatgatggtggtatcgttgttatttactgttattattaatagtggtattagaaagcagaagataaggagtagttgatccctgagagtggagtagggcaggggaggactatcctaaatggatagtggaagctacaagaaggaacaagaatacctgctggctactcccaggccaatcccctcttaggcaccaaaagcatagactacaccacaggcaacaaccagggtgtttcttgctctataaatatttgcaaggtgaatgcacagaaacttcttggaacttttgaaggagcatcattaacaccaatatctgatcaatttgttctaagaggtatggggcagcactccattattaaattgcaatttagtagctaaggcaagctctgggatcatgtgctcaagagagaagaaatgaagcagagcacagacaacagaatcacgctgcctggttcaaatcttagctttgccacctatttgaataatgtctctgtgcctcagtttcctcatctgtaaaatgaggatgaataatacctcatacagttgctataaggacacacacacacacaacagtgcctggcatgtgtcaaggactgtgaaagctctggaatttttatcctacttgcaagctcgcaagttagcctgccacatttcatagaagctggtgggtgacgtgagacccctggtcagaagcaaaggactttattactcacagcaacagctatagcagtagcatcagtatttgtgctagttccctgagctcagttcctatggagtgacacaaaggcatcaccggcacatacagtgggctgcattacaggaggggaaccctgagcttagagaacccaaatcttttataatgggcagtcagcatgcctgctctttgctccaggagaagatactatctctgtcttctaaggctgtttgctaataagcatctttgaaaagataacccacaacaaaaagtcagtgctcctgctcataagatgtgcagaagtaagagcgatccgtggagaattgcctctcaagagcatgtggtaagaactttattattactatgggaaaatgaacttatactacataactttcttctggtgactttaaaattgatagaaattagagcaaatcaggacatggactaaggaaaagttacaaagactaatggcaagtcaaggaatccgagttaacattcggtgactagactcccaaatgcgtttcacaaatgggtttccagaaaaactgctgtcagcaattgattgtgatatggggcaaatgagtttgcaatttcatgatgaataatctatcactccctatcttagaaactcaggcattccatcttttttgacaggcagcatgtatattctattgccaggaaggaaggcagttgtcaaattcctaatttttctctttgaaaaattaacatttaactcaaacgtaagatctagaggaacacataagatcttaattacaaagtgcaatccaagatttgcactaattaatatgctgatgaaaaattcattgaaattcagagaagaaccaagagggaaaaaattggccagtgttaacactgagttctataaaatgtgtaagtctatccaaataggcagctgcctttctcggataattatcatttcatcattcatgattattttatttgtaagactttagttgcacatccaaaactatgcagacagaatatttccttaaactttctgatttctaacagttaaattatactagtatatgagggacttttaaagaccagcttagttacctgaaatatgggggttttttgtttttttgtttttgtttttgttttttttttaagtgagagaagccatgtgcttgattcctggttttggcattcactaactgtgacctcccgcaggttgcttaagccctttgagcctgttcctcctatccaaatggggacaataataatgcatgaggttgtggtaaggaatggctattgttgtgaatcagttgcatgccttccttttagtcttcatcacaccagacctggtactagatggggactgaaatatagtaactgatttgttattgatacagctgggttgatgaataagctagtaagtactcaggctgaaaactgggcttccaccctccccaagcccccaggtcctgagacctgggaggatagagattgtatctgcagatccacacccaggcagcctcagggaggatgccaggctgcccactgccccccacccccgacccccatcctcatccatgaggattaggaaagagagcagccagtgtagtgagagggtaaggaaggtctcctgggtatctggaactaggactggagaggggcctcagcttgaggcaggcagcatgggtccctttatgagaccagagctttgcagcgtggaggaggagggagaagggaggggtaaggttgtgttcccctggccccaccagacaatctcaccaatctcataactgcttccactcaatggagagcgatcatgggggcagatgttccttctgactcatgaagtttccatctcctgagcaactgagtaaaagcgcccctcccaggcctctctgagtcatccagcccccacgtggccagtcccccacatggccagccccctccacggccatcagagtctctttccagagtgaaaatttagtcagtatctcagaggataaagtccagccagacacatgaggacttcagtggtatgaaccctgtttcatttcccacgtcacatgccctttgccacaccaccctgccactcccagcccaccactctcaaccccaaacaagccgtgcacctgttgtggcccagccctcccacctaacatacccttgccccctgtccattggtccacagtactcatccttcatgaactactttaaacacctcctctgccttgaactgtctctgactctcacctcccaaggctggtttgctccttatctcctgggggtcccacaccttggtttctctaagcacgcacgcagatgccagctgtctggattcaaatccagtacctgtgtgaccttaggcaagttacataagttcgctgctcagtttccttattggcaaaatagggatgacaattgtactgcatggtggttataaagattatacaaaaatacaaaaaacacttataaattgtacttggcccatactaagcactttataagcgttggctgttataatcattattactattatttaccaagttggtgatttttctacatcctaataccactaggtctattattatttcctttaaatcaactttatcagtctcctgagcagtgtctgtggaattacaggttggaagggatagttatgtttatataatacaattgaaaataaaatacataatgatttaaataaaacctgatcatctgaactccacgcccgccgttcctcaccattatttcctctccaagtacaccgggaataacactgttttatgatgttactcaatcattcattcatctgtctgcagagattataagttgcatgaaggcaggcaccgaagctggattcatgttttactctgcaaacagtttacaagtgccctagaccaggggtccccaacccccaagccacgaactggtaccagtttgtggcctattaggatctgggccaccagcaggcggtgagtgcaggtgagcaagcattactgcctgagctccgcctcctgtcagctcagctgcagcattagattctcacaaaagcccgaaccctattgtgaactgctgatgcgagggatctaggttatgcgctccttatgagaatctaatccctgatccccaaatcatccctcccgactccctcccatttgtggaaaaactgtcttccacaaaaccagtccctggtgccaaaaaaggttggggactgctgccctagactcgtcacacacgcttgataactgttagtgaaatggatgaatgaatgcagttgactgaaatgcatcaactgatgttcaggaacccagaacattctacatgaaggtcagaaaataataaattaagaatttcacaataaacaaattgtgaaataaaatagcaaattaagaacggacgtgagctgccacctccctcttcccacctgtaccccgggacaatgagaatggcctccactcttaattttcctctcttccctttcaacagactaacctcctggctttttgacagcaagttgaaggggtttttaagatggaatgaatcttgcagttgtaatgaatcagaaattgggggaaaacatcagattttagcagcagcagaattctctcactgtttaaaaagcacttgtcccttaggcttggagagattagaagctaataatttgtattgaaatccagcaaagctcttcacagagtcctattgcttgtccctgtcttttgaatgacaagtaggaaaatagagactgatttgaaaacctagggctatttaactaaagcagcaataattcttccattagaaactaagaaatgagaaggtaggaatggcccagacaccacaacaaaacagatgttgctggtggaaggccacacctttttccaaatgaaactcaccagcccttcaagttgagttagctttctaaccctctggacctcaaagtggcaaaaatatttttacatgctagttaaaatgccctcaagctacagtcattagatttgctggacagtggcatcattctgatgttatcggctctgtcttcccgttttcatgaataatgtataagaagcagctattagaaatggattcttccatggctgacagtatcaccaccagacaagcccctggattctcagtcatttcatctgtagctctaacagatctcccttcttttccctctcactgctttctgcctgcctttcatggatggagactcttccaaagactccttatccctgcttctccctcaatactaggaaactggcagggaggcaaaaggaggagcccattaccttcctgccttttaactgttgctcagtgtcagaggaggagtgctgggcctcctgatgaaaccaagttcatcgtcttgcctcctggccctgccagccttgctctggagccaaatgcctgccaaaagatgcttttccttgggcacaggcaagagctggaagggaagctgtgctgagcctcctctacctgctctttttttttctgtatctttctatgtttgcatctatcatacctttacaaagaaaacaaagatctttaagtcccctgctttcattcattcattcattcattcattcatttaacatatttttcattgtttgtgaagcttccattgacagaggtgggcagtaatcaaggattattgagataaatataaaatgttttacaaagaagagcagcaattttgagagtgtctaatagagggaagtagctgagttagggaagtcagtaaggggatatgaagattgagctaaagagctcaaagacaaggaacctaaaatcagtgaatgggatccaggcagcagaaactgcatgtgcgaagtctctgcagcaggagtgggtgtggcctatgttagagaaactggaagaagacctggggccagagcacagtttgctaacaggattcagggcttctccagcccctttgacacttgcccacttttttcttcctgttactgccccctcccatagagtctgaggacggtggtcttggctctcctcccagcttctgatgggtcctaccctcccgggctcctctactattgcctttcaactattgctgctaatgatatgaacaggagacagggaaatactgggtagaagaggatggttcccaggcaaaggccccgccctcaagcctggagactcacagccctaagtgggaacaggcatttctgttttcacacccaaaaagttgccttttggcctgccagatccacctatcctatacctgtataaaccctgaaccccaggctccagaagcatatgagcagaagaggaaatgaggagatgaggggacaagtggacaaacagcacaacagcacagcagagaaagagaaaagagaaggagcatctgaacgccaagaggagtccagctgggggcggtcaaagaggagtttggccgctagacctccaaaactccaagggaaggctatcttcccattccatcccccttccagctccccatccatcccactaagagccacctccaccactcaataaaaccccgcattcatccttcaagtccgtgtgtgacttgattctttcaggacgctgggcaagagctctggatatatacagaaagctgtcacactggcccactgcccttgtgaaaaggcagaaggcccactgagctggtaaatacataagctgtctgtgaatggcaaggctgaaagagcacagtgtaacacgtgcccacttgggctttgggagtcgcagacacccacccctagatgctgccatggggcgggaacccgaaagcactcactctggttcctgcacctgacctgtcaggggttcgagcagcagcgaccaaacaggtgacctctgtcgcatgtcctgcaaaggggatcagggaactctcccgtttcactaacttagaactttcctctgtctctgtgccctggtgtcaaacacagagcctgccaccgtgggtgcctgtagttccagctacttaggaggctgaggcaggagaatagcgtgaacccaggaggcggagcttgcagtgagctgaggttgcaccactgcactgcagcctgggtgacagagcgaaactctgtctcggggaaaaaagaaaagaaaagaaaagcacaatgcatgcaatgagcctctattgttccgggtcccagttgaaaacttgaaaacattctgaccactcaatatgagaatgattaaataaacaatggtacacacaatattggagtgtcatatgatcattaaaggtaatgtttcttcagactaatgatcttggaaatgtctcttggtggaacattaattttcaagacagaatacaaaattcatcataaagcatgatctaaattgtatttggaaaaatgtatatgcaaataaaaagactagaagcaaattcagcaaaatattaacaggctatctattagtggcactattgctggtttttatctcctttttatactactccatttctcccaaaatgtgctaacttaataaataatttaagtgagttgatttaattgaactaaaattcaagcacttattaaacacgaggcatcactagcaatttaatgatgggcagaacataaacgtggtctctgtcctgaaaaattgtttttatagttttttttttaaattttactttaaaaagcaagataggccaaacatggcggctcatgcctataatcccagtactttgggaagtcaagacaggaggatcgcttgagcccaggagtttgagaccagcctgggcaatataatgggaccccatctctacaaaaaatttaaaaatcagctgatcgtagtggtgcacacctgtaattccacctacaggagcctgaggaagaaggctcgcttaagcccaggaggtcaaggatgtagtgagtcatggtcatgacactgcactctaacctgggtgacagagcaagaccttgcctcaaaaaaaaaaaaaaaaaaaggaagaaagaatattcatcatcactcctagaaaacaaattctctccagggtaagtgttatctagcagcgtcttgaagtgtcacccaccaagagtaccaaggactgaaccttggtgaatgtccatttgtcatttctgcccaaagcaagatgcttggaacaaggactctttcctggcagtgacacaaaactccccgctctaccaccctagagtagaaagccccttgtaccacttactttataaaattcagtccccacctccctgcatgcttacagtcacttcatttccagccctcctgagggtacatttccaaggattctctcctgggaatcagccttcaaggattctagatggaaatgccacgtccccacgtgtctgaaacttggctccactacttgctggttcctaacggtacccaaagcaggagtttgtgattaaaccacagacaaagcaccagcctgagcaagcaagaaaacagcaggagcccaaggactcctgtgagctaagagtctgatggttttcatgcaaattgtttttagtagtagggagataacaggcaaataaaatatgggagataggcagagatttttctaaaccagtgatgggggcgggggagttctttcataaaatcccagtgcatccttaacagtaaagctataaagttcccatatttcttatcgagtggaataaaatttgtctctctcagggatcctcctgctcctcctctcccagcctagcacaatcaatgtctctttccccttctctaacgttccatcttagccttgactgaagagtctttttcagaatggcaatgctttccaatgatgaaaagcatattatcagaggacgattttaagtggtagacaaaatgagcaatatttattctactagctgtctatttattttaatgcacttagagtaaaatctgtctagcacatgaaacctatgattttattataggctatgttggcctaagtttttaaaagggaattaatatagagccaataaagagaaaagcattcagtgaatcatgatatgcatggtaggcaaacgcaggaagaaactgtgatgtggggcctacgtgcatgatatttggaaaatacgagtaggaattctgcaacaaatccaactcagctcctggggaggggccacaaaaatcagacggttcattgccgtaactcagatgtagacatttccatttaattctggatcataaataagtctttacagttctgaatcctggaacctcctgaagtctaagatctgagtcttcaagctgatagacttggccttcagtagggagaggtgttttgtttttaaaatcaggaaatttcacataaaaatgcaggtttcttgttctctttaaaaattaaagatctggaaaaccgggtctacatctctgagtggcaataatcaggtgaccataagccacaggagtggctattatctgatactaggacctacccctgcactcctgtgactggggctgcctcagagacaaaggctagaaagggagttcctccttttctaagatttctctgccctttctccaccttctctttcttctctcttccctcgcaatccctcctcacccatacacgtacacgcacactcataaacatgtacatacctccaggagatgaagacaacttctgtcttccctcactaattcccatggtttatgtgcctcaatgctggcccaaattcactggtaattcccatgttgattatttattgccttttagctatttgattggcagaagatcatatgaaatcatctaatatgttatttttgtgtaggatgtgagatagggggaaaaattccattttctccctaattagtagatcatgaagaatagtagagtagagagacaacagacacatgaattggagccagagtatttgaatttgaatcctagttttctcatttcctggctgtgtgatgatcatgggcaagtcatttgacttctctgcaccgtaatttcctcatctgtaataccaggatgacagtatctattgaataggattgttgtaaagatgaaattagtgaacatatataaagtgctagactagagcccggtatacaataagggttatacaaaggtggcctattatatgagtaatggtcttccattctatgaactaccactggaataaactttaactctgcaccttgaaattattacatcagttgtattcctttacccaacaccatttatttaaggcaaataagtgccaggcactgcatagggcactagaaatataaaaaataagaaaatgttcttgctcttcaaagagcttcctatccctaatgtatttggaatttgaagttaaattaagaaaataacacacaatcatgtttaaataaagattaaactaagcaaaaatcatatgatgattgtttaatacgagtcttaaggagaacaaataattagaatcatttcagattcagtccacaaaaatcaatcttccaaaaagtagggacaagatgagattttgaaagataccctcagggccgggcacagtggctcacgcctgtaatcccagcactttgggagactgaagcaggtggatcacttgaggtcaggagttggagaccagcctggccaatatggcgaaaacctgtctttactgaaaatacaaacattagccaggtgtggtggcacgtgcctgtagtcccagttactctggaggctgaggcaggagaatcacttgaacctgtgaggcggaggttgcagtgagccaagattgcaccactgcactccagcctgggtgacagagcaagactccatctcaaaaaaaaaaaaaaaaagaaaagaaaagaaaaagaaagaaagatatcctttagtaagaagcaaagtcttgaactttggaccagaagaataagggccagaggaaactgatggaggctttcagaagatcaccaagggtctgtgagttacacacacacacacacacacacacacacacacacaccatgtttgagggaacacaggctagtaatgggaaccaggagaatccattcagggttcagaacaggtagaatctgttcagttctttttgtgattttaagtttcttgaattcgctctgcttaagtattcctagtacaacagaggcatactatacttttgaaatttacttttaagtacttttgcaaaatcaggatgataacgatgcatctgcctggtggtcagttaacacactatcaggaattcacattcaaggaggtcagcgaggtcagctagcattatatcagagagggccaactccagaggcagtacttttcaatcaacaactgatgatttcttaattagcactcatcactttctggccgttggcttagggaatttttaattgcatgatgcctgctaagggacagagaatcctgcctcagaaggtttgcgatcttttatccaggtggatcagagcacagcaaaggacagagagctggaacttcatcagacctacaaaactgcttgttgcctgtgtggctaaagaatttctctctaggccgggcactatggctcacacctgtaatcccaagcactttggcaggccaaggcaggaaggtcaccagaacccaggagttcgagaccagcctagacaagatggtgagccctcgtctctattaaaaataaataaataaattagccaggtgtgctggtagcacatgcctgtagtcccagctactcaataggctgagatgggaggatcgcttgagcccagaaggtcaaggctgcagtgagccgtgattgcaccactgcacttcaagctgggcaacagagcaagaccctgcctctaaaaaagtaaaatatataaataaaataaaattttttaaaaagaatttatgcttacaactagaagcatggcagaatttggcttgaaccttaccttttgttcaatgaggacatgaggtttaggggaagagataaccctcatccctcatgttctctactgcctgctgttaccctccaaaaagaacctacgtgtagtgcatgaccaaagtgacccatgtcaattcccaagaaggggtgggactccaggcgccagggccctgcccatttctggcctttgattctctggtgattctcttcccacccagccctaatgggcaggacctgcaaggctcacagatgtgacagtagctggcagaggttggctggcatccttagagagctgatatgtgaagggaagctctcaatggtcttaatttggttttgaaatattttccatttgaccctggctattcccaaggtccggggaaggtcctcactaacctaagtgccaccagaaagtcctgtccagggctcccatagtccagctttacacagagagggactcccaccactgcctcttggttcacctcctactgaatcagagagaggggttggggctgggagaagtggcaggctgggaagaagagtgaaacagcctagctggcccagcctccaggtgcactggcattagaacactgagaacagactgaaatctggatacattgtgggaaaaaatcagcctgtccacccttaataaggcctggagcagtgctgcccaaaacagctttctagcaccggcaaccatggtagccactagtcacaggcagccagtgagcattcaaaatgtgactggtaggaagcaggagatgaatttcaaattgcatttcattttaatttatttacattaaatagccacatgagactaatggttactgtagtggacagcacaggcctagagcctggcttttctccctattctctcaggaccttctcttaattctcaaatagtccgttctatggccagccccctctttttctttcttcctttttcctccctccctccctccctcccttccttcctttccttccttcctggtctcattccgtcaaccaggctggagtacagtggcatgatcatagttcattgcagccgcagcctgctgagctcaggtgatcttcccacctcagccacctgagtagctaggactataagtgcatgccactatgccaagctaatatttttttaagggggtgttaaattattatttatttattttattattttttaaattttacaattttaattgttgtgggtacatagtaggtgtatatatttgtggggtacataagatgttttgatacaggcatgcaatgggaaataagcacatcatgcagaagggggtatccatcccctcaatcatttattctttgagttacaaacaatccaattacactctttacggtgtttttttttttttctttttgagacagggtctcactatggcacccaggctggaatgcagtggtatgatcacagcttattgcagcctcgacctcccaggttcaagtgatcctcccagcccagcctcccaagtagctgggaccacaggcatgcaccatcatgcccggctaatttttttatgatttgtggggatctcactatgttgcccaggctggtctcaaactcctaggctcaagtgagctgcccacctccgacctcccaaagtgctaagattacaggcatgaaccaccacatctggcctccaatatcttgttttgaccttagatccctctcctttcttcaactctctggaatattctggcttgggtggttcaaaagaaggaaaccaatgcttcccaaatgtttccccattagagatggataaagtgtcaggctaccagaaaatagggtctttaatggcacatgggagtcatagaatgcacatgccccatttggaactaatacatccaatggtgctattcaaagtaatcataataatgtgctatactctgcttgtatatgtgtatggatacatcatcacaatgcatcctgcatgtaaagtgaccggaacaacaattaggcttctcattttaaaaattagaaaaccaaagtcagcttagctaagagaatcacattgcagataatgatagagctgggaccagcaccaggtgttctgactcctaacttctcttggaatatttgagtcagccctgattagagaagaaacatgacagaagaagagagcagaccataatcacccccaatagactggccatgtctccaacaaggctcttttctttcaggcctgcagggagtcattttgtacacagtgcacagcatattatttcctagcattgtggaagctggaatgtgttagggaatttaagcagtatctgtcttccagagctctaatgggccatcctgatcgttcttgcattctaactgtatttgtagggatcttatcaacgaatttccttctcataggatctctgctctttgcacaattcagaggtgtcttcttatttaatacaatatacaacaccatggtattactctaatggatgttctaaactgaacaagccaagcttttttttccttatgcttcagttaaatttgttttcatatcatttttctggatcctctgattaagcatgtcagatttttttaattttattatttttctggatcctctgatttttttattttattatttttctggatcctccaattatttattatttttctggatcctccgatttatttatttatttatttattatttttctggatcctccaattaagcacgtgtcagactaaggggtccaaattttggctgtatatctgaattcatggcactttattttaatgtaattaaattaattaattttgagacagggtctcactctgtcgcccagcctggagtgcagtggttcactgcaacttccacctcctgggttcaagcagtcctcccacctcagcctcttgagtagctgggactacaggcgtggaccaccatgcccaccctttttttttttttttttttccttggtggagacagggtttcatcatcttgcccaggctggtgtcgaactcctgggctcaagtgatcctcctgcctcagcctcccaaagtgctggtctcataggcatgagccaccacgcctagccctcatggcactttaaagaaaatacacattccaggctgggtgcggtggctcacgcctgtaatcccagcactttgggaggcccaggcaggtgatcacttgaggttaggagttacagaccagcctggccaacatggtgaaaccccgtctctactaaaaatacaaaaactagccagttgtggtggtgggcacctgtaatctcagctacttgggaggctaaggtaggagaattgcttgaacctgggaagtggaggttgcaatgaatcaagatcacgccactgcactccagcctgggcgacaagagtgagactccatctcaaaaaaaaaaagaaagaaagaaaaatacacattccaggttctatctcttgaggagctgggattgagcctgggcatccacatttttcaaagttcccccacatgatctcagtgctaaaaactgagactcatggaatgttggaccaaagaatcaagagacccatattctggttcctgactttcctacacactggcctctctgagcctgtttcccattctgtaaaatggagagataggagccctgtcctacttttgtgagtttaaagcataagaacttgtgtgaaagaattttgacaaggaacttttgtatttatggtgggagggatctggtgaccagcagtcagacaccacctgcaaacaggcctgcgatctggtcacttggtgacatttccactgggttctcgtggtctgcttgcctccatcacactatgctaaaaatgggtagagagtgggtggagctcagaatactttaactccagtgtaatagtgtgggcagcttccacttagttaggtacttctggacaaatggaagcttgtctgcatgcagctatatttatttccaaaataactggtgagatacccccacgaatttgagaacattcatttctgttttacctgttttgagacctttagaccatgagattagaacgccccaggcatgatcaggaggcagaagtacacaggtcgtctattcccaacctcagagctgatgctcagggtaaatccacagccattcgatgtagggacgttttaatttgggaaatcaaatgcaggaaagatattaccttactgttcatttcaagcatctcacacacaccattaaatgccccaaactaggctactattgaaccttaaccacatacaaattacgtatttacccaaatactctaacatgctaacaatcctttcttttgaaacttcctggtttaaccgatctgacaaacagatccttcatttctgttcgctctattttattcattcagtgtatcacaagttgaccatagcaagacgagaaatgcattaaggatcatgattttgcaaagcattaataaggatactgggacaaggaagttaagcttttgatggccttgatacaactatttcaaacttctctatttcaaactgacttctgcacaagggcaccacatctaaaggaccatcattgatagtaaacacagttagtttgtatatttattatgatagttttctggcagatgatagtcatgtgtcttattctaataaatcagcccatgacaacaattttccaacagaagtaagccaagtgtcttgaagaaggggtgggagtgtgccttttgtaattcacacacaggggcagtttgggctacatgcaacccagaaaggattgttagcatgttggggtatttgggtaaatatgtcatttgtatgtggttaaggttcaatagtagcctggtttggggcatttaatggtgtgtgtgagatgcttgaaatgaacagtaaggtaatatctttcctgcatttgatttcccaaattaaaatgtccctacatcaaatggctgtggatttaccctgtccactgatctcttccctggtcatccctgatctggggacaagtcttctgtcaaaaaggggctgagtgagcagcagctgggctttccctctccgccctctccagagcaggctccttgtggtctgccagccacaacataaaagtggaagtagtagtctggcttcttcttggtcagtttaaggtgaggagttttgtggggtttttttgttttttgttttttgttttttgttttttttgagttttttttttttttttggaggtggagtctcactctgtcgcccaggctggagtgcagtggcgcgatctcggctcactgcatcctccacctcccgggttcaagcgattctcatgcctcagcctcaggagtagctgggattacagacacctacctccacacctggctaatttttatatttttagtagagatgtgatttcaccatgttggccaggctggtctcgaacttctgacctcaagtgatccacccgcctcggcctcccaaagtgctgggattacaggcatgagccaccacgcccagccagagctatttttttttctacattacactttgaaaacaaaaaacttcccctcccctttctctctgtcttccttccctgagctctgtttgtgttgtccctactaatcccaggacatcccctgtggagctggagctctttcttcattttttccttttctccacttcaggtcttaactttaaaaacatctgggctattcctatacccagccctgggtgtctgaacctgttcagggaggttagggtactgttgattgccccagactctgaggtttgggcatgcacttcctgccaccctagaagtttcaaaaaaaaaaagaagtgtttcttagtaaaagggcagtgaattctcaaattctatagtttcccttcctccactttcatatctcagctactatcagagtaactttaccctactttctcacccctgtctctgtaagcctgatgaaaatcaggaagtatatagtgatgtaggagtggctgaacattctctggagatgggacacacaaactttaggatcctggaagaagctatcagaggatccagtgttaaattacaaagtttggagtagggtcacttttctaagtgctgatgtgttttcaaaagagaagtatcttgtagagcaagaggatgccatgctgcctggaagtgaccttgggtataatgggaaccctgatacattcatttattccatttgtttacaacaggtatacttttattcattcattttttacaacaggtacagtttcatttcattcattaagcatttggtatgtgccaggcaatttgctaggaatcgaggataatcagtaaacacaactagccttcgtggagtgaacaggctagtgttggagaattcactagctagataaactattcctatgcaattacacacagtgttaagtgttctaaagagaaacactgtgtggaaagagggaataatataggggacgcaactttcgactgtgagtgagggaaagcatgtctgagctgggcttttaagctgagacctgcaggatgagagggagccagcctgcggaaggttgcgccaggcagcagcaacaatcatacaaagactaagacatgaaaactctagaacataagtttcgacccttctcctttttcccagctcctaaggtttcgcttcatcctggcttctttgttatttccactagtaaagtacgagaagcactcagcaccacacctggcataactaacacttctcatgtgccaggtgctactggaagtgtgttatgtgcattaactcatttaatcctcataaccacccaaggatggagggtctattcatgtccctatttcacagatgaagaaactgcacaagtcactatgcaataatggccacgattattattggaattagtaatttcatcaataatagcacagtgacaattttcagacttctggcagacttaattttgtttatttctgacctttacactgctcattgagagcctctttagtagacttcttccgtgtactttgcaaattgtaaaagcttgtttcttttaaaaaatccattattaatgttattggtggaaaacttttttaacactgctggtcaggctttatagaaaaatccctttctgtatcctccctcatcagcaatacttctccgaattcccttcgattcagcaaaggtttattaagaacctgctaattgcctggcatgactctggagatgccagctccaaaaattcaaagtcaaggaaaaaaaccacacaaatagctgtaatagaataggatataggctctgcttgtcttataatcaaaatacaaatgcaagtgattgggaaaaagtatgatctagagtcaaggagacagctacccagaaggtgttttcttagacttacttttttttttttttaaataaatatgtaagtggtcaaaagcctttttaatatgaagatgtgatagctccatattttataatgtgttgccctcataaatttggtcttagaattgttctgttttgttttttccaaatcccccggttttttcactaatgacgacctactgtttagatgtagattgttctattgtcgaatgaattttaccttttttccttttaatttacaggtatgaaagctaatctttgaagacacacttaatcagcgaaatggtgattgttgaaggagaattgtggcctgatgcgctaatttctaagttaaaaaggaacatcattttcgcaacaataaagtagtgatctgcccttccacgcagtgttaagacacttcccacaactccttcacccttctcatttaggtaagtactaaaataaacaggaaaagggaactgtacctcttatacctatgcaactggcccagtgaattgatttcaagtttgcatttgtgagaaaaaaaaaaagatgacttccttatttatattttagtgggcacaaaattccccttccagagagccctgtctttatccctcagccattttcaaagagcactttcatgcaaagagcaaacagcttctctaggcggagagtttgaatttcctcttcctgaaccatttcctatatctgaactgcccacatcttatggggcaagaacatcacaagaggatgtaaaggatccagcaagctactaactcagcagacaacacaataatgccagtcttagagaactaagtgctaaggagagttcatggcaatgaattcaataaaggtcttttccaaccagcagcctgataggaccctttctctcttcttgttgttgaacctatctatataagaacacatttttttaaagatgcatgatataaattgtgatttaattgcttgaataggtgggacatgacctcccagagctgtgtgcatcaatgtcaagaaaacacgtaggggccctagttctcaacatggttgccatgtggtagagggacctcataacagcagtttctaacctggtctgtgaacttggatggcaaaataaaatgacatctttattttctcttacctctaactgaaatttaacattccctgcaattacaaatataggcaacaaactagaatagtatcagtagcacctgtgactttttgtcaccaagagaaatcacacatctttcaaatcgcatgacagttgttgcagctatcttgatttatacttattgttacttcagataatgattaagtattagagatgttactagtttttgttatttaaactgttattaaataacactttaccatgccatattttaaaaattattttgtagctgtatttcaacatagtttacagcttttgtaattctatttattatatttttatgcattttaaaacattctgaggaaagtccatagatttcaccacactgtcaaaggggttcatgccccccgctgccatgttaagtatgccttaggagactctcagtattgacccactgcaagcacagtttccatgcagtgaagggctcgaaaatgatccatttagtgcatttcactgtgcctttcatacagttttagttacctcttttccaataacacatcttatcaaaaacctcaaatgcagtacaattgtaaaatatggaatcgtttgatcttcaaatcgctggttaaaactgcatcagctttcagctattcaagagctgactatctaagctgtgaattatcaaggtccccttttctccctggtttcctctttggctgtttaccatgtggttcttttactactgggtcacaggtgcaccaacagataggcagggctccccgaggaaatgacattcaaatctgacaattttcctacatcactaagaagttgtggaccggtggaggttgaaagtgttgattaaattaaggcttggaattacctgtggattttaattaccattctaccactgtcccagtgtcctctgtctccccaccgccacgctctcctgtagctctaatgagacacttatcagatgctatttttgtttgttagttatctttgctctgcatacggtcttcccacagaaactgtgttctccttctcttgtgttgcccctggtgcttggcagacaatagatcccccataaataggtgtggctgaactgaatcactgtctatggtacatacccagtggtccttcatggttgaagatgtcagtgctaacatgatgattttctatattggatttcttacgtctatttggattttattacgcaacatttcttctacaaatgctgaacactatgtaccaggcatcatactagatattagagacaaagatgaatataatatgaacttccttcaaggagttctgaggtcacagggacactagacaaatacatatcgcgatggagtgtaacaagagcaagtgtaggcatatggactaggtatgtcggtgacacccagaaagggctggtcatttctggagaatgaaaatgagagtcagagaagatgctggagtgggaacccaaagcatgggttggatttaggcaatggcaagagggacggggagaattccagcatcagagaactgtgactcttttaggatgtaacaatacacaagcattctttacgtaccggacactcatttcttccctgctaagagaacctagttgtgtatctgggataatcttaaggaaggtaagttcctcctccagacttgggcttatgagccaatcatgagccaattatggtcattctttttctcttcaccagacattggtatagtgtgggcatgtgaccacattctggtcaatgacgtctaagggggaagtctgctcagggatttctgtttgggcaaaaaaaaaagacagagtcttgctaggagaaagtagccttcccctcgttttgaaaacaaatacaatgtttacagttgtggcagttatcttgtgacaggagaaagatattaaaagcctggaggggctctttaatagtaacactgaatagcaaccagtactagcaactgggctccttcttgtgcaagaaaagattaacctctacttgcctatgttctaagtaattaggggttttttccccttatagctaaacacatcacaaccgatgtatacagcttctgaaaactattttgcacaggtctccccagtgggtatcaatggggtcacaactaataccccctgagtttttctgcctgattatccctaacttgtataactctaggactcaacctcttcctccttcaatctctccagtcattttggggagtccccaggggaatatctttgagaatgtagcttcttccctgattctctctatcctccctttgatgcaaggagagtaagaaagcccttctctctgactctgtgtttcactctgccactagacccgaaggtgaatgggtctagctccattcatggaatgggaccccaagataaatgccctgaatgtcatcaacttttggtcagcgtataccttctagctgctgactacccctgctctctattaaggaatgtctgaggaatagtaagcatactaatttcatctactttcctttgtgtctttccatagaaggctagcatcaacctcttcctttagacagaccaaaacagcaacaatcatctgcaggcttatcagcctgtgccaatagatccccagagttcagattagctggccccaaggagctactcttcatctagctcagcccagagcccagtcacatgtgcacatgaaggaatggaagacacaatattgcaaaaatggtcaggcagggaccttatatatcaagctaagaaatataagctgtatcctctaagtcagggcttcccaataagtgttccatagagtgttgagatactaccctgccctctcagcccttgggactgctgggtggaacctgacagagggagctcctaggctggtcacctctggcagccagtgcccttgtttggtgtaggaaggtattgccaagaagagtggggcccaatgaagccatggtataaaacaattgggaaacaatggggagtcattgaaggatttttaacaggaagtaatcccatcagctttccatatcggaagacaatgaaagggcaatgcaaaggctgggttggaggaggtgggcaatgaacctgggaccaggaccaccagtctcacctaaaatagcctagtgatgaaatgatgagagggcaagctaaggagtaggaaagagagaggagggaggatctgggaaataagaaatcttttttttttaattatactttaagttctagggtacatgtgcacaacatgtaggtttgttacatatgtatacatgtgccatgttggtgtgctgcacccgttaactcgtcatttacattaggtatatctcctaatgctatccctcctccctccccaaccccacgacaggccccggtgtgtgatgttccccaccctgtgtccaagtgttctcattgttcaattcccacctatgagtgagaacatacaatgtttggttttctgtccttgtgatagtttgctgagaatgatggtttccagcttcatccatgtccctacaactcatccttttttatggcttcatccatgtccatgaactcatcctttttatggctgcataatattccatgatgtatatgtcccacattttcttaatccagtctatcattgatggacatttgggttggttccaagtctttgctattgtgaatagtgccgcaatatacatatgtgtgcatgtgtctttatagcagcatgatttataatcctttgggtatatgcctagtaatgggatgctgggtcaaatggtatttctagttctagatccttgagggatcgccacactgtcttccacaatggttaaactagtttacagtcccaccaacagtgtaaaagcattcctgtttctccacatcctctccagcacctgttgtttcctgactttttaatggtcaccattctaactgttgtgagatggtatctcattgtggttttgatttgcatttctgtgatggccagtgatgatgagcatttctttcttgtgtctgttggctgcataaatgtcttcttttgtgaagtgtctgttcatatcctttgcccaatttttgatggggttgtttgatgggattttttcttgtaaatttgtttaagttctttgtagattctggatattagcactttgtcagatgggtagattgcaaaaatattctcccattctgtaggttgcctgttcactctgatggtagtttcttttgctgtgcagaagctctttagtttaattagatcccatttgtctatttggcttttgttgccattgcttttggtgttttattcatgaagtccttgcccatgcctatgtcctgaatggtattgcctaggttttcttctatggtttttatggttttaggtctaacatataagtctttaatccatcttgaattaatttttgtataagatgtaaggaagggatccagtttcagctttctacatatggctagtcagttttcccagcaccatttattaaatagggaatcctttccccatttcttgtttttgtcaggtttgtctaagatcagatggttatagatgtgtgctattatttctgggggctctaatctgttccattggtctatatctctgttttggtaccagtaccatgctgttttggttactgtagccttgtagtatagtttgaagtagtatagtagtgtgatgcctccagctttcttcttttggcttaggattgtcttggcaatgcgggctcttttttggttccatatgaactttaaagtatttttttccaattctgtgaagaaagtcattggtagcttgatggggatggcattgaatctataaattaccttgggcagtatggccattttcacaatattgattcttcctatccatgagcatggaatgttcttccatttgtttgtgtcctcttttatctcgttgagcagtggtttgtagttctccttgaagaggtccttcacatcccttgtaagtcagattcctaggtattttattctctttgaagcaattgtgaatgggagttcactcatgatttggctctctgtttgtctgttattggtgtataggaatgcttgtgatttttgcacattgattttgtatcctgagactgctgaaattgcttatcagcttaagaagatttggggctgagattatggggttttctaaatatacaatcatgtcatctgcaaacaggaacaatttgacttcctcctttcctaattgaataccctttatttctttctcttgcctgattgccctggccagaatttccaacactatgttgaataggagtggtgagagagggcatctctgtcttgtgccagttttcaaagggaatgcttccagtttttgcccattctgtattatattggctgtgggtttgtcataaatagctcttattattttgagatacgtcccatcaatacctagtttattgagagtttttagcatgaagggcagttgaatttatcgaaggccttttctgcatctgttgagataatcatgtggtttttgtctttggttctgcttatatgacgggttacatttattgatttgcatatgttgaaccagccttgcatcccagggatgaagccaacttgatcgtggtggataagctttttggtgtgctgctggattcagtttgccagtattttattgaggatttttgcatcaatgttcatcagggatattggtctaaaattctctttttttgttgtgtctttaccaggctttggtatcaggatgatgttggcctcataaaatgagttagggaggattccctctttttctattgattggaatagtttcagaaggaatggtaccagctcctctttgtacctctggtacaattcggctgtgaatctgtctggtcctggactttttttggttggtagactattaattattgcctcaatttcagaacctgttattggtctattcagagattcaacttcttcctggtttagtcttgggagggtgtaggtgtccaggaatttatccatttcttctagattttctagttttttttttgtatagaggtgtttatagtattctctgatggtagttggtaggaaataagaaatcttataacaagaaatcaagcccatgattcagatcagcaggcttgctggttgattaaatatagaaggtgagggaagtatctaggatgacttccaccttctggtttgaaaacctggatgggcagtggtgccaccgaaggagactaggaacatgtggagaaaaggtatggaagaaaattgacttgacttgaagtatgtatggaatgtacaagggaaatgaccagtaggcatttagacatgtagatctaaaattcagggcctaaagttcagagatcaagagatcacttttgtgtagattttttagagtcatcagcaggtaagtaatgatggaagcccgtggtgtgcattggtgatactgaccagggagaatactacaggaatgagaggatgccaaagacagaagaagggattgatgtcaaaggaccaagagtgagctgaggactcagttctagagagcctcaacagtcagtctctctctctctctgtgtctctatctgtctctctctctctctctctctctctcatatctctctctctctctctcatatctctctctctctctctcatcactatctctatctctttctctatctagctctctctcctacttcatactggacttttctgctaggcagagagcaaagtcactgctagccccagattagccacccccataaaaaatctcttttctcccaccatccctataacaattcctggaaagaactctggttgactttgctagaatcacatgacccatgcttagaccaaacctaaggagcacttgggttggccagacccatgtcatatgcccccatattgttggaaggagggtacagcctctttatgagaagaacagggatggtaaaactttctgggcagataaaaatagttatcaggtcacctacacatcaacactttaaaaggtaggaggagaaagtggagccagtaaaggagacagaaagttggtatgtcagagtagattaacagtttttcagaggccaagatctttgtcttatccttatctgtgtccttcatcccccccatctagtatctagccttgtgcctataatcaacaagtgtgtatggaatgaattcatagacactacacatgataagtaatggggatttgtaaaagacatgacaaagaccaacactcaggaatctaatttgggcaatacacaaaagcacattttttaagtagctggccaccactgacatagataataatagagtctctaaaaagagccaaactttttcatgatttggataaaggcaccatatccgtttaaaccaaaacagtcacagatgaggatttgatttggggagtgtcttatggaaattagatggtgttgttttaaagagtgttcattttatttctctgttctagggctgactgtaatttcatgctgcatttgcaagcctgcaggcagacaccttaattactatggatgccagatagaaagaggagtgctaatcaaacctttattaattggtgacatacttccaactttcagaaacagatgctagggaggaatgaatccttgtaaaccacagtacccaccaactcccctcaggtgtggatttttttttttcttaaatcaagtaccttttacatccactagggggaatcctagcgcgcttcaaagtctgcctttttctatgcttagaatgacatacccatgaaaacttgcttgtctattgatgggtgtgtcctctactctggagaagctccgagatctggcatgttgtcatatttttcaaacagaagagaaaatatcattcaagatatgttaaagaaaataaattgctcaaattctcactggaagaaatccatcttagagaaaattttccgtgtaaacagaagtttctaccaggaaaaagagggtaattatttgtcagaatctttacttaccaaaaaatagaaaacactaaatatgtgcctttgcaattttagagagcttaattttaaatacctgttaggcactagtgcgatctttatgctcagtggagttcttaaagtattattggcactcggttgataattattataattattataagcttgccttacataattacagtataagactctccccttttcagtataaagccatgttcaaacaaagtttgaaaggtgctgtaaattaacaaataatttaaaagctatgttcagtggatgctcctccatgttatcaataatattttttgtggcaaggagttgtttttctccttttatattctctgtctctgcagagatagtcaattcatgaattggtaaatatgcactgtggagatgccaagttatgtcattgtatgtggggctgtgggtacctcaaagaatgacccttgcccctaaggagtatagagcctttacattacacttcaactgacatttattgaacactgactccgtgtaaggcccagtaatctgcacaaaaataacaccactgatcttgctcattgccataaccccagcctgcaacacatgcctagcacatggtagattctcaggaagtatctgttaaaagatggagtaagttaatgaacagaaagtttgaggaataaagggaatatggagataaactgaatttaagacaccatctctgatctcaaagaaattatattaagtgaaagagctataaacacaaccaatgcatagtgtatgatgtgactcaccagattttaatgctatcaacctacagataaagtgctcttcaagttcagagcagggaattcataaccaaagggaggaattggccccgttaaacaaattcaacaggtaagtttagttacactgctagaacagagcctggcatgaaggagacacacttcactattttgtaataaatgaatgggtacttactgtatacaaggcctagttcctgggggcacaaagatgagacagcacttagtttctagttttctttattttttaaatgggagtttatagtttagtagaggcactctagtacaatttcaaggaagactcccaggagaaagtagcttttacactggaccttagtggataagtgagagctcacaaagctgagaagatggaaagggtgttttaggtgaaatgtacagcaaatgcaaggacacaggggcttgaaagagcctgactcatttaaagaagcatgaaaatcccactgctaacaacaggagacagtaccaaggatattcctagctcttagcataaggccctacgtatgaaagtcccctaataaatacttgttgttttttaacaataatgatggtaagagtccaaagatgagcacaagttttaagtgctggacaagtatgaagctgaaagagttatctgggctggtaggatctggggccagtttatgggcaacatctttggactttgtgtgctgaggccacagaaccctccatacagcaggaaggccctttcccaccagcctgttaccatggcctgttttgtttcatctacacagtctatttaacaacaaaaccagagaaaagtgctcacagtcactacctatttctttgaggtccctctttatttttttctgagatggagtctcactctctcgctctgtcgcccaggctggagtgcagtggcataatctcagctcactacaacctccacatcctgggttcaagcaattctcctgcctcagcctcctgagtagctgggactacaggtgcgtgccaccatgcccagctaatttttgtatttttagtagagacgggggtttcaccatgttggccaggctggtcttgaacttctgatctcaagtgatctacctgccttggcctcccaacgtgctgggattacaggcgtgagccaccgtgcccagccgaggcccctcttttcatgccttcatgctaactgcacccctcctacaggcccttgagtgccacttctgtgagtctctcctcaactaggtaaaatgtggttccattaatcatattttgtcttttgggttttagttttgtcactctcattcacatacaaccagcaatgttttttgaataccctttcattcgcaatcaaatgatctcataatcctaatactgttaacaacacatagcctgttcacagaggctgaaggtctagctgaaaagataggacttgtaccttaaaagataaataatactgctacctaaaaagattaataatactactgccattagcattctttgctttgtactgtatctatgacccttaatcaaatttcacacacacatccacacacatccttatagttcacagcattcatggggtacacattcaatgggcagcaaatagcatttagtaataaagctttagtaatgcttgcctattctcaaagtctggttttttcgatggtaaatttcttaaagcagtataccccaaaatttaatatttaataaagattcttcccttgcttaaaaggactactcccaagcacaggggcagctttgccatctgccatcctgcttcatatgttctatttgcttgtaacatttataccaacttgttttcctgatcactttctcacctctttgtaagtacctgccactgaatctgctgctctccctggctttcttgcatttcttgaaaacccttccactccctcctcctgttgttacttttctgacctattctttatgccatttggaaatcacagatctgtgtatcttcttcttcttctttttttttttttttaagacagtctcactctgtcacccaggctggagtgcggtggtatgatctcagctcactgcaacctctgcttcccaggttcaagcaattctcctgcctcagcctcccgagtagctgggattacaggcgcccaccaccacgcctgactaatttttgtatttttagtagagatggggtttcacaatgttggccaggctggtctggaactcctgacctcaggtgatctgcccaccttggcctcccaaagtgctgggattacaggcgtgagccaccacacctgggcatgtatcttcttgatatcccgagatgactctgagccgctcatccaccaattacaaatgtagacttgattgcagatgttgccattcccctgttcctgctggttctgatgtacctaacacccacatccactcttaacactagtggcatcccctcttaaccttcatgaaactcaagccagtaggaccaagaggtaggtaaatgaattgtgaacataagggggttggcaggatagtgcaacaggtgagaaatgaaaaggcagagacatccagtgagaacacagcaatgggaagtgaggaaaacctttatggaggaagagactatgagaacagagtgtttgctctgctgtggctggctggccaccagccaccactgcaacagaacaaccagggagggtaacagattaagtgttatcagccactaatatcatatggtgagaatccatcagcaaacctgatgtagaagccatggacttggccagaagaaggggttcaaggcccttaccgtactgtgggaccttggcttgtcattaagctctctgcactttagtttgcttatctgcaaaatgatgtgataatacttttgaggttattggaaaaactaaatgaagaaacagaagtaaatcggctcagtactgagcggaaacatgtgcccaagaaatgccagttaaaatgttttcctaaggatagggtttgagatggaaaataggtgtgttacaggctgaattgtcaccgtctccccaattcatacgttgaagtcctatcccccagtagcttcggatgtaactatatttagaggtagggtctttaaagaagtaaaatgaagtcattagggtggacactaatctaatctgactggtgttcttataagaggaaatttggacacagatatgtacagaggaaggatcatgtgaagataccaagagaagatgaccatctacaagccaaggagagaggcctcagaagaaaccaaccctgccaaaaccttgatcttggacttccagcatccagatctgtgaggaaatacactgccacccagtctgtgatactttgttatggcagtcctagcaaactcctaatactaatagtgctcctaacacagcactagagtcctgataataataatggtaatcataataataacgttttttatttatggagcgacttcctgtgtgccaggcattgtgctaaatgctttacacatattatctcatttaatacgcatgaaaatcccatgtgatggatgcaatttttccaacccacgatgaggatgctgagggtcagagagcccaagcctacgtagttattgagtggtgggactgggtctggaacctaggcctgactgggatcactgctggcctacagtgtctttgtacaaagaaaaaggtgccacttcctttgggaacacccagccccaagccagggtgcaaggtttggtaaacagaagacaggctgggttttaattcctctttcctccttggctgggtgcccttgtgcaaacctaagcctctcagggtggcccacactgaggcccaagctcttaatcattacaccggactgctcagtgggccagggtggctgggggtaacaccattgccaccgtcgaggtaggatcagttgggcacgtaagggactgtgagtgctggcaaggcaaaccttacctccctcatggctgggaatgagatacgtgggagcccaggtccatgagttctgggacccatgtgggtgggcttccaacggtcctacaggacaacgacaaatggcccttgacttagggcaattctgcttatttctaattggccccagaacagttctgtgtccagtcctcagtcagcaagaaatccagtttgccaggatcgtgcccctaggattacacagctgtcctttcgccattatccccatgcctcctcctcctcccaccaaatcaaagagaatgagaaatgcatcttcgaccatttggctataactataagtgtgcctgtcctcacaattaaagctcctgaaagttccaaatttgctgctttcacggtgggaaaaaaaggcctccgacagcgtaaatatttaatcaccattaagaatgtccaataaatgaggggaatcaggtttcaaattgactggttcagatgattaaagtacagaagtcatagcagggtaaaaataaagtaccctctaaaaaagtagcatcttgtgggcaggggcaagatggaagatagcacgttgggacctctcaaggccgggccgggcactgcactctccaggcagggccgggcgagtgcggcaaccaccgtcactctccaaaggcttccgtgccccctggggcagctgagcggggtaatgccctccgtgatggagagcgcgtgtcccacagccgggccaagacggtgcccaaccgcagatagccccactctgaggatgacagcagcgaggaggagcactcgcacgacagcatggtccgcgttggaaccaattaccaggccataattccggagtgcaagcctgagagcctcgcacgctacagcaacaagaagctgaagggggtgctggtgtggtcacccaaccactgtgtgtcagatgccaaacttgacaagtatattgtgatggccacggagaagcatggctacaacattgagcagacgctgggcatgctctggaataagcaccatgtggagaagtcgctggctgacctggccaacttcaccccattccctgaggagtggacagtagaggacaaggtgctgttggaacaggcctttggcttccacgacaagtgtggatccaacagacgctgcccgacaagttgatttccagcctggtgaaatatcactactcttggaagaaaacccacagccgaactagcatgacggacagacaggcccggcggctgaggggctgcaaggacaaagaagacagtgatgagttcgaagagagtcgaggaggcctgagtgaaggagagcccgatgctggacacccgaagagagaggtacagagcataaagcagaggaacagcagcctgcgccaagccctggagggcgccattgatccactccgcgctctggaggccaacactaagttcaactcctgctggaccacagaggagcagcttttggctgcctaagccatccggaggtatggcagactttggggctattgcagaggtgattgggaacaagactctgacccaggtgaagaccttctttgtgagctattggcactgcttcaatctggaggaggtgctgcaggaatgggaggctgagcaggatggggcccgtggagccacagtccccgtggaggaggctaggagaggggctcccttgctagccccagcccaagaagaagatcatgaggtccagattacatcgatctccatgtctgtgtcccgatcggtgcccccctgcaccacccccgttccacctcccacctccctgccctaggtgccccctgctgctgaggccacctttgcccacggctcccactctgctctgacagccacccacagtgcagcagggccgcttcctccagccctggttggcccccaaccagcgcccaccacctctcatcctccccgctctggctgcctgtcctggccctccgcccctacccaccctgattggagcccccagtgccctcactctgaatcctgaggtcctccaccaaccacaggctccaggacctctttgctggccatccccaggcatctctggtgtcactgaggacggaaggggctagggctcttgccaggtctttccaagacccagagctgccgacagcccagcctggacctgtgggttctgcatgtgttcctggcagctgggcctgtctcttggggccatggcccgggctcaggggcctttgagctggactgagggcactttcgcttccttgctgggactggaatggctgcctcctagttggctggggcttggtctctgggccctgccctttgtgtgtcgggggtagggaccttagcgtgggggtgggacaggacagttgggtgtgctggctgttctcattcctcttcccttcttttagcaatcagtcttgggtgaggtgggaagggaggctgcagggggaggtggcagaggggccttacagcagcagaggctggaagggaagttctgtcttcaggggccagctgggaaacactaaggagctgagggtgcccaccaggcccaccttccagaagcttggagaaatgtgggttgggaacttatgcagacatggatttacttttcaacatgttttaaaagttaaaaaagaaaaaccttctaaaaaaaaaagtagcatctttagagggttcctgtctctactacataggtttccttgagtataaaggaaccaaaaacatccaagttatctcttcattattagtagggggcgacatagggtgaggtctggagatgaggaagtatagcaatctcttaataatcctgctttggtaataatgaatatcaatggaatttctcaactttattgaagggacagctggagttcagacttaaggagaaatgtcttaaaaggaaaaagcggcatgcttggttttgtatcttgtttgaaaatatatttcaaacgttcagcagaattttagagatcataaccaccctctgcccccaccaccttctgaacccttagtccccagtagttctgatttacttttaagattcttttagttttatgttttaactgaaaaaaaaaaaaatcctgcccagccaggtttccatctgtctgtatcaccgggttgaatttagtgtaggaaagcctgtgcaaagggaataaaaatgtagctttttttccattgccagattcaggggaaccaaccatttggaaacaaaggagttccattttgactagcagcctttctgctttccatcagtggacaaagtgaatgtacaggtttaaacatcatttggggtcacctctagatccatgtttggaggtagattggtttgttagttatgattctggcaggaaacaggtgacacatgcaaacagatacattaattgagggaccatggccgagccatgccaggatgaagggagaccagcagaggctagccacagcgacaaccatggaatcccacaggcctgaggaggagggtgagggagtggttactgggtccacgaaaggctgtggctacagtgtagctgtgagagaggacagcccacaggagctgtggccttgtagagggacacagccatggccaatgcatagatcagcagagagggagctgggagaataaatattcaaacttcaccctagctgtccacccctagatctctggctggggcttcccattggctgaatccaacgagaagccaaaaggcaagggtgatgtccataaatgtcaaacttctgggtctcaagcaaaagggggagcagtggggaaatggtctgcagggagaagaagagactattcaacacagacggggaagaagaactaaataggaaggactagggaaggggtgaaagagattgcggtgatggtttcaagggtgtagacttatctccaagcacaacatgttgtatataataaataggtatggatttttgtatgacagtcatacttcaatgaaggctttgtaaaaaaaaaaaaaataggggcaggagagcgaggcaaacactcggtcttccatgaactttgcatttgggattctgtgcgtggggatgagtgcctgagagatgctgtttggactgccatattcccagggcttccccaggatgggtgatgagtggggctgcccccaccctggggccatacgccaaactgcccgaccgcaagagcccatgctcagagctgatattggttgcttcctcccgaccttggtggggctattttctagggagtggcaaggacataagaatgagaagccacaccagcttggtggagagcactagagggctcactgcgaagtccagcaactttattgtcagctcagagcatctccccaccagaatctcaaggaagcggaagtacaagtggctgtgaagttatctgcgtgtttatcttatcttctgctattcatttcaagagttggagttattattaataagaaggcctggtttctggcagctcttctcttagaatgggtttatgccaagctgccagttatcagaggattcagagcctaggattatgctgacagcgagtctcagagctgtgatgggagggcaaagacacgggaaacaacgttgtattaaagaggaatcagcgttttgtgtctagtccttgatgcccttttggcttcctatttccgaagaacagcaaggaaaatacaaggagagacagactggaatcctgtgaatatcagagaaaagcttgattttcaagagactgctcaagttacagagattccccaaatctgaagaagtaattaactgatgagttcgcatacttcatgcagggtgaactccagccggtctagaaaaacactgtgatggttgatgatttaccatactttgctttcaaccagtaattgtctcagattcttaaccactgatggttttggtgaatgttttggagaaaaggctcgagagaaacttcatgacactaaacatactctctgagaagtgtggtgctagaatgctaaggtgatgtcctagacttcgcagtctcttaaacatatctgacattatattatgctatggcatgctatgctatgctatgctatgctatgctatgctatgctatgctatgctatgctatgctatgctatgctatgctatgttatgtctttttaggcaatagctcatccctccctaaagcagagtgaatgctcttatttagcttaaagacagtcattggactttgagtaaagagtcattttcttgtacgttccactccaccctccagtgtacatttgcactctgctggcgaatgaccatgagctattaaatcatgacaaagaaaaagatgacaactgtaatgttgggagtgacccccaagtcccacctactgaaggaacaccacaagccttcctcactttaaaccatggcatgggggcactatcaccaagcataagaatgcccagcaatcgtctggggccatgttgggtgggcagagaggatgaggcactgagttccttcagccacgtcttaactgtgccatgtcagagagacttttcatgttgattgaactgtgtccaactcatctctcagcaccaatgcgaacttattaaacagctcttcctctaatcttttttcaaccatctactcatcagcagactagaaagaagactggctcatttctttttcctgtcagccaccaaaagggcctgggagctttgataagggcctcgatgtggaagaccacatagatatcagcaaaactgtggaggaagaagtggtctgcttaaaacctaagaggacaatacaggtactattccacccactgggtggtatttccaaattctgcacagggggttgtagctatgtagatgaggcttagagagaattcactgaccaccagaacaaatattctcagttgctttcaatctctgccagccaagtcatgctacagaccactgtcagatgaaaaaaaaaaaaaaaaagaaagaaaatcagaaagaaaactgaagcaccaatgatagccatcttgtgactgtgaccaattgcctactgaacagttcttaatgtcctgggccccagcaggaaaccactgaatctataaagtcctgtccaccagaaatgagtctgattgtggatggcctggttaacccagattgccttcggtgcctgagggacttgatattttctcattatgaagactttcccatctagtgaacgctgcaaataaaactgctcagaatcggtctgaactgcctgtttccgtggtagcaggcctctgtctggaggataaatctgcaccatcttcttttttttttttttttttttgggtttcagccagttgtgttacaaggagttccgaaatgtgctataagtgacacccaacaagatgggctcggccagttggagagggaagctttgtcaccaaagggacttgcacccctgggccagacggtggtgtccaagagaaagtgatcaaagagatacagaacccgcatgcctaaatatttatttcagttgttcgtatttcccacacttttcaaatgtgaacttgtgtcctgaaggtggagctttagtacacaagaaaattgggaaggggcaaacatgtttgtacaaaatgggggtagaatcagcaaagaatgcatttatatgcttcctcgtcgcctacgtttttcatgccaaaaagttagcacagattctgatttctttcaccgtaggagtctgcatacaattaaatgggaggcaaaagaagcccactcttaagagtggggcttatggtcccagtagaatggcagggaactgtagccatcaaagccatttatacttcttgtgggtagtatttttaagatgttgtttctttttcaaaatgaagcagcaatgaactgagtagtgatcaaaatgccgcaccacagagtatgtttaatccaaatagctcccaagatggtctgtgactgattgtaccaactctacgggacttagagaaatgacttggttaccagtgaagtaaaactatctctggaatggaattgaactgttgcttctcagcacatagcgacactgccaccgctggttcacggagccagtgaaggtcactgagttctgcatcagtcacagggaaaactgtcaaaacaccagcgcataaatcccctactatgctgtggagggggtctctgagcttcggatgaggtttttaaaatattgatcttcccacttccagaggtgcaaaaattctgaaagcattccaggagggcagggagtgggggagcaaggccagatattttggagcaggtgaaacatctgacttgtcttgcctgagatgtcccgattaacaccaactgggtactttaggcctttccccttcttcctcccctctccttatggacactccaacaccatcatcacagcacaaagggcaacctcatatctcgtgggaaggcattttctgcctcctgccaggcaaagataatgttatccaattgcaaatgaaaggcttatgaatgaaaagatgaccactctgactttagtgtatgagagccactgctgaaatgataggatccttgaacttcacatctagagcagaaactcacacttctcttcttctccctccacctcacccttctttccttaagccttccagaactcctgccatatccctcagcactggggagaacttgaagcactgttggagaagtttgaaacctgcaaccttcggcaggactcagcatgggacaaaagccacctcattcctttcccttcccaaaacagcatctcgagctggggaacttggagggaaggaagaaaggggatagcagccaattgccctccctggggcctggggtctggaaatagcctgggaaggaacagagatcatttcccaacgatccatagaggtcctcagcaccctccactcctatgcaccccctggctcatctgccagactgtaagggtgctgatggtgcccgcagctgccccgggaagctgggaggcatttgtgcatcctctgggaagccccattccgagaaatcatgaacctattccccagtgggcaatgattccctgtgcttcagaaattcttggcggctgtgggggcaacccagctgttattcaccctctgggtgaggtggtgagacctcagggggtccaaaggataaaagtgggtaatgatgagacagatggagagcctcgagggaaatacggggacttgggtctaatagtagaaagcagggcgggggctggttggtgcatttaacttgaggaacttttcagtctcactacagagaatgatctctgggggattatggcaatggccacaggtggcacttaactagagccaggtatgtaagaggccctggggctagatatggattcgaatctcggctctgatatctaccagcagtagaatgccagcacgttccacaacctttctataaccattctcctggactactaagtagggatgacaataacagtcactaattaatagggctgttatgagaattatgagtcttaacccatgtggtgagttcacaagcgcacccggcacgtagtaagtgctcagtaaatgttagccccgctcattaggttagatggtgagcagaactttccaagtgctaggcttgagagcctgggactctgttgccaagggagattagagaacctttgcaaatatgggcgctccggccctggggattgtccagaacgagagtgtggcgcctgcctttctgccacctcactcatccgacccggggaaacccacaccctgtcacaggggcgccttggtccccggagtctccggctcggccatgtctcccgcgcgcctccccggggcctccctctcgccgctccacacctgtcagccgctctcgcagcagccctgtggcccgagcccggggcctcagctgcaaccccttcgcaccctggatcctcgctccgcgcgcctggcgtatccccgacccggctgctgtcgtaaacaaaaccgggcgttggagcagcaccgcgggcggacgggcgcgggagcccgctccgtgcgccgttagcgcgccccgggagccccaggcgagccaagggggcgatggtggcggccgcggcggccgcggcgggcggctgagctttgttatgaatagatgaaagaggccacctacacagtaacccaaattacgagacctccctcctccctatctcaccgaatcaagaggggaggggagatgggcgtggagggagggcgggcgggcgggcaggaggcggagggcggaggaggaagagaggatgaggaagggggccagttgcatcccactttcacaatgggaaagtgaaacgcacaagcgcacccaacctctccagccctccccgcccgcctcgctcctctccgcccgtcccctcccttcccctccgcgcctccccgcgagcgccagcgctgcacacaggaactctccggcgaaggagggcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactacacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcgtaagtcctgcccccggggcgccgcggagagcgctgctgccggggagccgccgccgccgccgaggcagaacgagctgggggcgagcggcggggcgggggtacagccgggtgacatttaccaggtctcaggttcacaccgcgggcggccgtccgaaggctcctctcggacggtccccgagacctggagcacggcctgaggtccccaaagggagagtgtaaaaaggggggcggggagggttggagttagactcaaaactctagtggctgcatcccattgccatccttccctgtccaaacggggacgcttgtttggggctgagtctcctcgcgcagcccctctttcccattcgcttctccagacttctctgtgccccttccgtgtagtcccagcaggcgtgtgggtctgaccctcttggtcaacagttagcaacacagtgccctcggcagagaagccattgaacctaaagggctccctgccacaccccagcctttgtggccccctgtctccgccccccaccggcaacgcaagtgctgtggtctgaagagttgctagcccgctcagcgtggagaaatgccagcctgcaacagaggcttgcgctggaaccgaacccctggcgtgagccggtgcgagggggcggtgccgtggctctgctcagggtgcgctgtggtcgccagccgccgggagaggctgggcgggaggtggccttgtggtaaaagcctcatcctagaggggagtgcaagggaaagtgttgggggtgctacaggcagtttctgggctccagattgcgagactagatggcgggactcagagtcaccaccctggggctgaaccaggcaagcgatacaggtttcccctgggctcccagggcagccacagcttttatcttgagattggcatttctttgactggaaaataaagaggcagttcaagagggtccagttgatggggattatggagccattgtgcacttctccggaggccgtttcccttccaaggcggctggcacatcaactccacatatggctcctgagaggggagcctgctgggagcctcctttataactggacaaaaatcaaagcgcagaaattaacggctacaggtgttgccattgttttggtacaaaatgaatcagagaggaaggggagaagtcactgcttggaaaatgtgttgatacaggggcacgttggctcccaggtatattaatatgtgtatagaaagacagcttcccccacccccttctttctctgcaaagcacatcttaccaaatattagccctatgagccagggagaaaaaaaccaggaggtcttttgcaaggcttcttagaacggtcacttgctgctgcttctttgcctgtcaagctgtgtgctgggacacacacattaaggccttcattttgttactggtataatttttaaaaatatgtaaaaacacatatttgcctcctaaatgacttgctgttgccgtacacatataatgtaatatttgattcctgtctttattagatctttataatctaacggtttaagtttggtaaaattatcgtttcctacttctctgttgaaagacttgaaagtacccccgaaatattactttgtgtcaagctttagacacacttagtctctggggttaatgacaagccagctcagaggcccacagcaggtaatgagggtgaaagtccaagctttgccatctgacagctgtgtcgatgtgtggagccaaaacatttctcttgactgcgtctctctacctattgggtcctggaagactcagttcccttccaaacccagccagcatcttgaatgcactcaaaatccacgttttggctcaatcaggtgttcctgcttgtgccgggatggggaggggcagtggcagaggaagtcgcggagcttctgcgagagagctgccccttggaaatcaagcaaaggataaacacatgctgccaaaaatctggaactggaaaaataaataattaaaatgggtccctccacagcatttcttgctgctatttatcaagaactcccagtgtgctcagagctgtgtgttctgaaagacagggtctgtaccccctgagcttgtcagccaagttaaataatatactctggttcaaacaatagcatgtcatggctgcacaggtgggagcttggagctttgcatttttttttcatttaagtaaattccttgctgctagtatgcattgaaaagccttaatggaattgaatttcaagaggagtttgaatgaaaaagggtggtagttttgatgaaaaagctgacaattttctaacctattaaataggtagagaagatactcaattcaacaaatatttgtttgatgcctgctagtgtaagcaatgctctgtgctgggtgccactgattttgccactgaaaggacgatagcagattgcaaccttgtgtaatggggtcatgggatcagtgtgcccctggctgtcactcagaagaatgatgtcatttgattgcatttgttctgcattttattttcaggtcttgaatgtgtttttgaaaaggcatgctgaattataggtgcctaaaacaggagcaggacttgaaacactctagagggaacctcaatagattccaacagcaattcctttagagcagacacagtaattttaacagtaatccacaggctgcaaggcacaagcggctggatttgcttgccttctttctccctctcctcctagctggctcttattttccgtcttcaatcagccataggtagaaaagtgacaggactgactgggttgtattttcccactttctggttctcttatctcttgtcactgatcctcctctccttcagcttctgctaagcagtgatttacgagatgcttgtgtaatgagtgtgtactcagctgtttacacactggaccattactttttctgccttgccaccaactttgaatccactttcataactgtagcaggttaactgcagctctcaaatgtgctaaggcaaccgatttctgtagaccctctctctaataatcttctgtgatatttgtacagcacttccacatgtattatttcttttgagccccgcatcaagtctgaggttgattctatggggatgatttcattttccagatgaggaggctaaagatccgttaagcagcttgctcaagatagttaagtgccaaagccctccaccttaaatccaggtcttccaatgtctacatctctactcttcccaccaccccagggtttctcgaactttcccttgaaggtcccctaattaaattggcagcaaacaacctcccctaggatgtggggttgaggctagagggtaacctcagaaggcagtacatgcctctaatcttggcttgtgttttagaacttcatgtggtctctttcctttttttcattcttttttataacacacctgtgcttggattagtataaaaatgaatgtttttaattatgcacaagttaatcaatttgacttcctacctttctgaactctcactacccctggcacaccaacgtgatacacagaaagtgtttgtgttcgagtttgtggagtctgattgctccagacttgtttggccaccattgttgggttctggggtcactcgtggtttaaacatggcagccacccctcggtagacattgagggtagtacgttttcctgcagtattggtccacaggactctagatcattctagtttgttctctagttcattctaccctttgtagggggacataccgccttcttccacgcctacataattctaaagcctgacataatttaactgtcatgcagacaaccacagaatgctcacatgctgcccaacagagagcaacccaaggaacatgtgtggagaagtgacatcccagttccacttggcgatgcagcctattgacctcaaaatccgcagtcttcttgtgatgtttatttctcttccagcttctgttatgattttgtcaagccattttgcagtctatagactagatggtgattttaccctcatatacacatattatatgcaaaaatggattcaaaaaggacaattgccatgacagcacccacttagaaagaggggaaagcaatcatagctactatctactgaatagttattatggccaggttttgtgtgaagcaatttacatgccttattttctgttgattctcattcaccatatggggcaaggactgtagttatcatgatgattagagatgagaaaattaaggcccagagagcttctgttaggttccatagctggaaaatagcagaggatttagaacctgggtggtccagctctacgacctgagcttttagccaccttacaagtctatattaaggagccctaccctattactattaataatcatgatggtgatgatagtaaagacatccaaagcacacggcattttctatgggtcaagtagtgcttattctatacacattaactcatgaatccagagaatattgctgtcaaggaaatgggattccccacttataaataaagaaaccaaagcacgaagggttaaataattactacatgcaataatgtgtacatgtccactgccatggacagtctgtcagcatggacattaggtcctgatgtcaaccctaacctgtatggagcaagctaagcccttgcaactgctatgctaagaccagctttttgtggacacaggcataggatagcagagaatccttagttatgagctgagtttctaggtttgcattggtgaccacctgaagttctgactctggcaggattgtagtttcttaactgtgaacttctagacagtgttggtgttctgatctatacatcatctcaaagggtgttctctgttgaaccccccatacctagcatagtacccagtatgtagttgggacttcagaaatatttgttgaatgaataaatgaaggatcgtagagaatcatgttggaaatgttttctctactcagcagcaacactttctgggagtctggtcacctcatactcccttaatcattgtctttttcttaatgcctgatgtgtcagggccccttccttccttagttttaggttacatggtgtcctttactccttcacctcttcccaggtacttccattcattggaataccaggcttctggtgttgccaatctgagagttacttttgaccatggaaacctagcatggttggaacttctatggtgtaatttttgattgcctttcaactatgagaggaaagggctttatgctgtaggcagtggtccttaaagtgtggactgtggcccagcagcatgaatatcacctgggaacttgctagaaatgcacattcttggaccctacaccagacttactaaatcagaagctctggaggttggggtgggactggcaatctgtattttagcaagctctcaacgtgatttgaagtcatgcttaggtttaagaaccactattgtaagataaaacaattttccttgtgttccaactgaggcacctaggataggaacttgtcgcattttttttccccttgcattttacttagggccataaaaagtaaccaacacattttaccacctgatattccttattccctcctcactgatcaaaggcagtacctagaaagccctttaaagacttgccatttttgggcttagagtctgagtctcaaaaacctgtaagccatagtttaattagctccttcactcttgcatataacagtttatttgtatttcactcccagatgtggggggatgtctagagtcgtctattgtgctgtacgccagaaccaattccgcacaccagacattctctccaagggtccattctttacaacatcagtcctgttaccaatttctatcctagtcatgtacagttggttgcatggaataaagatctacttgagtaaggtcagataaagggatgagggatattgtggacagaaacacatggaattacatggtaatctaggaataaaagcaatgctgtgttatggttatgtgcacagtcactggaaccaggtcaattgggaccaaagctaccagttaccagttgtgggactgtagacaaattattcaacctttctgtgcctcagtttcttatctataaatagtgatcctcttggtttcataggattattgtctggattcacgagttaataagtatagaatgaatactactaactacttaactcatagtaaatgttatgtctgtgtttactatcatcaccatcattactactaatagtgttaggacgggctccttgatatgcagttggaaggtggttccacattcaaggcagcttaaaggagctcagtcagcatcagcaaatgatggatgctccttccttagtctccctgttaacatgacttagcctggctgctttgcaccatcctcctaccaaataacctcctctgcttcctcaaacatctactccctcccacctgagtatgcctcaggcctgccttgatccccactgtctatctttttttttttttttcttgaaacagggtctcattctgttgcccaggctagagtgcagtggcacaatctcggctcactgcaactacctcctcctggattcaagcgattctcctgcctcagcctcctgagtagctgggaccacaggcgggtgctatcacgcccagctaattggaataaaatcatttcttaaacaatatggttcctggaggagagacactggaaactttctttcttttttttttttttttttaaacagagtctcaccctgtcacctagactggagtgcagtggcatgatcatagcttattgcggcctcaaactcttgggttcaagtgatcctcccacctcagcttcccaagtagctgggactacaggcacacaccaccatgccaggctgattttttttatttttatttttggtaaagatgaggtcttgctatgttgcccatgctggtctcaatctcctgagctaaagcagtccttccgaagtgctaagattataggcataagccagcacacttgcctcccactgtacatcttaacagcctgtcaccttcggctttggctactaactggcaatgactttctgtattatttagtccaagttgccaggagagagatagagttgagtccagttcatctttcccaccagatgatgagcccgagttcagtgtagggatttgtaacccttggggcaggtgctggcccctggtccgactagaagaggatcaaacatgcaattgtccccagcaggtgctgcaggtggattcccttagaacaggatggcggaagagccacaccaagaccaacatcttgattacagtagcatacagtagtgtcaaatctgcctcccttaaagttttttgatgaccactcccttccccaaacatgcattggcacacagatgatgaagactgggaaaccccaaagtcgacttgggaacagtgtgtggccagcatgggtctaacctgttcatcaaagtggggccatggaatggtaggttttcttattatgttttttatgaaatgtgcttatcatttttcttagttttaattttctatcttgatgaaatgctaatttttacatgatcacaaaaacaaatagaactgtgacattcatttttcagtttcagtagctgattttcatgttggttggattgtctgttcaatagctacacatagtgctttccttagagaagttactagggggatgtggccctatttccatcccaccaccctggtcaatgctgttatgcaggggtcagcaaactctttctgtaaagggccagatcatcaatattttcggctttgcaggctgcatacagtctctatcacaactgctcaattctgctgctgtagtgtgaacacagccatggacaatacataaatgagcaggtagggctgtgttccattaaaatgttatggacaccgaaatgtgaattccctgtaattttcacttgtcatgagttattctttttttgattcttttcaaccattttaaaatgcaaaagctattcttagctcatgggccgtttgaaaaacaggcaacaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggcagagaagggagttctagagagaaggcacagcttgtgcacaagcaggaagttgagtaagcctgggagccacaagcagctcaccaggctgcggaatgtccagaaacgagtgtgcaggtccagatggtgaagggcttaatgagacgggcaaaggtggttggattttatcctgatggttggtcctctagactttccaaaccttgcctttaaaataaattatcaatcggaagctccctatgagaaaaaggttagaaaattatcattaggcagggagcagatggcgcatgcccataatcccagcaccttgggtggccaagacgggtggatcacttgagcccaggagttttaagactagcctgggcaacgtagcaagaccccatctctacaaaaataaaaataaaaatcttagccaggtgtagtggcacatatttgtagtccaactgcttgggagtctgagacagggagatcgcttgagcccgggagttaaaatccagcctgaacaacgtaacacgaccctgtctcttgagaaaaattatcattgacttggttctttttgtaagaccaattaccaagcgctgggaacatgggaggaagcaggggttgggagtttccggagccctacaacttgccacaccccatccgggcctgtccctgaggcatctccaaggaacttctagagcagggtgtgaaaaccatggctaaggttgatggagtaaaacagcgggattataaacagacacaatctgaatgtgttctagaaagattactcagaagataaagtggctgcaataaggttggaggcaaagcaccttattagaaggactatcatttgttcgaatactttcttgagctcctattatgtgccaagcaatgtgtggagacatttatatcatggtaaatagggtagacaataaacatttggcaaattaatagttacttttacattaagatgatagctaaaatttacagctcacctactgtatatcattattctaagcactttaccaatattaactcatctaatcctcactgcaactttacaaaatgggctgtattattactaccattttaaagatgaagaaacggaggcacttcactaaacaggtaatgtagcagaggcatttgggggttgcaggtgttggggtaagttctctttaaggaggccgaattgacaccaggaagataagaaaggccggttgcaggtttcccttgcagatctgggaagagcagtgctggcagactggagggcatgtgcaagaactcaaagatggaacatcctggtcttggtggttgtggagagcaaaatgctagtgtggttgaggctagggaggtagaggagagagtatgaggggaggaggctggagaaggaagcagcaggcccagcctgcaggcctccttggcaatgggaaggagattagattttcttctccgagcacaggagagcctttgaagggaagtgaaatgattggatttgaattcctaaataacggctgccctgtggggaatggatgagagattggccacagcggaagaaggaaaacctgcaggaggctcttgcagtagtccagacaagaaataatgtcaccttggccacgagcagtggtgacaaatatggagagaaacagatggattttgtttattgcaatcattcaactgagggacgttgaagagctgaactgaggttgcagcaatgaggatggagaggaggggtgaagtgaaataggtttttaagacgtggaggaccaattagaggatgagtttaatttttgttgatttttagatgccttgggacatacaggaagacaggaagagttgctaagtagggagttggcaatgaagttaggagttggggatccactctataaaccttagagtgtgccaggccctgtgtcaggccccacacatccctgtttgggctatatgtgcactgaggggagtagccaggtctggctcatctttctttcccaggcatctatcaggttggctaacacatggtgagtgagccctcagtaagtgtttctagaactggaaaaaaggtactcttcatctggtggagaagatagtgattatagcatggtgagatgagtgcgtccaagaggagttgacactggggctctgttttgaggaaaagtaaaagctgggcagcaacagggaagtgtatttccttttgactcccttcccaattagccaggattccttgtcatcccctgtctccccgcaacctgactgaggaagcgtgttacctaacacaccagctgttcctgatcatcgccccttggtcttctcctgaggctcctttctctatcattgaccccttttaaaaattggattccgagtgcaaagccttgcttctctgaggcaatagaggggggaatagcctagagcagctggtggctgtaggtgtaacctagtgtcagcccccgcacttagcaatatgtttcttcataaccctgcagagctcttgtgctgtagacctctaatgcagcctgtagaccccctgacagaataatgttttttaatgcatgaaatgaaaacattggattgcaaaatagatgtaatatattaatatatcgatctatcaaaatgttttttcaattaaaggtatagtaatgtatcttaacacattcaatagcaagatatagaggcagtaactaccataatttcaaagtagagatgagcataaatgatactttgagatatctgcaacaactatcaaataatatgaaaatatctgatttcttttggtgacaaagtcacaggttcagtaaatactgctgtggcctgaatccatgattaaaggaaatgctaagttccagttagagctccctggaataaagatttttttttttcatccagtttcatggattccctgaattctgttcatgaactgtggatatcagtggagccccactctaaccattcatttcagttaccaagtgtttcagaaaccaatgacatgaaatgcaaagtttagcattttatttcaaaactcatttgactggtttattttgacaatagggagtttgttcccatctgtattttacagatcaagtacttggtcaacagcaagtgctccataaataataggtggatgagtggatgggtgggtggatgagtggatgggtgggtagagaaagctcagaaaggataaatgactgtctaaacacttacagctcataagtaatagagtttgaacttgaaaccacatattttttactctaaatcacttgttctttctattcttccatgctaccatcagctacttttatttgaaaggacacaatgatagggcatgttcttaaaaatatgcatttgaatcatgggaaaggacaatcctattattatttgctttggtcagagcacacctaaagtactgtgtttacttcttagaagcacattttaagtacactgaatctgttgactgttcatggactgagatggcgagagacttagaaattgtctcttacaagctatcaatgagctatggatgtgaaattcagagaaggccagtttacatggtaatgggaggtctggggtggttttctattgctccccaaggcagaaccaaggcccagtatttacaagggacgaatcttggctcaattaaagaactcagtaatgattaggcctacttatcaatgtatcataattgcctgatgagatattgactgaaagtattcaaacattgacccatgtatttatttatccctttgataagcatttattgacaacctactccatgccagatgctgaggtggatgctgcattcgaagtgtagaatacaatactattggagatagtcagtcttataaagatggagtctactgggagacagtaagtttttaaaaacaatagttataataagtattttgaaggaaataaatggagtgctgtgattcagaataaaaactgaggtaggaacgggaagagctatggtcatgtgtccacgagtaggtgacattcaacttgaaacctgacagattgaaaagagccagcctacaagggagtgaaggggggtggggctagaagaagtagcaagtgcaaaggccctgaggcagaaagatggtaatgtgtccagagtctgaaagaaagtgactggacttggggagcagaagcagagtgcaggaggagaagaatggcaaggaatgggtgtgaagacgtcatcagggatcagctcagggagagtctggggaggcatatggattcaattctcagcattgtgatgggaagccattggagaattttagtcaagggagtaacaggacctgtttcatgttttaaaagatcactttggctactggacagagaataaattgaaagttaaaagggagacaccaagagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagggaagaaaagtctagataaccatttgtcagcacctctgaaaccatgtcacagatttcagtggttcttaacaggggataatgacatttacttaggggatgttgagaaatgttggggagagactttcacagtagtcaacataatagagggcactgctttgtggacaggagtcaggaatgctagaagtcccgcatcacacaggacagctcccataatgaggagccatcccatgtagaatgccagttgtttcctcctggacaagcactggtggactgagtctctttcaattctgagaacctagggccaggtgcggtggctcacacctgtaatgccagcactttgggaagctaaggtgggcggatcatgaggtcaggagttcaagaccagcctagccaacatagtgaaaccccatctctactaaaaatacaataattagccaggcatggtggcaggcacctgtagctactccggaggctgaggcaggagaatcgcttgaacccgggagtcagaggttgccgtgagccgagatcgtgccactacactccagcctgggcgacacagtgagactctgtctcaaaataataataataaaaaaaagaatctaggaaaatgcagtttcacgctatctgccattcatatacttttgtaaattatttgagtcaggtcgtctttttataagtaattgactgaaattagccatagggaggagaaggaggttgtgggggtggggaagggacataaagcgggaagaaggaaggatgaatcttggagagtgggactttgctggtgggttggcctgggtggctgggaacactggggcccgtcgagggaggggagagggtagaaggaggtgaaatacaagcttcaccaccttgcatgcttcccacggctgtgctgcacaccagtgatgttttctggtctagaggctgcccagctgtgtccctaagcacactttgaacctctccttttggtcatttgagtccccagtgtaaattcttccttcagacgatcagagagctgccataacttagtcagatcccggtcaacactgtatacactagaatggagaaaagcaacccgagccttcctagctaataaaatcactgtccgacttgggcaaatagttgtcctttccatctccttagctgaataaaagtaatctaattattttcaaacacatgatttcatctggacctcacaacaacactgagaggcagggcatgtggtattattaggtccattttacagatacagtcactgaggttcaggagacttaacttgctggaatcaagcagtctataaggcacagagcaggggccagaacttgggtgcagggctccttcaggggtttcctaatggcaagtgggccccttgggaagtaacagaaaatgatgaaactgcttcaaaacaaagggatcccaaagggaacagaatataaaattaactgcccaagaaaggcattttgtcatgtacaagaaattgataggtacccagttggtatttcctcccacctggtaaggtaaaatcaacatacaggaatccttttagcaccttgggggtaaaacacttgactcttgcttggtgctcaacattggaggccccagttttgtgcccattccctcccgatgatgccgcaaaagctggagcatggctgtgagcaccctgcctcgatgagccgggccatctttcacatggtaggggcagggccaagctgtggctcagctctagagggtgcctttcacaccctggaatgcatgactggcaccccctgcagttgtgcagggcacaatgggagagtatttattgtccatgaaaaatcatatgaagcagctgcaaagaagtctaattgttttcctcatgatatgcccatgactccctgcacacacacacacacacacacacacacacacacacacacacacacgtacacacacaaacacacacacacctcaggagctttggtcccagtttgctatatcaggcccaaagctctttctctctttcagcccaaacatcgcttgagccaaggtagctttctcctccaactgagaaaagtttccctcttagagccggcaaacgtgtaggcgtgacgttatgcttagacacggcaggaaggagaagcagagtgacaactctgagggaaccaagaaagcccaaaggggagacaaggtttagagcgaaatcaagatcggattttgtcatgaaaggcagaactggcaaaagcatcattacaaggcattaaccttgttacacacagacgaacaagcagaggctgggattcagaaataaattacacataataaactagacagaataggctgagagcaacattagcgattatgccctaaggggagagaagggcaagatagaaaataggcccgaaaaaaagagagaaagaataatctctggacacagggggctgactgcactgtttcccccttcttctgcctggctccctgggtattaacctcacttttgtgaggacgtttctccggagcctgtctttcttttgttttcatttgctgcaataagcataagaaagccattcaaagggttccttttcccattcacagggacctgtccatttctgtgtgtttccagcacaaaagaatccatttccattcagccagagcagcccctagagttttcatgaggtccaagcctcctctcctgttttcttccaggctcgctgttgtaataggctgcaaaatcctgactgtggccagggtcctccaggctggtgagaggaacaagcatttgtccacgtcctggtccctgcagctggggaagaactgcagtttagtgtccgctccaacaagttgtgattgtcatttcttaaacagtgacttccttttggttccaagtagcagaaaacgcaaccaacagtggcttaaaccatgacaactattgttaacttagtaaaatgtttaaaagttgaaggtctgcggctcagtggtgtctccaggaacatagaatctcttttctttcccctgcaccaatcttagcatgttgctttgtatccttcatcttgaatctcatggaaacagaacggttgccacgagtctatgcatgatgagatcacacaactgtattccagaggaggaagtgagggaagagggcaaacgggttctcctcaagaggcttctgttatcaatgaggaaacttattcccagaaatccttccagtggacttctcacatctccctgcccaggactgggccacatgaccaccctcagctctaagggttaggaaagccagtgtctggcaatagggaatggagctgccatttggcttggcccaacgatagcttccaccaggcttgggttcattgctgtctgaacaaaattagggttcttcttggcaaagagaaaataactgccatgggtgtggcagtaacttgtgtttttaaatgaagtaatgatagcaagcatgggttatgtgttgctatgtgccaaacctgttctaagctttactgaggcttacgcacaaactcacccagtcctcataaaaagtctgtggcataaaaagtctgtgctcttatcatcatttccatcatatggaggagaaaactgagtcacagagagattaaatcacatttacaaaattacttagctagaaagtgacagagccaggagtcaaacttaggtggtctggctggctctctatgctatactgccttcattaggtaagatgataaaatacttcaggtagcacacagtaagtattagtacatgttagctggtattattattattattattattattattattattattattattactatcatcatctcttttttgtaaccaccctgccaatcagacacatcagccttattagatactagaaagctaacccctaacagcattaaattaattgcccaggtcacacagtgagtgagaaccaagctcaaatgtaaacgagtgctgggtgttctctcaagtttgagaatgttgatttaatggctgcaccacttacccatgctacttttttttttttaaggtaaggtctcactttgttgtccaggctggagtgcagtggctcaatcatagctcactgtaacctggaactcctggactcaagtgatccacctgtctcagcctcctaaataggtgggacaacaggtgtgtgccacacatctggctgattttttatctctgtagagatgggggtcttgctatgttgcccaggctggtctccaactcttggcctcaagcgatcctctcgcctcagttacctatactactgatcccggacttactttgaaaaaaaaactacaattgttgaggacagccagaaatcagagaaggacaccgggaaaggtgagatggtaatttgggacggatttttccttgttccgttttagcttttgagctgcctctgttttcttggatccagtcttttgcaaacaggatctctcatcccacctcaggaaaggctacccatggttcttggtgaattagaacaggtacagtattaagcacctactgtataccagacctggctgtacactgtcccacctggtccttgtggataatctacagtccacatccattactttttctgtgttgtgagatgaagggaatggagtcctctagccagagatagtggtattagaacattctggatacccaggcagagacgatgccctattctccgcgttagcctctctgcagtgttcaaatatttaataaaaataacaggcatggtcagctgatcttacgtttgaacaattctggatttattttaaagcaagatgtgtggcatggttttacttatttttttaatcctaaaggtcatccgacttttctttttctgctcatagtcatgaggcttccttatctaaacagtgatctattgttccaaccttagacccacagagaatttttttccttaacttcaattttcacaggacagctcctcatcttcccatattgcatgaaaagtatctttcaacaagggaaaaagaaactctaatgagctttccctaaatcttcttaaaccgagttcactatagaatattttatgcaaaaacattgccttctcttaggttatgacatcttttccttgaaaagtgatcagggcattggacaaatcctggctagcttatcttgtccttgcagcgcaacctcaacaaagaaatatagatggcactttaaaggcttcagaaatcaatttagtcccataatccatttagtttagatgttaatgaaacttggtgggtttaaaaataatgaatatttaataagacataaattgaaagacataaacactgttggcgataatataatgaagttaataagtcttagcctccccctccccaaatagggcgattttaggagttgctgtgttgcttactgaagtttgctggctgcaacttcaatgtgcctttaaaaaccttagtacagttgggaactgagctctggcagataaagtgtgctatcacactgtgttcagtagctgcagacggcaacggctcttcctagctccatatcttccagagatttgtgtaacaaactcagtttcctgtcgttgaaggcaggatgcagcacgaagcacttcattccttttaaacaaaaaagaaaaagacattttggtcgacactctctctgctctgggtttaaagaggggctttatttaatgatcaggaccaagcgtgtgattacatgtgctcagagcctcagacaatttaaatgccttcaggttgggagttagactttttgttttcccctttaaaagcatcagcaccagggccagcccttcaacttggttcctccttagctctgtggctcgatcctacccatcgtccacaactgtatctttaccttttcaccccctcaactagctaccctgtctttaggcttcctgtggtcccttttggtaaatctagaatccctcctttctgccatcacacccaacaggatcgtccgtgtcacatcttgggaaatgtttgtgtttaacctcacagaagccaacgcctagctaaaatgaattggcggcaggattttgaaaacagccaagtataagatagtctgcctcccaattcagcggtgggctgtctcttggcactaaagtggaattcagcttcttatatcagctgaggggtgttagatagatggccagctcgctttggcactcaatacctgttcatacatagtaaacaggggttttctttggttgggcaggtatggtgattttgcaaggtaatgaaaggttgctcccggggaatctagtctaagagaatatatgtggggcccagaagtgagatcctgcctaggagggcatgagtgacatttcatcagtataatgagaactattgttgttaaaaattattattatttttttgtgcgtttgtgtgcatgttcagaaagaaggggatcaacctgaaagagtccaaccaatcgcatcatctaccttgatccattccgacctgacatccgtttatggcaccgtggtaatgaacaggactgttttattcttggggactggagatggccagttacttaaggttggttttctgtgccttcttcaaatgtctattttaatggtgatattttgtactttaaaaaaacatttttttaatgcttctgggttatacatgagaccaaaccaagaacttcatgaactccttaaagacccccagaaatggcctggaagaaaatctggaattctgtatgtaagaatgccccgtagccatgtaatgaagtatcagctaccttgctgcccaggagtgcaccaagatgtttttccttccttactcataagccagctgggtgaggtaaatggaggtctggtccctaccccaaccctgactcaccttcccaagacatgtaaccttttagttctagctcctttatcatggaaatgtacaaagcacctgatttctcacaacttgaaagagatgagagattatagggcttgaaaagaagaaaaaacaggtgttctttccctccagcccacttaccacccacagagggggtttgttttttgccctttgtacccacacacaccacagagaggttagagatctaaaatcctttgagactcctcttgacttttatctcagaggactatttcttctccactgtgtggacacaccccggtcaagtgcaggtttttattcacttaggagaggggaagaggggaggaggagaaaataaaatcagagataccaaatgacttgtctgaagttatctagcgttcatcttatcaatgtcatcagcaagcatttattgaagaccttctgtggtctccaacaacattcctggtcaggaactgcaccatttctatgactaaagactgagattccttggcttctctgcagccatccatttactctcagctcagatttttaatcgagtaatggtagatctgtttccctcaactgatctcccacagataactcgctgtgtgactttaggtgaattgcttaacctctctgagccttcatttccttaccagtaaaatacagttctactagacaacccagaaaaacgctttcctcttctgaaagtctctaattctgtcttctgcacacgtattccccaccatccccatccccaagccaaacctatttacttgctcctgtttgatcctgtttccaaatatgatcctgtttccacacttgctcacactgtacctccagcctgaaatgcttttttcttttttctcttatttacggcaccttatgtgtctatgctgtggctcagctcaaaccccacctcctctttgatgacatctaggcctggagtgaccttgctctcctctcatttcctgaaatactcatgatctatgtcattcttgtggctcattccaaatgtcttgcctggagacctcaccttttcactggtgtctgtcttgccttcccaacttgattttaagcctcatgagaagggggccatgaattcccacagcctaatacagtgctgagtgcctggtaggcatttgatttaatctgttttctttggaggaaacccagtaacatatgggagggagtttgtttgtatacacattcttttaaaatatacattgatcatctttcctgttgtgttagctttatttcctggggaagggtaaatacccatccatcattctacacaagtcactgggtgacgtctgtagctccaccaacctggtcaggcttattggacccatttgcctggcgggagtttccatcaagcctttctgggcctcctcaccaattatctcttcagatttgggatgtttttgatgagtgttttgacaagaacactgtttccccaaagccgagccaaccaaaccgctacatggtgaattggaggtgaaggaacactcgtctataaatagttccccatgggatggcctggttttgcctgtcctgtgtgttcacccagcagcctgcatgccgctggccagcttttagcgatgttgtggcaaccagggagtggaccaagctgcagcttcatgctgctgaggaggccgcagccgaccgaagtctcgctctcctcaggatctgtatggggtacccattcagaagccacctgtgtggcctcgttgtttttttcaaggtttgaataacaaaggcagctttttgttgtttgttttgtgactgctaacatttacacagtgcttcctagatgccaagggactctatatcttctaccgaattcagtcctctccatgacacaatggggcaggcctactattcccattttacagatgagggaatcgaggcccagagaaatgggatgattgttgttcaaggtcacacaggggcagagcagggatttgaacctggaatgacttcagagactgcactaagatcccctatgctgcactgactttgcaacctctgccgcacacattggtactactctctgaggattccgggggcacatgggagacatgcagatagggttccatgccgtggctggggacacatgctcctggggtgagtcagccttcctagaggctcaggaaagagtcccagcttgagaataaggcggaccatctgactgaggaaatacctcactggcgtggtaacttcttgggaattaacacccaccccccaagcccccaataagagagaagttctctcactcaggagaagggtgtgagggatgaacttgagctgacttgccccaccaggctccctagggcagctcagtaatgcccaagcctctcccctgtatcctgtgtacagattcttggatgtagcccctgaatttacccagaatcctgaagacccaggatcgtgtggatgatttggaaactaccgataatcctcaaatccctttattcagaagctttcagcttctcccttgccaaggcttgtcaccagaactgttagaaaggatgaacactgatagacacaagcttggctccttaagccacagcgtgggggaactaatgagcggcaaaaaacaaaactcaacccaacgcagacagtaggaggaggagaagaaagagggcttggatcagccacagcctgactcatcagtttctgagtgatcatgagttgacggcattttgacatgtgccaggcactgttgtgtataccttgttgaatgagagtcaggaaacagcaattggggcccaactgctgttttttaccaccaccagtaaaaacctgacttcttaaatctctgcaaatcctgtgagttttaatataatttggtgcaattttaagcctcatgttatttaaataatttttccttattgtaaaggtaatatatgctcatgtaaaaagttgcagagtcgtcgggggtgagaggacaacaaagaaaaaattacccctaatcatgtcatgcagaagcaactgctgtcagcattttggattctctatttatgtagttgaggtcaggttttgcatccttttcttcagttagtgagggaaaatgcttacattaaaatgttattgcaaaccctttgtaaaaagtatttttaaataactatatcatattctattatttgggtacattattttgaacttaagctaagatactggatcacttttaaagtatctttaaagacatgcattttccaaggaagacggcattacctccaaaggtaagatttcactgataatctgtgaagaaactaaaggctacagtatgccagtacctttactgtcctccttctcttgcctatagacctaagtccctttataagattttggggaaatagaaggaatttagagctcaaagggtcctttgagagcatctaatctgctcttttattttatcggtgtaccgtcccatggtcgtgaggtgagttatgtctagtcacccccgcagttatttccccatcctgcttcttttcggaacatgattgcatgccgggtttttttcagtcgtcagcatctccactgagatcagctgaaaagtatggtcacactgaactcagctttggggaattcacactgcacgtgttgcacaatgtatgcatttctgtaaacacacaccgagtctttctccagattatagtacagcctatcatgtggtttggattcctttgagctgactctgttgcccatagaaaattgtccttatttcaaaggcagaattgcatattttgagcttttccaggtggtaaagtaagtaataacagaatatgcatgaaatttgaaatttgtaactttatgcatgcccattaaccttcgtgtaagcataaaagataagaaggcaatgggcaaggaagaataatcgctaacatttctgagctcttcctgtgtgctgggcattagaaccagcatctgcacgggttaactggtttaatccttaccagtcaatactctcaccatccccactttataaatgaaaaaacctgaggcctcgagaggttaggtatctttttcaaggtgctctgaaccaaaataatctgtcccagagcccgagcttctatcccccaactaaactgcattaactcttacagagcttagtagagtttgagagctggtttttgttatatttctttctaatactggggtataagggttgataccaagatgcagatgtttgaggtttcataagaaggggccgagaaccctgtggtttagtttgttcctatttggggatggcttcctggcaacccagctgagtgcagagcccgctcctctctgagctgcgcgtagtccacgggggtctctgaatctcctttggggccccagctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggctcagactggttacctatgtggccctctactcccacttaatggctttcttttgtttatttttttttcttttttgagccaaggtctggctctgttgcccaggctggagtgcagtggtgcagtctcggctcactacaacctctgtctcccaggcttaagcgatcctcccacctcagcctcttgagtagctgggactacagacctgtgcccccacacctggctaatttttttgtatggacagggttttgccatgttgcccaggctggtctcaaactcctaggctcaagagatcctcccacctcggccttccaaagagctgggattacaggcatgagccactgcacacggcgccactcagggatttcgtttattcaaatcacagcaaaattaaaccggttccaaaaagttctgtctgaattcaaacagaagcaaaaactctgtactgcctaaagagtctgccttgactctggttattgaagtttttgaatgaatgtcagagaaaaaaatcttttgtaaaggcaagctgtactatatacccagaagatgttcaaataaggaataggagaacttggggaacctagaacaggacctgggaccggaagtggtggtggtggtggggatgactgagctaacagaccaaaaagttaaaacaggaggaagtgtcaaaacttggaagtgggttcattggttggctgtttaggatgtcatgtgaagcctgcttcaagttctccccacctcattaattgcaatttatgagtttgcagggactccccagtttgaaacttttagtcccatataatccacaaatctagaacctgtggttcagactgtatgcttctcttactacctacactgcaataagtagattggaaacaaaagagaaatttgccttgatctttatatttcatctttgttactcctaactactgaggcacattaaatacttaccttgctttctcctgtgtgtgcatgtgtgtgtgtgtgcacgcatgcacaggcatgcacgtgtgtgtatatgtatgcaggcatgcacgtgcatatgtgtgtgtgagcttgtgtgtgtgtatgtgtggtttaagtctccttcccagcatttctcagaaactgcttatggaaaaaaataataataaatgaaagggttggcttgtttgcccttcaactggttagccccacagagtgaggcataggaaattaaatttggcataaaatattatagctttttgaacacccgtggcttttccatctcatggtaatcgtaaagaaaaaaaaatagttttttgtttaatttttctcccccctcattttcctcaccatgatatccttcctgtgggtgatcttgaacctgtcttacaattgtatggtgttgaaatctccactcagttaatttcagcagtgtagttgggagttttatatgcaacaaaaatcccaaggctcgttaatagtctaccatgaggcttcaggaagacatcaacagaaacaatatgttgacacgaactgaaattctccatcagagaaaatttgttttctacacaggcttcagctggaaaaagctgaagagccctataaaatcttgaatgctaatagcgtcgtttttcatttaataaatatctactgggcaccttgtatgtgccaggcactgttctgggtgctgaatatacaaaggtgaacaaaacagacaatgcccttgctctgctggtgggaagaaaaagacagaaaacaagtaaatggattaatcagcgataaagacacttcagatagtgctatgaagaaaatacagtgatgggtagagagtgacagaggtgttcagcggagaagtgatcagggaaggcttctcagaggaggtgatgttggagacttgaaagataaaggagtatacaagcatacacatggagaaggttcagattgacttcagattagatctatattaaggtcgtatcctggaagataaaaatccacatcgtgcccaaggattgtgtgtgtgaattggatgagatttctcttatgcaaaattcaacccgttttgggtttttgtgactcattgttacttcctgcattgcttcactgatcatgttctttttccgaggctgcccacctaaactgagctgaggaaggaacgtttcccttgctccagtcttgctggcttttgtctgtgtgttgatattctcctgaagtttgcaattagaaagtccaagtgttccattagtgcctgtgggctggggctcgggctaggtgagagatgatatgaacactgacctgtcctttagtcatctgagagagatgagactccaggggccacggaagcagaaatccctcacccctctgtgtagcacatttgggacctttgtggtgaaaactaaaacttcctcttgtcctgtcctcaggattatggagagcattgtttgcataatctagcaaaaagaaaaacaatttgactcactcaccctcaaggatttttaaatttaaatgttatatatttatttttaaggtaatacaatgatattgtttaaaactcaaaagaaccaagaaaatattccgtgaaaggcacctggtcttgacttccaaggcaaccaatgatagtagtttcatgggtatctttccagagatagtttatatctgtctacaggcaaaagagtgaagatattcttcctcccttttgttgaaacataaaacacagtaaacatatatgttatatatgtaaaaatacctgtatatgtaaatatgtctatatttatagatatatgtacatatttcatataactttaaatataacacaaagagctttctaattatttttatagctaaatagtatttccttgtttgtactatagtttacttaaccagttccctattgctggagatttaagttgttttaatcttttctttataacatacaatgctacaatgaatatatgtcatttcatatatatgtgtgtgtgtgtgtgtgtgtgtgtatatatatatgtgtatatatatatgtgtgtgtgtatatatgtgtgtgtgtgtatatatatgtgtgtgtgtgtatatatatatgtatatatatatatacgtatatatatgtatatatatatacgtatatatatatgtgtgtgtatatatatacatatatatatatatatatatatgtatatatatatgaggggctgcagggtccaagggtatgtcctttgtaattttgatagatgatgccaaattaccttctagagaggtctggcttccaccactgaggaaacatactaatttaaacccagcatctatggctatcaggacaagcttcagtgcaagccacgctaagtagctttttcaggaaactgattggtaaatcctgggccacagaactttttgataacttgtaaaaaaagaaagaaagaaaaacaaagaaagaaagagagagagagggagaaagaaagaaagagagagaaagaaaaagaaagagagagaggtaaggaaggaaaggaaaggagaaaggaagggagaggagaggagaggagaaaggaaaggaaaagcttccttgccacaattcagagttctagagagaatattgatgcttcatttccaaggtaccaagtaaataaatcaatgttgcacccaactagatcttgctgaccatctgtatcaatgatgctccaagagtaaataaaataagcccccaataaaaactgcagtgcagctcctaatttacgtaaaatggatgagtggtggtgtaaagtatgtttttactttgttattttaaagcaaaccccacagacatgatgtcgtttcacctcaacatatttcgttatgcatctctcaaaacctacagttgttttcttaaataatagtaaccataatgccatgatcacagctaataaaattatcagtcattctttaggatcacttactatccagtctgtgtaactaagtattcccaattgattcaaaaaggtattttaaatggttttgttcaaattggtatctgcacaaagtcctcaaaccaaatttggttgttctattatctagagcagtctcctcccttacttttattccctgccactgacttaactgaaaaaaccaggtattttgccctatagaatgtctcttatcatgtgtttggctttttgcttccttgtggtgtcatttagcttgttcctctactcctgcttcctagtgctaaatggaagttagtgctaaagacttgactagattcagtttcaactttattggcaagaatacattatgggtggtgctgcccaatgatgcttttgccatgatgaattcctgaagagataccagggcagcagcttctcttctcttgacccttccttgataatatttctatcagtgtttgtttaaaaaaaacaaaaactggcttcctgtttctctttccctatacaactgctttccagaaccagatcaactgaatctgagctgattaatacagctaatgaattagagacggcaaatcctggcaagcccataccttggtcagtgcctgtcccttggctccacttacaggattctgtagagcagtgttggccaagagaactttctgtagtgatagaaatgttctacatctgtactctccagtatggtagccagtcaccttaggtagctagtgaacacttgaaatgttgctagtgtttttaattaaatgtaaatttttaattaaatttaaatagccattatgtggctagcggctgtcatatttgatagtgcagctataaagtcgttttaaaatgacttgagacacacacctttcccacctcccttaggacctaactgcttctgttttaaaaagagcttttaagaagtcatatttcatatgtttggttagtgagattgacttttacaaagctgctgctgaatttgatgagcagtccaagggcttcaagtgagccactatttgcaccaaatccacctgggcttggcccaagcagatgatggaaggaagtcactgatcgcagggcaaagctagactcgggcccaggtcctggaaaggagaagtgaatgcgggaagttgctctgtgcaaaattgataagaagcctttggctaaacagcaaatccctaactgccatcaggatatgtgggaacaggcatattattgattagtagatgtgtgaagtagactttgtccaaaaagaatctcaggtgccaaatttttcttttgaaaccatgcgcccaatgtggctgatgtctacagtggtagagatatgaatacagataatctatctggatgtgttcaaactgacaaaatgttgaacaccttcacttttcaaagtagtgggtacaaattgtgttaggtacaaagaagattaaaggttaggtacaaaggtgattaagacatggtcccaggccaggcacggtggctcacgcctgtaatcccaccactttgggaggcagaggcgagcggatcacctcaggtcaggagttcaagaccagcctggccaacatggtgaaaccccgtctctactaaaaatacaaaaattagctgggtgtggtggcgcatgtctgtagtcccagctattcaggaggctgaggcaagagaatggcttgaacctgggaagcagaggttgcagtgagccaagatcgcaccactgcactccagtctgggcgactgagtaagactccatctcaaaaaaaaaaaaaaaaaaaaatgacatggtccctgcgcaaaaggagcttgcaatctagtaacagattattatctattgactattgattatgtgctaagcatctttcatagttcttatttgatccttacaaaactgtaataaggaaggcactattagccccattttagagatgaggaaattgaggcctagggagattaagttaccagttcaaagtagtgcagctacttaaaggatggaggcaggatgcaaactcaagcttaagccaccattatacttctctagcactataggattcgagtctcccgatggctcttcatacccacacttcaaaccctgccttcttaccatctcctcttgctccttgacccaaagccctgccatggcctcctctctctcatctacagtaaaaggcaggctgtttacacaggcccacaagacccttgattatcattcccctgttatcttactatcttactgttcactcctctacctctctccactgaagccaccctggcctcctcccattttagtttctttgcactgacagggctgcttttaagaacatgtttcattcaagtatgaaaataactcatctcctgcaagtctaaataaatatcaccttttcagtgacacctaccctgaacatatattctcttaacccctgaccccactatattttataatttacttttttcttattaatagtctgctgttactcaccccaccatacacacacaggaatgtaagttctatgaggtcaggagctctcccttccccattttgttcactgccatttttcaaacacccagaacagtgctgggtacataatgggtgttgggtagatgtttgttgactgaagatggatgaagctcaggtgtgtccaatttcaaaaccactgagtactgagtcacacttgcgtatattttatatgtgaacacaaacctacttgtctgtatctgccaagttaatctgggtcacttctaactgtatgatgatcagagtatcctgtgcaaatacatgtgggagctacttcctttaatttccagtctctcttgagacagcactaatgaagctgtcacttgtggcttcctatagggccagacatggtcagaaattgtggtcagccagcttccacatatgaggatactaccccagccctgaagagcggctttttttgtttgttcatttttggtaactttgcctttacaaaagaagaaatattatgcttgttattaccagccttgttgaggactgagatgtgggaggatgattaaggagcatggtaccttaggcagtatttgtagtgagtgaaaaaggatgtagctttatgattaagctacaatttttgccaccctgctattcaaagtgttgaatagaggccggaagtggtggctcacacctgttaccccagcactttgggaggctgaggcgggtggatcacgaggtcaggagatcaaaaccatcctggccaacgtagtgaaaccccatctctactaaaaaaaattagctgggtgtggtgcatctatagtcccagctacttgggaggctgaggcagtggaattgcttgaacctgggaggcggaggttgcagtgagccaagatcatgccaatgcattccagcctggcgacagagcgagattccgtctcaaaaaaaaaaaaaagtattaaatagaaatcatgtttctctttttgaaaaaaaaaaataggttattcttggtgagaatttgacttcaaattgtccagaggttatctatgaaattaaagaagagacacctgttttctacaaactcgttcctgatcctgtgaagaatatctacatttatctaacagctgggaaagaggtaggtagaaatactagttattgcttctgatttatgaataaaaatggtttaattgatgtcattatctagtagcaaagcttttactttgaactacagagtttaagcagtgccccaggctttgaggagacccgcagtggttcacaggcacggaattaaaaaccttactgactgtcagtaagtaagcaagaaatattatctatttagacaattttattattggctatatttccagtgccaagtttttcagaggagggtgtgcttggaaatgggcgcataatcagcaaggtaactgaatttacacatttattgtgtgggcactgaacggttagatgcatttatgaatatacccaatgggactggctttggaatttggggttaatatcaggccacagtctcatacacattcatgaaccaggaaatatatggtactccccctccccctcttcatttatcttgctgttttggcttttcttttgcttctgcttactgaaataaaagtaatatatttttatattttcttcatctttaccaagtgctgtcaccaagggaaggggaaaagaaactaattgttaatgagtctctactatgcattagtcactattctttgcatgatctctgtctaggtgcatagaattgtgtacatatacatacacacaagtgtagaaaacagtgttaatgaaatgtgttactgaccgggcatagtggctcatgcctgtcaccccagcactttgggaggctgaggcaggaggatcacttgaggccaggagtttaaggctgcagtgagccatgatcaaaccactgtaccctagcctgggtgatggagcaagaccctgtctcaaaaaaaaaaaaaaaaaaaaaaaaaaggctgggcatggtggctcacacctataatcctagcactctgggaagccaaggcagggatcacctgagttcagacgttcaagaccagcctgggcaacatgatgaaaccccatctccactaaaaatacaaacaattagctgggcgtggtggtgcatgcctgtaatcccagctacttgggaggctgaagaacaagaatcgcttgaaaccaggaggtggagtttgcagtgagctgacatcacaccactgcaccccagcctgggcaacagagtgagactctgtctcaaaaaagaaaaaaaaaagaaagaagaagaaaaagaaatgtgttattaatttaataaaaataaatgtgttattaatttattttatgtgaagaatctaagacttggagaggttaaataacttgttcaagaatatctgtatctatctatctatctatctatctatctatctatctatctatctatcatctatctatctatctataggttagcctttgcagggctgtgacaaaaactcaaccctgattctaaagcctctgataaatgatattaaatccaaaatttgtgaaaactggacattccctggctcagtggttttgacctatgaccgtttgaacatggaaagtgcaaagaagataattgagacttacataattatataatggatgtaacagatactctcagcccaaccctggttttccattcttttcctttcagtcattctaaggaaaatagcaatgacagcaatctacatgtgctttttgagtcacagataagatgtgcaagcaatttgtagtttctggtattcttataaagacgatactgttctttgcacattgaaaagtcagttatatcaaaatgaccacactgagatggccacatcttcccacagagcttgtaaaccagtccttcaccatatagaatctcctatgccaatttgcttcaccatgcagacactttgtattatgtttcttccctggggatcccatctttgaaagacttttgtctacccaacaaactgcacatattaagtaacagttcccattcccagggtttatttatcaagggcgtctcaaaactgccggtcagagtactgactgtgttcccacatggagctgataaaattccaacccaaagcaaagaaacttgatatcttccttaatccatgcgtgtttttccattcagctgtctgaaatattgcaaatagctcataagcccccattacttccttcatggatagtaatggaaccccagaactcaggaccccaggctgggaaccattatgaaaagccaccagtagttgatgggttcccactttctagaaagcaaaaagttctagcctctgatcattcaaagcctgaagtcctgggaagagtttttgactgggcatcaaagctggttagccctgcattcttcactgaggattactgctagagatcctactgtttgaactctggctgagcaaatataacgcctaaagagacaaagtccaaggaaggctcttggggagataagaacagccaaactaataagctatgggatatccataaaatggtatgatacggggccgctaaaaataatcatatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttctcctgtctcagcctccctagtagctgggactacagtcacacgctaccatgcccggctaatttttgtatttttttttttttaatagagacggggtttcaccatactggtcaggctggtctcaaactcctgacctcaggtgatccacccacctcagcctcccaaagtgctgggattataggcgtgagccacctcgcctggccctctctcatttttttttgaaacagagtctcactgtcgcccaggctggagtgcagtggtgtgatcttggctcactgcaacctccacctcctgagttcaagagattctcctgcctcagcctcctgactagctgggattacagacgcccaccactatgcccagctaaattttgtatttttagtagagacagagttggccagactggtctccaactccaggcctgaagtgatctgtccacctcagcctcccaaagtgctgggattacaggtgtgagccaccacggccagccagtgtcctccctcttatacagagttatatttgtgtgtttaaatagactgagtaatagttctcagagaatgttctggagacccatattccacagaatgctctgagcaaaagtggtcccagaaccagctgttacttactatacccctcctggaatactgtgaggctcagcatagtcaaaggctccgagaagccctgtgctaaggaaacccgttttgctttttcagtctgaggttttatgtttgctggatcatggagcccttttcttgcataatagcagtaaccaatacttattgaacatttagtacctgtcagacaatagttcataataaccccatgaagtcgtgatccattttacagatgaggaaacaaggttagagagattgcatgacacttattaaaatccatcagtgttacagaggcatttgtgaactacaaggaaatacctctattctggttaattccggctcaggatcacgggctgccagctgcatctgtcagcagtgttggggactatgaaatggaagggcgtggttatcctccatgaagtcaacttggaactgaaggatccagctcaggatagtccttgttttcctcacaaaatagagaaaaatagagaggtcccttctagaactccttatttctctaacctgctaaagaagttatttatactatctagcatgtacaacttcctggcataatgagttccacaagttcccttactacctgctgtgtggttttgcctgcagaaagtgctctgtgtgatgctcagttactccctgcctctcaccgccctacttgcaggctctgactggctgcctagatgtctgggtctgcccagctggggtgccctctttgtgggctgctgtttcctgacaatggcaagaggcagctctagggatggggaaatgatttgactactccccctgtttcttttattttcaactccactggaggggtgtgagcaaaacaagccaggagctgaggtgacggcgctgcccctggcaggggtgtgggagggcctcgtccctggtcctcctcgtttccacattgagtgccaaactcctgctgacactcctggggcagagcctttgttattccctaatactcatttccaaaatgccattggccacatatggactgtctctgtatgaaaaccaggcaacctgattccatgatccgtatggaaatcatcattagcagatcggaaacccaactgggtgtcagactcacctgagagagagctcttaaaatacagattcctggccagacacagtggtgcacgcctgcaacctcagcacttttgggaggagtgctttgagcccagaagttcaaaaccagcctgggcaacgtagtgagaccctgtgtctttaagaaaaaaatcttttaaatgaaaaaatacaacttcctaggctctgcccccagacttagcgagagtctctgcggcagaggcctgggaatacgcactgtcaaaagctccccaggtgattgtgatacaatgacttcatgtcctagatcttgagacccactgcccagtgccagtatggaggtgttgagttcaagttgataaataggctctttttggcccttcattagataaggtgttgtagttttcctgctgttgcttataattccatctgaaccattgtcctctttccttttaggtgaggagaattcgtgttgcaaactgcaataaacataaatcctgttcggagtgtttaacagccacagaccctcactgcggttggtgccattcgctacaaaggtatctcctgaattctttctcaccaactcgcatttttgaaaaagtgtcatgcggcagaacacttgttgccctactttaacgatccattccagtgacctgagggaactgatctcttcctcgactaaaatcttgttgtgcaatcctaatgaattctcgaaggtgtttccagcggcgtccgtgctatgcaatcactggacccgggagctccccagtctcggggcgggaggggcaggtgtgcagccttcaggagaacgggagagagcaggcaggtttggcttttactttctccagagttcgccaagactcaagagagaggcaaaagggccccccctccgagaagataaaagaatagagatgtctgaaaatttttcagctgaatccccatcatgtatgtcatgtattctgttcgctccgcagaagcctcgttattgatggcgccgtctcctaatgcgccgcgcagctgtgggcctgatgtacaatctcagtctccgggcagaatctgcccagcctggtctggaatgacgatgctcacgacccatctaggctcaggggcgactcggagcggcttccccgccatggcagtttcctagcgtcgctgggcccggcctggttggattcgccgtcgccatggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggggacagtttgggtttagaaaagagcaggaggaagagaattggtgactgaagggggagacagccaagagaaatgaagggagagggggaaatgcaatacaagcaagaggtttaggaaacaaatcaaaaatacggggatggaattaattaagagttcacgggggaaggcgcaatccgagctgcagcaagaggaataattgcccctgccatttgctacgcttccttaccgggctgtttccgtcagagtcactggcagacaaacgaagcaagggccagaaaaatgctcatgaataattcactgatcacgaacgggatttgtttgttgcacactcagtgagcagtcttgccataatcttttagatccattcatttatgtagcatccctgtctgtatttgtagagctgtgtacaggagtcaattcgataatggtggcgatgatggtggtgattaaatagccacatggagctagcggctaacgtattaacaagctcagctctggagcttttgggagatctccaagctggtgatatgaatttgggagttggtagtattttagatggtacttagagaagccttaagaccagacgaaggagtgagtgttgattgaggagagaagtttgagaactgggccttgaggggctgtggtgtttaggggttggggagaaggaggggaaacagaacaagaaataaggagggagcagtcagaaggggaagaggaaaaactggagagggtggtctcctggaagccaaggaaagaaaggaggaggaagtgatccactgggtcagattcagctgagaggtcaagcaggagaagaaaagaatggatcctttgcacttagcaggtgacaatgggtgactgctgggaatgccatggttaggagtggcgctaaatccacaagagacaatgggaaaataagaccttaagaagggacagcttagagaagctttactgagaaaggcagctgaaaaaaatgaagcagacactgaaagcgaaagtagagtccaaagaattttgtctttttgtcctttttttttttttttttgagatggactctggctttgtctcccaggctggggtgcagtggcatgatcttggctcactgcaacctccacctcccaggttcaagccgattctcctgccgcagcctcccgagtagctgggattaccggtacgtgccaccatgcccgactaatttttgtatttttagtagagatggggtttcaccatgttggccaggttggtctcgaactcctgacctcaggtgatccgcctgcctcagcctcccaaattgccaggattacagccgtgagccaccacgcccagccagttttgtctttttaagatgcatgaaataacagtgcatgtctgcactgttgggaaaattccagaagagaaggagaaatggatgatacaggagagagaagggttgtggagtgttcagtctttcagcaggtggaagaaaatatgacttggtgtgccagtagggaggccagcctcagacaggagcactggcccctcaccctcagtggtaggagggaaggtagggactctgggcccaagcatggggaggtggcagaggcctgtgtggtgtcttctcctattgctcacattattttcagtggcctacggccattgagaatgaggtgagggaggaagcactggaggtttgaggagaaaagagagagaaggagtggactggaagactaggagggagaatagaatagggaaatatcgagcggttgccaggaagcattagggcccacttgaggttgatggtcctgtgtttgaagtgagagctgtaagcatggttttgtctttctcaagctgcgttcagctttggtggtatagctgtagactcagaaaaagttagctttagccagtttgggggctttgccggaaaatacatcaagaaaggagagagtggccagggagctgagggagcatgtaaggaatggatgatgatatcgatatggatgttgattcatataatgatggcacttgggctctaaggagggaaataaggacctgataggggtagggatgtgaaaaggtggcagggtctgtgttggaagttcaagttgagtttaaagattgttaggggcaggcgcggtgactcacacctatattcccagctttttgggaggccaaagtgggtggatcacttgagcccaagagtttgagaccagcctgggcaacatggcaaagaccccatctctacaaaaaatatgaacattagctgagtgtggtggtatgtgcttctggtcccagctactcgggaggttaaggtgggaggcttgcttgagtcccagaggtagaagttgcagtgagctgagatcacacctctactttccagcttggatgacaaagtgagaccctgtctcaaaaaaaaaaaaaattgttggaactagagaattggaaaggggaattattggactgtgggggcttgatattgaggtcatggagggatggagttattggcaatgacagggtctgccatatgattgtcaagatcattggcagagaggtgtcaaggaactgaggtggttaccagagtactaaatggctccatcatctgtgtggaaatcgcagtcaccaagagagtgaggagctacatattcaaggaacgaagggaagtggccagggctggggtggtctgtaatgatcacaatgaggagggacctggggtggtttgagctgacagcatgggctttgaagctggggaggaagtgttggaaagagagaagaaggatcttccagaagaggctgcaagacacaaataggacagctagatgagggagaggaagcagccaggccttgagaggggcctggggaagctgtggcctcgaaggagagctggtttcagtaatattgagaaggggaaaggaacaatcagagaagaggttgaagacatgggggcttctgttgataactggctgtgagttatagtcttttgtttgttttgagacagggtctcatcctgtcacccaggctggagtgcagtggtgcaattacagctcactaaagcctagacctccccaggctcaggtgatccttccactgcagtctcccaagtagtggggaccacaggtgtgcaccaccatgcccaggttttttttgtattttgtagagacggggtttcaccatgttgcccaggctggtcttgaactcctgggctcaagcaatcctccttcctgggcctcccaaagtgttagaattagagacgtgggccaccacacctggccaaaagcctgcttctgctcttgctccctcacccctatcccagtgcgctccaagaagagtgattcatttaaaatccaaatcagattatgtcactccccagcttaataccctcccctggctttccatcttagaactcagtctgactcccttgctgccagggcctgcataccaggctttccgtgatctggcctttcaccacttctctgacctctcatgccattctctcctttgtttacttaaccccagacatcctgatttaagactatgctaagcatgttcctgccccagggcctttgcatgtgctgtttcctcagtctagtacattcttccccacatctttctatggcagactctttcttgacggtctggtcctagagcacacatctctctgcacctgcctacccagtcttcagtagcctccccttactcacagtgacattactgttttattttcttcatggcccatcactattaggaatgaccttacttctctacctctctttattgaaatgtgctcagaaaaacataagttaaatgaatgagataggctgagtgattggtcgactctgccaatagcaggttaagacttgtgccttaaatcttataagacattctgaagtcatggagcgatggcccttcacagccatgtcagaaaccacttggtttcagacagcctgggttctggcctacaatgaaatgaaactaagtctcatatctgtgactcatatgaagctcccagtaccattcaaaattaggaattctaaagggggatgttttcttataatggtagagcatcccactgtgtttattttaaatgtcatggatttatttagaaaaataatttattttctctgttgagaaggttgagttttcttgcatacatgtctagaaagtggaatggtggggagaggcaagaaaactatcttcacttccttttgatcagatgttaagaataggcatccagactgggcatggtggctcacgcctgtaatcccagcactttgggaggctgaggtaggtggatcacctgagatcaagagttcaacaccagcctggccaacatggtgaaaccctgtctctactaaaaatacaaaaattagccaggtgtggtggtgcatgcctgtaatcccagcaacacgggaggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgtgctgaatttgtctgtgtgggtggaaagtgaatttttgcaggctgaatatcttgggtttggaagcagtttctcagtttctcccatattgcaaagcatagcacatgtgttcagttatggatttccacaaaactggcaatcccgaaccaatgaatgggtgaggttccaaaagttcatttgcaagtttgtttggcatgcagaatgcattttcccatagaaacaatgtcataaattaaggattgattcccaagccagcccataaaatccaaaattatttaatttcaacaaatatttattgaacacctagtgagagcctaatctggggcatgagatagctaggtagtattgagagaaatcggatgccattcttggctttaaggaactcgcatgctagctgggaaggcagacttatcaatggccaacattcattcattcaatcctacatccaatcacaaatattttttaagcacaacaatgtgctaagtcctatgctcagtgctcaggatacagttctttcttgtctctatagagcttgcaatctaatgggggatataatgtgtatcagttaggtttctgatctagtaatgctgtataacaaacaacccccaaatccttagtggtctaaaagagcaaacatttatttacatttgtttttcatgctcatgggtcagcctgtcagctatgggaagaagggtggggtcaatgtcaagctgaaggttgagttcaggtctgtttcccatgtttctcattctgtacatgctcttcttaaggcacatagaagtagcatgagagaccaagctaaactagacaacatgttctaagccctggctgacatcatgctgactaatattccattgataaagcaagctgcatggccaagcccaatatccatggagtagggaaatatattccacctactctagtggaagattctgcaaagtgacctggcaaaaatgtagtgtgggtgtgtcattctagtacaggatggattgaagaattgggagcaataatccactcttatcaataagtaaaggagataaatgaatagagtgtcataagagctagcatgggggaagtttagggtttcatgggggcacataaaattatctaacccaaacttaacaggtcaaggaaggcttcctggaggaagggatatctaatctgaacctgaagggtagggggatatcagctaggtaaagatgaggcaggggaagctggtgtagggaccaggctgtacaaaggccaggagagcttggcctgaagctcagtgtggacgagcttcacattaaagaatttgaattttgttggaaggaccttggggagccattgcagggctttaattaaaagtgcgaccagatcaggtgagtgttttagaacgagaactctggggtgcaaggtggaccggaggggactgagaagagctggcagatcagttagcaggtggctgtaaaccagtaagagaccagggactgaattagaatgatagtagtggtgagggaaggaagtgggtggattagagagctatttagaagatagaattgacagggcttagtgattaattagattcccctttgagtctgacacactaaaaatagggccataaaatgaaaaataaaatctcaaggtggccactgtttttctggaagatgtatcctttctcctttgatctcagtcttcatgaagaaaacaaacaagtgatacccacatgtacacttgattcttcctgtgtcccaggcactgggctaggcaccaggttagaccccaaaagatgggcacctgagtcaaatgtgggagggcttctgagagacaccagcgctgagtctcagagtgtgcagtggggtgagttattgcattgaagctggtgttgagattacagcggaaggagtgcaggcatctggctggggtgaccagatggacagaggtgtcggttactgagtagggagtgtagaaggagtggcctgtttgggctgcatgggaaacgcggggggtggacttccacactggcaacatgggcaggacagcctatgaggacagaggaaaggtcctgtgtttgtctgtttttgcactgctataatgaaatacctgagactgggtaatttataaagaaaagaggttagttggctcatggttctgctggctgtacaggaagcacgatactggcatctgctcagcttctggggaggcctcaggaaacttacaatcatggcagaaggtgaagggaaagcagggcacgtcttacatggctggaacaggaggaaaggggggttggggaggtgccacacacttttaaacaaccagatctcaagagaactcaccatcacgaaaacagcactgaggaaatggtgctaaaccattcatgaaggacccacccccatgatccaatcacctttcaccaggccccacctccaacactgaggattacaattgaacatgagatttgggtggagacacagatccaaacgatatcaggtcccaaatgcattttgctttggatagaatctgggctttgtgtgacctgccagtttcttatctctgccacttctcctcttctataaagtggcatttataattggccaggtattgcaaaaaagtgctgggattacaggcacataatcctgggattacaggcactttgggaggccgagttgggtgaatcacttgagcccaggagttcaagaccagcctgggcaacatggtgaaaccctgtctctacaaaaaatacaaaaattagctgggtgtggtggcgcatgcctgtggtcccagctactctggaggctgaggtggaaggatcatttgaacataggaggttgaggcttcagtgagccgtgattgtaccactgcactccagccttggtgacagaacgagaccttgtctcaataataatagtaatagtacctgcctcagaggtttgctgagagaattaaattccataacgtacatcattgtaggcccagtgcctggctcctggtaggcaacgaagttgtgtcaactgtcatttggtggaagcccaaggaggcagtcattacttgtccctgaggttgggaaaggcttcaacgaggaggtggccttaaaattggccttgaagcctgggtagaccttcaccaggggaagagtggtcgggaggcatttcaggcagaagaatcagcgcagtgagaggtctgtggagagactggcagatggagttctatgcactggctgtagaaggaaggaagtgggtggagatgctgggtgggctctcagggtggaccttactagcgggtgctgggaactcatgacagggttttaagcagaggccttccagcgccatatttgtgttttaaaaagattatcccactggcagtgtggaagatgaaccacgttaatccaagtctctcccggcctcccaccccacccttcctgggtcactttcctctggtgtgttttgtaaagagagagtttatgtcacatctcgtcctgagtcagttacttggtggctattctccgaattcatgtacctccccactgggagaggtagtacgtctcccagtgcatccatggggccccacttgctctggttttagtgccatgatggaatcagggctgggtcctcttcagaaaatgggccctacaggaaagagcacacttgcattcaccctcccaacacttcgtgctccaccctgcactgggtacacacaggtggaggcaaggcccccaggcatgctgcttataaggtatctgtatgcgtccttcaattatctgtacaaatttcacattcactccatatttttctacatgtttcttccatgttgacagttggaagaccttcaagcagcccctggtggctgtttttaggtcttcagctgcagttaggctgttccacgcatgagatcgtgaaagagatcatttctcgctcggtctaacagcagggccctgtggtcagtcttcctatcagactttctgaagggttgggaataacagaagggtatttttaacacatgagagaaaactgccatctgaatgctaaacatatttgtccccaacaccccagagtaacaaatgaaaagaattacatgagttgcttgtggacacgtcccagctcctttttttatcttgctctcctgtcttgagggttcttctccaagtgacactccttcctcaagccccccaggcctatcattaacctgctgggatccttcccaccaggactgtgattgccctgaaacttgaccagtataatccatggtgcacagtaatttatggccatattcttcagtagcctgagttagtctgttctgtcatcatgagaggtgagctacatacagcagagagggcccgatagggcttagatgttttgtctcctccaaatctcgtgttgaaatgtgacctccagtactggaggtgggcctgctgggaggggtcgggtcatgggaacggatccctcatgaatggcttggtgctgtccttggcaatagtgagcgagttctcactctgagttcacaggagatctggttgtttaagagagtgtggcacctgccccctcacagtcttgctcccaccctagccgtgtgacacacctgttctcccttcgcttccagcatgattggaagcttcctgagcccctcaccaggagcagacactacccatgcttcctgtacagcctgtaaaatcatgagccaattaaaccccttttctttataaattatccagtctcaggtatttcttcatagctatgcaaaaaatggactaacacagggtcacagaaggctttgcagtagaaaagtccagatggatgtgactgttcctcattcagaaggcggctgcagtgccccttccacagggagcctgcctcgagtccaggcctggccaggagacagtgtgcatgggtagagaagaatatgcttatcatacattagacactaccttgcacgttctgtgccatgttccatttagtcctcctggtaccccatgaagaaagcactattacaatccccacttcttagagaacagccttagcttatgtatagtttcccacagctgcagaaacaaattcccacaaacttggcagcttaaaacaacatgcacttgtgatcttacagttctggaggtcacaagcctgcagtgggtttcactgggctgaaaccaaagcattgacagggctgtgctccttctggaggcccttctttgccttttccagcttttggaagcagccagcattccttggctcatggtcccttcctgcatcttcaaaaccaacagtgtggcatcatcagattacattgggcccacccagataatccaaaataatctgcccattttaagatcctccacttactcacatctgcagagtcccctttgccatgtcctatggtttgaatgtatcccccaaagttcatgtattggacacttaatccccagtgcaacagttttgagaggtggaacctttcggacgtgattaggtcatgaggactctgtcctcatgaatggattaatgacattatcacaggagtgggttagttattgcaggagtgggttacttatcacaggagtaggttcctgataaaatgatacattaggcccctttctctctctctctctctctctctgtctctctctccctcgtgctttcttgcccttccaccatggaatgatgcagcaagaaggccctcaccagatgcaggccccttgaccctggactgcccagtctctagaactgtaaaaaataaatttattttctttataaatttcccagttagtagtattctgtaatagcaacacaaaatggactgagacaccatgtaaggtgacacagtcacacattccagggattaggacctggacatctttgggggccattattctgcctactactggttgtacaagtaatggattcaactctgggcttagctctagctcctaagccattagagcaaaacaaagagacacaggcaagggacattatccctcatggcagtgggtggagaggggagagcctggagcaaatggccctaatggagcatttgtgataactgctatgtataagaaagacacggcactcagggcccacctgagtcagagaaaaccctccatcttgaaagcttaggcaaccatgcattcatttaacaggtatttactgagtacctgatatgtgtcagtcactgtcctaagcactgggattctaagcactagcagtgagtaacacaggtcaaaatccctccacacgtatgttcattgcagcactattcacattagcaaagacatggaatcaacccaaatgcccatccatgatagactggataaagaaaatgtggtacatatgtgccatggaatgaaaaggaatgagcagccatgaaaaggaatgagatcatgtccttttggggatgtggatggagctggaagccattatcctcagcaaactaacgcaggaacagaaaaccaaataccgcatgttctcacttataggtgggaggtgaacaatgagaacacatggacacagggaggggacaacacacataggctcagctaatgcaagctgagcttaatacctagttgatgagttgataggtgcagcaaaccaccctggcacacatttgcctatgtaacaaacctacacatcctgcacatgtaccctggaacttaaaatgaaaataaaaattgaaaaaaaaatccctgccctcatggagttccctctagtgaggtgttttagtttcccaaggctgccataacaaattactaccaacacaaatttatcgtctcccagttctggaggccagaagtctgaaatcaaggtgtcagcagagccgggctccctctggaggctataggggcaaatccttcctcacctctcccagctccgggtgactcctggtgtttcttggcttggggtaggataaccatctctgccttggtcttcacatgaccttcttctgtgtgtccaaatctccctctcctttctcctagaaaattcccattcactgggacaccctaaatccaggatgatttcatctcgacgtccttaactctttacatctacaaagaccctatttctacataaggtcacgttctgaggttctgatgggcacgaatttgggggaacactctttaacgcacaacatgagggaagatggacagtgtgaaaataaatgaggaaagagagaacatgtcacagagtaaacagggctgtgaaggaaaataaagcagaaaaaggaaatggggagcgctagttggaggcagggggcgctaaatttaaacgggagccctggaaggcctcagtgagaaggggcatctgagccaagacccaaagggacccactcagttttggggctatccgccttcatgggctattgcactattgagtggaatggccgacaatttgagacagaagagccttcctcctttccttccaatccgggatgtgtccttgtgcagatctcaagcttgacgtctgtgcggtgacacttctttatggtccagtgaggctctaatgacagcaataatgataatggaattggggatggcccctccttctcgtgtgaggaccccattgtgccgactaattgtgtagaagcaagtaggacaactgtctgtggggtggaagcggtggggagcaaagaggaatatgtcctttgggcctcagggaattactgaattaccgttgtgtgggctgagtccatgcatctgggttactgtgaatgctggaagggatttggggggctttccaacaccagaaggggtctgggggtcaacctgtgtcctgtgggttctctacctcctttttcagctgtgagaggagctatgagttctatgtatttcaaagcagaaggcaaaggggatagcagtgctaaggggcacctctccacccttggtgtcccagacagttggcactgggaaagtgctcgccatgctcagaagccaggcttttttgtttgtttgtttgtttggttggttggtttttttagatggagtctcattctgttgtcaggctggagtgcaatggcacaatctcggctcactgcaacctccacctcccaggtccaaatgattcttctgcctcagcctcctgagaagctgggactgactacaggcgcgtgccaccatgctcgcctaatttttgtatttttagtagagatggggtttcaccatgttggccagtatggtctctatctcttgacctcgtgatccccctaccttggcctcccaaactgctgggattacaggcgtgagccaccatgcccagccaggtttgttttttgtttagtggagctagtaactgacgttctcggacctcagcctccgtgctacttacctgcaccatctctaatggatgctctctgacttccaacaagcaccattaagaacatcccttttagtaaatatatgttgtaatggaatagatttttttgaaatgaccttatctcaggcagcatgcactttcataagaatgtattgattggcctttaaatattcctcaaatgttttcacttgtctctgtgacctaatatttgtcctgttcccagcatctcctccatatccaaacacaatgttcaggtcttcattcgaagccttcctgccagtcttttgttttttgctttttaaacattttgatgcttttattctgctatatggagggtgcactgtttctgataggccaaatgtgggatttgatattgctttcaggaggatcgggttttaatatcattgccacctgtttagtggtggagaaactgaggcccacagaggctaaggaatgtggcccccagttacacagggagtatatgggagagcagctttgaacccagacccttctgactcaagaggtgtcattttcccatttttatttccatgctgctgtttttttaaatggctcccctaaattatttagttcatggtttgcatttggaaataaacaccaacttttagtacactcattgcccacaaaagaaccacatggagcaaaggccacaaacccattttgtgtgagtgtttcagtctgcaaatgtgttttttatgtgctaaatagctcaaagtttcaagacaaaggctgtttttccaccacgccagtgaacaggccaacctagtgaacaaaaatcaatgaaatgacttctgctggtatcactgaaacacagacaagaatttagccattttaaaatttccttgttaatccaattcagctaccttttgttgaatcccagccatgggccaagtcctgtactaggccctgggggaaacaaagatgaatgagggtctactctgatgaagttcacaggtgagtgtgggaataatttcaatacactgtgtaaaatgctctaatagctggtactcaaggtatgaaaggactccaaagaaccctttaatatttaggaggaaacagagctgtgattaagaatcccccaagaagcctcgaattgtgtctgcctccttacatagaaaaggcatgttgggcattgagctggtgtgtgagcaatgccaaagggcatctggtcaacctcattgcccaaatccctttctcatcactaccattttgtctttggcttatgtcatccatttttttgcctaaattttctgttccattttcccatataatataataataataatgaatatttattgaggcataattgtaaactcttagaacagatgtacatttttctcccaacttcatcaggtgaaaactattatttgcatttctgcagatggagagcctgaaacacagagagggcacatgtcttgcttgaggtcaccagcttgcaaatggcacaaccactatcctccttccttcactaagttctagccaagctggtctatttcatcagttccttgcagagaccatgctttaagtgcactcagatactttgcacatgctgttccttctgcctggactgctcttcccactacttttttttttttttttttttttttttttttttttttttgagacagagtcttgctctgtcacccaggctggagtgcagtggcatgatctcgactcactgcaggctctgcctccagttcaagcaattctcgtgcctcagcttcccgagtagctgggattacaggaatgcaccacctcgcccagctaattttttgtatttttattagagacagggtttcaccaggttggccaggatggtcttgagctcctggcctcaagtgatctggcctcccaaagtgctgggattacaggcataagccactagcactggcctcttcctactactcttgacccgactacatggttctcacccttgaatgcttagctgaaatgccatctttcttcactagcctgtctaaagtgggttcctttctactatatctttggtttctgcagaagacgtacctcaatttgaaattattttaaatgattgtctgtttatttggtttttgtctatgtgcttctctggactgtaagctcaataagagaaggaacttaactggcttatccatggaagtgtctgcagttcctagtggagtgtttggcatctgatgggctctcagttaatatttgtagaatgaatgccaggtatggtcttaggccctgagggtgcaaaggtgaataaggtgggcctttccctttgggggatttacagtgtagctggagagacaggcaggcaatcagcaactaatgcagtatgctgtgtagagtaggagcatgtgtaaatgtcatggagacacagaggagggagtgactgctttgcctggagtctgagcaaacatcatagaggaagacactgaaatagcccttgaacaaggaatgtgatttcaccaagtgttgcaggcccaggcacgttcagggcagtgaggatggcacacgctcgggagggcctggcctgtttgccctgtatgtgtttatcaaatgcctgctctccacgaggcactatggaatagataccagggatgggtgtttttaggagcttgcagtctagagagatagactcatcaaccaaacttacctggggatgagtttgaagaggaaggcaggggccagatcacagtgttggggtcagagatgggcatggaaacatgtattgcagactgaggtgctgaaaggcatgtagacaggagagtctggtatgggagaaagggtgtcatgagagatttttaagcagggagtaacatcatcagctctgtgcgtaagagtaacccagatgttgatgtggaggttgatgagaggaacaggaagtgggaagcgggagacctcatttggctgctgcaggaacccaggtgagaggtggggggtaagcatgggttgtagaggatgcttagaattcgtttgggtacaagagttacccaaactagccaaagtaggcacaaagttttgtaatttgatccgccgtgaggattattgctcattaaaccagaccaggtagtggttcccaacatgtgtgactagaatttctcatccctcagaacatccttcaacaaaaaagctggaagatggtacatcattcattcttgtctcagaaagttacaaagcacagtggcatctacaaggctctgagaagtcctgcagcagagagacttgtttaattttatttaactagtgtttcccaagcttcttggcaatagaaccctactttaatattaacaccaaaacaaatccaggaacacagtttgaaaaatgctgagaaattgagtaaaacttgtattttcctatatgttcatgtcttggaagaatctacttgctattatgctggcatttgtgatgtcgctgccctggaagccttcaaaatttttgagcaattaggtgtagtagtaagagatagatgccagtgccagacaccatgctaactaacctctctgcacctccgtttctcaacctctgacatggaggtggtaacaataacacctacttcatgggctggttgtgaggattactgtgttaattcccagaagtccccagaaacagtgcctggcctatgggcactaggaaggtgcgatggtttgaaaatgtcacctaaaaagcgtgtgttgggaatttaatccccaatgcaactctgttgaaaggtgggacctagtgagaggtgtttaggtcatgagggctctgcctttgtgaatggattaatgccaatcatagaagggcttcaggctgcaaattcagtctctttctcttgttcacatgcgcatgccctcgctctctcttgctcttccacctcctgccatgggatgattcagcaataaggccctcgccagatgcaggcccctcgaccttggactctccagcctccagaactgtaaaaaataaatttcttgtctttataaattacccagtctgtggtattctattatagcaacacaaaacagactaagacagatgggctcagtcactattagctattctgagaggcaatataggtagctgatgagaccacaggctttgaggctacactgcctgacttagtaggtcagctcctctgcttactatccctgtgaccttaggaaagcaatatggaaccagctatgcctcagtttcccacatctgtgaagcagggacaattattgcagctacttagaggtttgttgtgaataataaatgaatcaaatcatgtgaaaagacatcgcctggcatgttagatgtttttgcttaaaaaaaatcttttaattgtctctgttattagcataattttatcatgtagactgactttcagcttcagtgatgaagatccaatttttgagctttcccagcaagttattttggtcttatgttttggcattcccctcttaaagagtctggaggcctttcatttgaagtttagtttgtcacagacttcctattctcgtccattcagtagactttggtttcctcatctcatggactggcaattgtaaagaaagtcccccgattctggagaccacctcgcccctccactgggctctgtgccttccctaaaaatgcagacatctgtttcaaatcacttagcaaaagaccttgggttgctcttatagcaaagccctcccccagcatggatgcagtctcttgtttcctgggagagagagaagctggattgtttccttgttaaaagttttctgatattatatcagtgtagaatctttggaacagttcacactaacccccacattcaagccacttacctgatatgtagttatcagattccttcagggactgtctgctcttggtgaacaattagattagaggatgctgatgaaatttgagtggcaggaagtagaagttacatttctgagttcagagtttctatttcaaggttgagtaagtggtaaatttttactgcaagattctagcctaacagagttggcttctcaaggtcccccagcccggcccatgggtatttcacctgcttggaaacttcagctccttttcagaggtgggcctccctgttctttatgttggcatgaaaacaattaataatttaagccatgcccattaaaaaaatagaaatgctgtataaatacaatactgtaataataaatttaaaagtcgatccagctgggcgctgttcccacactaccagctgagcagaaacacaaataagtaaagaagaaaactgctatataatgcaaatggctgcaatctcattgttttctgctattgtttattgcaaatatatagtagtaaagttacattatggataagtaggttttgtgggctaacctggaaacctaatcactgtttataacattatttctatgggggaaaaatgcattttatattagaaacagatggtttgcaagaaaacctttttgggagtagaatggatttctaagtccagggccgcctgaaattttaacctcttgctagttgtgtggttgtgttgtattcacagctagtgatagaggaaaattagaggcctctcagaatgcccacttctgtgttctcccccaaatccttgctaaccgcttcatcctacagtctctgccttaccttctgtcttctctgtttctggggtccccatccctgtgtcctcatcctggcccagctccaccctgcaaccactggttgaggtcccaggaagccaggaggaactatgaatgtcctctattaagtggtggttaggatctataggaaggcatgaagccagggggccaagtttgtgggctctgaaatcagacttctgccacttggcagctatgtggccttgatatgttactgtacttctctgagcttctgtttcatccgtaaagagtgaggttgttgtgagaactaactgcaaacactcccatcagtgcctggcacacagtaatgtttcctccatgccagtctgtggtggggtaattattcagggatattatgggttacacatatttctatgaacccaggaagcaaacccactgtatataaagactttctaagttttcaaacagtgaacttagaaacaagtgtctgggaccttcctgtttatgacttggggccggagtaggtttggaactttttttttttttaaatctgttgggggtgagggagggggcggttacatacttatatagttgaatgccaatatcaaactctagtattatctcgaatacattaagctctacagcagattttatagcaaactaacaagaacagctttcttaaatagtttcattgactgaattgtttctacatacagtgtttttcacataagggaagtctttttaaattaactttttggtttgggggatttttttttttttccttcaggcaatcttttctttgcatttgggcaggttctgtattctaatttgcaaataggcttgtgtctgcctgcaggctttatcatgaaagtattagctctaagtggaaataaggactagaaaaataaaatactgactgggagtctgaggactttgggatagatcctcagtagaggatggagcaaaagtaatagtaagtcaagaaagcaaatatatctctaccagtttccctagaatatgtccattcttatccaaatccaattttcctcctattcttggcctgaagaaattgaaatgaagccattaagatatcagcctatctgagagtgcatcactgaagaatcagcctcactaagagtcctgtgtgacaatgagattttaatttaattagggcagtggctcaagtgtttatgcacttgaccgttgctcttgttgatacgcaggaattagagtgatagctttcaaaaggaattatttcagagtaactagctttgtttactaaaatatgggagctataagatctgctctgtaagaaatgtaaatgtatgagtaatatgctgtcatgaagattttataatctgcagtatttgagaagtaataagatactgttgttggctggccatctggttatacatacttggtgtcatggtttgctttttattttttcattttttatttgtactggtgagaggcaaagaataggagttcagaggtggtgggttgtttttttatatatatataaaaacaaggaatttatgtttagttgcttaacatggttagattttgtttttgccttatgcagaataaaaaatgaaaggttcattttatactttcttttccctttttttttcaaaaagtaaaatggaaacctcacccccaatttgtccccagatttaaactttttgcttgttttaaaaatagtctctttggcatgaggaggagtcagacatgaattaaaactctagaaagaaaaatcagcaacagaaaagacctatagagatttcatatttcatcctttcattcaaaaatatttattgaaaccctagtatttgcatatcatgctgccagacactgagggatttgctaaagaaatattaaagaccttctcccttctttgaggagcttagagcttacttggggagaactgagatagacttatgaaatagttaagttgtaattcgaggcagcatatgattaaataccgaaatatgtacttctgacaagaaatgctataggagttcagaaaagggagtgataactcagtggcactactgttttctgcctacaaattggcaaattgtagcactatttgtatgaaatattttacacttgtttttttggcagccttaggctttgactcccaggcagcattaagagccaacaaaaatatttgtactccagtctcttcggaattggcttatttttttttttcttataggcagaggaagtgccttacacaaaccggagtgcccatgagaggcagggagtttttgacagtcatgatctatttcagatacaaccgaaagaaccagcttcgtcattctgtttttcaatccagcagtgcttgtctctccgttgcaaactctctctgacattgacaggcggtttaatttgaacttaatgtctttgacggatgagctagccatcaagggtcagataaatttatggctttggagaattgccgatgaaaatccccatggttataatgttggagaagaaactgacacagatgtagtgggaggtggaacacagatgtgcttattgggagcagggttccccaaatgtcagaagccggtgacatgctaaaggtattgtgcttggggatgacgtttagtgaaactcactgacttcctgttctatttttgccatattcaaattaacacagagctcaaagatgaagccatgaggcctaaattcttaagaattgaaagagagagagagtagagaaaggagaaaaaataaaacctttaggaagccaaatacactgtttgggcccatccattcctcattccgctcggatcccctccgggactccccgtagctgaatgtggtcatcatttggttgcttttcaatctcatgattcatgtgttttcagtttcttttaaaaattcaccatcactggtttaccacccctgcattttaatcttcagccttgaggaggtgtagtactagaaatatttcgttctttccttgatgctattcaatggaatatctgtggagtccaacaccctttggcgataacgtgctgttggtatttgttcttcttgccaggttggtgccccgtctggtgaggcaagggttcccaagttagtgtgacctagagtgactgacacatcaagcaagccagtgatctcaccactcagcttctgagcatctctttatcaaagtagttggccctggccacagcttaagacttatctgggtcagcctctgagctggctgacttgggaaaatggccctggaaaaatgtttcacctatatcttttgatataatttggtatctgtctaaataaatggtatgtagcagatggttatggaatgtcttatcaaattcttaggcagactctgcccttgaaatttttctatttaattatcatactgcaaagcacaaaatagtaactttgttattatttttaaacaaaatcaagttacacaataggttgatattctgagaatgaatagcaaacctaaaatttatacaatatgtgaactcttccttgagctgttctttgctaggcatttctaaaagggagctccctatttcagaatccatgggaggatgtgtttcagatatatttggcgatgtcatcttgagagatggctcaggagtcgaagttcaccatgttgtctacatttgttctttgctcctagacatgatggaaaaaaatgctctgctgttttcttgttgcttttcatggttttagcatcatgttcctattctcgctcaaatcaataatccactgtacaaggtctggcattttgtactgaagccaagtataagaaagttttaactaatgcacgtatggggtcgctgttttaactaacacacgtatggggtcgctgttttgttgcctcgtttttttaggtgcacttttcaaggagattgtgtacattcagagaacttagaaaactggctggatatttcgtctggagcaaaaaagtgccctaaaattcagataattcgaagcagtaaagaaaaggtaagaggaaagattttaatttgtcctcgttgtattgtctcattttgcacagcggatgctaaatttcttctgtgtgtaaaatatccattagcaatcaaacatgcttagtgatagcactccattcatttagcactcattaacgaatattgagtgcccaccagatgccatccactctgcaaggtgctggggatacagcggtaaccaagtcacatcatgggcctgctctcatggagtttgtcgtcttgtggagctgaagatgaccctcaatggttgaactggaagaaaagttggacttctaatgttgtagaaatacatattgcttttgaaaataaagaaaaaagaggttcagattcatggtcaacgagataccttaaaggtggcttaattgcagaattttgtttagtgtaatggtcccttatcctaatgtgttgaggcttccccagtaaccatcttatgaacatagcttccaacagtcttggtagcgatggagagaagaccaacatgggcagtgaccattgcaagtgaggtcctttggaaagccagtggacccttgctatggcagcaccactcttgacaacacatcagtcctgtcattggatgagagaagggagcaaggagcatatttaagcattttcaaatgcacacgccaaccgtgccctacggaaaaagggaattcctgccttgcagtctcagtggtgctataaggaggcattttctccctaatgacggctcttgtgttatgaataattgtacagagtcctctgttatgaataactgtacagcagccagctgacctgtctgttgagctcactgtgttctgtttgaatgccatattaacaaggaaatgggccactttctcttttcccttacactttgccatttcagagaaatagcaagaactttaccacttacgatgatttaacatttaataaaggagagccaaagtatttaatgagtgataaataataaaataatcaagcttctaagttgtaactgatcagaacgaacagatttaaagttatttggctgttgtcactttctgttgtcttcctggagaaaaaaaataataataataactttcatacaaacttctaccagtcctgaatcagagtgaatagatttggtggaaaagattcttaggcatctaaacataggtatatccaaattctaatttctctcatcagtctgaaaaatagccaaatttggcgctaatagagaatagtagaaagtagaataccataatccttgaatatacccaggactctgataagtggttaaaattctggaagattttttttcttatgttatttataaaaatttaaggataatacttcagctaaatgtagtgggaggaagtagcttgttcattaaattaaaagtgctgcttatacaacttccgtacctagctaggggctcactattacaaattaatcactgtttatatctggtctggtacatttcaaaactgcttaccacccaaacgaccactggtgttttcttcctcgccctaagtcccactgtggtttaccctaatcttcccagagacttcccacacagccactgcctcactctctccagctcaccaccactctcaaagaagataagaagttcgtaatttgactaaagctatcctttgaaaccaacttcggactaattattttaatagtgttgataagccatctgattctatctcttgatcacattatttcaaaatatttcctaccctattgccacctttggcttacctgaaaatctcaggtctttgtttaaataaacctgaccctgacctatggagacggcagtctagggttgtgttcagttccacctattagctctattcaaaggctatttgctacctgcctatcatatgcctagtaacattctagtcactttgtaggcagagaaaaacctccatataataagaacctctgttcacagaagctttatttctttccacaaaacaattaaaagatagtacatcctcatactcactatgggatcagcattaaaaagaaataatcagagcaattccagttgtcctggagggatttctgtgaggttttgttgagtaaaaacagcaagatgcataaaagtgttcctagcatgatcttatattgatcaaaaaatgcccctgtatatgtttatgtatatatgtctctatatgattatttgagcatgggcaaaaatatagaagaattcaaacaaggttgtaaacatgggctcccctggtggaatgactgatgtggtggagaaggaaagcagagatatgtaataaaaatagaaaagacggccgggcgcggtggctcacgcctgtaatcccagcacgttgggaggccgaggcgggcggatcacgaggtcaggagatcgagaccaccccggctaaaacggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgctctccagcctgggcgacagagcgagactccgtctcaaaaaaaaaaaaaaaaaaaaaaaaatagaaaagacacagaaataaaattattattgttattatttattatactttaagttctagggtacatgtgcacaacgtgcagttttgttacataggtatacatgtgccatgttggtttgctgcacccatcagctcgtcatttacattaggtatttctcctaatgttatccctcccccagccccccaccccccggcaggccccggtgtgtgatgttccccgccctgtgaccaagtgatctcattgttcagttcccacctgtgagtgagaacatgtggtgtttggttttctgtctttgtgatagtttgctgagaatgatggtttccagtttcatccatgtccctgcaaaggacatgaactcatcttttttatggctgcatagtattccatggtgtataggtgccacattttcttttcttttcttttctttttttttttttttgagatggagtctcgctctgtcgcccaggctggagtgcagtggcacgatcttggctcactgcaagctccgcctcccaggttcatgccattctcctgcctcagcctcccaagtagctgggactacaggcgcccaccactacacccggctaattttttgtatttttagtagagatggggtttcaccgtgttggccaagatggtctcaatctcctgacctcgtgatctgcccgccttggcctcccaaagtgctgggattacaggcgtgagccaccgtgcccggcctacgtgccacatttccttaatccagtctatcatggatggacatttgggttggttccaagtctttgctatggtgaatagtgctgcaatatacttacatgtgcatgtgtctttatagtagcatgatttataatcctttgggtatatatccagtaatgggatttgctgggtcaaatgatatttctagttctagatccttgagggattgccacactgtcttccacaatggttgaactagtttacactcccaccaacagtgtaaaagtgttcctgtttctccacatcctcttcagcatctgttttttcctgactttttaatgatcgccattctaactggtgtgagatggtatctcattgtggttttgatttgcatttctttaatgaccagtgatgatgagcatttttgcttatgtctgttggctgcataaatgtcttcttttgagaagtgcctgttcatatcctttgcctactttttgatggggtcgtttgctttttcttgtaaatgtgtttgagttctttgtagattctggatattagccctttgtcagctgggtagattgcaaaaattttctcccgttctgtaggttgcctgttcactctgatggtagtttcttttgccgtgcagaagctctttagtttaattagatcccatttgtctgttttggcttttgttgccattgcttttggtgttttagacatgaagtctttgcccatgcctatgtcctgaatggtattgcctaggttttcttctagggtttttatggttttaggtctaacatttaagtctttaatccatcttgaattaattttttgtatcaggtgtaaggaagggatccagtttccgctttctacattttttttttttttttgagatggagtcttgctctgtcacccaggctggagtgcagtggcacgttctaggctcactgcaacctccacctcccaggttcaagcgattctcctgcctcagcctcccaaatagctaggattacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagcctcccaagtagctgggactacaggtgtgaaccaccacacccagctaatttttaaaaattttttatagagataaggtctccctatgttgcccaggctggtctcaaacccctgggctcaagtgatcctcccacctcagcctctcaaagtgctggcattataggcataagtgaccatgcccatcctagaaacattcttttacaaatcagaactaaaacaaggaattccaccatcgctaatactgttgacattatttgtaaagccctgtccactgcagtaattcaagaaacaagtaatacaaattattatttgaattaaatataaaaaacattacttactcatcttaagtggctgcatatctgcagaatctaaatatgttagctttaaaaattattcaaatgaattaacgttaaatgaagtgctgaatgttcaataaatatttaaatatcaataaccttactacatgttaaataaaacaaacttttaacttcatgaataaaaagtcctattcataaaaacaacagaactactcagccataaacttaaagagcaaggtacatatcctgcattaaaaccatttttactaagagatatgtgttggagtcagctaccaaaaatagtaattttgctttgaacaacttagcttaagccgttctttgtaatagtagttagatagcagagcagtggtgtattaaggctattttttttttttgagacaaagtttcactcttgttgcccaggctggagtgctgtggcgcgatcatggttcactgcaacctctgcctcccgggttcaagcgattctcctgcctcagcctcccgagtagctgggattacaggtgcccaccaccaagcctggctaattttttatattttaagtagagacggagtttcaccatgttggccaggctggtcttgaactcctgaactcaggtgatctgcccgcctcggcctcccaaagtgctgggattacaggcgtgagccaccgtgcccagccttaaggctatttataatttatcatagcaaaaccttattaattaaaaacataagcataaagaaaaataaaaacaaaaatacaccaagtattttcttagaatatatggaaaacatcttgaacatattcaggcatgttctacatttcttggtgagaagatatcataaaaatgtcacttcttcctcacctatttttcttgatttcatgtaattccaatgatttttgagttagtgtttatttaaaattaatataaaattcatctggaatatcatgagctgatcaagaatatccaaaacatattttggaaaaaaaaaagaagtcaatttaggcaagaccactcccattagattgcaaacatagatgatagatagatagatagatagatagatagatagatatcaaaaataatttaatccatgattctggtttaaaaataggaatatagattcatagaatatagtggaaagctcagaaatagatgtaaaaattttaaagaacagatatcataaaataagaggaaacaaaaattatttcataaaatgtgtgagataactggcttatactatggaaacgtaatttcatattttacattaaatataaaaataaaatttagactaattaagaaattgatatgtaaagcaaagtcacagaagaaccaacagaaaatgaagttgaacataatttgaaagtatgatcatttattttacctctgaagcaatatagtatgtaataacaaaagaaaaatattcatatacatgatttccttttacaaaaaataagagttaacttggccaggcatggtggctcatgcctgtaatcccagcagtttggggactgaggcgggcagatcacctgaaggtcaggagtttgagaccagcctggccaacctggtgaaacactgtctctactacaaatacaaaaaaattagccaggcgtggtggcaggtgtctgtaatcccagctactcgggaggctgaggcaggagaatcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaatacaccaaaaagtaagtgggccaaaacacatatattctcacaagaggagattcagaaagtagatataaatatggaaatatgttcaacctcactagttttcaaataaatacaaattaaagcgataataagctatgctaacacccagtgttggtgatgccaattagcacaacctttttggaaagcaatttggcagcatgtttcaaaagtcataaatatattcattccgtttgaagcattaatttcagccttagaatcctgaggaaataacttgaaagaagaaaatccctaggcatgaagatgctcttgccgtagcatttatagaattagaaacctggaaataatgaaactgtttagcaataacgaatgattcagtaaaataagatatgtcgatctgataagagtgttgtgcagcaagcaattctttggccttgtgaatgttgcgggctaattgacaccccagctccctctgcatcccacctgccctttaagtcttcactccctctttatccagcttgattcacgaaaaagccatcagcctggtaaggagtcctatactgggtttcttaggacgaagcttcagctttttaactgtactcgcctggaccccaagttacgcaaaaataccttcacctcactggctcctctctccttccactgcacctgaaaaaaacatgctgtctcctcttttcaggtccactccaacctggtttctgccccagtgttcccctgaacctgttcttgctaaggtcactagtgaactccatgcagccattccagcggacactgtaaggtcctcatctaacttggctgttagccagcattcttgaaactgtcttttccattgctttccatggcacgcccactccatgctctcctccttctctgtggccaggcctcaattcccttgctgggccttgctggtcccttccctccctgtctctaaatattggagccatttaaggcccagttttggctcttcctctcttcttactctacatttcgtctgtagacaatcttattcacttccatggctttataaatcatctgtatgttcatgtctcctttatccccaccccagattgatcctctgagctccaggcccatacccaacttgacacatttgcttgagtatcacacaagtatcttgaactacatacacctaaagctgaagtcttgaatcttctacccatctgcctctccatcagtatgccccatctccatgtatggtacctccatccatcccatttgctcaccagcatcctccatatccacatcccccacttccagtcctgccccatgccacttctaaggggtaccttgactgcctcgttctttcccttttcattgtaccatcttagctcagtcatttcttgatgattccttgataccatgtgaccttccagttttattctggtggaatgttctatacttctactagtctataagctctttgagggcaaggaccatagctgtttggttcactggtatattcagtacattgtgcagcacttggcacatgttgcaagcttgatgaacatttatggaataaataaatggaataattatagttatgtaaaagctacatatgtgagaactagaaggaaatgtggaaactttaaaagagttggtgaaaatgtgatttttaaaaattctgatactcttgttataacgtttgagtgtgaattcaatttaagacatatatgtatacaagataagatgtgtggtgcggatataaatgctgcgttgaagattgagcatgaatgagagttcaggcatttgttgaagatgagttagtgggaatggtttgggatctttcactgtgctcagaattccctaaagataattgaactccagtccaggtgaagtggactgaaagaacttgccttcttccagcatgataatatggccagaactttttgaaaatgggaagataggggtgacctccggggactagattagacttagcaagcttatcaaagaaccagggagacagcagagtcttaggtggcagtgcctaagtctgggaggaagtgagaagtataacagaagacagagagctgccaggttgtctagactatggctcttcatagggggtgataaggttaccacttcctgcactcccaggttccttttacttagcgctcattcccatcagatcccatcatgcgcctgatgcaaaaggagtccactgttggcatgttaattcctataatttcccttctgaacaggacacctggctgccttgttcctttggaccatttccttgggaaaaagttactttggggacatttcaagattgtctttttgtgtccctactatacacacacacacacacacgtacaggcacacagatgtatccctgtacacatacaaacatacacacacaaaaacactccctccacccaattttgatcatatgtttgaccacaagcaaaaccttaactaattctaaagcacatttcacaggccaccttctttaatcattatctaacaatattagcaataaggaatagttgacaaatgtatcttcacacctaggatcatcaaggcacgctgtcttaaatgaaccccagatcaaagagaaacagatgaaaaaagtcatgtgtttggatgggaataattaatatcataaagacagaaatttttctaacattaaggcatatatttaatacaatttcatttagactcagtcccctcaacccctttggataaaatgaatatagatgaataatgctcaggaaatggtaagaaaattatgaaaatagagataaagcaggagagatttgccttatcagatgctaaatatatttaaaattacaggagtaaaaacttaatggcattggaatagaagtagatcaatagattattagagcagagcagagttcagaaatagattccagataaatggaaatttaatataggacaaaatgatatttcagttcagtgggaaaaggaggtttgtttttgtttaataaatggctgtgacataattgattaaccatctggataaagttggacccttatctcacactgtatataaaaataaattccagatggattaaagatataagcttaaaaaataaagcaataaagatgttggaacaattttatatttgtccataagctagagtttgggaagcactttatagccgagacaagaaaccctgtatttgattactcaaaagcacattgtgtaagggtaaaagatgccacaagcaaaagttacaagacaaacaatagattaggagaaaaatatgtgtcagaaatatgacagataaagattaatatctacaccatacagagagctcttgaaaattgataagaaaaatatacacacaaagcagaaaaatggtcaaagaataagaatatgctctttacagaagagcaaaccaaatagccaacaaaacatctattcttttatatttttatttatttatttatttatttatttatttatttatttatttatggaggcagtgtcttgctctgtcacccagaaacatctattctttacatcagctcttctgagaaattctccctcctgtggcaggtcaaagggtgagatcatatgaggctctatgatggatggaaatgaggcaaaaatcatcattttttccccatatcttccccgcacagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaaggtatgtggattcttctgggttatttttgttataaaatcaaaaaaacaagggaacctcctgagtttagtttgcccaaggaatatgaatagttccccctctgtagactcactccctcactaccccctggttcccacttttgctctgggtcctcctcacctctggtttacctcattcatttactccaagaccccactatcagatatgcctggacaatgacaagagaagggcaagttggataggagagtgcagaaaagccagatagcactgggccgactacccaaatggtttagataattcagagatctgaaaagcaagaaatgccctgggtgagatgagaaattttaacaaccaatgttccatcagtttgagttcattgcattcatacatccatccaggaagtatttactgaacatctactatatgtgaggcactatgctaggtactagggatacagtgactcccccttgcccctaaaaaaaagactgtacactgggatagagagaagtaagtagctcattacaatgcagtgtgtaaatacagggaacatagagtaccatgagaagcacatgaaaaatgtaccttaccagacatggtggagggggaaggggtaaggaaagcttcctggaggaagtgatgtccagacaaggtgagggtagagttgagccagacaaagacgatggggatgggtatttcagacagagaccaacctgcatgatggccaggagacaaaaagctttatttgaagaaccagaagagcttctacatggccaaggcacatggggtaggggaaggtggaaaggggagacggagggaagatagataccaaaggaggcagccaggggaccatgaagggccttgtgaaccgtgaatcctgcgagctgtgatgaaacactgaaaggtttaagccggaggctggcagcacaatcagatttttattacagaaaggttccattgtgcattgtctgtctttcctgctggaatgtaagccccatggaggcagggacttggagaagacatcttcactgctgtgcttagaacagtatctggcacaacgtaggcattcacaatcaataaatgtttcttgaatgaatgaatggcttgaaggtggagaatggaccaaagaagggaaagactgaaagactgagttccaacagatcacttggaggggtccaagtgagagagaaagtgaaagcggaaagctactggagggtccaggtgagagggaaagtgagagctggaggagaagccaagggggatggagagaagtggattcaatagatggtcagtaggtacggtgggcagactgaggactcctgagtctcttcgaatgagaaagactagaagtagagttgagttcatggagtaggtctccaggactgagtgatgatcattaatggagctgagtgggttttatggtgagagctggagttacccaatatcttagtccattctggctgctataacaaaataccttagactggataatttataaacaatagaaatgtattgcttacagccctggtgactggggagtccaaggtcaaggctccagcagattcagtgtctggtaatggcttggcctctgacttcgcagatggtgccttgttgctgtattctcacatacagaaggggcaggggagctctcttaagcctcttctataaggacactaatcacattcatgagggtgcagccctcatgatttaatcacttcacaaaggccccgtggcttaatactatcacattgggtattagattccaacttatgaatttaggggagacataaatattctgaccatagcacccaattgatcctaaatccttcaaaaggcaatttaatgcaccaggccagagaagtgagcttaaaaatgctctcagccactgggtggtggctgtttgggtctgattgcttggaaaatcacctcaattttccactttactttgtccacactgtgcagcctttgtgatgcatttctggttaattttgttcattaaaacgcagaccttgctcacctataaaatatgcctctaaagtatttgagatcaccttgtaaagctagttggttgcttttagcgcctccatccgttgcacccaacccttcacctgccgttttctgaatatcttacatattctgaacgggcaaacaaatttgcttcccagcctcttgtactcagccagccggtgaccattgccaagcctttatccatggccttctttaaacctagaatggcttccccctttcacaaaatcctgtctccctttctgctttgaaacattggagaaaagtcacctcttccacatgcccttgccagattctgctctgactttctcagccattctaacacccctttggtcctccatgcacacccctatcttggcacccaggttaccagagggaactgaaaccactcatatggttgtttccttgactgtgctgtcatcacctaaattattttacctcttccagaataactgtaaatgctttcctagaagaaatcatgaatattcatttccttgtgatatttccaaatagagttttgtgcctatttggtgcttgaaaaaaagtatgacttttgcagtcttcatcaccggacacttatagattccactggagtgtattttcactgggagtccctctgagctgactgtccctgtgttcattctactcacatgtatcaagtgtctgttcagaggcttttgcagagaggtcatgccagccctccaagcctctttgtcttgagaacagaagatgatcatttcacacacaccctctgtacgtgaaccgaattttatgtggaattctgactttcagagggagtgttattgctgtggagaaggaccttaaagtaagggtttttagactttgggaaccacacactaataaaatttcaatgagaaaattagggttgccaacggagtcaagccagcttcttattttgtcaagacttagatttaaaaagcaccctctcggccaggcatggtggcacacgcctgtaatcccagcactttgggaggctgaggcgggcagatcacttgaggtcaggagttcaagaccagcctagccaacatggtgaaaccccgtctcaactaaaataaataaataaacaaacaaataaatagtaccacctcctattcctattaattcaccaaaggaaaaagatattaataccttgttattagcactggtccgtggacagaaggggatttgaaaggtgctattctgtgttgtggccccaaacctgggctctatacaattgttccatggggagcaatgcaaccacaggttcctgggtccaccccaggcttgctaaatcagaatatttaggggcatggccctgggatctatagctttgtaaatttctcaggtgattctgatagagaactgggtttgggaatcactaccttggatagagcatatatgtttaaagagatacaggaaatactacatttctctaatgctgatttagtagttttgaaatccttgttattttgttcttttggggttttctaaccaatgagtaggttttcaaaggcaaataagaaaacctttatcacagatttggtgacagttgaccccaagaagatcgtggaacccagcccatggaaactacactttagagtatgttaggtaaatatttgcagcgtggatttttctgaaggtgcaggatttctaatgctccggttttcatgttctaggcacttcttgctcggtgacttgttttgttcttatgccttggccaattaaaagctgagatagtgatccctaggagagtatgagatgtaaatgagctgtaaaatggcttcttcctagtgattattcatgggaggcttggaactcgaggtgggttcagtctgtttggaggcttgagctgtgcacttcggctgcctgatgcgaatggcctatggggaaggaaccacatactgattgaaatgttagcaaacagctggcacgctcctgcccactatgcagaggaagcaaaaatatttatctttttttgcatttacagctatgcttgactatagcaggactccaccgtaaatgacattttccccccttccctccagatgtttcagttgtcaacgtgatgttctccttcggttcttggaatttatcagacagattcaactttaccaactgctcatcattaaaagagtaagattttatttgaaatttgaatattctctcgttgatcttaatttacttatttgtttgactcctcgatttcctaaagaactcttttgtgagacagaactttccaaaatgccttttgaagcatggtgtaatgggagataggagagccaccgagctaataagctccgctcgcacattctagccctgactagtaagctggcgctgcgagggagagaaatcccctgtgcttaagtgttcatacccacagggaaatatgtcttcccaggaccgagaggcagccttgaagtaagtaaagaagaagggacaagccaggtgtggtggctcacatctggaatcccagcactttaggaggctgaggtgggcagatcgcttgagcccaggagagtttgagaccagcctgggcaatatagtgagacgccatcgctacaaaaaaacacaaaagttagccaagcatggtggtatgtgcctgtagtcccagctacttgggaggctgaggtgggaggatcacctgagcctaggagatggaggttgcagtgagccgggatggcgccccgcattccagtctgagtgacagagtgagattgtctcaacaaaaagaaggagcgctgctaggttctcttctgattggaatggcttcgggaatttgggcggaacgagaagccttgagtgtaggggtaaaaagtcttacttgagaaggacaaggtgaagtccctttcaccaaaagaacatgttcctgctgccccccttttcaccatctttggcctctttgagctacataggcccctgagttagtgccaaacctcactccttgcttctaaagcagcaagaggacagaggaaatatgtttctcagatgcctgacttgccaattggaagttgggatggaggcctgcagggcaccttgggaggctgcatgagtagcagtgctgtagatcactgcatagtttgattgaccagttatgtgagcaccaaatgggagtttcttttgtcctggcctgggaaccatggtttctatggggaaaatgaatttgaacttgaagctgagctaggaggctgctcttgaatgattagaacaggagcccctgggcctcatctcttccactgaggcactttgaaaaagatgacacaaggcccagttcaattattgctaagaaacagaatggatttaaggagaaaaaaatacaaaaattgctacagaaagcctcagaagttcatgaaaataggaaaaaagggtgtgaattaaatagaattatatagctcaaagacagttgaaagaacgtagctcccccgatgcccactttaaggccagatgaaaggaaccgactagccccaggtcccacaacttggtaattaagaaccagacctcagacctaggtcccccagggagggtgagcgccctttccataggtaactgcttcctgttaggaaagcacttagtacagtaatcacaccctgggggtagaagaagcgagcaaatcacaaacccgtgtctagctcacttaggtggccggatccacgcaaaagccagtgtgtcctctccttccacggaaactgcagtttctgtagatcagaatctcagaatgtttcctcatttcttggagaaggtataaaacaaactgggtcccccggccctgtgctagcaccccttgctagagctaaggcttcctctggcctcccttggccctgtttccagatcaaccctgatttccctttttaacattccttctcataagtgcttttcaagtcctccacagtttacccaatcatgataggtgatttgattagtagaaacacaattcttccttaatttgattataaagcaaacacaggcacctcgttgcctctgcttgccagctaacactttctgtctcacatcttccaggcagttggcagtgtgactgctggagtgagtgagggcttcctgattttggaaggcagagtgggtagaggcggggagagagagagatccatctccagagggacttacctgagggtagacaaatagcagaactggattcagaaacagattcattgggttcctattatctacagaccagcaggtgacccagcttcaggtttccatggcaacacccctgcaggtgccattccggcccatcaacctgagggcttccaagagcagggcacaaagcctcacaggaatgtctgtccagggatttttttttttttttgccttcttttaaatgcttgcatgccacatcacagagggaaattctaggatgtgaacattgtcctaaaacgcaggaattaagtcagttttctgtgttgctagatgcccagcatgcgtagaaactggctgcgcgtggtgtaaaagtgcaagaaggtgtatccaccccttcacagcttgcgacccttctgattatgagagaaaccaggtaaagtgacatttttggtattgtaagtcttaaccgccgggcatggtggctcacgcctgcaatcccagcattttgggaggtcgaggcgggtggatcaattgaggtcaggagttcgagaccagcctgaccaacatggcaaaaccctgcctctactaaaaatacaaagttagtggggtgtggtggcgcatgcctgtaatcccagctactcgggaggctgaggcaggagaatcacttgaacccgggaggcggaggttgcagtgagccgagatcgcgccactgcactcccagcctgggtgacagagtgagactccgtctcaaaaaaaaaaggtttaaccaaaaataaatgtttgtgactgcctggtcctaccttctcttttatgtttgttgcacactttgaatttaccacccatctggatgttgaagggatgttctccattccaggaacagtgtccagtggctgtcgagaagacatcaggaggaggaagacccaaggagaacaaggggaacagaaccaaccaggctttacaggtcagaccctatttttgtgtggttgaggggaaaacctgtctttgaatgaccatgaccacaactcatactactttgggttccttaaaaaaattctctattttactttctaccaaaattcccttttgtgtctttggttttttaaccaagtttcacttaattagcgcaatacatcaatggctggacactcacataaaataaattaaaactctgtaattatgaaaaatgatgttgctctggtcgaaataaaattgtaaaggtgactttgcggctcactggtgaagagctggaaggaagtttagcattccatctgagggatttcaacttgcactttatataattgcgtttctgggggttatgtgtgtggatgggggtctgtgcaaagtgtgcaaactaacctcgattccgttgttttttttcaactttgtagggacgtctaaccagtagtgaacactgctaaaccagaattgttatagaatgtgtatttctctcgccttctcacaagcagttattaatccatgaactttccttggaaatgcccgttattttcttcatagtaaattacataagcccccacgtcagtcatgtttgaaaagaggggacatgtcaacgtaaacatttctgggcggaacacatgtggctgtgcttacaacttcactcagtcaacaaaagttcattgagcatctatatgtggtaaaacacaaaaagaggataagtcctgccctcgctaaccttggagtctagcagaaatagacaaattaaaaatgacagctctggggagaaaagggctccattttccatttctctaatctgtggttttgacttctccacttgctgcttacctaaggtcaagtgcaaaggtaaataagtagcatattttgaatcattactgaaaagtttatagtaacttcaggtgaattaacaaccaggcagagggaatatgaatcaaatggatatgaagttaattaaaggcattagaaaagcttgatgctcaggtatctccagactttagcagtctctgaggtcttgttaagtaatgggctccttttctcatcccattggtttggaaaactaagacacagcgacaaggacttggatcaggaagacagtggctttgtggctttttctttttaattaaactttgttgttgttccagggtttgtttgtttgttttttcgttttgataaaatacacaaacaaaatttaccatttttattgcttttaagtgtacagttagttgaggtaagtacattcacatcattgcacaacctatctccagaactcttttcatcttgcaaaactgaaactctatgctcgttaaataataactcttcatctctccttccccccagcccttggaaaccgccattctaattttttgtctctatgaatttgactactctaggtacctcatgtaattgaatttgtctatttgtgctggcgtctttcacttagcatgatgtcctcaaggttcatctgtgtggtcgcatgggtcagaattcccttcttttctaaggttgactaatattccagtgtatgtatataccatattttgtttatccattcatccatggattaacgcttgggtcgcttccacattttagctatgatgaataatgctactaggaacgtgggtgtgctgctatttcttcgagaccctgctctcagttcttttcggtatatgcccagaagcagaattactggattgtattgtaattctctttttggttttttgaagaaccattgtaccgttttccatagcaacgataccattttgcattcccaccaacagtgcacaagggttccagtttcaccccatcctcaccaatacttgttattttcgattttgtttgatagtagccatcctaatatgggtcaggtggtatctcattgtggttttgatttgcatttccttgatgattaatgatgttgagcatctttgtgtatgcttgctggccatttgtatatcttctctggagaaatgtctaatcaagtcctttgcccatttttaaaattgggttatttttgttgttgttgagttgtaggagttctttatgtattctgggtatcaaccccctatcagatatatcatttgcaaatattttctaccattccataggtttccttttcattccgttgactgtgtcctgtaatacacagagtttttaattttgatgaagtccagttcatttattttttcttttattgcccatgcttttggtgtcagatccaataaatcattgccaaattcaatgtcatgaaactttctttctgcatttatttgtaaaggtctgtagcacttatattttggcctctgattcattctcagttcatttttatatatggcataagaaatgggtctaacttcattcttttgcatgtggatatccagttttcccaacatcatttgttgaaaaaaatgtcctttcccccattgaatggtcttggcaccctcgttgaaaatcatttcaccatatttgtgagagtgtatttctgggtgttcttttctattctattggtctatgcctgtctttatggcagtaacgcactgtttgattactgtagctttgtaaagtaaattttgaaatcaggaaatgtgaattcttcaactttgttcttctttttcaagattgttttagaaaataataaacttttaattttgagataattgtagattcacatgtacttgtgagacaataatacttaatatcttttacccagtttccttcaatagtactatcctgcaaaactatagcaaaacatcacagtcaggatattgacgttgacagcagtcaagacacagaacagctctatcatcacaaggctccccaggttgccctttcacagtcgcatccatttccctcctccctcccattctccatctctgatgcctggcaaccactgacctcagctccatttctataattttatcatttcaataattttatataaacggaatcatccagatgtaccctttgggggactggctcttttaactcaacataattctctggaaattcttccaagttcttttatgtatcaataattcattcctttttatcgctgagtcgtggtccaggcagcggctttttaaacttctttaattttaaagataaatatcataaagtcactacctcctggtttcctgcagtgtatctctctgcaccctttgaactgtgtggttaaaaggactggggtcaccacaagagaagaagaaggctgaaaataaacaaaagcccagatctgtttttagtgcttctctgtggattacccctctaagtgtggagaaagacattttgttgatactgacatgttttctttaaatatgtgactcagagcagaatctctcttttgtttgatagggaatggagtgttatttgtcacaggagggatttctcgtgctctgtcaaacactgctgtctttcattatcaggtggaatgtgtaacattctggtttccactttgggccttcatgttggccttgaacaaagcacccaatgtctttgtgattctgtttctaccagagaagtcactcacagctttgcttcaatgcatctgcccacaccacatatgtactgagtacttcctgtgtgctaggcactaggaatggagcaggtactgtcctaggcgtctaggatcctgaacttgagttgattctttctagaggcatttattgcacacctattagatgcaagtataccgacctccacagattccatgaggaggattcagatgaatcaggcacatctctggccatcagtctcaagaatcttatccatgagtacatgagtaaaaatacaagattttaaaaatattaatatgaaggtacaagaaagtacacagagagcctctctgtgcccggggctttgtcttagtccttcctgtttgcttaaacccagtgccttgaagttgaaaacacttaatcagtgtggttggttaagtctttgattgatggatggattgattgctggagatggcatttcagcccacctttgaggacgagaagcatccagacacatgaatgcgggtatttgaagcagaggaaccagcatatgcacagtgtaggggtaggagccagaagattccaggacacacgctagaggaaaccctaagtaggcacagaggatgcaggaaattatgagacacaaggttgaaatgaccctggagcctgcatatatagggcctcacataccagtcctgtgagtgctcgctttattcttcagtggcaatggaatgccattcaaggtatcttattttatttttttagtgtatgagtttgctaatccaaggatctggtacttatgaggtagggtcctggttcagtccctactaggccagtagccctcacactgtttcatgaccccaagacctactcctgtatcctgaccctgaaacgtatagcgtcatctgccaagggggctgagttacagaaaagtgtgaccacaatagagaaatgagctcaaaaatctatgtatgaccttggaggaggagtatttcaagctataaaggccagtgtctgaccgtctgtctgtttctttccacatatctagtagttgaaaccttgtcagggaccgttggcccttttaccctgccctgaccacttctccttccatttcttaacattctcatatctggtgccttcactcactgagaccagagatagttcccctctcttttgtgcattcaaggagagattgtgaagatttatgatatgatgtcattctaatatttgttattaccctcaatatgcttatcactatagggcagaaataaagcatacaaagtcatatcccctggcaatttacattcaaatggttctttctcttccttgcacctcctcttctcttcctccatcacttcttcccccctccgagatggagtttcactcttgttgcccagggtggagtgcagtggcacaatctcggctcactgcaacctctgcctccccagttcaagtgattctcctgccttggcctcccaagtagctgggattacaggcacccgccaccatgcccagctaattttttccaatttttagtagagacagggtttcaccatgttggccaggatggtctcgaactcctgacctcaagtgatctgcctgcttcagcctcccaaagtgctgggattacaggcatgagccaccgcacccggcccctccatcacttttgaatatgcatttttgatctctcacaggcaatccagatgaatgcttttggggaccttgccttcaagagtgaaattaaatttcacatataccttgctgagtagcttctatgggcctagcatagagccgggtactgtagaattaacttacaatcattcatttattcattcattcaaaatttgtttgctgagcaactactatgtgctagacaggcaggcaaagtgtgtgactgcatggagcttacatggtagaacttataatattttggaggaaataagattcattttcatgaagcagttgcatgtgcacaagagaaaaagatacaagagagaatgccagaatgtactcaaatgaacagtggtagctaagattcgctgagcctgtgccatgccctgagctcagagtatctaagcctcacaatggacctattttccccattttatagataaggaaattttagctcagagagagcaaatggtaggtaagaaatatgaatccaggcaatctgactcaacagagttttaaccattaccctacattgtatgccctaaattgaatataaacattggttaaaccatactactgatgatattaataaaagtcagtctggaaaggactctaatattggcttctcttggcattagactgtcaaagcctgcccccgatccatgccacacatgtagggtgggagcaagacctccaacctggccaggatgtgggaggagtgtattaacctcaaagacatgggagaaaggggtggggcagggtgtggtccgagggaaggagtcagacccagacacggctgggcatctgctccaagacagggagagcagaataggcttagtgaggcaactgaggccctggggagaggggagcagcaagaatctcatgcatgagtcgaatcttggccaaagggtggactttgaggggctgggtttaaattagaatcagggccctccactggctgggaagagctgccctccctggccctggagttttggtcacccagtccaggtctggggagccacactcagaaggctcaaatgccaagaggaatagcaggttgttcggagggtgggcttggcagccaagtcagcctccttttagagtctgcagctcagagaagtgagtcttgatctcttcgcacagggcattggtctgtcaccttctatctggaagtctcaagctctgtgtccagaggcactgctcactattggcatttccagggccaactgaaatcacatctcaagttccctggagcctgtaccgaggggcccccgtgaaaaggcatttgtcccaggggctaagcatcaaatggataaccattttgttccatttcacactctaatttttcttgagtggacctgtattttgctattttctttccatatctcacctccttttactctttcccatttccacggctggttaccactcttaccaatttatacatttcattaatatattagttctatcctcttctcagtcattaataaagatgttaaataatcctgaaccgaatactcactcctgtagggccctacaggactctttcctttaattagttgtgctacctttcatctatctaatgtccttcggtttcagatttccagctggttttgaatccatgtgactttttatctagtcctgtttgaactaatttcatgagtgaaaatccgagagatgttttactgagtgttgattcaggtccaggcctacagagagtttgctatattcagatttttttttaacagattaatagagtacaatttggccttaataaactgagccctcctaatgcacctctttccaatattcttttcaatcatagcagtattttctccattaatgtcatggtaatttgaattgtgttgacgtcagacttcacaaaaggtactcttactgtcagaagtaatcctcttagaccttttgaaagataactatttcttagtggttgtgctatttccaatatcctataatgacttagttaaaaataaaaaataaaaaggatcgggtattctataaatctcctaattaaccagcttctaatgtgctttcttatacaaaacagggactgaaagccagagctcatagtagtttattaaataagttcaaattgtgcagccatttaaaaataaccctgaagtctttaaaacgtaacctacaggaagcacactattctgaggttaattgctggacaacatagggctgtgacggttatagtcaacggtattttgatttgaatacatagaaatccttggacatagagtgagggaggaatcccacgatagggctctaagaatttgtctctttgtattgagctcaattatgttttacaattaactccctctaaaatgcataagcttatagggctggctactatatgccaggttttatgaattaactcttgatgaaaatacaaaaattgatctaaaatattgaatgtgtagaacctttatggggaaatgattctttgctcttttgtctgtactggatttttcaaaatctttattggtaaaaagaaagaatgtatttctaagaattgttgcaaccatacagggcagccatggagctgactctacattttgttttaaaaatgttgttttatacctgcactatttatttaggagggtcctcttggtagctctttaacccatttattaagattagaagaggttccaccagcaaacaaaagacaactaatctgagtctgtttaaaagcagactgaagcacccactttcacaagacaggccagggctggattccatcctagatggccaagagaaccctctctaaacaataggggtttaaaatgtttttgaagtagcaaggcggtctccactcagggaaataaaaagttaataagatgatgtggcaagtcctctgatggtgttcgtagagccatttaaggagcaaaatataacttccttaaaaaatcttttttacattagttgtaaggctctctttatcctctgcagagaatggagaagaagcatttacttggcatgtttgaaaattttgcttgagcagacatcaacagtataaatataagaagcaggaaggactatctagaaagaaaagaaacctgggaatcatagttgacttggatgtaaacgtgagtctgcaatgaggtttacataaaaaaagaaaaaaaattctatcttgctcccctaagaagacagtggactcctctagagcagaggtcggcaaatgttttctacaaagagccaagacagtaaatattttaggctttgcgggccgtatggtctctgctgcagctactccactcgactgctgcagtgcaacagcagccagagacactacccagacgaatatttatgggtgctgaaatttgaatttcatgtgtttttatatgtcatgaaatattattcttcttttgacattttgtcatggcccatacaaaagcaggtagcgggcaggatctggcccacagactatagtttgccaactcctgatctagtgcacacatagatcatgtgtcccccacaatatctggcctaaggaccctgtaggtgctcaataaacacttgttctcttagctgtcaccacgtaagagcgaagagtaagccttttgctatataacacacacttgacatttgcaagagatttatcttgaaggctttgctaatccccccattccaagtaccactctagcagataatttcccccataaaatgcagtcaagtataacagaataattaaagtgaccctttcaggcccttagtgattctattaatacagggctaacgtccttcacaaagtgattaaaataaattctgctaccaaaatcaattctgtgtcatgttacatcattgctgtgatgacattaacaatgaatttacctcaatctgcaaaaccagtccaaagcgctgatgagtgatggggacgactgtgccgtgtagcacctgtgtgtgctggggagcagaatgagaaaatgtctgtttgagcaggatgggcagcccctgtagcccagcaatgccaccccaatgagtgttccatgtacaaaggagcagaggatactcaattgcttcaagaagcaggtgttaggcaggtgttggacatcacggagttctcccagtggctcaggggcttcttcctggactcggtcctccaagtggatgcactcagcatttagaatttcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattatagaagaatacagacttgctgaaaatggtctacaaaagaacagtgaaattatcagaatgatagacagtagcatctgtaacataaaagtgaaagaactcaggattgttttatcttgaaaagggaaaatgattcttgctatcaaataaagggctttttttttaaagggagaatttgattagatatcacaaatggagaagtaaggtggcattcacctatatggtatgaagctaggtagcaagggactccaagggacatgttcttgaccttaggcctgataaagtctattgaaactgggtagcaagaaggaggttgtggtatctacaaaccttggttggccacagtggtttagacatccaactacttgatagtaggtgactgaacaggttgatttcttgaggtttttccccctgcagtatcctcctggattcaaatagcctcactgtaacaaaaatatgactgctttcttgggaactgaatttatctggaatgacatttatttcaacttaacgatgagtctgtcattggcctacggtcaatggactctctttcttttccttgattttgcttacattgtgagcctccagaggctgtaaggcagtaaacattttcaaaactctagtgatacctcactcttcagacagaatatcagacttttcaactgtattttcaactgtcttgtgagacaaagactaattggtttgacctcatgctgtcacatgttgagagacatgaatctgcagccctcttccttgaattcattgatttcattaaacactgtctgcttgtgttcgcaaaatgttgtaatttcccagtgatttcttcgaactgcagcgtataaacagatttttttggagcgatgccatttcttagctttgatctcctgttttaatcttttctttccaataggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgtgagtcgaaatactaataatttatcctcggtaacgtaacgctcaaacctgtgccaaaggaatatcagtgtgattataaccttaatatagtcaaattattgccatgccccaaagcaggccaattagtcagagtatttgacataatataattccaacacgtaaaataattttcacaacagatctgaagttcattgtgagagaatctgttctgtgttattccccaaaaatctcagtatatagtcatttcaggatgttgcctgtttggggtcttgattcattttcagtaacaaaatcaagtatatggagtagcaaacatcattctttaggtgatgcacttggaaaaatagttgagtaccttgaaatttgatgaggaattttttggagcagctcttccagtgtgccacccaaagttgaaaaaacaaaacctcttggatccattttatgtggacattttattctttgtagccttctctttactggtttggtttcagcctccaaaaattaaattactactacatataatggtagtaaaaaagaacaccccaacataaatatctggtcaatgtatctcttgaacattattatttctgtcacttctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgttacagtctacatagagtataatactaagcttattttcatcatggaaatgcatttaagacaatctgctgaagcgtgatgttttgatttttaactactaaaacagatttgtacagcattctaatctgctatgcttatttactgaattttcttctttaattcattttctgcacatcactgccatgcccttcccctcatagcagtaaatttggaatatctgtgatcttgatgagaaaagctgctcattggtggcttgcctgtgttctgctatttgccagaattatcaagcacacattagaggctgtatctatgcaacataggtttttttgtgctgtttatcctggctaaataccttattgcaaaaatctttcattttatgtagcgaaatctgtgaagttagacacctgtgtattcactgaaaggcaatcaacttcatggaaaataagtagtttttcggagcattaccctgtttctgactctttatgttctcattttaattccgaatgtgtcttgagatactgcagttattaaattaaatgactaggagacctttctgcatgtcgcatttcagtaaccacatctgtgtggtgaagccaagttcacaagcagtcaacataatactcagttaatcctatacctgagcccaggctgtaatcccaagctcttttaatatggtacttttaaaatgggtaattattttaaagagaaaaatactagtagtggaatgacctacattttcacctctcttcttctgaaatttataaacaagtttgaattttaatgttcaaccactttatgataaatttcctagagctttgctctgaatataaacctgaaaatgtgcgtctgaggtggcgtaagtacaaactgactcagatgtttttgaatttgccttatcctaaagggttagtgatagcattaaagttaatcatcatgcacatggcctttaagtagtaataacagattctcatgtagcacggttatactgagcattattcagacacaacccaggcttaatgatttgtgctttagaggatcattgtagacacacagaggaagctgcaggtgacagcgggaatgtcggagaaagcttcgctctgactctgaaagggcgccaagcatcagctgttggacatcaggagcaccctggacagccccagctaagtcccagcctggatactccttagggagcatgttggccccaatgctgattgattctgagatgcctgggctcttggtttaggccccctttgaacagcagaatttccatctctgtctggtgctgtgttttaccctctcagtgcttgactagggctttttttcttaagctttttattatggaaactcaaacataatacaagagagatgagtgtaatgaacctctctgtagccattcccggtttcaaagcctatcaacattttgccaatcttgcttcatctatcttatctgggatttttgggggggcatgataagaaccaaacaccatatccttcactgctaaatacttcagtacctctctaacagataagccatagtgccattatgatactcaacagaattatccacaattcttaacataatgtaacccccagttcatgttctgctttctattagtacttcttcagggcaatggttacacctccttcctttcccacttctaagggcaatgcaaataagaaagataaaaatgtactaaagaaagaggaacccaacccctaataataccaacttgggtcactggcccctcatgagtcagtagttgcctgcagctgttctgctccttcatgaagtgttgtagttcaagtgaaattcatttgctgtcaccttgggtaatcaactgtgctaagtgtctgtgtcatgtgagagttctttttctactcttttctaggatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcaggtactttctagattcataatctttttctcattgtggttaaaggtcatatgcccaaagatcattgattttattcaagtaaattcagaaacagtggtcattccaaattcctctcaccgagttctccttaggatttactcctagaaaaatgcatacctgacaagacatttgcttcccatgctcatcgtgaatgctatgagcacacctttttcccttcaccatggctgctgagaaactcacagctgaaatgtttgcctaggtttttgatatagatatatgacactctttactatgtgtccctcctgcttgtgataaaaggcttctttcttacctctttcattttatagactttagatactttaagctgttttgaattctttgggggaaatattgggagctatcaaaatgaaaagcagaatcaaccttttcaagatgttccctaagggggagatggaaaccccaaaataaactctcccagataaatccaatatgttaagaaaaacatttatctccctagttgaatttttaaatttattactattatgtattttttgcattttcatgggtacataatacttgtacatgtttatgggacacgtgatgttttttctatgatcatacagtgaatatgtaatcatcaaatcagggtaattggagtatccatcacctcaagcacttatcatttctttctgttaggaacattccaattccactcttctagctatttttaaatatgcaataaattattgtgagttatagacaccctactatgctactgaacactagatcttattctatctcattgtatttttgtagccattaaccaaaccctctttatccctctctggccccgccacaccacccttcccagcctctgatacccataattctactctctatctccattagaccaactttctcagctcccacatatgggtgagaacctgcaatatttgtctttctgtgcctggcttatttcacttaacataatgtcctgcagttccatctgtgttgttgcaaatgacaggatctcattcttttttgtatgctgaataatactccattgtgtataggtaccacattttctttatcctctaatctgttgatggacacttaggttgagtccctatcttggttattgtgaagaatgctgtaataaagattcctcctagttgaatttaaattcactttcataatatttttattcctaaatctctttaggactaaaatcctaacgatattttctttgcctgacacagtacgaagctaattttcaaagtactctctaggtaaacctacagacaaaaagctttgttaaaaaaaaaaaagaagaagaagaagaagaaaaggaggggaagagaaagaggaaaaaaagtagagaagaaaaaaatcacttttaatattcttatttaagatcaagtgagaggtggctatattagtttgctagggtggacataaagtgccacagcgtttgtggcttaaacaacagaaatttctttctccccggttctggaggctgaaatcatggtgttggtaagattggtttctcctgaggcccttacaccttggcttgtagatggtcatcttctctctatgtcttcacgtggtcttccctctgtatctctgtcctaatctccccaattttttttttttttttttttttttttgtgacagtctcactctgtcacccaggctggagtgcagtggcgcaatcttggctcactgcaacctccgcctcccagattcaagtgattctcctgcctcagcctctctagtagctgggataatctcccctttttataaggacatcggtcatgttggattagggcccaccccaatgacttcgtttaaccttccttacctctttaaccacccacgtctctaaatacagtcccattctgaggcactgggagttagggcttcaacatacattttatggggacacattttttggggacacagttcagtccataatagtaagataaggagaactgaaatttcaaaaccaaggctctagcatgacatcccccactctaggaccaattccattctccatataaaaggagacattgatgtggcatgccccatgtgcctggtgtgttcatctattgactaggttaatcctcacaacaaatttatgagatctgctatggcttgtcccttttgcaaatgagggaactgggggaggaaaagggttcaaacaactcaccccagcctcccagacagctggtactaggaggttgggctctgagccacagcagtatcctgctttgctataaagtaagaggctccctactgttctgtcacctgcgacattctgagcctgtgtgtcttggctgctccttggtcactgtgccttgagcaagaatgtggctctaaatgctggccatcgggagatcacgcttggctcggttttctggtaatggctacagactggcatgaggccaactcagcccttccccattgtggctggaggattcagagatcagtgtcttctctctgccctacacaaattgggttgctcaggcccacctcctggtcttgtcatcaggggctcagctggctgttggacctgacgtacccaggctcttgtcccctagaatgagtgtctggtgacctacgtgaacaggggtgcaagggcagacagagctgtggacagctgtttctttcacacccagtgaccgctttgcttatatgcactgagaaacgtgaagttatttggcctggttttagagagatggaatgcagctgttatttatacggcgtaccaaataggaatttacactttgcatgtcatctgtaattctaccttgcccaaagtgtttcctgtctctctaaataacataccattggtaggttaggagtttgattttgaaaattcttagattgaagtctctttatatagattaaacagtaatcaaacaaaattctgtttagtgaaaccttttcaaggtacagctcctgatctgattatatgtggcgatatgacacaaacaaaattcaaattccatcaaagaatctgggcattttcctagaattaaaataggatctgacctgaatttttatatttatgcatcttgaaacccatgaatttgtggctggtatcctgaaaagattcccaaaattgtcctgtatttgaaattaaaattcattaatttgctctcaaacataattgggtttaatattaaacatgaataaattgatagctttgttcataaatgcaaaatgcctgtgtgttagctatgaaacccttattgttgcttttattccttgcagtggtggtcaaaatataaccatgatgggcagaaattttgatgtaattgacaacttaatcatttcacatgaattaaaaggaaacataaatgtaagtctccagctgctttgtaataatagttgttttcaaggatggttctattttcatcacactatgctatgttgggggtattttttgtttctgtgactttggtgttataaacttttacctatgctatcatatattctatccatgctagaatggaaataataagaccttatccttgtagctgagtatttctagttgcagcaatgaggaaagagaaatgaacttggtacgataagacctgacattttctttttatgtgatttgtggcaagtcaccctaatgaggcaatgcttatgaatatgtgtgaaaatgctccgtgaatggttaaggtgtgatataaagaattgcatttctgtgaagagtaggtggtattgttcccattgcacagagagagttgggttcacagaggttagatgacttgccaaggtcccagaaatcttgtcatgtgcttctccttctcttcgacccaatttgttccctaccatctgatgtcaccttctcttacctttcgtctccccacaggagaaatggtaggaggggtctggtttccacctttgcccgattctcccactggtgcctccagatggggatcctctagagcaggggtgtcaaccttttggcttcctgtggccacattggaagaagaattgtcttgggccacacataagatacaccaacactaacgatagctaatgagctaaaaaatggtttgtgcataatttccgtgatatccaccaccacagataagcaaaaaagtcctcacattcaaaaggctggacacggctgctctagatggaagcttctgatgccaagaggggagatgagggatttcacatacaagtcaggcctccaagtgtacttgcacacacttctaaatatccttccccattctttcttcccctttttccctctccttgatgagatatgtgaggtggctgcctctctggggccctgcctgaccacttcctgccaaggctgacacactccctcctcaggagcagtgtgggttcagacccaaattccgggggccgcctgataggccgtccttacagccttgtggtgcacacattcacctgctgacacagttcagagccacttccaagcctcacactgtatctgactccaggcctcatctccatggtgtgaacacctccagttgaatggctcgtatagtttgaccctctgagcagaggcattacctgagtttgtcacggacttgctctccctcctacttgctgttcccaaatcaagttgaattttttgagcacctactgcaggcaaaacattttgctgggtgcagggacaaaagataagtgagatagtcatattgccttcatggaggcaggcagcaaatctacattgggattgaaagttgaggctgggtgtggtggctcacgattataatcccagcactttgggaggccaaggcgggaagactgcttgaggccaggagttcgagaccagcctaggcaacatagtgagacccccatctctataaaataaaaattaaaaaagttgacagcacagagtatcatcaggttctaggtcctctggttccctaactgttcagaaaccctgtgagtccaagaagacaccatttcttttcacattaaagagaaattaaacatgcatgggattaagtacgcctgcagtatggagtggggtgggtggaagcagggaggtgagttcaggtacagaggacagagtcctcgcaggcccgtgctgggaacatcactcaatcctgcttagtgggaacctagagggtgggtctggaatgaccaagagcgatagctgtaaaactgagctggggccacaaaaagcagcgtcagactgaaaactttgcccttaattctgtaggcagcagggagccactgaagatctctgagcaggaagtgacataggtctaggtacactggactcacactggaccgagacaattagtgacaatgaaagcagtcagaaggttaccaatgggaaaagagactatgcagaaagcagtagactagggaaaggggaggattctgacccaaaaggcttcggtgtcctgtcttgagtcctgggaaaccacgagaaaagaagagagtgtccaacccccagcaggggccagctcctgaagtgcttgttgccgctgaatcactctttgttggggaacctcctgcagggcggttattattttggcaatggtgcacagctgagtttggagaggcaggaactgaagaaaggctgggagcccagtgaggatgctcatgccagtgcaggtgtgtctgagacgtccacagtctctctgggctgacagtagctccctttgggctgtggttagcagagcaggtctcaagtgctggggcatcgtgaagctagagatgaccagcttgtctttatagcagtatcgttgaagggagagtgggggtgacatcatgggagtgagagcacagaggaggaagaaaagagcacctaggactggtggcaaagcttcattttaaggaatgacagacagtaggatgggccgtgaaggtggccgagaaggtgctcagaaaccagtgaaaaagagtaaatcgcatggcgcgagtttgtcacgagtatggaactgtagagtcttgaggataatagggttgggtgatcctctcacctgcaatccttctagaaggcatcttcagtaaaaagccagcctgctaggagttaaggctgctgaggcagtagagacagtggttttcatcctgaggacagaaatgtgagcaggagattcagggctatagtttggaaagatgtgaagggaaaggaaggttgtgcttgtccaaatctcagctctttacatcatattttcccaccaattgcctcttcctattgtcttttttatgctctagtatcagggggtggcgggggtgggggaaaaatagtttttcccacctgataaatttctttttatgagttataattgcttttctgtagaatgtttgccatcctcccctaacccaccagcctcctctgcctgtccttctgtacacctaaacaggacaatatatttatgttatgtatttactaactttttaaattttattttttatatatatagagagagacagggtctcactgtgttacccaggctgatctccaactcccgggctcacgtaaccctcctccctccgtttcccacagcgctgggattacaggcgtgagccactacgcccagcctatttatgtgttgttgtttttttttaatcctgtaaatcaggccaccttttttgcattgttttcagttttcatgctcttcatttcatgggagatgcattgttccttttacttttgttttctcctgttttctgttatgcctgaaaacccttgtcctccttgtgtctagtgacttctgctaaggccctgcaggaggttcccccaacaaagggtgattcagctgcaacaagcgcttcaggagctggcccttgctgagagttggacacttttcttttctcgtggtttcccagggctcagacaggctgaccccaaggacacctaagccccttgggtcagaatcttcccctttccctagcctactgctttcagcctagtctcttttcccatggcataaccttccagctgctttcattgtcactcatgatattaatcataatattaactagcatgttttgagtgcttactgtgtgccgggccctgatctaagcatgtataatctcagttaacgtagccctcatttaatgtaatgtagggtgaagtcaatcctgtgagggaggtagttttgctgtctccatattacacatgagaaaacagaagcaccaagaagttaagttgctcaggtcacttagctcttagagatcacagctgggattcgttaacaaagttactaaaacattcttttctttttgtccaggtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaagtatgtttcttttctttctgggtgggatgtcaccccgaccccttgactggaaaggtgtgtttatgctcgtgagtttctacatgtgctctgatttctccatcttcattttgttctttacagaaagaaaatgacaacttcaacatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtaagtgacctggcagtcccacctgctgtctttacctgatttttgtgataattccttggctaaaccagaggccagaatggaatctttcatggatcttcagatcctcactttaaatagaagataaacaaagctggtactgcgagcccaagcaaaatagctccaaaatagctggctgaatccatccctgtgcctgttcgaacgtcaaagcgttggacacaccattgtctataatcctaatgagtcttgatagcttttgttctagccacacatttatacagtaggatcggcaagcaaaatctctagacccattgacaaatgagctgtcactcttttctcaaatgcggaggtgacatgtcttagcagaaacccaaaacaaacaagggcctcttcagcacactctgggtagcattagaatcagatggagaccagataatctctgggtcatgggctgcttccttcaccatgaagtcatactttctgcgattaatcttttcccagatatgtttgggggacggatcactgctatatttatatcccataataaagatgtgagaccactgagaagggaaacacattagaagtcaccctttatagtattcatgccgtatgaggctctgtacagcctatataaattcttcttgatctatcatcataaataattggataaaagacaatgcaaaagaacttcagactggaaggcaacaacaaaaatgtgttcatgtcccactggcaccagttaatagctctgtggccttaggtaaatcacttgagtttcctgagcctctcttagtccatctgtatgataaatggggttaataataagttttatttgtttttttagacagagtctcactttgttacccaggcaggagtacagtggcacgatcttggcttacagcaacctccgcttcccagttttaagcaattctcatgcctcagtcacccaagtagctgggattacaggtgcgcaccaccacacctggctagttttttctatttttagtagagacggagtttcactgtgttgggctggctggtcccaaactccttgcctcaagtgatctgcctgcctcggcctcccaaagtgctggcattacaggtgtgagctaccgcgcccagccaatagtaagttttaagtcaggaataacaactaggctgggagagacaactcaagcctataatgccagcactttgggaagccaaagcaggaggatcacttgagcctctagaagtctgggcaacacagtaagaccctgtctcaaaaaaaaataaggaacaacaactcaactcaccagtgttcccacctttcctgttagttgagaagagcaaatgctaacattcttcatcattcatgacatagctcctgagagcctacgctgtgatggggacagacagagaataaaacagacaaaaacatctgcctttatggaggttccctaaagagacacagcgtgaagaatataaataaaaattgtgttacttggtggcagttgctatggagaaaaaaagcaccagtgtgggggggtgggggggtgggaacaggagcaggtaggggggccatgctgcaggttttgcaacggtgggcagaagaggcctgcttgtgaaagtgacatctgtataaggaggagtgggaacaagccatgggctatctggggtagaacgttctaggcagagggagcagagggagcagaggtcctgaggcaggaggctgcctggcatgtttgaagagcagcaaggaggccagtgtgactggagtggagggagcagagcagaggcttctgaggttagagagttcatggagacaacaggagatgattagaaccttgtggaccatggcaagggcttggcttgtgggctgcagaaggcatgggagagttttgaggagggcgccatgagctgacttattcagatgacgtcatgaatttagtcaggacagcctaccaagaggcactcccaacatcccatttcagagatgaggaaaaagaggactggatgtgcatacctaattcagggttccatagctgagaaacagagcaggtggcagagctggtatggagagcttcagctatccgggtccaaatccatcctccagctactgtgctcagatgcctccacgggggcagcatgagtccaaggatggaaacacgccttaatacttgtatgtacatcagtgaaataattaagcttcatgtagagtttttcccttgacaagtttcacaaaatataacccaaaaaaatgctaaaactggaaaaatccctcagggatgatctgatcagcactgccaatctggtttttgccacagaatgttttattcaaaataggatgccaggtacagtggctcacacctgtaatcccagcagtttgagaggctgaggtgggaggatcgcttgagttcaggagttcgagaccagactgggcaacatagtgagaccccgtctctacaaaaaatttaaaaattagccaggtgtggtggtgtgtaccgtagccccagctacttgggaggctgaggtgggaggatcacttgagcccatgatgagttcaaggctacagtgggctatgatcacaccactgcactccaacctgggcaacagagcaagactttgtctctaaaacaaaaacaaaataagcctgcctgtaaaaatgataaaaattgagtttcttccttagaataaagggcaggcaggggcttcttgcctacaggttactactgcctctttattgccctcactcctgcaacttaaaacccccagagcaaagagggccaaaattaagactctgagggtctagtccagcatgtgtcaactgacatttcaggaaactgaggcacagtgaatattctggatttgcccaaggacacatagctaatctgccacagaaatgagagttgaactcagatatcctacccagctcactgcttctttttgtattgtgaagccattttaggggggaaattatgtaaataaatacagtccccaactcaattgggtctaatgacattctttgtcccatcaggtcaagctgggaaacctggagctctacgtcgagcaggagtcagttccttccacatggtattttctgattgtgctccctgtcttgctagtgattgtcatttttggtaagtgccctgtttaattttgtcagagaaattattccctggggcctctcgccgggcaggcagactttcagctttcaggggctgtttgcttcaattaagtataaatgggtgaaagcccaaatcaaaactttgagaaacgaataataggtacacgctgagggctttctaaacatttcttttggccaggcgtggtggctgatgcctataatcccagcactttgggacactgaggcgggcggatcgccttgaggtcaggagttcaagaccagcctggccaacatggcaaaaccccgtctctactaaaaatacaaaaattagccgggcgtgatggcaggtgcctgtaatcccagctactcaggagactgaggtaggaagaattgcttgaacccgggaggcggaggttgcagtgagccgagatcacaccactgcactccagcctgggtgacagagcaagactccatctcaaaaacaaacaaacaaaaaacaaaatttttttttaaaggatgcttcattaatagaaggctggattacacagatggtatcttgggatttgagggatataatctactttgcttctccattccttcaaattgtggtgacaaatgttcatttatgtaattccccaagaacttctctgggattttgggctcccaggacttggttatttcatcttgaccaccccccaccacccatcaccccagcctcatttcagtcttgattttctgggcagaaccacactttagaagtgtggtcatgcctgggcacagtggcacacacctgtagttccaacactttgggaggccaaggagggaggacggcataagtccaggagtttgaggttacagtgagttatgatcgtgccactgcatgccagcctggacaacagaatgaggccctgtgtctaaaaagtaaatgattttttttaatagaagtgtgatctatgtcatctcttaaagtggtcccgggcccatccacacacagtgagcccatggtggttgctcattggccaaatctggtccaccaatatattttgttttgccgtgtagcattgtctaaaactattaagtagcttataacatttaaaaattagtgattcacatttggaaacgtctcttgaaaatgtgaaagatttggatcattggatcccaaatttccatagcatcagtttattagagctgagtagcagctacgccctagagagagggaatgtgctccctaggttttgaccacagtcgccaccactccatattgtctccacctaggccatttaactcatctatgtacctgatatctgtagccatttcgtttgtgactctggttctgagctgcttgtcatttgaagtctattttctctcatccttctttgaaaaaggaactcttatccaccaacaaatagcactttggctgggcccggtggctcatgcctgtaatcccagcactttgggaggctgaggcgggtggatcacgaggtcagcagatcgagaccatcctgaccaacatggtgaaaccctgtctctactaaaaatacaaaaattagctgagtgtggtggcacgtgcctgtaatcccagctactcaggaggctgaggcaggaaaatcatttgaacccgggagctggaggttgcagtgagccgagatcgtgccactgcactcccgcctggccacagaacaagactccgtctcagaaaaaaaaaaaaaaaaaaaaaaaaaaagcactttgtatttcctgatttaacataggtattgactttctgaaatttgacagctagtacaggcagttgccagtgtctccttctatacactcatttattcactcattcatccctgcatctatttaccttatgttcattgagcacctgttatgttgctgataactgtgcaagtctctggagctagaaaaaaatgagcctttgcgtgcatgagccagtgttgctcaaactgaggcctgaggaacagtggtcccaagtgactgtcctggaaaaaggggttccatggtcaagtaagtttgggaatcactacatcatactccaccctttcttagacatgcacaatgcatgttattaagactgttgactttatgaagtagtccagtgaagagccatatttgtttcctccagcattattggtagcagagcccgtctattatgtaatttcttttttttttttgagaaagggtctcacttttttgcccaggctgagtgcagtggcacgatcacggctcactgcagccttgacctcctgggctcaagtggtcctcccacctcggcctcccaagtagctgggactccaggcatgcaccatcgcacccatctaattttctatttttttgtagagacagaaaaatatctttctctgttgcccaggctgatctcaaacccctagcctcaaggcatgctcccacctcagcctctcaaagagctggaattacagacgtaagcccccgcacctggctgtaatttctataaggaggagaagcttcctagaataacagtggttgattgttgaatacctatacttttttaaacaatacattcttaatgctttttgtgagttacttcttataatcctcccagcatcacagtgagataggcactcttacagagaaggcagccaggcacagagatgctgaggaacttaacccaggtcacatagctagtaaatggcagagcaaggacatgaacccaagcaccaaactgggttggtttatggcctctgcagcacagttagaagcaatatggaggtatgggagttccttgtggctcgctcatcatgtcaccccattagctctatgcaggtttggcccatgtagccaactgtggatctgcggttcctttctacgtttgcagcacaactttatttctccagggatgcttacaaacattcaaaaacaatggaacaatgcaagtggctgcagctgtggggaagaaacttggcttgtttcattacgtttcagccaactgggatctttggttacaagtgaaggttatttgatttagctttcacttgtaaaatgagtaaggttttggtttttttctgctgcattttggcatcttcctcttcagagtgacccctcactgggaaattttcttataagatccagctttttaatgctattttctagtttcattctagctcctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaagcgagctccggaaagagatacgtgacggtaggctccaaaattgtgtttgtagaaaaacaagccttttatatttatacttttatttttttacccttacatagagatggccacagtaatgagaactgtttgtataatagaaggcaacggaagggcagggcctgggcctggctttgtgttttatttcagctcttctctgcagccaaccaagtcattatctattgtttcttctttaatgaaaaccaaggtcatactctgtgttagacaaaacagcagaagatcctatccattgtttgttgagttaaaatattgctcttgggattctgttttgcaggctttgctgagctgcagatggataaattggatgtggttgatagttttggaactgttcccttccttgactacaaacattttgctctgagaactttcttccctgaggtaaaagagcattgatcatattccgaaggttgagtcttgaataataatgaaggtgcttgttgctgttgtcaaaacgagtgtttgcttccaaggcagctataatgtgcttggtacaaaaataatggcttaagtttgagcagagcagggaggagggtaattattaattgcattgattagggtataaaacagtgatgggtcactggtgattattctttgcccagtaacaaaaacctaggagggacagaagctcagagtgatgatttttgctttcttttactctcaatgtagaactgaatgtgtagctgggaagtgagctagtttatttaaaaatcaataaattgtgagctagccaatttgttgtgtttatctgcatgacttacattgcagtgactagattattcactattacttctcaattggaaaggaaaaatactactggtcaaaagggaggaaagtagacatggatggaattggagttgaaaacaggcatttttagccatgtagagttcttatggttctctttggtagtttttctttagctggtcagtttgtattgtcctcatttagtagacgtagatgcacgaactgattaattcatttgttctagggctctgaggagtcgtctacttaaccttttgggttgctggtcttacctatgttctcacgcctccattttctcacccactcactcagccttctccatttaccctcccaagtctttggcgaggtacactcatcctgcgtatcatcactgccatgtcctgataccccagctctgccatattgcccttcttttttgcggtatgatgaccacatagaggcccaacctcttaaacacatcaataccaatgatcacatttcaatctagacttctaagcaacggctgaaatctctccaggccaaaggagagtttgtatcaccttaccagaagcttctccggaacaattggccagaagcctagagttcagaaacccagacacatgcagtaagcaatttccagtttctctataatttagaagaggacaccatgatatgtaatgcggggtctggaggttggaatgcctccataaaacacctgccatattttttggtccaagccttagtgttataaatcaagaaggctgtaaataagacttcagctttttgtgctggtgaagtttgtttcctttaacttatcctccaagagtaccgaggcaccgagatctaccatttgccacctcatccatttctatggcagaacaccgcctggggaaaggaattcgattccccgaatcaggatgactgtgtggggcttctgcaaaggttgcatcacgagtcctatttctgagctatctgagatccccattaagaatttaaaagcaataaaataacggagatttttgactatcaacatgaatgctgtgtgggcttttacagttaatgattgcccttgagtgctgaataatctgtggcctgaaaaaagaaatgttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaactgggaaagtcataaaaattgaagtcagaagttgtttaaaggagagaacccaggaaaaaacatgcataaatttgtcagaaccctttcaagaagacctaagtcaaaactgattttataataattaagaaaagatagaacagggaaacagatcgtaagaagacaatgccacttaaatgcattccaggctgcagataagtcctggtattaattaggctctttatggattgatcagaagccgaatcctctaggcctggaggttgggggctgtgggggtaggatttgggtgttcagcacctacaaaaaagcaacaggcaaaatccagaggagattgtaggttctcaaaggaggccagggttctttgctctgcctgtcggttttggcttttaaagccttgctttttattttattgactcttctttgctttgcataaagtaggagaagaaataagggtaggcagaggatctaagctgaagaaaagggaaatttgaatgaaaggaggaagcagccttaaaactcagagagccacgggtccaggcgcggtggctcaagcctgtaatcccagcactttgggaggccgaggcgggtggatcacttgaggtcaggagttagggaccagcctggccaacatggtgaaaccccgtctgtactaaaaatacacaattagccaggcatggtggcgtgcacctgtaatcccagctactcgggaggctgaggcagagaattgcttgaacccgagatcaagaccatcctggctaacacagtgaaaccccgtctctactaaaaatacaaaaaaattagccaggcatggtggcgggcgcctgtagtcccagctactcgggaggctgaggcaggagaatggtgtgaacctgggaggcggagcttgcagtgagccgagatagcgccacactgcactccagcctgggcgacagagcgagactctgtctcaaaaaaaataataaataaataaaaagaattgcttgaacctgggaggcggaggttgcagtgagccgagatcacgccactgcactccagcctgggcgacagagggagattccgtctcaaaaaaaaataaagaattgcttgaacccgggaggcagaggttgccgtgagccgagatcgcgccactgcactcctgcccgggcgacagagcaagactccgtctcaaaaaaacaaaacaaacaaaaaaacacacagagagaaccagggcggcacttccgtatttacgattaagaatcaacctgtttctcctgtctatttacatgaagttggttcagcagaaaaatattaagaaccagaaaatgcaaacctagggtctgggggtttttttggtttgtttttttggggcttttttgctttttactaggggaggatatggccaaaatagtttcaggtcttttgcttgggcttgcagatttgaaactatgaagcaaaattctctacagaagaaatttacttcacaagatataaaattagctcaaagtttctattattatcaaaaaagaagaaaaacttgaatgttttgagtttagagtctcattctgtggacttaaagtattgcttaacatacttttaaagtttaaccattgatttttaataagattgatgatacactataaaccctttttatattccagagctacctagcatttagaaaccagtggggtgatagcattgtggtctagtttgctataaattaggaataaaaccagtaatgataactgacacagggcacttactctgcacccattttattttcacactaaacctctgaggtgggaaccattactgtccccatttcagagatgaggcaagtcagacacagagaggttaggtaacacatcccacgtcatgtgaccagtatgtgattaaaaccaggactggaacccaagtagtttggtccagattctatgcttttaactaccccctgtctttcaatatcattgtgtattgaaacagtagatgctacttaggtaagacttgtaaaacttaacaacgtaatttagtctttatctttagaaggtaaattgcttgaagaggggtctgatatttgcataatcttcatcaatgaccccttctttaactcttaaatcacttcttctaaaacgtgggatgataccttcatctaccaaacctggaactaatgccatgataattattattcttagaggctttcggaattcagtggcgtttcttgaaagctgaataattatttattatgtattagagaatacgcagccaccataaacccaggggcgcttcagattagcaaatagtgtctctactttattaaaacggacttgggtattataacaaaaatacactcttcatttcctttggatgttatgaataataaaagtgtctccttcctctcagtcaggtggcttcacccacatcttcactgaagatatgcatgtaagtctctacgttttcatttttagcccagtgactgcctgatgttcatagtgttatcatcatcactatcatctctattattattactttgaatttttattgtgggttttttttggatcatgaattcaatattgaataattcattgtcttggaaaacccattgtgggtctactttctaactttaaacttatatatgattttgtattatactatatatttttttctttttatcagaacagagacgccaacgacaagaatgaaagtctcacagctttggatgccctaatctgtaataaaagctttcttgttactgtcatccacacccttgaaaagcagaagaacttttctgtgaaggacaggtattagtccattctttgatgttttaaaagcctttaagaaaaaatcaggccgggcatggtggctcatggctgtaatcccagcattttgggaggccaaggcaggcaatcacttgaggccaggagttcaagaccagcctgaccaacacagcaaaaccttgtctctacaaaaaaaaaaaaaaagagagagaaatcaaacctgagtcccatattttatttccaaaccactatctgaacttggtatcttgagaacatgcacttttccaaaggctatttgattgggagtttatgcagccttctctccattttagatcataccaccccaacacaatttttttgttgttgttgttggagtctcactctgtggcccaggctgaagtgtgtgatcataggtcactgcagcctcatcctcctgggctcaagctaccctcctgcctcagcctccccaagtagctggaactacaggtgcatgccaccacacccagctaatgttttgttgttgttgtagtagagatggggtcttgctatattgcccaggctggtctcaaactcctgacctcaggtgatctgcctgctttagactcctaaagtgctgggattataggcgtgaaccaccatgcccggcccataaattcttaataaaaaaagcagaagtgttaatttttatttttaaaacatcccgaaactttggaagactcacatcttgttaccactctagtttaaatgctgaaaacacagaaaatgttctagagatagaagtggttagaatctaaacattaaaaaaaaaaaaaaaaaagctcccaacccaacaggccagctccctgccctgccagtgagcttccatggaaactcccatgggtgtccagctaggcctgcagccaatggttcacccagctctctttttcaacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggtaagtgtcacatccctcagcaatgtcagaggtaagacaataggcagttatttttagcggactctgatgcctttgccaggataaatcctgaatgctcgatggtgtcagcacttaaccatgtttcgtcttggtcctgacccagaacagagagagggaaagtaaacattgtttttgctgcaactggcctatgcaaatgtaattcatttagaatttcgtcaggtgagacttttcaggtgagtttaccttctcacgtcaattcacacccagagcccagtcagcccatttaagaaaatgtactgagaaaagggaatatttcaaacaccagagaacaaactgtttcaggccctctgaagcattgtagaaatacccgttgcctaccaatatgctgtaagctaattgcagtcaattcctaccagtcattccgcattaaagcagctctccaaagagctgcctccccctggagtttgctttgttggagttactgtgtgcatgtggttgtcactaattgaactttaaaatcttttcaaatgcaaactttctatagattccagtggagaagagggtgggccctaaagtctgctacttgatctgaatctagacttcaccacttacttggttttataaactagagaattggaagaagattttaggactattttgaagtacagatgagaaaacataggcaattgcttagccctaaggaagcctccataaatgttggccgttacgattataaaatattaatgtgaaaataagggtgtcctgttgaactcgatcttcacccagccctctgaggcccctggtacagaagattcttatcctttaattttaccagccatccagatttcagcaaaactgcataattgtgtatttgtagctagttccgaaatctaattaaactttgaataagatacactgctatgccacaggttttaacagtgctacttaagtttagatccaacagcagtgctttaaatagactgtgcttagtttaatgtttaatgcaatcttacaagtagatgcacaacaattttttttttaatttctcaccaacccctccctctccctaaggcaatacccatttattaagattaatgaaatctgccttcttttctgtttacttggtataaatcatcggaggctttggggagatgttgagccagttatttctgggacgaatatttttttgtttcccactgtctttgctttagccacaacagctgctagatggaggcaccaggactctcacccagttccctggtcttggtcttcaaaggccaactcctgccccaccacagtctcactggatcagaagctccggaagtggagcccagtaatccatgattttcacaagtccctgggatagtagagagagcaccacactaggggtcttggttagaagcagcaggtctgggctctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgttcagaaaatctgggctgcgagcccaaacagcctccttgagcaaagcattctgggtcaagacttcacagtgctgattcaagagcgtctcgagcactctgagtggtgagggggcggctcggctcgccaggaggaagtggcatccagccagtcggcgatactttcactttcagtggaataattcccgctggtgcaggggtctgatgtccctccaccaggtgctcaagggggtctgggacaccgacagccctagtcctcctgtcctaccccacagacgtttagtgggtgacagtagctccgtgaccgccaggtaactttcccttccaagacaccaaggatttgtgggtaaaataataataccatttattgaatgtgccagacagcatgctaagagctttacctatcttttctcatttcatccccttaagggtcctgtgagctaagtgtcttcatgaccattttgtatatgggggaactggaacacagaagagctgtgactctccccagatctcactgctactgtgggacagcaccagggtccgagagctcttagccaccgccctgtgccctgaaaagatggaatctgccctggtctgttaaagtgtcgaagcctggcccctgggggaggggaatcacgtacgcagcggctgtggctcgcctaaaagttgtgtttagtggtgacagagaaacctcatggccctgtgattccccaaatcagccacacatcagaatcctcctcccccaccgcctccccgcccccggccccgggaaggtaatgaaaactacagatacccaggcctcattcttcagagagatggcagctctgtaggtctagagtggagctcaggcatctgaatgcttaacaagagcccgcaagggattctggtgattagccagggttagacccaggagcatgggcagagtgtagggccagatgttacttagctcagtctagctactctccagaaagttctggagaattcctgaccacaggcctcctgagtcaagacctgtcccttcacacagcccccgagagcccacctggccccctgactccaacccctgcgggagtacacagcccctatccaagggttctcagcctcccttctgatctgtgctggaggaaaagaggttctaagttttgtggtcagggcattacttggggtgggggaggtgggcggtggagggaaagagaagagaagggtgaggttgtaaaccactaaataaaggaagtttctcatgagaattaaatgtcatgcactagtcctgctgccctccctaccttggaaatttctgaacttccacttctgccctgcactgaagaggagactcaaggaggtatcacagcagggatagaagctgcagggtggcaggaggtggcaagaggaagcccggggactggggagggcagatattcctgcagcaagtataaaggaagggacagggttggggtgggatgctgagagacttaagatgtcttaggtaacttgcctgcgcaagggaaagcaggtgagacccagtggaatcctcctttcccagctggacgtatcgcttgtcaagcttgactcttaactggcgcttcgagccccagccacgtggctggcctttcgtcatcactaaggcactttgacttcccagccacggttcttcctccaccacagaggcctaatgtccattgattacggaaggttcgttatttagcaaatactctacagctgacccagggctaagtgccttgggaggatgccgtggaaacagaacacaccgcctcccacttgaggtgctcagagtcctttggaatgcagacatccgtgtctgcgaatgtgagccatttccatcacagcaggggaggcagccccacccccagccaggaaaaatgcatgtggcttaaatttgtagaaagagccaatcgggatgggccgagtgtttggagaaaaaccttagaggaaatggaattggctctggttcagggaagaagatggagtccctctggcccagcaccggaaaacatgtccaggtgggactgtgcagtgtgtgtctgggaactgcccgggccgggcctggcctggcccatggagaggagataaggctgcaaactgttgaacggcaggctgcttccttcgagaagtgctgttaacaccaaaaaacattgtatttggcaaatgtataaaatgttcttacatttatccttgttactaaggatacttgtgcatttttttaaatgtcgtttatttctggcttgctaaagggtgattaaatacgaatgtaaacaaaggtacactctccacatctaactgttcctaggcattaacccactgatgagcattagtctgccatatgtaagtttaaacataaaataacaaggtatactgtgggtactgcacgtcgctgtgaatgtgcacgcgtgcgcgtgtgcagatgtgcattcgcgatggagagaggaggcggttttctgagttttgcatccaatcccaagtggagcaacgtgtattttcttgggcgtttcatgttgagtgttagaaaaccctgtctcctgccttactgctgtaaacagaaactttaattctttggaaagtacagtggattccacagaaagctaactgtcacttttgtgtcttttccaaggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggtatgttttcaataaagctcccagccagactcccaaataaatctggcggggaattagagggtgaggtgggtcatttacaatgaaacggtatcatctctactgcgggaggccctgtgtgtttagttaattaaaaacagtagttgataaaactgttaacacgtgttcacataatagattttaattactgagattgggggagaaaatattgtaatgatgcctggggtactcatcaatttccaaagattttaatatcaggattgcttataactttcagtgtcgtcaaaggaaatgcaaagtactccctattcagcacttataattgcaatcagaatttctcaaatggctctgctctgggaagacaatgtgtgaagatatatttcaatcaaattgaggccgtcttattttagaatgataacacaagacaaattccaccacgttccccatgcaacgtgacgccctttattttcatggattagttacaaatgtttggtgtcatgcacttaatgtactgtgatctcatagatatttttagaggaacgctgtaaatcactacaggaagatgattgcctagctgctggagggtttcacccgcttgagaacttctttctaattcatccccaccgcacccaccccatgctcttcctaaagaaagaaagaaagcccagtttggggcacatttgggaatttcagagagggagccaagcagggaaggtaactttagaattaggaattttctatgcttttctgttagtagagacttggagaagagattgctgtgttttggtttgatctttagctttatgaagattctgggcttcttcacgatctcgttagtggaggaggaaaagattacagtggggtttgggaattgctcattaagagagctgagtcttctgtggctttgctctggatggtggggactgcagtgtcatctgggaagaattcattccctaattggagaaggcaccactttgccgtggagcgtgttatggttatgtcctctggtgggagaatagtccgtaggtcagctgtttcaagttttctgccactgccagatgcggctcacttctccatcaaagatggcaccatgcacagctgccatccgagagcgggaagctgagctgaaagtcaacacttctcagcgttctgaattgtatcaatacacccatccacatctgagaggccggagagtgggctgcattggttctcaaacttgagcatctagcagaatcgcccagaaagctcactaaacaccagtcgctaggcagcatgctggagtttccgatgcagtaaatccaggctgtggcctgagaattcacttccctaaccagcttcctgatgctgcgggtgctgcttaacaactgttggtagagtggttaacagcatggactctggggccagacattttggaatcctgcctctgccactggttagctgtgtaatgttgggcaagtttctaaacctctctatgcctcattctcctcacatgtgaaatggaaatgatggtcatggttcctacccatctcatgaggtgttttgaggattaagagtcagtattataaaaagcacttagaacattgccaggcatgtgagtgctacctaaaactttattccatttgatccagatctcattgaacccttgtttaaaatgcaggtgcaaatataccagtgcccgggctttccctcgggactgactgaatcagaatctctggggagggagcccaggcgtggatgtattttgtaaaccttccagatatctctgatgtgtgttcagcctggacaccactgggtatcttggagaacaagagacaaactttgcacagggcctgttgactcacctttcgctgatcctgggcttgttattcctaacctagaagatgttcatgcctttactttaagacgttttagaagccccaaaggtctccaaagagaaatatttgcaaatgattatagtcgggaatcctccagcatttcagtcatgagacaacaccggacccaaacaggaaagacaggaaaggagaagatgggttggaatcaggaagaggtcagatgtctgaggcaacttttgaggttttgaagcctttttaatgctttacatctgaacgtgttttctccctttcatttcgaaacattatttatttcacagtcaattaagaccatgtgtttctgatttgttaacactcgactcatcatcataatgttacttgatgctgaaggaattcatgtcgactcttgaaatttttttttctttatagcccctggggaaaagggtaatggaaaatcatgatttcagaaatccacataaatcttccttttcaaattcagatttgccggtacataagatttgagccttgaaaaggaatgggccacttgtttttaggggccttgcctttaaaaatgattgttagtgcctcttatggggcctggcccagcccccctttcatggttggcagttgtacgagaagctgcagagaaggcacatgatccgttctatgcttgtgtgacaaactgttagcagaaggtcaatataaaaaatttaagtttttcatttcctttcaggcatttcccccagcctgaaccaccatatttctaattttctttcttcctcccttccctcctccccttctttttcacttcccccacctacccctcccaagcatgtacacccagccattttaggacttgatttcccaaatttgcctgaggtggtttatgtaattgaaaaccaaggtgcggtgaacaaactgattctgtgtgtccttgtgtgctggggaggtgggaggttgggggcagattctttcaaggaaaggaaagtcggaaatcaagagcatcctcacgaaccacttgaaatgacagaacctggtgccaaggcagggacacgtttggaaaaaaggcccccacactcgtgttcagctaaatgctcagaagcacagcacctcatatagcaatctaaaagttagctttcacacctctcagatgaggatgtgttctccctgaggtgtgggggattttctagaacataaaggcatcttgccaatttcttatacatgaaatcatgacactaacaaagaggccctgggaagtaatgttctcttcttgcatattgagaagaaaattcctctgtcttgccaaaaatccaagcaaagtcccctagagccatacttcctccaggaccataagaaaccatccttctctatcaagcattccaggctggtgtttaatgaggcaacagtgagacagaatgccctgatatctgcatcctccctaatgtcagcaccaggggtagggctgtgcacacacaggactttagtctttccttaatatctaggaattcagatcagacagctggaagagaataagaccttttttttttttttttttttttttaatttaaggaataccactctagtgcaggctggagtgcagtggcgcagtcttggctcactgcaacctccgcctctggggttcaagcgattctcctgcctcagcctcccaaatacctgggattataggcacctgccatcatgccaggctaatgcttgtatttttagtagaaacgggttttcgccgtgttggctagcctggtcttgaactcctggcctcaagtgatccacctgccttgtcctcccgaagtgctgggattacaggtgtgagcaactgcatccggccgataataagacctattgctctgctgggtttttttcccctttgcaaaattttgaacatgtttgattttgttgatggagtatctcagactcactcagcttacgttttgtcaagagtggaactttggaggagttagtgaaagtttgaggatttcacatgggagaagggacatttgcttcactttcaggaagagatgagaaaaaccaataactcgtagcaagcgtgctgaattagcaagagaaggttgacttgtaatcaaagttaagtgtgaaatggttttttgaactcttagaaaacgagcttgccaatctgctgtatctgagagagagcatcttggcaccctggaaaactgttccgacaaaaatattattgccttcattctcctatctataagaaagttttcaagattattagaaattcttgaaaaagcacaagtacatgcctgcagaaatattaatgcctccaatttgatttattgaaggtttatgccagcctaccccagtctgtctctttctctagcagttaccattttgggacaattacgtttaataaaatatctcatatacaacagagccctaggtgtctccaccaggagtttcttactagtatacttcctttaacagtgctctgcctaccagtgctggctgcttctgttccatttagtttgtccttgcagaagatccattagccccgtaattaaacaacccactgtcccgattaagtcattctctgttacttcaattacattccattgttcattaaatcctgatgtttgcacttcagcaatcttgtttttaatactcctaccatttgtggagaaacagtgaagttaattaacaattcttgagctttttatttttctctctaccatagtgcaaatcatttccattatgacttgcaatagtactgaaaccattactaacttcatagttagtgttctgagcttcctgatcaaagagtgaaaccactttttacaatcattttaggtaagtcattccctcgttgatggcaagtcatggaaaatgaaaaattaacatgtaatgggtgctttaaatgactttcctcttcatacactttcttctcatgcctgtaatcttggaattagaaaataatttagttatctaaatataaaagtatttactttttttctttatagctcaaatgtgactctattatgttattgttaggatcattatttatatttgtacccctcagagaatggtaaattttatcacaagtcatggcggagatagaaagcattttccagatttgtcttgttgctattgtcaaagttagcattccatttgaaggtactgttatctagagcagggaccagcaaacaacagcctgtgggccaaatgtggcccctctgcctatttttataaagttctattggaacacctgttcatttccttattgtctatagctgctttcctgctacagtgcagagtggagtagttgtcacagagatcatatgagttttaagtcttaaatactttctggccctttgcagaaagtttgttggcctttaatctagagcttgacatagtagagaataggaaccagaatcctccctcccacaaacccacaaacaggttggcctctttcctccccttctgggacacagcaatggaaatgccttgccactatttacaagtctgaaactcatggggctctttgccaacacacaacacccacccccacccccaaccctgcacccgcaaatactgtgaatactaaaatcagttatcttgggctaaatcagacagctcttcatacttgattctaggatggacaaaacgttagcaaatgctagcaagtatagaaaaattggtgagagaaacctaaatttgagaaaattatctccattacttttttttttttttaaatggaaaaaggctctcgttaccctgtcctccaccccttactcttctgttagagtagcagatcccttgatccaggaagctgtgatttatggatctttgtggggaaaggaaaaggggagcagagtgaagaggggaggctggatgggcaagcgcagctcaaaggggaacgtcaggcagaatgtcccagggctgctgactctggcttggaaagaagcttagatcagaagtttccctcagacttgcacttctaactggcctcatgctgcttctacggaacttctgaaactgaattttctttcttgtttcttctctctttaattcaggttggtataagaactaggcttttctcttgactttcattcggccctgaaataaaattagaaatatattttataggttttatttaatgaaagcaattattgctccaaggccttttatgataaagttgccagtttgtaataaattatcttacagttactttctaggcattataaggtatcacagaaaggaggcagcaacgttcctgcttttattagccaagaatatggttgaggagacagtgaggtagccagatcatcttcccatgtgggaaaagacctgttcccctgcccttgattcatcctgccagccccctgcagccttatcctctctgcctcctcaatacccaaaaccaccaaatcatgtgacgggacgatgggtaaaaccggtagtgaaaggggaatgcagttacatgttcccaggccgtgtgcagaagaggtggggtttggagtctgatagtcttgggtttgaatctgggctcagccactttactctgggcaagtctctcaacctctcaaaacctgtttcctcttctgtaaacaggcaatgaccaaaacctgccctcgcatatttgtggtgaggtcagaaaataatacatgtaccacgtctagccatctttcctggtgtgaagtaggtgctcattcttttttgattcagttttccttgtctgaggtgtgcttttctcttgtctcctgtaagcttcactaagcagaaagtgtcccgtcagtattctttttggttggttatttattgatgatgtgggatgtgggggagttgattagctgattccatcatcatgaaaagcatttcttgggtgcctgtgtgcttatgttcttgttaaaaatgttacatatgaccgctgtgatggggtgtttacaacctgtggcagacagtatcccattgggcagatgtgaacaggagacgaccgtgataacctgtgagaggctgatggctgacatgctacaaaggggccaggcctttccagcctggccctcttcccgggccttctggaccatacattttccaatagtcttttctttctcataaccctccttggtaataggcatcattcccaaatcaatcaggatgcagttcagttgtacagaacagagacccaagatgtctgtggcttcagcaacagagaagctgagttctctccctggtggcattctgggtgggcagtgcagggctggtagagcagctgctcctctcttgtcctcatattctaagtgtctgctcaccccagcctcattccccatcccagccagcaggatgtaagcagggctgtagaaaggagggcagatggtcaccagccatcttttaaggaagtgccacataacatatccacttaatgtcatcggccaggacttagtcataaccagaacatgtcctgactctgagctgcgaagccaagaggccagctctgggtcaccatctcccagtgcctcctggccctgccatcctagtcacaagatggctgccaccgctccaagcactactctcccttttgttcggatcgaagacttcccactgggcatggtggctcacacctgtaatcccagcactttggaggccaaggtgggaggatcatttgagcccactgaatctggagcatactggccacacctggcagcagcagaggctgggaaatgtcacctttattctgggtgaacagaagctctgtaaaaatgtccttgggtggcaccggaggcacagggtgctccagattcagtgggttctgtggggttcaatatcaagctggggtgaggaggtcaagcctcctctaccagatcgcctatgtccagcctgtctcctgggagggcattcattgaggccttcaagcagaggggaactgcccttgggaggctcatcaccttggctggcctcttcgcttcgcagcccagagtcaggacacgtcctagttatgactcccaccggctccatgattttggacatgcttctaaatctctctggtctcggtttcctcatccattaaatgaggctaataatggcacctacttcatagagcagttgtgaggattgaatgaacctataattgcattcccagtacgtgataagcactcaataaatgctggtccttattattacaaatctagaaccatattcttttctttaccatatttttttcctatgaatagtacagggactctctttcaggtggcaggaggtggttttgggaggcaggcctgggctacaagtcctccacccatacttccacccaaagaaggtgggatttttttctgtagacttcctgacctgatagcctgagtgagtgattgaagcttcctgctcaccagtctaattagagactggaagccaagtgtctccatggtctaggggcctccctcatgaactacagctctttgcgacccaattcaaatgctgcctcctccatgcagccttccttgatttctctgtttgaaaaccccctgccgacctaaaagaggtacctctctaaatccctaaaatgctccgtctgtacctcccacattctacctggcattagaatgtgttgtatatgccccacagttcttctactagtctgctagtacttcccaagcaggatgagtacaggttctgatttgtatcacctacagtgccctgcacacaataggtgcaaagtaaatggtcatcaatagacgaatctacctcagcatccacaaaatgagctctggcagtttggcacatgcagctataagtaagagaaaattgaactaaggatgcctgaaatagtaagagcatgacttgcctcttagagcagaaagtctggagggaaggagctccaagccggtccctacattccgtggtgtcagagctctgcgtcaccatctcccagtacctcctggccctgccatcctagtcacaagatggctgccaccgctccaagcgctactcccccttttgtttggatagaagacttccaacagggtgtggtggctcacacctgtaatcccagcactttgggaagccaaggtgggaggatcacttgagctcaggagttcaagactagcctgggcaacacagcaagaccctgtctctaaaaaaaaaaaaaaaaaaaaaaaaaaaaaaaatttagccaagcatggcagtgtgcacctgtagtctctgctatgtgggaggctgaggtgggaggattgcctgagcctgggaggtcgaggctgcagtaagccatgatcactgcacttcagcctgggcaacagagtgagaccctgtctattaaaaaagaaagaaagaaaacccttggttttatgtgttggccagagctgggttacatgaccagtccctggtgaaagagaagggagttgctgctgatcatgcctcccaacccaggctggacccactgctgtgcagacctggcctttgttagcagaggagggatggctgctggttggacgacaaaccagatctgccaccgcagcttactgacactttcctgccaaggaaataggaagaggcagggcagtccctctaaacagagggcagatttctggggaagggaccagtgtacatttcacagctctttagcctttcatgggtattttctgggtattatgccatcccatcgatttggaccatgcttactttacaaaacattcttgtacttccaaaggcaggatcaccgagtgtttaagaacacggagcttgagtacccggttctaccatcttcttgctggctgaccttgtgccatttatttaacctctctgtgcctcagtttctcatctgccacaaggggatgagtaaaagaatctacctcacagggttgtttctgagatttacatatacaaatacacacacgtcatttaaaacagtgtctggcacctataaagcactccttaatttgctattattatgtgtcattatttagtgatcctgtcactcctttgagataggaacagtgaggattttaaggctcagcgaagttagacgacttccctacattccctcagctggtgagcagcagagaatgggagggtccaggtggcccggtgctgggcctggaactcagggccctgacccccactgtcctccctactcagaatcctctgtggacacttgctgagggtgatagtcactgatgggtgactgttgtcccacagatgatgcttttgtctctgaaatttatcatgaattatctgagaacaaggactatgtcataacatctctctgacatcccagccctaatactaaatagggcaggagaacatgctggttaaatgggctttggtgggagtgtgggagccggagagatggcgcttccatcgaggtgtctcccccgatggggtacagtggctgagggcagacgctgtgatgtcacgctgtctgacatggcacaggcatctgctccccatcacagagcagaggcccgcgtgcactttcccagcctgggggtggaggtgttaagaggctgaccccaagggccttgactgtacttacgccttaagaaactgctgtttggccgggcgcggtggctcacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaaactgctgtttgagcactaagtgttagcagcatgaaaaatgaacacatatcaatttatgtctgaatttactctcagaattccctgtggactctgtaaaatgccattttacctcttttccacccatccagctgtggaggcagtggcagatttacattattttacatccagttaagggtgttttttcttttggttatgtttttaaaaagaacatttattgcccataaaaaagtgtttttgttaaagacaatagtgcctttaggtagtaatagaatgctgtttcacaaatatttataaaactattaaacaagctgagattgctgaagctccgattaaaaggtgcctcccattcatctttccctttagaaactgaagtagcttaactgcaattacccgccaccatgagaagatcaccttgcagagaaataaggcaagaccccaacaagatcgtaggtggtggcaccagcattgaccccttcacacccacccctcccactggtgtggggaatttagcttaggacattgcttacagcctgagctaagccagggtttctggagggtcaggagggctcctgggctataggtggaaccagaaggagggagggagggcgggtggtaaagcggggatggcatagccgaggggtttgtggcaccaattgtgcagttaggcaaatctggcttcaattcctggttctgccactggtgagctgttcctggagcaagttactcagcccctctgtgcctcagttccctcactctacaacagggatgggaataataatccaggaaacatttctagaaaagggaggtgaggagagggctcgggtgtgaggcttcacatgttggttccttctaggcactctgcccaccagctccctgccttctctcctgtctggtattttttgtttcttgtttgtgagcagacaggcctttgaaccccttcctagtcggtggctggcccagaacataaaggttctctgagagcaggcaagggagtgactctgttgtaggagggaaactcgtacaggccagacggagatcaccggcttacctcagagttcagattccactgattcggagttttaatcatttggttgagaccagaacaaaatttactcttgcgtaattatcaacaggattataagggcaagatttagtggtgtttgtctcagctctttataaacaccataaactgggtggcttataaataatagaaacttatttctcacagttctggaggatgagaagtccaagatcaagagttggtgtcctgtgagagccccctttctcatgatggcgccttcctgctgggtcctcacatggtggaaagggcagggcagctctctgaggcctcttttataagggcactaatcccatttatgaggactctgccctcatgatctaatcccctccaaaggccccacctccaagtaccatcaccttgggggttaggatttcaatacctggagttagggggacatcaatattcagatcatagcagcattaaagacaagaaacacccctgagaacctcccgaaatttcagaagccccacatccacgtcagtggtccataagtcacgggctcacatgccagatgctgttctaagaactgtgcggttactgttgttatgccctctttgcagatgagaaagcgacatacacagaggttacacagctggttagggatgggttcagaggtcacccagctggcttgcggtggactgggatgaaagccaggagtctactggcttccactgggttcattgctggcagcctcctccttattcagagatactgagcatggagtgggcgtcctagctgtccaatgtgggctgaatctgtttgcaaatgagtggatactaatgccaacaatagtaattgtacaggttttattgccgatactatcatcaagcctttcccagcagcctggccccgtgctaagcccttgaatgcatgatcacatttaatctccctaacaatgctagaaggccggtactgttattacacccatttttaagttgaggtaggcctgagggttcccatcttccatatgatttgtgttttcatctctcccctgagccctaggcaaatcagacattgcctcctgcagcctctgcatatatacctggctagtgtccacagtacttggggacctcctctttcggctttggagccccccctccctctgtctctgtatgggcgagcatcttccttctgtcttctcccttccttcttgcctgttagactctccgctccttaaaaccaaaaaaaacaaaacaaaattcccattacttgatcattttacattccctcgttaagccaggctcaaaacattaaataattgtgcatttcacaccatacccaagcctttctgactttgtgattaccaaggtgcattagaatctaaactgctatgttatgctatttgcaaaatactcttggctcttccctgaatcaattcccgtgagggtacgtatcaggtaaaactttgttgttttagatctatttgttcttagacaaagtaaacttggaattgcttttcagtttgttttgaaatattccctagttctgtgttttcacacgtgcacaaaggccttacttcccccattagtctgattctgaagttttgctgcactaggagaatgttcactgacaaaatgttaagtaatggtgctgaaatgtaaagtaattaatgcaagaatcatagtatggggtggggatctcagtgctttaatgagggctggggaaaccatctgactgaggatgttgaaagcggaggggtagatgaatgttcctgtaattaatgctgcatattaaaaaagtgacctctttgggccgggcacagtggctcacgcctgtaatcctagcactttgggaggctgaggtgggcagatcacaaggtcaggactttgagaccagcctggccaacatggtgaaaccccgtctctactaaaaaaatacaaaaattagccaggcatggtggcatgtgcctgtaatcccagctacttgggaggctgaggcaggagaattgcttgaacccaggaggcggaggttgcagtgagccaagatagcaccattgaactccagcctgggtgacagagcaagactccatctcaaaaaaaaaagtgacctctggcatggtcaatatggggacctcgtaaccttccctgtcacctagaactgcacttctgggactctgtggtcctattaataaaaaagataatcaccagtctgcctcatctactgtggaacccttccaattcttttttttctttttcttttgaggagaaattagaaatcaccaaattaccatttttagactatttatgtgtatatgtatattttactctcagatatatttattcaatgcttgctctataatgagagttttaactttctgttttcccttccattatccctgaaaagaatggattatggagaaaagatgaaagtagtctaatgcaatacagtgtttgctaatgtgctgtcagaggtattagtgggacttgctaaggtttgtgtcttttatgaaatgcctttcagattgcaattatctaatagacttggaaacctgtttgtactcttgcaggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttggtaaggcggtgcgggagctatgtggtcccaggccctgatgagtgtccctccctgcctgccctccctccctgtcccccctccctgcccccaccagcttccattcagtgacacttacacagccaggttgttcctggagggcatgtctaggggccaagagactgctttggtctctcatgggcatcctgattcttcgaaggaagcacggtccttcaaagatggcgtttgttgttgttgtctttaaatattacgtctgtaaatcagattgatgagattgcaggccctgagactgcacggaatcaccttgcatcatgaaatacagaaaggtgtcaacacagtgccctctgcgtgtgttgcatttcacattggcatttgatttgtttgttgtgatactgagcgtgtcattactgggtggctcagactctgggtgttaactctagcctgctagaaaggtcatcttcctctgctaatcacatcctgtattaagtatatgctccgtcctccctcagtgtgcagcagcatctgctatgaattcattttcgggctctactggtatactgcaaaggagagcatatgcgtgagcaagctaacagggccccacttccctcaaatgttcatcaacattttaaagttgagctccgtgcagtcctcccaggagactgtcgtgggattttatagcagataatgggacagaaatgaagaatagaatcatggtggtgacagacagtgtaacgaggttcacttccccttgatgtacagttataggccttgactaagcaggcaattaaaatcctcccactcggccctcccagtccagccccctgctaaaaggccattgataaagccttgaggcagggtcttggaagtttgagaccatgcaaatgtggggcaacttggtgatgtggctttaaagaaagcagggctgctaaggcacccctcttctgcttccttccttgggtgaccgttgagtcacttgaggaccattttagctcatttggttagatacaggatcaaagggggagccccagccaggacaccatgaccctgaccccagacccccagcttccttgctctgagcatacatcttgcaaatatgtggctgtcactacaaaggacatgggcataccccgcccgacagtcttggtcctgccgctgatgagtaggtagtagcatccttactcttttcctgagtttgggtgtcccttgcctcctaaagtaggaaggcaaggagcagagcaaggagggggcctggggacacagcctatcagctatgtcaggcttctgtgtgcctgctgatttcccagactacctccagaaaccagccatcaactgtactgaaatccaacaccaggctggacgtggtggctcacgcctgtaatcccagcactttgagaggccaaggctggtggatcacctgaagtcaggagtttgagaccagcctggccaacatggtgaaactctgtctctactacaaatacaaaaattagccaggcatggtggtgcacacctgtggtcccagctacttgggaggctgaggcagaagaactgcttgaacccgggaggcagaggttgcagtgagcccagattgcgccactgtactccagcctgggcaatggagggagaccctgtctccaaaaaaaacaaaaacaaaaccaaaaaaaagaaatccaacaccagaagcagctatgcttggagctcttacagcagagactcaaaaacgcagatgcccaaaggggcagaaaatacataaggggtgtcagccgcctgggactacagaaagcagtggagcttgacttaatgggaaaggactcgccatccaaggggacagtgccatttgcttcagtggttgccatgtggactacagattgtattactagactgttcgattttctttttttaaagaaatcagatatccagttttttatatgcaacttaaaaacttttaaaaaaaattttatagagacaagtctcactatgttgcccaggctggtcttgaactcctagcctcaagtaatccccctgcctccgcctcccaaagtattgggattataggtctgagctcctatgtccagcctatgtgcaatcttttaatctttaaatgttggcactgagttgacactaaaataataattaaacaccatgcaggttccaaaaaaagaaaaatcacatttgtgcaccacatgctcacctaggcataggttagcagccttggccagagagtctgcccactgtggtgctgggaccttcgcacactgatgcctccccctccaccccgaacaggagcctacagagatggttcatatcatgcctctctttgtgaacatgggcacacaagtgtgagcatatacaaatttgcttctggaatttttgttgaagagcttagtcgtccctcatagaatgcattattttgtcttcagtggctttacttccaggcttatcagggaagaagtggtttgaaacatcagagccctaaacaaacaaacaaagtaaaacagaactcagaattcaggctaccagtctggctgatgcatctctacaccttcaaacaaagatttaccactttattcaagttttagttatccataaatttgtgaaagtaaagtggtggcattttaaaactctctaaaaaggaacaaaatgctctttttcagagcttcaaatgggcacacgacagaaagaacttctggacatcgacagttcctccgtgattcttgaagatggaatcaccaagctaaacaccattggccactatgaggtaagagcaagacttgaccccgtgtctccttcctcatccccaatcctagtcccatggacattcttttaaaacatccaggactcccacccatttcctggaatgacttgcagatcgatcgtgtctggggctgaagttttctttcgttgcttgtgcagacaagcccatgaagggctctcacagtgtacttgtcacgtattcccttctcagaaggctatgattttctatctcctgaactctctccaccctgaggttcagcagaaaagaacccaggaaaaaagtctaggaaagccagagaagagttatcctttagccttcactgggtgacaagcgtgctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtgacttctcagagatctgagtgccagagaaacctgcacataacaagacagaggaggcagtgaaggttcctgaacacactgggatactggggttcacttgtttagcagtattatctgaatctttgttgaatatccactctgataagagctggggctgcatgggagaggagcaaagaccaggtccctgccctcacagagcctgcagccctggggaaggagtgcaaaaaaggacggagagacaagtagagtcaacaccttgcgtgtagtagtgctgtgtggcttggagaatccaagaggcttcctggaggaggttatgactgaactgagagctaaacaatgagaatttagccagactgggctagggtgcaggcacatccagcagggaagggagagcatgcgtgttagactagtcaaaacttgagaggggcaatggagagggggaaggagggcagtgacagctgattatagtcagtgcttatgaagtacttacaccacaccaggtactatttccagcatgtccctgtaatgtaactgcccaacaggttcaccttccccattgcctagacagagctgatttatcaagacaggaattgagataaagtaatttggctgtacgggagacgggagttttattattactcaaatcagtctccctgagcgttcagggatgagagtttttaaggacaacttggtgggttgggggaagccagtgagccaggagtgctgattggtcaggtcagagatgaaatcataggaagtcaaagctgtcttcttgcactgagtcagttcctggggtgggggccacaagatcagatgagccagtttattaatctgggtggtaccagctgatccatcaagagcagggtctgggccaggcgtggtggctcacgcctgtaatcccagcacttcgggaggctgaggtgggtggatcacctgaggtcaggagtccaacaccagcctggccaacacggtaaaacgctgtctctaaaaatacaaaaaaattagccgggcatggtggtgcacatctgtaatcccagctacttgggaggctgaggcaggagaattgcttgaacccgggaggcggaggttgcagtgagctgagatggtgccatggcactccagcctgtgcgacagagcaagactccatgtcaggggaaaaaaaaaaaaaaaaaaaaagcagggtttgcaaaatatctcaagcactggtcttaggttttacaatagtgattttatccccaggagcaatttggggagagtcagaatcttgtagcctccagctgcatgattcctaaaccacaatcccaatcttgtggctaatttgttagtcctatgaaggcaatctagtccccaggcaagaaggtggttttgggaaagggctgttgttgtctttgttttaaactgtaagttcctcccaaagttagttcagtctacatccagaaatgagcaagagcagcttggaggttagaagcaagatggagttggttaggtcagatctcttcactgtcttctaacacatctgcttcaccgtcttataacagtgaaaggcatctgaaaggtttgtttcagatgtttttcactgttcacctttcagatgtctttcactgttatagttttgcaatggcgatttcagtatttcgccccattctatcctatagcagtcctacgagataggtactattattaaccccactttatagatgggtacgatgaggctctgggaggtctggtaacagctagtcagtggcagggccagattcggacctggatagttggctgtagggtctgtggctgaaccagtccatgctgtggcctcttacaagatgtaggggtagggaggcaagcagggaagatgcagatcacacagatgggggcagcctcttcaggagttctgagtcttatcccaagaacagtgggaagccatgggaggtcctgaagcagggaggttagtatttcagaaaatgagtggggctgtgtgtgagatgtagatagaaggggtgcaaacctggaaatagccccattagaagctgtggatttctggtgaggattggtgctgtccagcaataatgcagtggctctggacagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctgtttttcatggctgtacagtcccagggtgacaggtctgcaccaggaaggacctaggactctgccagattctccccttgcccaggaagaagtgagactgttcccgagcagagcttcttagacaatggccagggacagagaacacccatccttgggctttttggctgagtgggtcacccagtttgaaagtggttgcgttgggtgatgactgaggtgctgcccctgtggcattgctgtagggagtctagcagagaaagctgcaggctagcaacttgccccgtgctcactctcctatagctcagacttgccaaccctggaatcatcttgccaagagcagtcgttcttagcttttggagtttgtaaaaatccccagggagttttctaaaagtgtgcattcttgggctcaggaataaggggcatctttggctgtatttggaaaaacacggccccagagggaaggtaatggccaggaggagatcggagtcagagatgctgccctgctgggtggaagtgcttatcatggcatcagttcagggttctagacctgcaagccagcacctctccctgtgtctgggtggcaggcttgtcttgatgagttaggaggggacacagactccaaggccctcctctggtgctgttgactggagttcttgtcttgctcagctgtgcctcccctgccaggcttctcagcatcccttggccactgtggggcatggggtgggccgcagaggcaggggatggggctacccactgccattaataggaggaggcagggcaagtctctccagcagggagaatgaagaaccaccacagctgtctgcaaggcaaggtgaaggcctgtcgggagagatagaacatcagtcttcactgcagacatcggccgtgctagacacctatctgcttaaggatgataatgaaattaatccggcctgtagtcacttcccgtccaaatgatttattggcctcataccccagtgttgctgcatggtggtaataaatgacaagcctaggacatgaaggcttaaaggattctccttatgtttaaaaagctaagccataaggcaaataaaccagagagcctgaaggaaacgggaggtcattgggctccatgttctctatgcctggaccatctcaaaagccctgttttttaaaggctgcttggagaaaatcatcccccaccaccctcagccacctacatctatatttgattaagcagcgcctccgcagactcaacatttgggagtaatttgacagggctgggctgaagtttgcttttacccttttgttaaagaaaaaattttctcttgagcactagcatttccctccaaagagacaagatgctaattatcactcttattcatttactaaagcaccctagtttgagtcactgtatgtgcttaaaagcaaaaaaaaaaaaaaaaaaaaaaaaaattcatttaaaaatagggtctaattcagagttttaagtgaatcagactcacctccctccaattagtccacattagttaggttttaaagttaatctgtagtgacggccagttcctcctactatctaaacaaagtccctgctgttggagagccagcctgtttcttctttccttgtctgtccttagggcaaacagagtgtagctggtctcgtctgaatgatttactctcagcacatttgaagaacaggtttctagaggggatttgagggcatgacaaaaatatagcatctcatggactagatgcagcccccagagccccacattgctggcagggccctgtcacctactggctgacacccttggcaacccccagcaccggggaattgctttccatgacaataaccatggcagccagtgcctggcactgctcacatgcattagttcaattaatgtccacaaaaaccctgggaggcaggtgctttccttactcccattttccatctgatgaacacagaggagggtgcatttctgttccagtgtcattctgtcctgtgcagacaaagggttaagcgtgtctttacacatgaagccagaggagtctttctcccctataattaaaccctcccggtgcgcttccttaactggatgtcattctgtgtgcgttgactatgaaggggactgtgctttgctctggtgccaacagggtctggggcatgtgcacctgcatgttcagggagtggggcacactcgtcccctaggactgtggcagggtggtttctctggagtccagccttcttcctctcactcgcaccctgctgtgacctttggctgggccgagttattgcacccgcaccctgctatggagtagtggcgagtgtgcaggacaggtgttgggcaggaaattttctctaaagattacacttcgagttctgagctgcaaggttttgagaggcagaaatgttgtttaaccgctttcattaacagatgtgtactaatgcagaagtggtcactgctaacaaatttgtaattcaaaagatatttaaagctcataggaatgccccaaagggtctgttaagtaaggtcagcaatgcttctggtcaagtccatcatctgtgacactaaaagggactggacaatcgctaaaggtctgttgcagtgtgaatgtctttagatattcatttaacaaacacgtataatgcttcttgtgtactgggtactgttctagggctttgaccaacagcagctctttccgtcttctttaccgctccatgaggtgaatactatcagccccattctgaggcccagggaggctaagaaacttggccagagtcacagagttccttcactgatgcctcaaggcttgaaagcaggcgaaataaccactctagagactgtggctctgcgcagggcctgagggataccttcccccagatccaggctttcagcccatgctcctaacctccgaggcagcctggctagagagctgggcctgattgaggagaaatcctggtagttacattctctgatgtcaaattcataaagggtaacttctcttaaaatcccagggtgaatctcgtgtctgtgagtttatcaaaatgcttccctacttctactttaaccctctttttggccagcagtccgtgaagatgacagttaccttcatccaaagggggcctctctcaggcatctgggctctgacaactccaacccaacaggatcactcttgagtcttaagtgttcaggtcttcgcagtttcccacacattcttggtggcccaactccctcaggaggaagacagtctcagggctatcactaataggccgcagaaggagctggctagtggcctggaggttaatttcaagtaaacaagagagaagcaggagccctgtggcattttctctggtttccagcatcctgtaagccctcccctggatgtccagaaccttctgtgtgatttgaccagcctgtggaggatgttctgacggccccttccaatgcactggtgaacccctgtgctgaaggactcagcaaggttatccctcaagccctgagaaacaagattttgttttcatcagtttccagccttggggcatcagtgagaagagctgagggagaagacgatactgacggagggagagcaatattggcacgtggctgctgggacagcatgtggaatagaattctgttttcacgtaatattgtttcagcagaaaaggtgatttcaggaatgagagatttcaatcagagtttctgtgtagtgatttgattctcatgttttcagatttttttctttaaattatcacaatattcagaacatattcataatttttcataaaatttatagctacaatgccagcatttctcttaggtggagccatatgaaattgtcaataggtgaccatttttacctacaaaagtggtagtttcataaggttaaacataagttcaaccttacatttctagaaaatctcttttcatggaattctaagctgtgccataaacatggtatcttataaagaaatcttaccttcacttgcaagtggtttggaggatgtgtagctcctgtttattttggaaatgacttaaagttgttgatatgggtctttttctccctgagtgattacaacttctcattctaatgatgggaaagtctacagtcatctctgccacttctaacgtggggtggccccaattcccctccattgatgattggaggggaatcgcttgttgtcacatcgaatcctagaaccctgtgagactggaaggaatttaatttgaaattgccgtgcgtaccagttctgctctgggctggagaaacaatcctgctgcagatccatctagtgacattaatctttctttgacttaatttggttttcatccctaaagtaggggcccagaggacgctccctgcctcacaggactaggggacgattaatgagtcactcttagaagagcatttggagctcctcagatggaacaaatggcatctttttaacactctgcattccagggcacttttcaaaaaggcatttctgtccttacctcagcagcagctgacttgtgctaaaaagaaaacggaaacctttcccccacaaacatctgtaaataaactatttttctgtctttataatcgtgttaaagtgtcacatgggggaaatgttccagctctagagcagctgtgaaagttagaaatgcactcacacatacgcgctcacacacacacacaactcatccactaataaaatgtttctacacttgctcttgggagataatttcagagtaaaatttccttggtacaagctgtgtctatgctatcttaatgcctgagcacagcactagcagcgggctgttgccagctcttgaggagacatttgaacttttggcagcgttccttatcagaaggcccatccgaggtatttgtgattatagagtaagggtgctcgcttttggcaaaacaaagcgtctgacagtagtgaagtactggctcaacactcaatgggagacatttgggattcattctttgacaattacccagaatgaatcatcagcttccttttataaaaagatatttattggcttagaaacagagcatatccagctcttcgtggggaggaattttgtaactatgttcaaagcttctcataaactcggtgtctgagtattgctaagggggtgcctgcacagagcatttagtttaattgcatcaaatatggaggagaattgaaaaatcagccagcaaacaatgaatagctcaaggggaaaaggagaggatgctcgttaataggagcagagtcgaagagctcagtaagagttaagaatccctgctggagtcactttgcagaggcctgatggccccagccggcccctgcccagtgctgcccccaccccaccaccaagatatcatgcacaccagcagttggaggcctctggcctaaacttagcggctggctggacagctgtgtttgaggacctcttgagggctggctcttgctctgtgttcctccctgtgggtgtaacctgaaggagattaggttttaatcctttggtgcttgctaggtgggctagtacattctgataaccaatgtgcagcaggccagaagagaaattctaggtttccactctttccaaactgggaaggcaaggtccaaattaatattagaattgagaatagctttggagcttcagaatggagggaaaagtcacttagctgataaggttcagaagtgacagggtcagtcctccagaaacagttccagaatgaaggagatttgtggatctctgacctgcctccttcttgccacccgtttgtcttgtaattttgtgaatgagcccctcctcccacagagccaggcctgcccccagcatcttggcatctttgtccccctttgcccgaagggcacttccttgcttggggatttgcgagtgcccatcagggtgtgggggaggggcactgtagggccacttgaccctggtttccatggtaccaaaaggtcttaggtgagaacgcttgattttaactccaaaagaggcaatatatacagaggcctgcctttgtcaaatgtatacatttaaaatctgtggcaattcttatcagttctattgaagcataatttttgagacagggtcttgctctgttgcccaggctggagtgcagtggcacaatcgtggctcactgcacccttgacctcccacgctcaagccatcctcctgcctcagctgggactacaggcgtgtgccacaatgctcagcgcttttttgtttgtttgtttgttttgaggagagatggggatctgagttctccgggctggtcttgaactcctaggatcaagcaatcctactgccttggcttcccaaagagctgggattacagtcatgaaccactgtgtccagccaaaatataattcatattaccataaagctaattcgtttaaagtatacaatacagtggttttaggtatacttatagaattgagcaaccattgccacaatctaattttagaacattttcatccctcccgaagaaaccttgaattcattaacagtcactccttatttcccccagccctgctttagccaactagtaatctacgatctgtctatataaatttgcccattttggacatttcgtatattctttttagattcgtgggtacatgtgcaggtttgctacaagggtatactgcatgatgctgaggtgtgggcttctattgatcccatcacccagtgaacgtagtacccaacaggaactttttcagcccttgccccagacccatccccgcttttggagtccctcatgtctactgctcccatctttatagacacttcatatcaataggaccatacaatatgtggtcttttgtgactggcttcttcgcgtgtttttgcagttcatccatgctgtagcatgtatcggtaattctttccttttattgtatggcaatttttggtagtatattcatactacatgaactaacacatagtaataatgaactacttgtagttgcaacatgaatacatgtcacagaccttatactgaccctcaaaatctagacacagtacatactgtatgattctatttatatgatacccaagaacaggcaaaattcataaatggtgatggaagacagaaaagtaattacctctggatgaagatggggtggtcattgtctcggaagggacaatgggagcacttttcaggaccttgcaatattttatatcttgataaaggtggtggttatgccagtatatatttaatgtgaatagtcattgagctgcacacttaatattagcaaaagttaagcatgtcccacattatgcttacatttcaaagcttttattaaaaagtatatgcaaattttgtgattttacaagcttttgaaaaaatgtcacaggttgaatatcccttatccaaaatgcttggaaccacaagtatttcagattttggaatttgcttggattctagaatatttgcatacacataatgaaatattttagtgacaggacccatgtttaaacacagaatttatttatgtttcatatacaccttgtacacagagcctgaaggtaattttatataatttgtgcacaaatcaaagtttttattgggttttgactgtcactcatgctatcatgagttcaggtgccgaattttccacttgtggcaccacgttagcacccacaacgtttcagattttggagcattttgaattttcggattagggatgctcaacctgtatatacctacagaaaaacaaataaattataagcgtactgctggatgaattatcatcaagtgagcatatcctgaaactaccacccatgtcaaaaaatagaagccctctcctggcctttcctaatcactaccgctgctctcttctccaaatatctaacatgatagttttgactgtttgggctttttcttttttcaagctctatgtaaatggaatcagtcagtatactttcttttctgtcgagcttcttctgctcaacattatgattgtaagatttacccatgtggcgtgtaacagtagtttgctcattttcattgttttataaactgttgtataaatatgccccaaattattcattctgatgatggatgtttgagttgtttccagtatgggacaattacaaatcgctccctatcaggatttatacttatttctgtggactaaggacctacatgtgaaatggctctgtcatagggtagataccaactttatataccacaatttctgaaaacccatttcagcatttcttaatagagtagtgtcatagtcagttcgggctgctataacagaataccattgactgggtggcttaaacatttgttccttatagttccagagactggaagttcactgtctgggcaaagtactagtagctcggtgaggaccctcctcctggtttgctgagagccgtcttcttgtatccttgtgtagtggaaagcagaggggaccagcaagctctgctgtctcttccttttcctcctctgtttagagacaaggtctcactctgtcgcccaggctggagtagagtggcacagtcagggctcactgcagccttggatgtctgggctcaagtgatcctctcacctcagcctcccaggtagctgggactacaggtgtgcaccaatgcgcccagataattaaaaaaattttttttatacagagggatctccctatgttgcccaggctggtctcaaaactcctggactcaaggatcctcctcttcttcctcccaaagtgctgggatcgcaggagtgaggcaccacgcccagccctggtgtctcttcttataagggcactattcccatcatgagggctccaacctcatgacttagtcacctcccaaaggccctacctcctaataccatcacactgggattaggatttaaacataggaatctggaggagacacaaacattcagtccatagcaagtaacaattttttaacctcaaaaaatgaaactggcctaggtcttgcctgacctctgcgaattggggggaatgtcctaacacagctcagtcttcccctcttccagggcttcccacctcccatctgtcccacagggtcctggcctccaccttctgcgtactaccccactgcctcccatggcctcatcagcctcctccacaggaccatgagccccttgaggacagagacactgccttgcttgtcatttagtcccagcctccagcacagtgcccagaacatagtaattcttgataaatatttgatttaataagtgacagcatgtaagatccatccagccatctaattcctgggtgaagttgagaaatccattaaattttgaacactcatatatcttttatctttggtttcagatatcaaatggatccactataaaagtctttaagaagatagcaaattttacttcaggtaaccaatataatattgttaaccttttgttctcacccagcttcataaagtattgctttttgcctctctcagctgtattgtcacaaaggtgagattgagttgttgctatgtaattctctgaaagttgagaaaagtcattttgatctctttgcagtcctaagaatgtgatccctgcaagaaggaaaggaaactatagatggtggttggcctggactgcccagcactgaggaagtggctgcctctttatagccctaaactcagggcagaatctcatagctttttttcaaccctttagaaggatggggcctaacagaggagatccccctggcaaactgagagggaagagtacagacaatcatcacagagccccgaagcaagcgctgaacaaacaagataatccacttagaaggtccaagtctcctgtgatagcacttgcaaaattcccagaaattggagagagacaaactaaagggggaacttttatgggaaagtcaataggctggtctctaaagtgatcttctgcttccctgatagccctggggcaggaaattcctgttccaggtttgtctccagagaaattataccccagtcaagacaatcagctctcagcccttggaaaggttctgagctcctcccaaacaggctcctttcacacacacagccagaggtagggcttcctgacttctggattcactattagaaggagcagggagcatctggccagtgcaaacagggaatgtggggttcttgattatacagacaggataattgggtaggactcctttggggaaacccaccttccatcactatatggggctgtggtgaagccatcttgcagagatcattccagcttaagggggatggtgtctttgtgttgaaaagtggaagagcatggtttttaggtttcaaagattgggccttttgaagagcctattatttggggattgaatagtagaatcttaggtttggatctcttcgtgggccctccagtcagtcaacactgctgctagtttccattcactgcaactgagagccaccgtcttacaccctgctaatactctaaacctcctgtacctctgtcctatcatcagcccctctgtcaaaatcccaacgctggatgaacccaacgattatcctttcctgaccctacagctagggagccacagaagaaaggcacataatggcacacagtgggtcactataagttcatggtacccaacttgaccagggccctccacacagcctgctctcattgggttcctctgggcaattcaactctgtgttgtccataatgtctgccttctctcctcaaagctttgacccacacagctctcctctcagcagatgacttcaccctgcactctttacagagaaaactaatcagaagtccttcaacagccagtagcaaacctaccaacctacctgcacctgccttcttccttgatgcttgtaggctgaccttcttccattcaaggccagtctctcacctgtgctttgggtccaccatcctttccaaccttcttggtatccttacaccaccagtaatctcttttctcacctgtactttcttttcctctccatctactccccattttccattagcatttcaagatgtgctcgtctctctcatctttatttttaagacagtgtctcgctgtcacccaggctgtagtgcagtggtacaatcatggctcactgaagcctcaacctgctgggctcaaatgatcctcccacctcagcctcccaagtagctgggattacaggagtgtgctaccatgctcagatactctttaaaattttttgtagaaatgaggtctcgctacattgtccaggctggtcttgaaatctggactcaggcagtcctcctgccttggcttcccaaagtgctgggattacagatgtgagccactgagcctctctcaactttaaaacaaacaaaccaaatgccttacttcctctcttccctccatttaccactcccttaccctttacagccacatttcctcactctgcgctactcttgacttgctctgtgagcaccacctcattgtcctttgagatcctagaaagggtcagctccttcctacctttggaccttcctgcaatttgcctagctgactctatctcttcattagattcagctcaagcatcccttcctcaaaaactcctggactagatttggtctcttgttaattctttagcatataattctccttcataacctttatcacagttataataattgtgtacctagaagtttgatgtctctcattggccagaatgcaaattccatcagggtgggaactgggtcttattcattgctatatgcccagtagtccctggcacataggaggtgttctaggtacatttgttaaatgaatgaggcttgagcctctcctaccagcaagagatcagagatcactagggaatctacttcctcctccaatccctcacccgtcccatcttcacgctgttcttaagatcttaagatgcagcagggggaaaaatgtagctatggagagctcaagtcaaaaagctcaagtaacttcagtatacagcacaaatggggccttttaagagaaggccgattagcccatggttgctttttttaatggactgctttctctccctctttctctggcattcagatgtggagtactcggatgaccactgccatttggtgagttcaggctttcttgtgctcaccactgaactgcatgccttctgtagcaagagtggtctccttgggtaacgcttctgctgtcttcccttcagattttaccagattcggaagcattccaagatgtgcaaggaaagagacatcgagggaagcacaagttcaaagtaaaagaaatgtatctgacaaagctgctgtcgaccaaggtacacttactgttctgggagcactttatggctacctagggggtgtatgatatgtttgacttaatttccactgaagtgtgaaaatgttacaaatcccttgtgccttctagcaaagcaaaatgaaagtttaaattgtaaacacttcctacccagttcctcttctttttatacactacaaagataacagcactttacagatttgtactgtagtatcttcagtcagggatttaatattgttcccagtctctttctccaccatttcactattattgttattttttaggttgacagcataattattccttttggtttacttgttattatagatgagcaataaaactccctttttgaattgcgaataaaatgaaggggatgggaagggtcaatgactataaacctagtaaatcttaatttttgtttttcattttaaaattaagaattctgctcacacataaaagtgtcagatgtgaaagccggtggaataccaaaccgagagcaaattttactttatctggcttttagtggaattaacagaagtctgtggtgatcttttttttcctccccctctggaatgatgagcactataaatgctatgatctacacttggccccaggaacttgatgggcatgcttcttcagattataacaaagaatctgcttagagcttaggagatttgtttagtgggcagaggacagcccaagcctcttgattttctcagctgtcccatagagcccagcctatttggcttttgtgaaatactcaaatgctttggaaagtacacaataaaactttatgatagaaatatatgcaacaggaaaaattctgggaacagagcagcatcacttgagcttttccaggctgaacataactaataaaagccaaatatccatggcttcctggtttatgtaaacagccctacaactgacatttcaactgctagagatttctgatatcctcccagttgactaaacaatgttatcagcaagaagcttatgaaccaaatctaaacctgggcatggattttcaagacttttgacctatactgtgagcactggccacatttgacaattttacatttttctcttcagtttgtttttccctgttttgaacattattttctctgaatgtggatttgcttttgctattatgttttcaaaaccactaccacagtttttaatctcccaaatctgatgttgtctatctttcaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacaggtgggaatgtaggtgattagtgactgttttcaagaatctgggacagaatattaactaaaagaaagacatagatagttatagaaggattcatttatctctatatcagaatctttgggcttggtaagctatcatgtcaaagtagtttcttattctgttactatttttaaacaataaaggaaaccattcctatgccaagaatcctgttcttgaagataaactgttatctttggtgcatgatactttgtctagaatgttaaaagaaatttaagttgaccagtaaagaatgagaaattaacatttgtggttttatatcatttttgcattagagaaaattttatgataaaccattttttgttcctaatcggttactttgcagtctccaagctgtctatactctgattctgtacagaaatttatcaagtgcagtactcagatactatgagaattagccaaaagtttgtgttttgttttatattttaatattttaccttaaggacaggcaaggcatccaaattttgcctcctcagtaaagaaatgtagctcatgagctctctttgaaatgctgtgtgcatgggctggataagactcagagttatgatgaagtagaacttctcagtgcaagctcaaggctttccaggcactgagggcagccaggtcactttaaatgagtatcaaaagctgaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctcagcttcccaagtagctggaattacacgagcatgccaccgcactcagctaacttttaaaactttttgtgagatgaggtctcactacactgcccaggctggtctcaaactcctggactcaagccatcctcctgcttcagcctaccaaagtagtgagattacaggtgtgagccactgcccctggcctgttctagcctcttatctccagtccctgccactcccacatcaagactgggagctgagggccaccattccaccttgaagattatggcatctgagcaggggcagcagccaggacagtagagctgttgggagacctagcagcatatgggggaggtaatgagctaggccagagttgaaaaggagataatggaaggactttgaaccagtcccaagttcatgttcgggtatttgagtacctactatgggccaagcagttagttgctggagatatagtaacaaaacagatgaaagtccaggtcccattctaatagttggggacagacactaaatgcaatatgcaaacagtagcacattagcagatgatgagtgcagtggagaaagtaggaaaggaggctagtatgtgtcaggactaggtgatctgagaaggcctcacagagatggtgacacttgaaccaagtcttgaaagaggagagggcataaaccatgagactacctgaggcaagaaagtttcaggcagacagacgccaagagcacaagttgtgaggcacgtgcttgcttggcccatatgaaaaatagcaaggagaacaggagagttggaatgagcgcggtgaggagcagtgggataggagggccaggtcatgcagggtgttatccagagggagatggagagcctcagagggttggagcagaggagagacatggtctgattctgtgttgagaggactgctgatagttatgtgagaacaaactgtcaggagatgggaaataatccaggtgagagagattataatcaagagctatctggagaaaattcttgcccatggccactttcaaacttaccctcctctatccttcttttacagtagctctgccagttaaccctttcttcttctctccaagtgacgcttctgtctgttgcttggtatgtttggctaagcagagttgtatacttcaataacaaggacaaaaacacccgtttacaaactgtgataaacagaccattggcttcatgaatggccctatttgaaaagagattattctctctttgaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggtaaggcccagcttgagtatttcttgtatgcagtcttatgagtttgacatacttgtctttctgataagcattcaaataataaacaattggtctaaactacaccagctaaaaagagatagcaagggccactgtcaatttgctgttatttaaaatctgtctcattatttttaatctaatttttttaaagtgaaaaacaaaataattagccccacccaactgcagaattctgcctgtgaaaaactttatcacaaagtatgcgttttgtttcctagaaaaatattctatggacactgataaactattaacccaaaatatgcaaccattgaaatttgcctaaatcaattctatttgaatatacataaaatgcctatttgaatataacacattgcttatgggacacaaaatcttgctcaagatttctaacaataccagtttgtcagtttctaatcaaagcatgagtactgttttcctatggttttctttgctgatcaatagtcccaagaactcaaagaaagacaaaaatcagagcaaacttcgaaagagatgttttggtcttatttgagcgctccaaaatatactaaactgagcaatatctgtgcctaatggatctttgaacactgaggaggagttcttgggcaggactttaagagtacctggaatgaatggagactgatgttccacaggtgcctcagactcccagtcataatctaaactctttatcagcagtatttctgcaaaacaaacctgtttttacttttgtcttccctagcattgcctagtctctcaaggtagaatcctcaacgttatctttgactcctcttccttccaacctctatccccaaattattggttaccacttacttctgtctcaaatgtctgtcgctccctcctccttccttagccttatcacttagccttatcccttcatcccgtccctactgggataactgcttcctaattggtgtccttgcccctgctgtccacctttccttctaaacttttccttttcactgtctctcaggtaatctttctaaaacataaatctgatgatgtcagtctgcttcttaaaaattgcaactatttcccattacctaccagctaaagtcttcacagtgccacatagtgcttcctgatgggcttcagccctctttgctggcctcgttattttcttgcacgccccacatacccactgtgctacagcttttacttttcccaagttcacaccatgaacttgttctcacacccctttgctcatctttcctgtctcacagtccctctgtctagtaaaatcctacccattcattcatcataaacattttattcattcgacaaatatgatttcctaatgaggaccagaaactgtaggagactcagatcagtctacatatgcctactttgtgaactttccccaatatatttcctacagcactttcttcatttgactaataaagttcatcttagcatgcagcacactgaaaggcacttaaatgtttgttcacactaaaaacagttgtttatgaattatgttcttgacacacttcacttaatcctcacaagtaccaaataaggtagttattattaccctcattttatagatgagaaaattgatgttctgggaggttacaagtcttgcctgaaaccacacaaagtagcagaattatgatttctgatttgtccaactctttctgtcaactactgctgctaattatttgtatcatagtaagcacttcataaatctgtctttgcaactagattgtaagcttctcaagggcagccactagtctttatcattgtactctcaatgcctgctccagtgcttaataatgtttattgaatgaatgaatgatagcatgatttctgggttccacttaaatttgacaaatgagaaaatctcaataatatctcagtctctaggcatccttcagaatgattcatcaagccattgattcagcctcatgggctgggacattagccctatcattaacttacctatcttccctgagtagaattttttaaagttttgtgaaaaataatgatttttaaaaataaaatcatatttaatttttaaatatcactgttataattacgtagaatcattcaaattgccagagaacctctgcaaaatcacacatcagagccaccaatactaatgaccatgtgcttccctgaagaaactggatgatgtctataatctaatgaaataaaagggacaagctggaaaatctgcctctgccaattacttaccagtttcatggttatataaagggctcaatcagacctacaatcaagtcttttgtaaatgccaaattcactggtgggtgaggatgagagcaaatgttttaattcaggctttttacaaccattagtaatgaactatgattgaaataagttccattgttacagtaactcaaaatcatgcaaaaataataattttagttcttttatgagaggaaggcagaatatattagcatttaatctgcctgaaaataacagtgactcaccagaactatctagatagcagtcagtcattcagtcaacaacatttaaggcctactgcatgaagccttgttagcaagaggtaaaactggttggtggtgggggttcagctacattggaatattataaattcctccatctttttttttttttttttttactcttttggtgatggttgctttttttttttttttttccccaggaagcaccaactaataagcttctctatgccaaggatatcccaacctacaaagaagaagtaaaatcttattacaaagcaatcagggatttgcctccattgtcatcctcagaaatggaagaatttttaactcaggaatctaaggtatcattagaaagcagaaataagcttatatttggttactttacgtcatttcagaatctctcaacaagtctttcttttagaaacatgaaaatgaatttaatgaagaagtggccttgacagaaatttacaaatacatcgtaaaatattttgatgaggtaagattttaaataacattgtttttaacctttgaatcaggcacaaggatgtggttatagcattctgtcagtttcagaacagctctggcatcccaaaaggccagaaagggaagccaggaagcctgtctgagatgggggatcctggcactgagccagaccctgtacatggctgccccccttacagttttatcatgctgcccacatttggaccagcctgaatttacatttgagttcatggggcctacagccaccctgactcaagttaactttgatgagtaagtagtggccctattaaatggggtcagcttatgcttgattgtaatttgctaaaaatgaaagctaagcttgttaaattgcctagattctgtattcaatcgttatatgaaattatgacatatttctaacttaagcgactatttcaataaaccattctcctttatgattaattctccttaatctgggtttttttctttggaaattcaaacagacacattcatcagatgctttgtttccaaacaaatgttaactcccccttccctgattcccccccaatcatgctgggacaggctatccatgtcaatggtgagaatagctcaccaattccatttgctacttgaagatgaagtgaagctctaaggtagggtagaggcaatgagttcttaaacatgataagcatccctcgttccaggggtcaggggagagaagggaagcacgaggagggactacactgcccagatgggagggaagggaaggatctgtctctgaccaggatgtccctgcctgctgcatttaaggagaaatacttgcctgcatgttggctgcccaggaatgcttgctgtgcttggaatggctgtgacataatgcataaagcagggcctaggaagcctggccccatatttgtaagcaaatagttggtatttcttgcgagcttctattttaagccaaggtattgttgatcctgtgataaggacttagcaaaacaacttgcaaagtgagtatgtaaatgatggaagaaaatgttggcatctgtttcatacagattttaccactcacagcatcaggtatgcaaaaaacagaattgtaacgctaaaaccacaatatctaaaataactgttctaattgtcaacagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcataccaacccttgtgcctgtgtgtataccgtgggaacccttctgtaaatagagttgaagtggttgttgcaaacagcctccttgtttacagagaatacaaggccagtaagcgaatgtcagtattgtaactacagtctccacttaagcacaatgatataagtggttttgtttgaaaactacagctatgtagcacttgtgctacactgcacctctgcattgtaaagggatactgccagtgctcaaaacaaaatgtgaaatgagtcatttggaaacaaggtgggggtgttagggcaacctcgaggatttgcagcattgaaactttccccagtagttcttggaaaagctgaccgcagaatttggtagtgtacacttagcatttgtgagtgtgtgtgtgtgtttaaaccaaaaactaacagtgttgcaacattgttgaaagggctcgtgtttttcagtggtcatcaactgcactccatcaaactcacctccatttcaccaaggagctctaaagtaaggagagtgggctttatttaaatgaacagcattttaaccagatactttgtcctaatgtatgttccttttcttcatctgttttttcatactaaatgtatttgatagtggacatgttggatattatacaaaaaaatcattaattcatttctgttccaaaacctttgatcagaacgatctgtggaagagtaactccatttctatatgagtgagtgtctccttgctttagatttctggtgaaccctgtggttatgaatacttgtgtgtgatttaaaaaaaaaaagatacattttacattttatcgaattgctgttcacactggagtattatatataaatatatatatttgaggcccaaggcctgaaaaatattagtatacaacttggtatcttagtcttactatgtactttttgaaagtattcctcgcaggagaaagaatttaaaatacccattttattcatgcctttctttttaaagaattctctatccagttatactgtagtctttttagtgctgattttttaattcctgaatttttgctgctcatgaccagttttaataccactgtgttttccttctattaaaccagaagaagtaaacagcataattggcaactcttgagcttttcttgtggcaggcaccttttacccttggtgctccaaatcccccatctaggaaagaaaattttttcaagtcaaataacattgatcacatattccttgaaatcatttaccaacactgtatggagcattaggatttaaatatgaatttgtcttaaaggcaattcctttttgcttctgtattatctggaaaagcatgagagaggtgacacctcaacaaactgatcagagaaaataagcagttactaccctgataggcaccttcccaatcctgttgcttttgaccattgtctgtccaacggacacacctcaaacaaacaaaactaccaaatagatgacagatcagaataaaggtgagaggtctggtccccattgaaggctgctacagtcttcaaagaggtgaaggagttcataagagaacaacagtaggaaagttgagagccaagggtaggagagttgcccaaaagacttcccctactactttagggtactgaaaactcaaaggatcagctacagctttatctaagtatttactaaatgctacatgagggtgtccctgtccagctttctggcacatgagtcctgtgtggagagttacctcctcttccagggactgtgctgttgggaactttgggcaagtcacttacctctttgtgcctcaatttctgtataatatttctaagctacctcactgaggtggtatgaagattcactaatgtatgtagcgtgtttgtcaatcctccagtgaaaagcactatctagatcacattttggatcacattagccaaatgcagtaaatggccaaattagatgtgtgctgaagacaatcagtcactgggtctatattaaacagcaaccagagcaacaaatggcaaacaatttctattttcaagtttctttgcatatttttttggtgcaaaaccatttataaacttttttttctaacactagtgtctacagcagcattcaaaaaaattctgttaccttttctgtattaggatttaaagtctatttcttattgtatacctgattgaagctgttcttggagatgaatgttttaaatgtctatatccaaaaaataaacattttgatgtaactgtggactgtcttttttttttttcaattttctagttataatagtttttttattctaagtggctccgtggaaattatttttcagagataaggtgtcactgtatatgctgtgaataagcagctatattatgtagtaagtaaacctagtttgctaaatggtgctaaggactgctcaattacagtcctggccttcttcactatcaactgggacttttgactatgaacaccttgggataatgaacattccacttaatttgggagacttgagctttagcctcgttaacatgaaattattccagcagaattcctctaaaagatgtcacattaaaaaggcttccaatgggtgtagaccaaaaaaaatgagagcatacttagggacacaaaacacataattatttggttagatccacagtaatgggaagtaaagttaaataccaacaatgtttataaaaggacctgagttcaagttttataatcaatggcccccttgttaatacagccataggatttaattatttgcacttattctctattctaacaaagccaaaatcagtagactgtcatattgctaaatatatgctatatggttgatgtaaaattaaacacacgattaaaaaaaaattaagctctttaattatgtgcacacagattttagaaaaggtagccttttgtatatagatacctttacattctttaggctgacttttaaattgtcatcttttttcaactacagtttttgtatatagtaaaccagaagatgtgtatggaccctgttatggccaagcatctcaaagatgaagagagaattaatgatagttatatttcactcaaaatgccaaaaaaaaaaattcaacaaagtaaaaattttaaaacttgactctaactagttcctttttgttttacattctcaaaccattgtcaaatattctaaatatctctgagaatttctcttttaatgcttcacttgtataatcttaaaatcctgacagtcatacaatacagcatgtagtaggtaccttttcttgaggcacattcaagtgttttggcaaacagtaaaaagtatctaaatgccacaggttaaaatgtcaagttttactgagtcaccaacttcacctcttttgatctgcctgttctccaagaacatcattctccggaagatccaagttcctctagttgttttctttgtgttgtttccagttcttctagtcttttgcgaagtagagagagttccctttgatgttgttcctccttaaaatgatgtagagaaagcatagcaaaagaaactattagaaaaactgttaggtagcaaccttggactgcctcttttatatatgcctataacatctggcaaggaaatgctgaccactgtagcagtctaaaaacagtagcatgggctaaactaccatctagttttgcttctctcctgcctcaggctctagccttaagcaaaacccgtagtctgttcttctctaggtataaaattcaccagggagtgaattagaaaatactaatgcagggcccaggtatacttacatggtaactttccaacaacactggtgtttaacagcagtttattataaacaaagcacttggcctgagattcaattcagtgattaaaatcttctgtgcttatgttataaaacataattacttattaatactcccatcttctgaaaaagaatcaatctgattccttcaatacctcaggggcttgatacaatagaaagagcccgggttttggattcaacaggtttaggtttgaaactttgtcacttattagctatgaccttatgcaagtcacttcactctgaatcagtttccttatctatgaattaggaatagtaatatctgccctcaaagcatttttcgttagtattagacattgcacggaacatgcacagttcactgcgttagtaaattctcagtagtaattactattaacattatgaataagctacaaactctaggttactcaatgactcaatcaagtttcctcttttctatcgtccagtaagagatttcactctcagcaccaacactaaaggatcatgattcaaactgaattcagcaaatttctatgctaaatgaaagggaagaagttaaaagtagttttaaatgtttatgccatttttgtggtgaattttgagcactgaccaaagttataatttgagttttatcaccatatttaaacataaaaacctacaaaaatgtacgactttttttttccccctaaaataaatgctcatacctgcatatgaggaggaaatggtagttccatgcttggaaccatggctgatgactgaaagctaacaggattgatagatgctgttggaggcatgttaggaaccaaaattagacttcgaaattcattatgtcttctctgtatatcttttagtcttttttgaagccttgtatagtcttcaaaaggaacattttgtcttaaaaagaaaaagaaatgtttctttaacatggttataccctattgaagcacagtatgattcacagaatataattttaaactggaatttctaaattatgagatctatatataatatatagataaaaaatctgtttacctagaaagataaacagaaacatgacataacatcttaatcattagcaatcattagcattgcagactatcaactcattataaagttttatttgctaattaaagatctaaaatcttttgatactttggtactcactcctaccctcctactcacccccattcatgaatcctgaaactaaagggagactctaaaccaaaagagtgccttatcttacagaaagaatcaaataaaaatacagttcatccctcagtatacacatgggattagttccaggacatccctcatatatcaaagcctgtgcatacaagtcctgcagtcagccctgcagaaccctcataatggaaaagttggttctctgaactggtgggtttcacatcctgtgaatactatattttctatccatgtttgcccgaataaaaatctgtatataagtagacccatgcagttcaagcccatgttgtcaagggtcaagtgtaaagaaaatgctggattgaagcttacaaaattgccatttttaaataggtgaaatatggtcaaatatagagattttcatagttcaatctaattttcaaaatgtcagtgtaatattttagtaagaaatatatatttggtctttgcccttggttcctggcacacagctcctaaaactctgggaaactctgaagtgataagagtatcttttgtatattaataagataactggtggctgggggcccctgaatagcttcaggatggggcaggtcaccagaaagactgaggcatgattagagggttggaactttcagccccactctccaaccccaccccatgacatctgggaaggtaaaggactaaaggttgagttgatcaccaatggccaatgatgtaatcaatcatgcctatgtaatgaagcctccataaaaacccaaaagcatggggtcagagagcttctgggttgctgaacatgtgcaggtgtctgcagggaggcatgcccagagagggcatggaaactccacacccccttcctcataacttttcctatgtatctctttcatctgactgctcatctatatattttgtaatatcctttctagtaagctggttaacataagtttccctgagttctgtaagctgctctagcaaattaactgaacatgatgagcaggtcatgggaaccccaatttatggccatttttagccagtcagaagcacgggttacaacttggggcttatggctgcattctgaagtggggggcagtcttgtgggactgagccctctacctgtgggatctgatgctaaatccaggtagacaggatcagacctgaattacaggacacctagctcgtgtccactggaaaactgattactccatgtataggaaaaaaccccaaacatctggtgtcagaaatgttgtgttgactgtgtgagaataggaaaaacactggtttttcctattataaaaggtaatcacaaaggtgaagctacacaactttaggaaaaaatgacatggagaaaaaggctaactttccaggccttcacagatcatcatctttttggacacgacatccagtaatcaaatataatttcaaaatcactcaaaattctagatgatctgcaccacaactggccaatcttgaattgctaacatttcaatattaatgtttatggaagaggaagtaagttgaattctgttttagaaggactgagccaggaatggtggctcatgcttgtaatcccagtgctttgggaggctgaggcaggagaatagattaagcctaggggttcgaggctacagttagctatgatcgtgccactgcactccaccctgaaccatagacgaagaccccatgtttaaaaaaaaaaagaattgaaacaaaattcaaaattacaagcatgtttgtaatttacaaattactaccaaattaataaactaaaggcggcctcctactttggaatagagtattgtaaggctggcactaattctacagtctagaaacttctagaatgttctttaaaaaacaattgttcacctgttggtaataattgcacccaagaacaccagtgcacatcataaaacgtcactgcatgatattataggcagtttccattacagaaaaatctatacttgaatagccaaggcgctgaaggctaccactaattcactaaattaaaaagatttttcttaacttgaatcaaatgtgtcatataatgccactaccaacaacttaatatgacaaatctctgctttaaaaatgctgatgatcctgattatcagatgtgcttgaatgtgactgcaaaacccgaaactacagctcaataaaatctccacaccaggaaaccaaaactgacctttgattcaaagttgtaggcacaattttcagaactatgcaatagctacaactgtcttgtacagcagcaacaactaacaccactccttgctaccaaagccagtgacattttctgttagtcccaatcataaggcaaacacctggtatgtgacagagaccttttggtttaaagaaacattcagttagggggtaaaaaaaggatagtacattaggagttatcaagctgttttagaaatctttaaaatgtatattttaaaagaaaagaaggtacgttatacttagagacaaagttctatgacatcaaaataaccacatggggaagatacacatacaaacacattacctatttaagacctgattttctgtttccaattcttctttctttgcctccaagacttctactttctcttgtagtcttttcaatttgttttcatgaagagattttctctaaaaagagaaatatgaacaagtatgttaatacataatctcttatttgaacaaaactatatagaaaatattttactcaccaaaaactgtgtttagatatgaatgttttcagtgaatactagaaacaaaggttagtagacatggctcttactgaaaattgcaaagataataaaccacaaatctatctaatattctcaatgtgacaattaattatgaatgccaaacaaaaaaactgttatcaataattgctgcaaaaaaaaaatctacaaagggaaggagtcaaattttactactgagtctgcctgtacatctggtaagaaataatgagctctccattgttccagaagatagcatgtgtttaagagaactgagccaggtacagtggctcatgcctgtaatcccagtgctttgggaggctgaggcaggaggatggattaagcctaggagttcaaggctacagttagctatgactgtgccactccaccctggacaacagatcaagaacccattaaaaaaaaaaaaaaaaaaaaagggtggggagccaggcacagtggctcacgcctataatcccagcactttgggaggccgaggcggacagatcacaaggtcaagagattgagaccatcctgaccaacatggtaaaaccccatctctactaaaaatataaaaattagctgggcgtggtggcgggtgcctgtagttccagctactcaggaggctgaggcaggagaatcacttgaacctgggaggcggaggttgcagtgagccgagattgcaccactgcactccagcctggcaaaaaagcaagactctgtctcaaaaaaggaaaagaaaagaactgaagtaaaattcaaaattacaagcacgtttgtaagttataaagtactaccaaattaataaaactgaaggatcagaaagctaagataaatatggatgcatctgtttaaaagttgcctttctaaatcttaaaaggaaaaaatttaaactttacaatatacaaagggagaaattcctaagtaaatcttgtatggtttcattaaacaatacggaaaagtccaggtaaaatgcaaaaggagtgtatggaaaaaagtagtattttttttcagtttttatacacaggccttttgttttttaatagaaaaacacctaaaatgttaaaactcatttagtcgctacaaaccttttaggtattttctaactcttttttaactgaagtataatcttacagcaaaatgcatagaatagaaacgtaaagctcaaagaaaaaccacaaaacaaatgctggcatgatttccttgtaggtcaagagcactgccatgccagaagggcccctacctttcccccttccaatcactagccctgtcatcctctgaaagggtaaccaactaatttacttccaaaactatagtttacttttgcctatttttgaacctcatatacatacaatcatagtatgtagtcttttattaatgactttatttcactcaacattgttagtgagatttatgttacttacagatatacttcattcattcccacatattatattccacttacgattattgcataacctagtatattcactcagtacaccgttaagggttatctgcattatttccagttgggactattacaaataactctgctacgagcattcattctcatgctttgattgtcccacatcctccaacatctcagaaggcttccttatgctcctgtctaccctggcaaaggaaccactcttctggtttttatcaccataagtatttatttatgaatttataggcagttaaggagtccatctgtctatccatccacccattcatatgaaagaaatcataaatttatgctcttttgtatctggacttttttctcaacattttatctatatgactaagccatggttatgtattgtcacagtacttctttttcattgcaatgttgtcattcattgtacaaatataccacattttatacattttcctgttaatgaaaatttaaattctttccagtctggggatatcataaatattttacgaacattcctaaacatgtttttcgcagattaagtacctcattctcttcagtatatacctatgaatgggtcatagtgtatacatgttttagctttagtagatactgccagttttctaaagcagttttaccaattacatttccaccagcaatatgtgagagttctagctgttctacatttttgccagtacttggtatggtcggtcttttagcttttgcatcctgttttggtgaaatacagtatctcactgtagttttaatttacattttcctgatagctaaaggtattgagcatctttttttatgcatgttagtcatctggatatcccttctttgtgacgtgtccatcctagtcttttgtccattaaaacttttgagtaacctgattcctactgatttgtagttctttatatattcaagatatgaatcgtatgtcagatatatatgtattgcagattgaccttctccagcctgtggtgtcattttcttttgcttaagagtatcccttaataaaaagattttaatttaaataaaatcaattacatcaatcatgtattttatagtaggaactttttgcatcctgcttatctttattatcccaagatcctaaaattttctcccaagttttcatctagaagctttattttttttttttacctatcacacttaggtgtatggttcatttttatctatgttgtgaggttaggctgagtttaatctattgactcactactatttgaaggaacatcctttatcgaaatgcagtggtacctttagtgtaaacctatttctggactctatactgttccatttgcctgtttatccttatgccaataccacactgaattactgtagcttatatttagtgttgatacctggtagttttaagtcctctagttttattgttcttcaagattgctttgggtattctagtcctttgtactttcagatgaattttagaatctactttctaatttctacaaagaaacctgctgagattttgattagaactgcattcaacttatggataaatttgggaagaactgacaccttaatattgaatcttccaagtcatgaacatggtacagttttccctttaggcatttttccatttttcttagcagtatttgtatttcagtgtagaagtcataaacatctttcactagatttgttcctaggtattttaggtatttttatgctattgtaaatggcatttaaatattttctaattgtgtgtgtaaagaaaaataactagtatttgttacttgacttcgtacttagaaattttaaaaattcatattaattttaatagtttgataggtttgacttttatgcatgcacagtgacatctgtgaataattttaaattcctgtctactctttatgtccatttctttattcttaaaactttttttaggctcagaggtacatgtgcaggtttgttttataggtaaatagattatttcatcacccaggtactaagcctagtacccaagttattttttctgatcctctccttcctcccatgctccagtctcaagtaggccccagtatctgttgctcccctttgtgtccatgtgttctcatcatttagctcccacttatgacaatgaaaacatgcagtattcggttttccttttttgtgttagtttgctaaggataatggcctcttgctccatccatgtacctggcaaaggacattatctcattcttttttatggctatatagtattccatggtgtatatataccgcattttctttatccaatcttccattgatgggcatttaggttgattccatgtctttgctattgtgaatagtgttgcaatgaacatatgcatgtgtctttatggcagaaagatttatattcctttgagtatatttacccagtaatgggattgctgggtccaatggtagttgtttctagctctttgaggaattaccacactgctttccacaatggttgaactaatttacactcccaccaacagtgtatcaaagtattcccttttctccacaacctcgccagaatctgctatttttttattttttaatagccattctgactggtgtaagatggtatctcattgtggttttgatttgcatttctctaatgatcagtgacattgagctttatttcatatgcttgttggtcacatgtatgtcttttgaaaatgatctgttcatttcctttgcccacttttgatggggttgtttttatcctgtaaatttaagttctttatagatgctagatagacctttgtcagatgcagatgcatagcttctaaatatcttctcccattctgtaggttatctgtctactctgttgacagtttcttttgctgtgcagaagctcttaagtttaattagaacccatttatcaacttttgcttttgtcgtgattgcttttggcatcttcatcatgaaatctttgccagttcctatgtcctgaatggtattgcctaggttgtcctccagtgtttttatagttttggattttacatttaagtctttaatccttcttgagttgacttttgcatatggtgtaaggaagaggtctagtttcaatcttctgcatatggctagctgtttatcccagcaccatttaatgaatggggtgtcctttttcccattgcttgtttttgtcagctttgttgaagatcagatgattgtagctgtgaggccttaattctggttactctattctgttccattgatttatgtgtttgtttttgtatcaatatcatgctgttttggttattgttgctctatagtatagttttaagtcaggtagcatgatgactccacgttttttgttgttgttgtttggcataggattgctgtggctatttggactcttttttggttccacatgaattttaaaagtttttttctagttccatgaagaatgccattggtagtgtgatagaaatagcactgaatcaataaattgcttttgacagtatggccattttaatgatattgattcttcctatccatgagcatggaaagttttgccatttatttgtatcatctctgatttgtctaagcagtgttttataattatcattgtagagatcattcacccacatttagctgtattcctaggtattttattttgtgcaattgtgaatgggattgcattcctgatttggctctcagcttggctgttggtgtacaggaatgctagtgatttttgtacattgagtttgtatcttgaaactttgctaaagttatcagctgaaggagctttttggattgagactatgggggtttcctaaacataaaaccatgtcgactgcaaacatgaatagtttcacttcctctcctcctacttggatgccctttatttctttctttctcttgcctaactactctggccaggacttttaatactatgttgaatgggagtggtgagagagggtataattgtcttgtgctggttttcaaagagaatgcttccatattttgcccattcagtatgatgttagctgtgggtttgtcacagatggctctcacattttgtagtatgttccttcaatacttagtttattgagtttttaatagaaagggatggtgaattttatcaaaagccttttctacatctattgagataaccatgtggtttttgtctttagtcctgtttatgtgatgaatcacatttattgatttgcacatgttgaatcaaccttgcatcccaaagataaaacctacataatcatggtagattaggtttttgatgtgctactggattcggtttgtaagcattttgttaaggatttctgcatcaatattcgtcaaagatattggcctaaagttttcattgttgtgtctctgccaggttttgttatcaggacaatgctggcttcacagaatgatttgggaaggatttcctgctcctctattttttgttaacagtttcaggagaagcagtaccagctcttctttgaacatttggtagcatgtggctgtgaatccatctggccctgggctttttttggttggcaggtatttactactgcctcaatttcagaactcattattggtctgtacaggaaatcaacttcttcctggttctatcttgggaaggtgtatgtgtccagaaatttatctgtctcttctagctttgttagtttgtatgcagaaaggtgtttatagttgtctgtgacggttgtttgtatttctgtggggtcagtggtaacatcccctctgtcatttctaattgtgtttatttggatcttctcatttttcttcattaggctaactagtggcctaacaattttttcaaaaacgcaactcccgtattagttaatcttttgaatggctgttcatgttttgatctccttctgttcagctctaatgctagctttgggttggttttctcttggtcctctcattgttttagttgtgctgctaggttgctgatatcttttttaactgtttgatgtgggcatttggtgctataaatttccctcataacattgccttagctgtgtcccagagattctggtatgttgtatcttttttctcttagtttcaaataacttctcgatttctgccttaatttcattctttactcaaaagtcattcaggagcaggttaacttccatgtaaatggttttgagcaattatatttttagtcttgatttcaatttttattgtgctgtgtgtttggtatttcagttcttttgcatttgctgaggattgttttatgtctgattgtgtggtcaatttcagagtatgtgccatgcagcaatgagaagaatgtatattcctgttgtttttggatgtagagttctgtagaggtctatcagatctatctggtccaatgttaagttcacgtcctgaatatctttgttaactttcttcctcaaggatttaatactgtcagtggaatgtggaagtctcccactgttattgtgtgggagtataaatctctttgtaggtctctaagaacttgctttatgaatccgggtgctcctatgttgggtgcatatatatttaggatagttacgtcttcttattgaattgaaccctttaccattatgtaaacccgtgtcttttttgatttttgttggtttaaaatgttttgtctgaaactaggattgcaaccctggcatttttctgatttccatttgcttggcagatgttcctccatccatttattttgagcctatgggtgtcattgcatataagatgggtctcttgaagacagcatatcactgggtcttgcttttttatccagcttgccactctgtgccttttaaatgggggcacttagcccatttatattcaaggtcagtattaatatgtgtggatttgatcctgtcattgtgttgttagctggttattaggctggcttgtgtggttgctttatagtgtggctcatctgtgtacttaagtgtgtttctgtattggctggtaaccatcttttttttttaatgctctctctcagcagaatcatggtaaccatctttctatatttagtgttcctgtcaagatctcttgtgagatgggtctccatttaacaagcatttgcttatctaaaactccctcagtatttgcttatctaaaaaggatcttatttctcctttgtcgaggaaggttagtttggctggatatgaaattcttggttgaagatttttttaagaatgttgactataggtccccagtctctcctggcttgaagggctcctgctgagaagtcagctgttatcctgagggggtttcctttgtaggtgacctgccctttttctccaagtgcctttaatattctttcattttgaccttggaaaatctgatgattatgtgtcttggggattatcttcctgtgtagaattttgttctctatagttcctgttggtctctctagtgaggctgaggaagttttcttggacaatatcctgaaatatgtttcctaagttgtttgctttctccccaaccctttcagggatgccagtgatttgtagatttggtctctttacataatctcatatttcttggaggttttgttcattcttttctattcttcttttttatttttgtctgactgtcttactccaaagagccagtattcaagttctgaaattattcagcttggtctctctcttctgctgttaatacttgtgattgcattgtgacattcttgtgtttttcagctctatcagatcagttaggttcttttttatactggctatttcatctgtcagtgcctgtatcgttttattgtgattcttagattccttggattgggttttgccattctcctgaatcttgattatcttcatgcctattcatattctgaattctatttgtgtcacttcagccaactcagcctggttaagaacccttgttggagaactagtggccatttgacactccgaccatctgtgttgctagagttcttccgttgattccttctgtctgatggttccatctctgcgtgggggtgttcctttaactgctgggctgcctctgattgaagtggtcaggcaagctcagggtagttgtgctacagttccaggttgggtgaccctgcccagggaggagaagtgaggactgggacttgcatagagaacagtctggccacttttctgaggtaggtgctttgtgttgggcatccgtaccagcccctggtccccacagactctccagaacctggagacagtaagagtgagggctacaagacagcaaagatggcaacccatccctcccactaggagctctgtcccagacagtaacagagctgctactggctggatggccctggtggggatggctggagattcaggttgggaggacgtgctcagtgaggagatatagaatcaaggacccaaataacagtctggccacttttccatagggctgctacagtatgctgggggtccgctccaatcccttttcatcttaaattttccagtacctgaagatatcaacaaggaagtctgtgaaacagcaaagatggaggactgccttctctctgggaactctgtcccagggaggcacggacctgttgctggcagaacacactaacaggaggtggctagagacctcggttgggagatcctacctagtgaggagtaacaggatcagggacccacatacaaaagccgtctagctttttccatagggtagccatgctttgctaggggtccactccagccgctaatcacctcagactctctaaagcctgaagacaacagctaaggctgctaaacagcagaagtggtggtccacccctctctttgggagctctgttccagggaggtttgaaactgttgctagccaaaaaacactggtgcaggtggctggaaaccctggtcaaaaggtcctgtccactgaggaggaatgggattagggattcaagtaaaaaagcagtctggccactttttcatagagcagttgtgctgtgagggggtacctcgagaacagttgcttcagactctccaaatcccaaaggcaaagagataaggctgcaaaacagcaaagctggcaccctgcccctctctctgggagagccattccagggaggtttgaaactgctgctggccagaaaacactggttggggtatggttgtagacctcagtcgggagatcccacccagtgaggagaaatgagatccaggagccacatgaggaagcagcctgaccacttctccttagagctgctgctctgtaccaggggatcactccagtccctaaccaactcagactccctagagcccaaaggcaacaatggctaagaatgtgaaacatcaaagatgacagccccatccctccccctgggaactctgtcccagggtggcttggaaccactgccagctggaaaacaccaacaagggtgactagtgaccctggtcgggaggtcccccacccattgaaaagcagggtctgggacctgcataaaaaagcagtctggatgcttttccatagggtggctgcaatgaaggcaatagctaaggctacaaaacagcaaagatggcagcccacccctccctctgggagctccatctcagagaggtgtaacactgctaccagtggctggctagagttccaagccagtgggtcttatcctgcaaggtgccatggtagtggggcctgcagactgtcactgctctatcccctgtatacagcctctttcctaggggtatgtacaggggtctaacgtcctgcttggctggagttgcagttgcttttgatgggaaacctgggtatctaaagctcccagggctctacgtgtatctgagcggctgcattgctgagactccacataattctgtgtaacaggctgcagaccctggtggagtgggctcacaaggggatctcctgacctgtgggttgcaaagatccaagggagaagcgtgggtcgctggggtcactcactcactcaccacttccctgggaagaggaggctcctctggctctgtgtcactcccaagtggatgactgtcctgattgctcttctccattctttctgggtcaagttgttttcttgatgaatcccaatgcgtgtacctggatgcttcagttgaaggtgctgtatttacttactccttctatttctctccatgaaagtggcacacaccagctgcttctagttggccatcttgaccagcctccccctccatttctttttcttgccttattacactaactagaacctccgataaaatattaaacaaaatggtgatagtagacatctgttcctgaccttgggtaagtaaggggaagcagtcaatatttttaatcagtaagtatgatgttagctgcagaatttttatagataccatttataagattgaaaattcccttctgttcccagtttggcaaaagtttttatcatgaatgggtactgaatgttgtcaaattatgtttcacactagagatcacaatagttttccttctttgttctgttagggtgttgaattacactgaacaattttgcatgttaagccacctatattcccagaataaaacctaaatgctcatgctatattatcatttttctatatcactaaattcagtttgctaatatttaagatttttacatgtttataatgcaatttttcttatattgattctatcaggttctaatctcataagtggagatgtgtttcctccttttctatcatctggaagagtttgcgttaagattagtattaattcttccttaagtatttggaataatttaccagtgaagccaaatgaggcatttctttgtggaaggtttttaactaaagatttcatttcattaatagatacaggactatccaaatgacctaattcttcttgtattaggtttaagatgttcttaaagaaatgtattcatttattctaaattgcatgattaattagcataatagtttttatactattccttttgttttaatatctatatgcagatagttaatatctatagatagatatcccttttttcattcactacattgttcatttgtggctctaatctcatctcatctactttgtggggagtctgaggacaatcagtcttgccaaggctttatcaatttcgtaatctttttaaaaccaactcttggcatttctattttcctcactgtacatcttctgtctctgtcactgatttgtgctcatctcttgatgatggtgatgttgtttgctattaaatctatccattgagttaattattgttattgtatttttttagttctaaactcatcttttttagtgctgatctgtaacctggacaactaaaacatggtttccctgactcctattctgcccctctacacaacagccagagattcttcaaaaatgtaattcagatatcacttctcaattcaaaaacctccagtgtgttcctaccttaactgagaataaaagctgaagtcatggcataaatttggcctcctactatacctctttctattctagctccctgggcctcctgtgttccctcaacataccaagcagattcctgcctctcttgtacttgctattccctctggaacacccttaccttacatataacaacatggcatcctccctcctttccttcagtctctgctcaaatgttaccttaccagagaagccttgcctgaccacctacataaaacagcaccccctactcctgtcaattttctctcccttttttttttttgagatggagtcttgctgtgctgcccaggctggaatgtgctgccaccatctccgctcactgcaacctctgcctccagggttcaagcaattctccctgccttagccccctgactagctgggattacaggcacccgccaccatgcccggctaatttttgtagttttagtagagatggggtttccccatgttggccaggctggtctcaaactcctgacctcaggtgatctgtccgccttggcctcccaaagtgctgggattacaggcgtgagtcaccgcacccagcctactcctgtcaattttcctcttagtactcacctccacctgatagtatttctttctttattctatgtctcctaacaaactacaatgtaaactccatggtgcagggtctttgtttacttctgtattccagtgaatgagtaagtacctgatacataatagatgcttaacagatatgttgagtaaattggataaatgaatacagataaacctcgtagggaagacagtctgaccaaggatgttagtaataggaatgaaaagaaatatggggtgggggaaaatttgagaggcatcataaaggaagaattcataggctttatgagttcttattttaggttgaataatgtctcccaaaaattcatgggcacccagaatgtgactgtggtataagaagaaatatatttggtctttgtacccagatcctggtacaaagctgctaagacctatggaattgtataagtgataggagtggtttttgtataattcttagcaagtccccttcaatcatacctgagttgatgttaatgaggtaacttagagttgaggtccctagatagcctaaggatgggggctggtcaccagaaagaccaagtgattagatggtgaatgctttcaggttcactcccctgacccgtaagaaggggagggggctggaaactcttcaacaatgagattttgagagcttccgggctggtgaccacattgacttgctgggagggtggctcacacagagagggcatggaggctctgcaccacaatccccgacccccaacaccttgcccaatgcatttctcccatttggctattcctgacttttatcctttacaataaactggtaaatatagtgttttcctgaattttgtgagccattctagcaaattatcaaactggaggagggggtcatgggaacccctaagttagtcagtcagaatataggtgactcagacttgcaactggtgtctgcagttggggcagtcttgtgggactgagccgtttaacttgtgggatctgactctaactccaggtagatagtttcagaattgaatttttggacacctggttggtatccagagaacaaagaaatgattgctggtattggaaaacaccctagagtaaccttatttggaaatagggtctacaaatgtaatcaagttaagatgaagttagattggattcgagtgggccctaaatccactatgactggtgtccttacataacaggagtgaaatctggacacagagctacagatacacagggagaccatcatgtaaagacaaggcagagaccagagtgatgtgcctgtctaaaacccaagaactccaaggattaccagcaactaccagaagctacacaaggggcatgaaaaaagatcctcctccagagccttttgaagaaggatgctcctgctggcactctgactgtagatttctaggctccagaactgtgagagaataagcttttgttgttttaagccacaaggtttgtggtaatttgtcatagcagccctaggaaactaatatagtgcctgactaaatttggagataaggcagacctcaggatgaatcacaggtttgaagcctaagtgactggaagaataacttctactgaaagaaatgcaaagtccagaggtaaaattagtggaaaggaatgattctaatttttacttgagtggtccaacacaatcacaggatagtcaaatcgatgccttagtgttataaacaatatgacacaaaggactaatagaacaattaaaacaatatagatataagaattaaggctgggattccccttttaccaccctctagtcaaatccaattaactttttttcaatgatcatgttaatgaccatttatctttgataactttctttacctttggttcccataacatcacaatatagcttctacctctgttcaccaccacacctagctcctcgttctaagtaaacttagtattcttcagtgatctgcaaaatcctgagtttctaattatatttctctaatttgaattattcatctctgtacttcacattctattatttctagttacctatataatatctttacttaagagtctacgtcatgtctacatggatgcactgccatcatttcctatctgacatgtgttttttatctttctactcaactgacattcttcaatccattatcataactccacttacatcttctcacagctaaaatacttcatagttttctttcttatttaccaatatattctgcaattattttttcctttggaatacctctggcagtcacgctttaccttcattcctatattccaagccccaattctagacttcttacctcactttaagtttactataacagcttcctaactggtctccttgtcttcagacttttgtctgtctagcacagtggttctcaaactttagagtccacataaatcacccaggagtgactagtgggattatttaggtgtttcttgcatgttatcttatttctccagcaagattatatagttatcaaagccaaggagtaatcatggcttctatttctccccagtgtatagtgtaatctaggccacacaacatattcaatcagatattttgcaacttcaagactatgattcatctcttttttgaaaacattcataatagtatctgaccaagaattatttcagagacgtataccttagaataaaattaacaagttgtcatttcaggttcctcaagaaaaaagaaaaaaacccaactcactgtgttcacttcaagagatctctcttcaatgggggtggggggaatacactctctctgtatgtatcagtcacagaagggcatcccaactcaagatcctgttcaagcttttccaaacaaatcaacacaacaaaacatcatttacaccaaagactacttaaaaacagcagaaatgacaatctctgtgctcaggagcttggagctctgagtaaacacagacggcagcgagccatcttacccagcctcagggaaaaaagaacttttcacaggaaagcaactccaaaggattatttctgcactgggttcataatttgtgacttttgttacatcttacggcaaaaaatgctatgacttttggcattaaagaatctaagaagtctgttgcactcttatgaattatatttatgtaatctgatagccaaaatggtcaaatagaagcattatctttaacttgaatgggaaaagggtatgagttaaattaatttacagtgattattctgacataagaaacgactcatatggaccatagctatattaagcgaaaagttgtaaagtatttggaatcaaggaaagtaggaaattaaagcctaacagcgcagtggaaagagcaccagactgagaacagaaacatgtagattttagtcaacttttgattcttactagttaagtaatcttgggtacctcctactttaggttgctaacttgtaaaagctatttgaatgctaagatcccttccagtcctaaaattatacatacttatatactttttaattgtatttctaagttacacatgatgtttttctattttaattgatgtaaacttgtaagctcctagggcagtgtcccacatagtaggacaattctaggtcataatcattcactgaattgaccttaacaatttcactatgacttaaatcacaatccatagatcacattttaaaaagtaaaatgactatctactatcttcacactcatcatctggtagacatttcagtagaaaaaaaaattcatcctgtcacaatactaatgaaatgttactttgtagtgttttggggtttttttgtttaattattatttttttttgagatagggtcttgctgtgtcatccaggctggagggcagtggtgccatcacagctctttgcaatcttgaactcctgggctcaagcaatcctcccacctcagccttccaagtagctgggactacaagcatgtgccaccatgcacagttttttcatgttttatagagatggggtctggctatattttgtagatttttaaaaatataacctcctccactccttctggtatacttatgattagctgataatctcaccactgggtgtcacttttgcttcaaaagaattcaacccaaactaaccttaataattagaatttgatctgtaagatacttattcctaaagcctcaaaatttagctcttaaaatttcttgctgtaacacggcttcagatgtttctaggcttcaaacacagtgcaaacaaaaatcagtaggatttctgagttcataggtcataaaacaatcctctgaaatcccattaatattcatacacttttcagtacctacatcgacagaaaggaagaaaagtgacatatacagaaaaacaaacaagtgtgcatatttgggtataaaacactgggatccctatataataaatgctgtttttccaataatactacttctagcattatgagaagataaaagtaatattcagagaccaagaaagtagagaaggaatgacttttagactactcatgttgtcactccaaccatcagcaacatttggcagtgatatccaattacataaaaaggggtctaggaactgctgtgtggttttcaaattcagaataactgaacgatctacagttattttctcttatccaaatataaacagttaacctttccaataaacagatattaagataatggttcctgcacctagaagcattttcctctcacctcagatcttctctcctctccacaacaaatgctactattaggggaatttatcaaatgaagacaactcaaatcatttgtgggactttacatataacacgcacacacacacacacacactttatcatgtccctcctcttcctctaatcctgttgaaaagattaccatgtccttcccctcccttaatcaccaccataagtcatggttactaatgggacctgttatattattcttgggtttgctgaaatagaaaaaagttgtaagtcactgatttagaagatccatctagatacattatttccatgatgccctggattgtttccaagaaaacaaagttaggttctggagaaaagtatgcctgcaaaggtaaaacttaaaaaggatcacaatgctgtgggaactcctgtggcagtttcagaaaccaagggagtcccatttcctcctgctggagcaaagaaatacttgctcttgtatttctgaattggaaacaaaaaagccttttaaccacaaaagcaataaaacagatattaggtataaatgaaacaagcttaatcacactataatttaactggagaatgtgttaaatatgacttccatgggatggcctggaaactatcactctgaaaaacaccttctgtatggaaaaatgcatgtcagctcaaaacaactgacttacatacaaaatttagaaacaaacctgctggacagtttggattttcccaatttatttctgcaaggttgacagcaaaatgtcatgcttatatatcaaattaaacatatcactaaaatctcagattcaactatatactttattctcctataagagtttattaggatggacgcggtagctcacacctcttaatcccagcactttgggaggctgaggtgggaggatcacttgaggtcaggagtttgagaccagtctggcaaacatgggaaaccctgtctctactaaaaatacaaaaattagtcgggtgtggtggcatgtgcctataattccagctactcgaaaggctgaggtatgagaatcgcttgaacccaggggatggaggttgcagtgagccaagattgcaccactgcaatccaacctgggtgatgggagtcagactctcagaaaaaaaaaaaaaaaaaaaaaaaaaaagatttaattatattttactccatagaaatcaccttttttcctttttttttttttttttttttttttttgcgacagagtcttgctctgtcacccaggctggagtgcagtggcacgatctcggctcactataagctctgcctcccgggttcatgccattctcctgtctcagcctcccgagtagctggggctacaggcgcccgccactatgcctggctaatttttttgtattttttcagtagagatggggtttcactgtgttagccaggatggtctcaatgatctcctgacctcgtgatccacctgcctccgcctcccaaagtgctgggattacaggtgtgagccaccatgcctggccagagatcactttaataagaaccacttgcctttttctgggcaattgcagctcgctgcagtttctccttagcttgattgtacttttcttctctgtctgtgatacgctcatgaagcttatgcttttcttccaaccactgtatctgtttctcttccaatgtcctgtcagaagaatgtatgtaaaacatggaagttaaataagttcttaggattaaatagatattatcacaagtataagcaaactcactacctgtctgaccacattcttaattatccaactgcaggccctcctgtatggccacttgtttggaaatcccaccattactgagcacttcctatgaataaggcactggacttagaaaactatgtgttctttacaaaaatcctgagttaggtatttctgtcacctttatacttctgtccattttataaatgaggaaactgaggattagagcagttaacgaacttaagggctcacatctagttaatggcaagacaaacacttgataaccagatgtgaagtataataaccatcaaactacaaatatctgtcctcataaatttggtttaagaaaatcaagcctggtatcaaatcttaatgcagtatgtcttctgactagagtaaaatgcatataaatgatatcttaaaataacatcataacaacttatatttttaaagctattctgcatactttatatgatttttttagtattcttactataggcagtactaatgaaaataacaaaccctgagaagttagattacttgcctaaggtcatacaagattttaagtatcttagctggaactaaaatcacattccattgacccttagttcagctattttcttctatgaaattctatgaatattatttagaaaccaatgattaattacttaaatttgctagctatactgtcattagaattattaagctcatttcaatcaaacacttgagaaatccaagcacatgtttctgttttttacaaaataaaagaaaaataagttggatcaactgaaatgtcacatgctatggacatttatcttgcttacttccttttcttgaaattcaaccccatataaaaaagcatggacaaacctttgaatatgtaataatagaaaaactgaagaaatacagttttatgtggcatggtggccttcagaagaagaaatttgaaaagaataatgttttgtagattaaaataaaaacttacttacaaggccaacatgttataaagacaaagcaaatacaaaatagtacagtgttctaccacatctaaacaaatttttccagaggatataagatcttgaacatcaccacaatcattttatccctaccagttttactccatactgtctactagtaacaaattttaagaccaaaaaaaaaaaaaaaaaaaacaaataaattagcttttcaaagaaaatccaagatagttctaattcaaggaattaagttttgcacatcaaaaacaaaacaaaaaacccattctgttctctggcattcagaagaatagatttttgaagaaatgttttggtttaatcaatgaataaaaaaagttttctttgaggtttttcagaatactatactgtcagaattttaatgtcttaatttttttaaaaacaattcaagagtcagtatagttcattctataaaaacataaagtacattattacctcagtagaccattgtacactattaaagtgtatttgtaactagtttctaaaatataatcaacattggaatcattactaaaataagtacatgttatatagaaaaaagaaaaaatagtttgtacataaagagcaaactctacttttcagcttctagttgcgctttttcagcttggcttctaaaatttcggcattcttgttttaatctctccaccatttccttcagcatttggtttgaattcagcaagtcattctctgactgtgcaagtgaagtcacttggatctgcaaactactgatttgcttaaaagagaagaaagaagataaattaaagcccactaaataaatgcggtaaggtatgagagaagcagaagatactaagcatctccctttgcaaatgctccctcaagctggtgtgtccttggagatgacccctaaaggaaataacaaatagcagcacccaggagcatttcttattataatcagagactatcaagaactatattcctcagtcactgagtcccctccctcttctttccaaaatatgcaggccaggagaggtattgggaatggagagaagggttatcagggggattagcagtgagatgagaaaagggaatccagtgattagagtgagtctcctaccactctagccttctcctcacctcctaggaaaaaaaactgattttaaaagcaagtcagctgggaaagcagctaaaaaaaaaaatccatcctcctcttcccacataccctgagatcagcaaccttccagaagttctactctccgagcaatcaaaattgttcagtgtaaatgtgggaaggatcactcctcacattgtttttaaaaggtttccaaaccttctgtatgtccagtgctgggcagaagaaagatgctctgggaaatctaataaatgctatagattccttggcctctacagccatttaccaaactacataatgtcactcacagcttttttttccatcccaatttacctttatctgggagtactttttctcataagaagtctagttacagattaacaggctagaaagattcacactcttctaaattatatccaaatctctttatttgggacagttacacatacctcccccacaagctattttaccaattagtaaacaataaaagtccttattttcctttcacttccttttatctctcttagccattttctgaagacatttcaaagcaaagacagtcaagagacagggatcaaaagaacctattatgagattcaagggtaaaaagaaacaagattcttatataataaacaaaataaatgggtaataatctcattacttcctaatggtaacaaaacaattcagataggattctgaaggtccacagagcaatttttagcagaataaaactaaacggtatgtctcagatttctattttagaataaatttatccatgtagaactattcactctttatttttaactggagtggcaaatattaaatctgtattacagctgcttgaataagcaaccttcaaagagcttaatacctctccatatgcatagcatgacagaaagcccaaatgccaatgatactaaataacttctgagtatcaaacgttatgtccatctagttaagacttagaaaccataactgcacatgaaaagcagtaccaactcgcatatgagcatgaattctaaaaatggaatcctacttcataatttatagggaaaaaaacaacaacaaaaaagaaaatagaattcagaaaagatcactcttccatgttttacccaactttatacaaatctttcctgaacccaaataactttaattataaacacaaatttccttccataaatacaaatcttggatttcatagggatatagcaaaaaatacctcatgatataaagttacaagtcaatcacacaagtaacttaaaacctggatgatatttctattgagtttttaaaattctgaatattaaaatactgtccttataactgtaattaaaaattatcatgggccacagcatttaataaataaatatatatatcttaagaataatagcagttagccaaagaagcttattaaagtatagaagtttaaacattttaaaacattttatctttacatatcacctccaacaatatgttaccaattgtggttagattctaaaaatactgatggcaaaatttttttaaaatttgcaaaacataaatttaaagaagcacttgaaaaaataaaaggaaaatcttcgctaaaatcatacctgttttaggtcagaattttcatttttttccttctctgcattttcaatagtcacaatttgttgctgaagttttaacctaaaaatcacaacccaacaaaaggcattattaagaatccatgattcatttatttcactgaattaaagagtcattttattgaatgcctgtttgacaccagagcacaaacacaaccaaagattgagacttcaagaaactaggttgtgttcacgtataacaaaaatgtaaaacaaattactgctattgtgataggaaaatctacaaactaggggcatagagaggataagaaatcaagtctgtccaggggtactggggaacgctacatggataaaaacctgacaggtaggattttgatatacataaacaacagcctgaaaaagtggcctttcatggaaaattatagaatgtgttgctaaggtatcagaaagtagtctagtttaggagaggccaacttacatccatatagtattttacaatttgcaaaattctttcagacacacgctacttcattttccttctaacaaggctacagatttaaaagaaaactaatacaacacaccatcctgtattctataaaatatcttatggagcttttcatccctgagatgaatgaatacttacacatttgcagactcttcaaagggaataatacatctacagccagagccttaaaaagcagagcagctctagtgaccaaatgagtaacctcatgaggaagacattacactaattaggtttggcaggataggcccttcagcctcctccctttcaaaactcttcaaacgcctatctcaaatataattcacttggcacctatttatagcttggtattattagcatgtcttatctgcccaagtagaatgtgtttatctagacaacactctcaagaccctaggtctgtgctttaaacacaataaggactcaataaacatttgttggcagactgaacgaaccaacccaaatcatggattagctgtttaaatgtgtgagatgattggataatataacataaaaaacctgaagatatgacccattgcttcctgagacgtttacatacaaatgccagaaacgataaatctaaagagggccagtccttttccttttgctccaccgtcagtaccagtcacattcttatttcataattctagctacatgattactcattcaaactttctgtgcacttcctccattaaatgtttatgaatgttatcaactgggtgccttctttttttttttttaaataagagatgtggtctcactatattgcctaggctgggctcaaactctttggcttaagcaatcctcctgcctcagcctctcaggtagcagggtggctaacttggggcttttaggttactgacttataaaggtttctttccacaaaatcatgaagatgaaaatggaacagagaacactgtgggtcccagctcaggtccacagttagaaaacttaggccctaagtatatcctagctccagttgagaatctggatacaattggtaaattaacaagaaacatgacccagttaagaaagttatggcctaatgctttctatataggttacacagacatgaagagaaacaatagtgccctacatacaaaagctgaagccaaagaaaccaatggtagagtatctgaaaattcattaaaatatgaaaggatggggaaaacaactaaatgaaaatatgaactaagtaagagcaccattgtggtagactatagaagatgatatacaacaagaccttccttcaggtcattttgttgaagcagtactgggttagaatctaaaactcatttttttttggagaaaattagtccatgatttaagatcattacatttaggattctatgggataatgaatcttaagataaataagataggaataagactaatggtattaaagttcaaaaaggcagatagtttcaaaagacagtgctgtaaatttaggagtaaagtacagtatctctttttattaggttttgaatactcaaggtgtgtcacagtaagtcaaaagaaaatataccttataacagacgtacaaggaacagaaaaaactgcaattaactttcattagaggataagttaaggctacataaaagagatgcaatttgaactagatcttgaaggaaaaataagagtccgagatagagaaattaaagatacaggtgacgaagagtatagaggaagtagagagatgggattaaaagcactgttcacttaagaagtaaaggggaaaaggacattttcaaaatagaaagggaggagagaatggatgaaggtaccggaattataagatggcaagaagttgagaaaattcatatccttagcttatgtacaagtaagaacatcgaacagtttccaagctgaaaaggaagcaagggagccaggttaataggctggaagaaaaagagaagtccaaagactgctaatttcagtatcttcagtgacaggagcatggataagagaaagaaaagatatttatgtctttgaagtgatcagttctaggtgacgacaaggtccaagaagcgtctaggtgtacaagatgctaaagtagaataaagataaaagaatgccagagtgcagatagaataaactgtaaggctaaggtgttgggtagttcaacaatatgaatacatagtcaccaagaatgatggtaagagaaacagaaaacagaaaaaagttgagccagatatcaaagtcctcagcgactgttaaggaatacactgtaggtcattaactgcaagagataaaagacaggtataaaactggatgccacaaatatcaaagaaaaaaatcactttaaccatactcaaacaatgaactggaagcacaaacggggcttacaaatgctcatttctcttcttggtctcttgttgcaggagagaggaaggaaaagtaatttctacttaaaaggcattccaggttatatgccatgagaggaagaaagcagttttcagcagggggagaggcattaaaaaaatgttgagattgcaaaaaaagttattggtatcagaatagggattccagaggctacagtggaaactgttaaaagttttaatgagtaggtgatagggagaaatcagagggtgaaggatgagtaagttgggggaaaagttaactatgagatcaagtactttatacttttgaagtaattatgaaggcagaaatagtaggtgaactggagggccaagttacaacagaaaatgtagctataaataagtttaaatggaaactttggaataacattaagatggaactatttcaagttcccttcaaagtatagggaagtcaaccgtaaggatcatggtctaggtcttctgtggcaggcagctgatatactgatatatactatttctttttttttttttctttttttagagatggagtttcactcttgttgcccaggctggagtgcaatggtgtgatctcagctcaccgcaacctccgcctcctgggttcaagtgattctcctgcctcagcctctcaagtagctgggattacaggcatccaccaccacgcccggctaattttttgtatttttagtagagacggagtttctccatgttgggcaggctggtcttgaactcccgacctcaggtaatctgcccgccttggcctcccaatatatgctatttcgacattcaacaaatatttattgagtacctatacatgctaagcccattctaagtgttgtggatacatcagaaaataacaaggacagaatgcctacccttgagtttatactccaacagtgttgtctgatagaactttctttgatggtggaaatattctacaatctgtgccttccaatatgatagtcactagcaacatgttgctagtgcacacttgaaatgtacttcatgtgactgaagaaactgaattttaattttttaaaattctaatttaaatttaggtttcaacagtcatctgtgactagtaatatcatattgggcagcaaaggctctaatgtaacttcttggcttcatttaatgtgagtccctgctatcaaagggaagcaacatacagggcaaacaatagaagttgtatttttctactgtgatttctctactgtcaaagagtcctacaagtctcatgagaatggcagtagccttcttataccaaccttctgaaagcatggttcttgcttgtgagcactggaaattgacactggccattattagcaaaaataaactttcctgaaagaatataagaacccactcaaaagagaactagaaaactgaaaccaggatacaataattgataggaatcacaggcaaagacatgccacagccctgcctggtccttcaaacattgacacatatcctttcatcccttacttcacagtttaaattcttgggagaaaatgtgtccaatgggccaatataattcttttcaagatggagtctaagtagaaaggtggatatattaaatgatagttttttggtttgtttttaaaaaagcaaatatccaacactggcagcaaagaaatccaaactgatgaaatgtaaacgttcattaaaagctcaagaaaaaaacagaaagccccaaatgggaaataagagccctggctttaagccatgcaaaaaataaattaagggggtattgactacaggatatcataaatgttcagcttccctttcccttggttattgctattccccttggttatttgctattatatcaaactgcatatcatttacttcctcctccttcacccactccacacagagacatgggcatataaccttggctgagccagagtgcctgataccacggtcgcagtggtaggtccagggatgagcatgtgaactagacccaaacttgtctctagattttttttttttttttttaagacagagtctcactctgtcacccaggctggagtgcagtggcacaatcttggctcactgtaacctccgcctcccaggttcacgcaattctcctgcctcagcctcctgagtagctgggactataggtggctgccaccacaccccactaatttttgtattttcagtagagatggggtttaaccaagttggccaggctggtctcaaatgcctgacctcaggtgttccacccgcctcggcctcccaaagtgctgggatcacaggcgtgagccaccacgcccagcctcgactctagactttttaaacttgagtttgctaacaagaactttgtcctcttggcttcaacatatgttcccagcatcacagagataggacagcagacaaacgagagagataataagagaggagagagaaaataagagaggaggaataaaagaaaaggaggagaaaagtcactattatctaattgcatttgagttcctagatccaggtgtccctgaaaccagcaaaacccttatctttcccacaattgtgtaaaccaagaaagtcccttttgtttgcttgcattagttggagttgcgttgctgtcataaccaaaagttgactacatattctattatatttaaactcctttaatttttacatggttttaatttgcaaattgaataaatgtgcagcggagcagccttttgaaatacagtacttttataaaaataatttttattactcttggcactatgataagctagtggtaaaaaaaaaacactttcatcaaaagaaaagactggtatataattaataaaggatctgtcaaagcagtgattaatatgtaatagattaatatctacttatcacagatatatattatttgtaaataaatggatatttctgctttgcatgatttatactttccatttccttagtaagaccttttgcttcacagataagtctccaatctgtcacgggttatctaaataggaggtgctgcaattatgaccattttaatgaatgatcaaaatagacctggttgatgtagctggacttataaatcagtaaatcataactgtcaaggaaaaaataccacaattgttgaacattaaaaaaaaaaagccatgcaaatcgtgtgaatttaatcctgctagattttatgttggttactatgtctttattttaaaataagttgaggtcatttacacattgtaagtgaaactccagaggaatcaaagaaaaattatcaatgtgactaacagaatagaaaattattcacatttaagaaaagctaaaggaatgaaagctgttttatatagcaaaaaactaaaaaacaaaacaaaacaaaacctaagggtcaagttcattattgtgttcaagtaatgacagaatgctgaacattttatcactatggcaacagaaacccaaagcaggagaaacaggcttaaattctaacagaaaagattctaactggccaaactgtgggattatcataggataaaacattagagtaggatgcctggggagggtctacccctactttctggagactgtcaaagagagatttaaaaacgacctgtcttgaatatgtcctaaaaaatgtacccatctaaaagcaaaaggacagacaagattggttcttaaaatctattacagattcatgcttttagaatcacagccactaacaatttaaataaagttataaaacctaagtaagtaataagtatacctctgcctgaagtaattctttcctaagtaatgcagatcaagaactctgtctcaaaacatagcctaccacttaatgaacatgatttttaaaagccactcaaactttatataattagagacgtcactaagatattagaatttgaaaagcagacataaagcatttccaagtgttgaggataacagcagatgtctagctctgtgttatccatatattctgcaaaaacaatacagaaaaagcaaagagaacaaataaagccacacaaaaccatacccttagcataactggcagacagaaaatgcccaaaacctcaaagtaactaagtaaaatgaaggaaaaaataccaaatcccagcaagtgatctctcccattcccgcctgcacatctttgcaggcaagggctcactgcatgtgaatgtacttaattcgcccattaaaataaaatgtttaatttattaaaatttggcccacaaaacaagacccaactaaacgctacatataaaacacacatttaaaaagcaaaacgattcagaaaatttaaaaataagaggataaaagtataccaggcaaatggaaactatatgaaaacagaagtggtgatggtatcagacaagtcaagcaaaaaaaaaagacaaaaaaagcaatttttaatgctaaacgctacaattcacacttaaaatagaactgctatgaatatttatattctgtaccaaataccatgaaactcacctttatgaaacaaaaactacaagatatacaaagagtcacatacagaaacacagtaataataggagactttaatatatcattctttgtacaagacaaatcaagtggacaaaaaataagcaagtatacagaagacctaaacatcgcagttaacaaggcagatcctatgtgtacagacacatatgtgtgtatgtatgtctgtgtgtgtatgtatatatatatagaacttcatatatatatatatatatagaacttcatactcttataagactccatgtgtttacgtaacacaataactgacatatactatgggactaagtgactatagttctatagtcgctgggcatgtgacatgtccagaatgcgaacttaagaagacacccattctaagactcctgcaagtgcagggtcagcaccgtgagactgtcgccttaaattttttgcaccctgggtgcctcaattgctttaccctagtcctacccttgatagattaggttacaaagaaacatcagagtgttccacaaagcagaaagagtacaaacaatattgtgatcacaatgcaataaagctagaaattaacttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttttagtagagacggggtttcaccttgttagccaggatggtctcgatctcctgacctcatgatccacccgcctcggcctcccaaagtgctgggattacaggcgtgagccaccgcgcccagccgaaattaactttttaaaaaggttctcctacctggaaattaaaaaaccttctgttatagactgaaacatgttccttcaagatatgactacatttcgagatagggcctttaaagagacaattaaggttaaagtcatatgggtgggccctaatccaatatgactagtgtccttacaaaaaggatagacaagaggggatgcaaaggcacagagaaaaggccatgtgaggacaaagtgggaagaaggtggctacctgcaagtcaagaagagaggtcttaggagaaaccaagccaggcaataccttaatctatgacttctagtctccaaaactgtaagaaaattaattcctgttgtttgatcacccagtctgtggtattttattatggcagacttagcaaactactacatcttctgttaaacaactctttggcagaaagaaaaatgcaaattaaaattagtgaatttctttaaaaataataattaaaacactatataatttatgggatacacgtaaagcagtgatgagaagaaaattattagcactaaatactcttaccaataagaatgaaagaataaactgtagtaaaattaaattctcaactcaaaaacaaccaaatgaacaaagtaaactaaaagaaagcccaaggtatacaacatgaccttagaaaactctaagaaatcaacaaagcagctattagaaaatatgtgactttagtaaagtcacaggattcaagatcaatacataaaagtaaactatatttctatatgcaacgaacaattaagaagtcaaatgaactccatttataccatatttagaaataaaattgaatcaaagatgaacatgatatatacaatgaaaactgcaacacactgatgaaagaaatgaaacctaaataaatggagagatgtatgatattcatggattggaagactcaatattgttaaggtaacaattctcctcaaattgacctaaaaatccaatacaatcccaattaaaattttaacaagaatttaaaaagataaaaaactgattaaaaaattaatatttgaaaggcaaaggacctagaaaagccaaaagaatttagacaaaaaagaaccaggtagaggacgtgcactacctgaaccaaacttactataaagctacagtaatcaaaatggtatgatactggtgtaaagacaagatcagtaaaatagaatagagtccagaaatagactcacacctgtaattcagtgagggaaaagatagtcttcaaaaaatggtgctggaacaactggatacctacatgaaaataaaaagcatatgtgtgccattaccttacaccacataaaagttaagatgaattagaccttaaaacctaaaggtaaaaaccaaatattaatcttttagaagaaaacaaatatctttttaacacagaattaggcaaagacttcttgaagagaacacaaaaaatacaaacaagaaaaaaattgataaagtggtgtagtattatgatgtatatatattggtttacatatacatatgggtttacattcatggttcctggctcgtaacttccatagcccttgtccacatttcctaagtgactaaaacaatacatgtatctttgttaccgtattaggccctttgtttatggctcgggaggcagcttcagaacagcttcagagtgataaaggcgaaagacagtctttggttataatactggggtgctctgggcctcagaaaacagaatctctctctgaccttctgtcctccttttacctgcgcctttttctctccaaggcaggccacacacactaaaaatatactccaatcttcccccatctttctgtcttggaactggtcataaaaaaatcctctgaattaccttacccgacagcaggtcataagacccgcatttctgaaggggtcctgccccttccttatccaggaggaaataatgctacacagaggggccaagaagaatctaaatgcacaggacttgttacaattctctgcacagtctattagtattagatcatgccctttttgtccaataagatttccatacgattgtccattcttcaatcatgtttatccaatgaagtctccaaaaaagactcaagaggacagggtaccgcaagcctccagacagctgaactcatggaggattacatgaaggtaaacaagaactcacccatgtgctaggagaatggcacactccaacttcacaggaacagaagctcctgagctctggacccttgagatctcaccctattatttctctttcttattgtttttttgagacggggtcttgctctgctgcccaggctggagtgcaatggccaatctcggctcactgcaacctctgcctcccaggttcaagcaagtctcctgcctcagcctcccgagtagctgggattacaggcacctgccaccacgcccaactaattttttttgtatttttagtagagacggggtttcactatgttggtcaggctggtctcaaactcctgacctcaggtgatccacccacctcagcttcccaaaatgctgggattataggcgtgggccaccgcacctggcctattatttcttcatctagctgtttatttgtatccgcagtgagctgagatcacaccattgcactccagcctgggtgacagagcgagacgccgtctcaaaaaaaaaaaaaaaatcctcttcaataacctgggaaacataaagtgtttccttaagcttgtgaaccactctagtaaatttagctgaaagagaaggttatggaaaccccaacttaaaaacctggtcgatcagaagttccagagtcctgaaagtgagactggtgtctgaaatggtggcaatcttgtgggaccaagccttcaacccgcaggatctgatgctatctccatatagagagcagtagaatcaaattagattagaagatgtcagactgctgtccactgcagaactgaatgcttgcttgttgatgggtagaaatccatacatttggtcacagaagttttctgtgttgtggtgtgaaaacacaggaaaaaacaccactcaggagttcaagaccagtctgggaaacatggagaaaccttgtctctgctaaaaatataaaacttagccaggcacggtgccatgcacctgtagtcccagctactcaggaggctgaggtgggaggatcgcttgagcccaagaggcagaggttgcagtgagctgagatggcaccacggcactccagcctgggcaacagagcaagatcctgtatcaaaaaataaacaaatatatatatatatatatacacatacacacacacacacacacatacacacacacacacatacacacacaagtaaatgaaaaggaaagtcatagataaggagaaaatatctgtaaaatatgtatctaagaaagagcttttatgcgtaacacataaataactattataaatcaataagataacttctgaatgtaaaaagtggccaaaatatttgaacagaaacttcacaaaagtagcttataagcacacaaaaagatgctaaccaccactagtcacagagacaataaaattaagaccacaggtgacatgttacaacatatccaattagaattattattaagactgaaaataacaagtgtcagtagggatgtaaaacaaacaaaatcctcatatattgctagttggaatgaaaaaacttctcaagtgtttccacattggaaaacagtatttctgtatgttataaaattaaatatatacttaacatatgacttagtaatcccatttctaggtatttaacaaggagaaataaaaacatatttccacacaaagacttgtaaatgaatgttcacagcagcattattcataatagcccccaactaaaaacaacccaacatttgtccaacaaaagaataaataaatcatattacgtttatacaatgaatactaatcagcaataaaaagacatgggctactgatacactcagagcatggataagtcacgggttgcctaatgttgggactcaggaaaggaggtcaactataaagagacataaagaaacttttggggtgatgaaactattccatatttttattatggtgaggattgtacaactgtatacaaaatggatgaattttattttaggtacattaaatgataacaataaaactatagaaactttttaagggcaaagaaccagaagataaaagcagaaattaatgagttagaaaatgggaaaccagtcgatctaataaataaaccaaaatcctaatttaaatgaatgtactgaactgtatgttttaaaatagttaaaatggtaaattttatgtatattttaccacaaaaaaaatatatatatatacacaaagcagtggctgacttgaccaagaaagaaagaaagcacacgtatagaacaaaaaataacaaaggggaaataagcattgaaacagaaaaaaaatttaaaaaaaagaggtctacttttcaaaaggaggagcatagtggccagccgtcagaagttgacaatgaccagttgagagcaatcattggagctgatcctctacaactacacaagaagctgccaaagaactcaatgtcaaccattttatggtcatttggcatttgaagcaattcggaaaggtgaaaaagctagataagtgggtgtctcatgaactgagtgaaaatttaaaatatcgtcattttgaagtgtagtcttctcttattctatgcaacaacaaactatttctcaagcagattgtgacatgcgacaaaaagtggatttcatacgactaccggcaatgaccacctcagtggctggatggagaagaagctccagagcacttcccgaagccaaacttgtgccaaaaaggctcatggtcactgtttggtggtctgctgccggtctgatctactacagctttctgaatcccagggaaaccattacatttgataagtatgctcagcaaatcgatgagatgcattgaaaactgcaatgcccgcagccggcactgatcaacagaaagggtccaattcttctctacgacaatgtccaactgtatgccacacaaccaatgcgtcaaaagtggaacgaactgcactacaaagttttgcctcatctgccatagtcacctgacctcttgccaactgactatgacttctttaagcatctcaacaactttttgcagggaaaatgcttccacaacgagcaggatgcagaaaatgctaagtgtttgtctaatcccaccaggtgtggtggctcacacttgtaatcccagcactttgggaggccgaggtgggtggatcacctgagatcaggagttcaagaccagcctggccaacatagtgaaacaccgtctctactaaaaatacaaaaattagctaggtgtggtggtgggtgcctataatcccagctactcgggaggctgaggcaggagaatcgctgaacccaggaggtggaacttgcagtgagccaagattgcgccactgcactccagcctgggtgacaagagcaagactctgtctcaaaaaaaaaaaaaaaaagaaaaaaagtttgtagaatcccgaagcatggatttttatactacaagaataaacttatttctcattggcaaaaatgtgttgactgtaatggttcctattttgattaataaagatgtgtttgagcctagttacactgatttaaaattcatggtccaaaaccacaattacttttgcaccaacctaataatacaccatattaaaagaatgaagaaaaaaatgcatgatcatctcaactgatgcagaaaaagcatttgacaaaattcaacaccctttcatgataaaacaaactaacaaactcggaatagaaggacactacctcaacataataaagccatatatgaaaaagccacagtgagtatcataagcaatggtgagagactgaaatgttttcctttaagatcaggaataaaccaagtactcccacttttgccacttccatttgacatgaaactggaagttctagccagagctattaggcaagagaaagacaatgaattcagcaaagtagctgaatacaaagccaacaaacaaaaattagctgcatctctatacactaacaatgaatactatgaaaaggaaaatgaagaaaataattccatttacaatagcatcaaaaagaatacataaaaattaactgaaccaaggaggtgaaatacttagaaaactaaaagacgctgctaacagaaattaaagaagatataaataaatggaaacacatcccatgttcataaattgaaagattcaatattgttgagatgtcaatactaccaaaaataatctacagaatcaatgcaattgctatcaaaatcccaatattttgcacagaaatagaaaaatctatcctaaaattcgtatggaatctcaaggcaacccaagtagatgaaataatcctgaagaacaaaactagagaactcatacttccttatttcaaaatttattgcaaagttataataatcaaaatagtgtgacactgacataaagaccaacatataagcaactggaatagaatacagaatgagtaaataaaccctcccatatacggtcaaatgatttttgacaagagtaccaaggtcattcaatgaagaaagggcaatgttgtcaacaaacagtgttgggaaaactggatacatacatataaaagaatgaacttggacctctctttatataggaaaattaatttaaaatagatcaaaggactaaatgtgcaacctaaaactataaactcttagaagatgggggaaaggcttcatggaatttgatttgataatgatttcttggatatgacacgaaaggcatagggcaataacaacaacaacaaaaaaaaacagacaaaatgaactccatgaaaataaatttttctgcaacaaaagatacttatcaacagagtaaaaccctacagaataggagaaaatatttgcaaatcatgtatctgataaggcattaatatccagaatatacagagaaaaactaaacaagaataaaaaataaaatttttaaatggacaaaaaacttgactagctgtttttcaaaaaagatgcatattaaaagatgctcgacatcactaatcattagaaagatgcaaatcaaaactacaatgagatacttactacctcacacctatcaggatggttactatcaaaaaaacatgaggaagacatcattaagatgactgactagaggaccaacactcttccacaaaggcccaaaataacaagtaaataactgcacttcaggtaagagtttctaagggagaacaacagaattcacatgaaagagaaaaaaaaaatccacttaatcatggagacttgagatggcagcatagagaagaaagcaaagcacccagccaggattggctcagaaccaagagagactccccattgtgtgagaaatggtaggtaggagttccttagcaatccctaataccactgtggacatgtgtaaacctagctacagaagagccctagagtcctaacaggccctgaatccggtacagggagctgcttggagtccacatggttacattgctccagagaaggaacacacactgggtccccccactccctgtgacccaagctgctacagcatggcaccattttgagaaccgagccaatgctgaaatacatgctgccatggggttcaacagacctggtatttccatatctgaagggtcccactgtaatcatgccacaatcaaataaaagggtccaacaccacaacctcagctacacagagcagtaaagccaaaactccagaacctgagctgatatagtagacctaaaggaacaagcaatctagcacagcagggaggccacctccaagaccaagggcactggtgcatgcagtccctagggtttaagaactagctgccagccactgccagcaatcccattcccataactggtgaagcagaaatgcaccccacatacctgtagggaccaatgatgggcccatatggcaacagccaccactggcaattccaccccacaactggcaaagccaccatacccaatgagcacccaacacccaaggcctgagaactgttccacctagaggcccctatcaacaccaaagacatgagattcattctacaaaaactcacagcagagaccactgaggtacttgcagacactgctgacacgaattacagccaaagatcatatggagactacattactgtactaatatagaaacaaagccaaagcaactacccaaacaatactgcaggacaaatatacaggaaaaagtccttctttacaaaagctactccataaaatagaaagagacaactattctaccagatgcacccataacatagggacacaagaaacatgaaaaaagttgggcgtggtggttcacgcctgtaattccagcactttgggaggccaaggcaggcagatcacgaggtcaggagtttgagaacagcctggccaacatactgaaaccccgtctctactaaaaatacaaaaaattacctgggcttggtggtgggtgcctgcaatcccagctacttgggaggctgtggcaggaaaatcgcttaaacctgggaggcagaggttgcagtgagccaagattgtgccactgcactccaacctgggtgacagtgtgagactttgtctcaaaaaaaaaaaaaaaagaaacatgaaaaagaaaacatgacacctcaaatggaacccaataatactccagtaatagaccctaacgaaaaagaaatctaaaaaatgcctgaaaagaaattaaaaataacaatgttaaggaaacttggaaagatacaagagaatacagatagaaaattcaacgaaatcaggaaaaaatgatatgaatgagaaatctgagagacacagatatcataaaaaagaaccaaacagaatccttggagctgaagaattccatgaacaaaattaaaaatacaatcaagaatttcaggaacagtctagatcaagcaggaaaaagaatttttgaacattaagacaggtcttttaaaataatccagtcagacaaataataataaagaataaaagggatgaagaaagcctatgagacttatgtgacaccattaagtgaacacatattcacattataaaaattccagaagaataagagatgggaaatggtatcaaaaacgttgtaaacaaaatcataactgtagagttcccaagtcttaggagagagatgaacatccaaatccaaaaagctcaaagaccccaaactgattcaacccaaaaaggtcctctccaaggcatactatactcaaacatcaaaaatcaaatcaaagagagaattctataaacaacaagaaaaaagcatcaagtcatatataagaaaatccccgtgagacaaacagcagatttctcaagagaaaccttacaggcaagaagagaacagaatgttatactcaaaagtagtgaaagaaaaataacttccattccaaaatactatacccagcaaaactatcttcagaaatgaagaagaaacaaagtctttctcagacaagcaaaaactgagacaattcatcaccactaaacctactcaacaagaaattcttaagggagtcctacaactgaaaatgaaaagacaatgactaacatcatgaaaacatgctagtataaaactcactagtagagcagatagatatacaaatgagaaagaaatcaaactttgtcactacagaaatccaccaaaccacaaagataaacaattaagagagcaagaaagaaacagaagatctacagtacaaccagaaaacaattaacaaaatgacaggactaagtccttctctaccaagaataactttgaatgtaaacagattacatcccccaattaagacatatagactgggtaaaggcataaaaactcaaagcccaaatataagctgcctaaacacaactcacttcacccataaagacatacatagtctgaaaacgaagtgggggaaaaaaaaaaaaacactccatgcaaagagaaaccaaaaatgaacagaagcaacttacttatatcagataaaataaactttaagtcaaaaactgtgaaaagtttgtcacactgtaaaaagaactgtaaaaaaaaaaagtttttaagctgtaaagagacaaggaagttcattatataatggaaaaaaaaacccaattcagcaagaggattagcaatagtaaatatgtatgcatcaaacaccagagaaccaagatatattaaagcaaatataattattatctaaggggaaagatagacaccaatgcaataatagtagaggatttcaataccccactctctgcattagagagatcacctagaaagaaacatagatttaaactacactgtagaccaaatggacttcacagacacttgtaaaacatttcatccagtagctggagaatgcagagtactcattcttcttcttctttttttttttgagatggagtcttgctctggcacccaggctggagggcagtggcacaatctcggctcactgtaacctctgcctcctgggttcttgtgcctcagcctctcgagtagcggggattactgtcacgcaccaccaaacccaatcaatttttttctgtatttttagtagggacaaggtttcaccattttggccaggctgctctccaactcctgacctcaagtgatctgcccaccttggtctcccaaagtgctgggattacaggtatgagccaccatgcttggccagaatattcactctttttatcagaacatggagcattccacaggacagaccatatgttaggccacaaaacaagtctcaataaatttttaaaaatcaatatatcaagtatattttctgacaacagcagtataaaactagaaatcagtaacaagaagaactctgaaaggtgtacaaatacatgaaaattaaataacatgctcctgaatgaccaatgagtcaaggaggaaattaaaaaattaactgaaggccgggtgtggtggctcacacctgtaatcccaacacttcagcaggctgaggcaggaggatcacaaggtcaagagatcgaaaccatcctggccatcatggtgaaaccctgtctgtactaaaaatataaaaattatatgggcgtggtggcacacgccttgctactcgggaggctgaagcaggagaactgcttgaatctgggaggtggaggttgcagttagctgagatcgtgccactgcactccagcctggctacagagtgagactccgtctcaaaaacacaaaacaaaaaaaaacagaaaaatttcttaaaaacaaataaataaaaataaaaatgcaacatacccaaaacctatgcaatgaataccacaaaagcagaattaagagtgaaagtttatagcaataaatgcctacatcaaaaaagtacagaaacttcaaatcaacaacataatcatgttccccagggaactagaaaaacaagaacaggccgggcacagtggctcacacctgtaatctcagcactttgggaggccaaggcgggtggatcacgaggtcaggagatcgagactatcctggctaacaccgtgaaaccccatctctactaaaaatacaaaaaattagccaggcatggtggcaggtgcctgtagtcctggctactcaggaggctgaggcgggagaatggcgtgaacccaggaggcagagcttgcagtgagcagatcgcaccactgcactccagcctgggcaacagagcgagactccgtctcaaaaaaaaagaaaagaaaaacaagaacaaacaaagcccaaagttagtagagagaactaaaacgtaaaaatcagtacagaaacttacaaaaagatgttgggagcaagccccccaaagtctggccataaactggccccaaaactggccataaataaaatctctgcagcaatgtaacatgtccataatggccataatgtccaagctggaaggttgtgggtttacaggaacgagggcaaggaacacctggcccgcccagggtggaaaaccgcttaaaagcattcttaagccacaaacaaaagcctgagcatctgtgtcttaagggcgtattcctgctgcaattaattcggcccatcctttcgtttcccttaaggggtacttttagttaatttaatatctatagaaacaatgctaatgactggtttgctgttaataaatatgtgggtaaatctctgttcagggctctcagctctgaaggctgtgagacccctgatttcccacttcacacctctatatttctgcgtgtgtgtctttaattcctctagtgccgctgggttagggtctcccctaccaagcctgtctcggcaagtggcgcccattcatgggggctcgaatccaggtcgaagggtcgccagagcgacggctgggaacagaaaactagctggaggacacccgagtactcttaaagcaatccctgtggtgagtaagaaggggagctctgaagcatcagggtaacaatgggataggtatggggtctggttcgtttcatcttagaactttttcacactgataacaaggaggaacaagagtatagtgaagtaacagaagaggttacagagcatgtttatttgccagctaaagctaaagcggcaaaggaaggacaggttcatccctacccttctgcaccccctcattattttttgaggaaaatgaccccccagatctttcttttccagaggacactgggtgaaaaatagctgccccagtgactgttcgagcagcgcctcgagcgatggctcttagttctattaggcaggaattcggcaagctagacaagagggtgatttagaggcttggcagttccctgttagaatacatcccccagatcaagagggaaatattacagctatatttgagccttttccttttaaattacttaaagaactaaaacaagcaataagtcaatatggaccaggttctccttttgtaatgggactgttaaggaatgttactgtttccagtcggatgattcctactgactgggacgctcttactcgagcttgtctaactcctgctcagttcttacaatttaaaatttggtgggcagatgaagcttccatttgggctgctcgcaatgcccaggcccaacctcaaattaatataactgcagaccaacttttgggggttggcggctgggctggtttagatgcacaactggtcatgcaggatgatgccatagaacaacttagaggtgtgcacattagagcttggggaaaaaaaatcacttaatgtggggaacaatacccttcctttagtgctataaaacagggaccaagggaaccatatgttgattttatagctcggttacaggagtctcttaaaaagatgattgcagatttggctgctcaggatatagtgttgcagttattagctttccacaatgctaatcccgattgccaggctgctctgtgacctatcagagggaaaacacatttagttgattatatcaaggcctgtgatggtatcggaggtaatctgcataaagctaccttgttggcacaggcaatggcaggactgagagtggataaaggaaatactccatttcctggagcttgttttaactgtgggaagcatggtcatactaaaaaagaatgtagaaaaaatcagcgagtcaggccaccagataggggaaaaaagaaaactgttgagccagaaatatgtccaaaatgtaaaaaaggaagacactgggctagtcagtgtcactctaagtttgataaagaagggaatccgatttcgggaaatgccatgagggagccgtctcgggccctgttctaaaccggggcatttccagcacaggccattccctcacccctgtacaatgtctgtcccctgccacagcaagtagttccacagtagatttatgctgcacaaaagctgtgagccttctgcctggggaacccctgcaaaaggtcccaacaggagtctgtggacccttgccagcagggactataggattacttttaggaaggtctagtgtaagtttaaaaggtgtacaaatacatacaggagtcattgattcagattataatgggtatattcaaattgttatatctacttctgttccctggaaagcagagccaggaaagcacatagcacagctcctgattgtgccgtatgtgggaatgggaaaaagtgaaattaaacgaacaggaggatttggaagcacaaataaacaaggcaaagcagcttactgggtaaatcaaattactgataaatgtcctacctgtgaaataactattgaaggaaagaaatgtaaaggtttggtagatacaggagcagacatttcaatcatttctctacagtactggccatccacgtggccaattcaacctgctcaatttaacatagttgaagttggtaaagtcactgaagtatatcaaagtagttatattttgcattgtgaggggcccgatggacaacctgggactattcaagcaattataacttctgtacctataaactgatggggaagagatttattacaacaatggggagcacaagttctaattccagaacaattatatagccctcaaagtcaatatacaatgcatgaaatgaggtatgtccctggtacgggactagaaaaaaaaattgcaaggtttgaaagaaccacttcaagtggaaaaaacaaagttcccgccaaacattagggaaaaatttttgatggcagccattgttaagcctccagaacctatacctttcaaatggttaacagatacccaatttggatagaacaatggctgctaagtaaagagaaactggaggctttagagaaattagttgctgaacaattagaaaatgggcacatagctccaacattttcttcttggaattctccaattttcgtaattaagaaaaaatcaggaaaatggaaaatgttcactgacttaagagccaccaattcagttatacaacctatgggagcattacagccaggattgccttctcctgctataattccaaaaaactggcctgattcctgcaagaagtagctcaccatgacaaagctgcccttgcttttatctctttgcaaatctaagaagggagacatgttgggagcaaccccccaaagtctggccataaactggccccaaaactggccataaataaaatctctgcagcaatgtaacatgtccataatggccataaagtccaagctggaaggttgtgagtttatgggaatgaggacaaggaatacctggcccgcccagggcagaaaactgcttaaaggcattcttaagccacaaacaaaagcctgagcatctgtgtcttaagggtgtgttcctgctgcaattaatttggcccatcccttcatttcccttaagggatacttttagttaatttaatatctatagaaacaatgctaatgactggtttgctgttaataaatatgtgggtaaatctctgttcagggctctcagctctgaaggttgtgagaaatcaggggatttcccacttcacacttctatatttctgtgtgtgtgtctctaatccctctagtgccgctgggttagggtctccccaactgagctggtctcggcaaaaaggagactaaaaaactataaaatatcaacaaaacaaaatgttggttttttgaaaaaacaaaattgacaaaacattagctagactaactaaaagtgagaagacccaaataaataaaatcaaaaatgaaaaagcagacattacagctgatgccacagaaatactaaagatcattagagactattatgagcaactgtaggacaacaaataggaaaacctagagaaaatggataaattgctaaacacacaaaacctatcaagactgaaccaaacagaaggaaatacaaaacctgaacagatcaataatgagtaacaagactgcatcatcaataaaaagtctcccaagaaaaaaagcccaggaccagatggcttcactgctgaattctaccaaacttttaaaaaagaactaatactaattcttctcaaactattccaaaaaattgaaagggagaggattcttccaaactctacgaggccagcattaccctgacaccaaaaccagacagggacacaacaaaaaaaagagcactatggccagtatccctaataaatacagatgcaaaaaccctcaacaaaaacaccagcaaaccaaatccagcaacacgttaaaaagattattcaccatgatcaagttagatttatcacaggtatgcaaggatggttcaatatatgcaaatcaataaatgtgatacatcgtatcaactgaatgaagaaaaaacgataatttcaatacatgcagaaaaagcgtctgacaaaaattcagctttccttcatgacaaaaactttaaaaaaaattaggtataaaagaaacatacctcaatacaatgaataccatatatgacaaaaccacaactaacatcatactgaacaaaaaaacattgaaagcttttcccctaagaactagaacaatacaaggatgttcacccttgtcaatcttattcaacacagcactggaaatctcagccaaagcaattaggcatgagagagaaataaatggcttcaaaataaaaaaggagaaagtcaaaactgtccacttgcagatgacattatcttatatatagaaaaacctaaagatcccaccaaaaagctcttagaacttttaattcattaaagtttcaggataaaaaaactcaacatacaaaaatcagtagcatttctacatacttaaactaactggaaaagaaagaaatcttctttattataattataaaaattaaaatacctatgaataaatttaacaaaggaggtaaaagatctctaaaaggaaaactataaaatactgattaaagaaattgaagacaccaaaaaatgaaaagaaatctcatgcttatggattgggagattaatattgttaacatgaccatactaccaaaagtgatctacagtcaatgcaatttctaccatattaccaatgaatttcttcacagaaattgaaaaaaaaaatcttaaaatttgcatggagtcacaagactccaaagagtcaaagcaatcctgtgtaaaaagaacaaagttggagctatctatcacactatctgacttcaaaatatgctacaaagctgtagtaaccaaaacaccatagtactggcataaaaacacatacacccacaaatgaaacagaagagagaagtcaaaaataattccacatatttacagataactgattttcaacaaaagcaccaagaaaatacattggggaaaggacagcctcttcaataaatgattatgggaaaactgcatatccaaatgcagaagaataaaactagatccatctctcatcatatataaaaatcaaaaacttaagtatgagaccccaaactatgaaactactacaggaaaacacaaggaaaagacttcaggacattgccctaggggaagattttacgggtgagacctcaataacacaggcaacaagttgggcatggtggcacgtgcctatagtctcagctacttgggaagctgaggcaagaggatcacctgagtccagaaattttgtgctgtagatgctgtagtgcgctactgcaattgggcattcacattaagtttcgcatcaggataatgacctcccaagagtagaggaccaccagaatgcctaaggaggggtgacctgacccaggtcagaaatagagtgggtcaaaactctacgctgaacaatagtagcattgcacctgtgaatacccactgcaatccagcctgggcaacacagcaaaatcccatcccttatataaatacaaaaacaaaataaatgaaacaactataacaacagaaaacgcaggcaacaaaagcaaacatagataaatgagatcgtatcaaaccaagtttctgcacaacaaggaaacaatcaacagagtgaagagacaacctatacaatgggagaaaatattaatacctgcaaactaatttttttttttttgagacagagtttcgctctttttgcccaggctggggtgcaatggcatggtctcggctcaccacaacctccgcctcctgagttcaagcaattctcctgcctcagcctccagtgtagctgggattactggcgcacactaccaggcccagctaattttgtatttttagtagaggcagggtttcaccatgttggtcaggctggtcttgtactcctgacctcaggtgatccacccgccttggcctctcaaagtgctgggattacaggtgtgaaccatcatacctggcccacctgcaaactatttatctgacaagggattaaaatttagaataaacaagaaactcaaacaactgcaaaaagccccaagtaatttcatttaaaaatgggcaaatgatctgaatggatcattcatgaaaaattgttcaacataactatttatcagggaaatgcaaatcaaaccacaatgagatttcatctcaccagctagaatgcctgtcaaaaagacaaaacaaatgttgtcaagaatgaggagaaaagggactctaatacactgttagtggggatgtaaattagtatagccattaagaaaaatagtatggaagctctacaaaaaaaactaacaacaggccaagtgcggtggctcacgcttataatctcagtactttgggaggccaaggcaggtggatcacttgaggtcaagagttggagaccagcctggccaacacagtgaaaccccgtctctactaaaaataacagtcaatcaattaatcaataaattagccaggcatggtggcacacacctgtaatccagctgctcaggaggctgaggcaagagaatcacttgaacctgggaggcagaggttacagtgagccgagatcacaccactgcactccagcctaggtgacagagtgagaccctgtctcaaaaaaaactgaaacagaactaccacaggacccagaaattccacaactgggtatatacccaaagcaaaggaaattagtatgtcaaagtgatatctgcactcctatgtttactgtagaactattcacagtaagcaagatatggaatcaacctacgtgcccatcaacggatggataaagaaaatgtggcatatataaacaatggaatactattcagccataaaaaaggatgaaatcctgtcattcatggcaacatggacaagtatggaggacaattgttaattaaataagtcaggcacacaaagatatatactgcatgttctcactcacatgtgtaagctaaaaagtttatttcatagaactagagagtagaatagtggttactagaggctggaagggtagtgaggagggaagacagaggttggttaacaaatacaaaattactattggataggaagaataatttctggtgttctacagcactacagactgactacagttagcactaatttattgtatatttgagctagaagagacgattttgaatgttcccaaatcaaagaacatatgaaatgtttgaggtgattgaatatgctaattaccctgatttgatcattacacattgtatacgtgaatcaaaatatcacactgtaccctgtaaacatgtacaattgtgtgtcaattaagttttttaaaaacatgaaataagtgctggtgaagatatggagaaattagaagtcttttgcatttttggtgggaatttaaaatggtgcagccactgaagaaaatagaatggcagttcctcaaaaaattaaaaacagaattacaatataagccagtaattcttcttctggatatacacccaaaataactgaaaccaaggtcgtaaggagatgtttgtacacacatgttcataacagcattattaatagctaaaatgtggaagaaatccaggtgtccataaacaaatcgataaatatagtatatatgtagaactgaaatattattaagccttagaaagtaatgaacattagggcaggtgcggtggctcacgcttgtaatctcagcactttgggaggctgaggtgggcaaatcacctgaggtcatgagttcgagaccagcctggccaacatggtgaaacggcatctctacaaaaatacaaaaattagccaggtatggtagcaggcgcctttaatcccagctacttgggagactaaggcaggagaatggcttgaacctgggagacagaggttgcagtgagctgagatcatgccactgcactccagcctgggcaacagagtgagacgctgtctcaaaaaaaaaaaaaaaaaagtaattacatcatgctaagtaaaataacccagtcaaaaaaaaaagacaaatactgtttgattccacttacaaaggtatgtagagcagtcaaaaatcctaaaagacagaaagtgaaatggtgattaccagggtttgggaggatgggctaaaggggagttattgtttaatgggtacagagtttgttttacaagctaaaaagaactctggagatagatggtaatgatggttccacaatatgaatgtattcaataccactgaattgtacacttaaaaatagttaagatggtagattttatttttacatgtattttaacaattttcaaatattggaaaaaaattaatggaatcccaataaaactgcaaacaaactttttaatggagctagacattaatattcaagttgatatgaaaaaacaaacatataattatagctaggaaaatactgagagaaaaactataaggactgagtaccacaaccagacattaaagcatactataaagcctctataattaaagtatcataataatggtacaggcgcctaaagttccaactacttgggaggctgaggcaggaggattgcttgagctcaggagttcagtgttacagtgagccatgatcgctcactccagcctgggcaacaaagaaagactctgtctctaaataaaaattaaaacaaaaaaaatttttttaatgtaaaatggcacatgaacagacaaccagatgagtgaaacagaatagaaagtccagaaatatacccaagtatatatggaaatttaaaatacaataaaagcatcatcatgaatcactggggcaaagacaggtttttaataaaagtgtgggacaatcaattagccatttagaaaaaactgatcaaatccatacctcacagcatacaaaagaatacacttcaaatagatcagagaactaaatgtaaaaaatgaaaccatacaagcaaaaagaagtgaattcctctttaacctcagttcagggagagagtactaactctgacttaatacccagaggcaataacagattaaatttgattacataataaaaatttttgcatggcaaaaaaataacggaagcaaaatcaaaggactgctgacacacactggcagaaaatatctgcagcataatcctaatatataaagaactcttaaaaagtaaggtaatttaaaaaaaatttttaagcaagggaaaaaaggccaaaaaaaccaagtataatagggaaagacaagaacaaacaatacatacaaaaatgatataaaaatggcccttaaacacatggaacattgttcaatctcatttgtaatatgagaaatgcaaattaaactacactaagatgcaaagtgatataattctcttggatggaaatttggcaatatctaacaaaactgcgtatgatttaccttttgacccacctatttacttcaggaattcaccctgaagatacacctccagaaaatgaaaatatttacatgtacaacattattgattagttgtaatcacaaaatactggaggccaggtgcagtggctcaacacctataatcccagtactctgggaggccgaggtgggcagatcacccgaagccagaagtttgacagcagcctggccaacatggtgaaaccccacccctactaaaaatacaaaatttagccagttgtggtgacatacacctgtaatctcagctactcaggaggcaggagaatcacttgaatcccagaggcagaggcggaggctgcagtgagccaagatcgccccactgccctccagcctgggcaacagagcaagactgtgtttgaaaaaaaaaaaaaaaaaaagacaaaatattggaaattaaatgaacataggagactatttcactaaacactgatagatacacatagtggagtgctatgcagccataaaaaagaatgaggctaatccctatgaactaatctgaagcagtttccagggtgcactgataagaaagaaggaaaaatacaatgacatctggtatttgtgaggaacaaaaacaaacaaacaaaaaatgtaggaagtctaaaccagaaactaatgagattaatctcacatggggcaggatagatgagaaaagatgagggaaatgggaacagggtagaggagatgtgggaagtggcatttttttgaaggttttgtttttttgtttttgtttttttttggtgtattatagttctgtcctttagaaccatgtagacattccaaatgcccaacatattaataaataaataaacaaggatgaggtatggactcaaaacagaatagaatagaaagaataaacctgctttataagtgaataacaaaccacattaaaggagaatttggtgagaaaaatcctaagtaactttggaaaataatattttgactatatactctaaggctaaagataaaaacaactatacacaaatattacatgtaagttaataggtttgtttttcattgagtgatgagttagcaattctaaaacaactttatattttaggactgaggaaataagtaaatatggtaggaataatgaatgccagttttctcactgtcaaaagaattgcaagtatgaaaagaggaagaccagaatgaactccacggtgctggaacagaactggaaatatcaatgtaaactcaagattattaatatagagaaaaaataaagaaatagatgtaaatgtgtaattttcagttcactgggaggacctagaagcaatgactctctagtaccaataagcatacctagagttgagattttggtttctaaatgccattctccaattaaaaaggaatcaaagcacctcagataaatgtttaattccagggctggggcagggaaagtgaaagagaatcacagaacatcctgtaatgacagaaaaaagtcacaataaatggtgggattatgtcaaaaggacatgggattcaacttgaaagatcttccaatagccaaatctgagaaaagttaagcaacaaaaaaaataacaaaatcttataatctatagaaaaaatatgaatgtataaatccataatgatataaatatatttagaggagaagggaaagcacttactttcaggagaattccaactaataaatgaggaaggatcatagaaatggaaagatcaccatttggcaaatgctagagttataactgtttcagataagaattatcaatggatactaaaattaatggaagattatataaaggcaaaatatgagaatatttacacagacttgaaatatcatatgggcaaccacagataattatatattacaaagggaaaaaatagtaattttataggggaaaaatgtggcagataccaccttaaccaagtgatcaaggttaaaatcaccagttaaggggccaaatcatggaaattcactgaggacacatgactttgatgttttgctaaaaatgcctaacctgaatttaaccatgaaaaatgcaatacaaaaccaaaatgagagaggatatacaaaatactgacaagtatttgtcaaagtgttcataagttccagattaaaagtaactaaatgcaacatgtgatcctgaattgggttttagaccagaagaaagacatcagtgggacaactggtaaaatttaagtacagttaatagattttataatagtaatgcctgatttcctgattatattcatgttaatttcttaatcttgattattataatatggttacataggtatttgtatttgggagatcagggtgaagagcacatgggaattctttgtactagttgtacatcattttgttaactctgaccttatttcaacatgaaaaactttaaatatatatgtatatataacctaacactctgaagctccttcctggtgatctcttctgccatctgtgaagcccgcaatttctcttcatactgatccttttcagattgcctccagacatcatgttccactttcattttctccaaatctgctaatctgttctcgagttctaacctaaaacaagagatcataattatgttacaagaactataataaagatgatatgacagcaaaatgttttcatttgcaaggatatttaagtcaaactaaggtaattaagtacttacttttcatcttgtaataccacaagtttttgataaccttcttctttggcagcttgtactttacgtattaattcacgatccttttctactaagagcactttgtgatgttcaacagctgctttgagaatttcattgtctgactgtaatcctagtgtttttcaaggagaaaagtgtactatattcaatgttattaagatgaaaaatcacatttaacagcaagcattcataagctggtaagacaaatgaatgtagaaagtctctacaaatatatattctcaacaatactcacatcattaataaacactcttaaaataagaatgaaacaggctaaaactcagagcaaattttcctgtcactgtttatttagtgcatacacatataaaaactttaataaaagctgtatacatttactcattcgaacattgagagttgagatcaaactggatgataaccagaggtttacttacttcacctctaaagaggttctgtgacctaagcctcatagaaaaagctggctgatagcagagtgaaataaatcacaaaacccttcaaaacctattgattctagcagaattgctagatctctagcagaagtataaataacatggacactttcaagtttgtacaatgaattcagaaatctttgcaatgaaatggcaaatactttgcagatggaataactaaagcaaattcacatctaactcaaagtgaaaacaaaatgcagcattctttaagttcctaaaaaaatttacttcttaactctatggaaatccatgagtcaataaatagaaattaacaattggaaaaaatcattcatagcagccagacacggtgttagcacctgtagtcccagctactgaggaggcttaggcaggaggaccatttgagcccaggagttcaaggctagcctgggcaacatggtgagaccccatttcaaaacatgaaaggcattcatcataaactctgtctgaaatgagttcaactacagatcaactcaagcatagctacaggccaaaggtaagcttatttaaatacttcaagttagaaacaacataaataatgaggaaatctgatgagacagatgttccaagattaaactggaacttaaaaataagcctactcggctgggcgtggctcatgcctgtaatcccagtactttgggaggccgaggcaggcagatcacgaggtcaggagatcaagaccatcctggctaacacggtgaaacgctgtctctacttaaaaatacaaaaaaatagccagcctggtggtgggcgcctgtagtcccagctatttgggaggctgaggcaggagaatggcgtgaacctgggaggcagagcttccagtgagccgagatcacgccactgcactccagccagggggacagagcgagactccatctcaaaaataaaaaataaaaataaaaaataaataaataagcctactctgcactaggctacaatgaactggcctgaggtctacataaaaaaatctttttaattgaaaaaaattaagcctggaacccaattatcttcctcacattctccagacttaaaatgtcctgggactaataactacaccataaatagatttaaaatttataaatcaggaagtatggcatcccatttacaaaattcatttatgtatccaataactatgataaaaacataagactgatttttttaaagttattaaatcttacaatgaacaaaacactcaacatataataaacatttcatatgtactccaaaattaaaactaaattaagttgaaaatttggaaataaaaattcagattcaactattttaataatttgagttcatatctgaaaataagcagcagcagcagcagcaagggaaatcacatattaccatccagttcactttgaatcttattcctttctctttctagctcactcttagctcttgctgtctccagtttgatgtctgttatttccagtttgtttgaatgtttaagttcttttacctgttgataattaaaaactgaaattactattggtcattttcttgccattcaatacttaccccaaaacataagtggaaacaagaaaacgctctggtagtaaagtagagtctaagtatcttccaagaagaaagaagtgtcagtgcctgcaacagtacttcaagtaaggagacattaagaaaatactgttctttcctaacagaacagaggcatttctttacgaatatctgtgtatggtcctttggcttaatcttgccttaaagacttaattacaagtatctaaaatcaactactcaatgattggaaaatctgcaggggaaaaaaccctgaaacttttaaaatttgttaatatttctaaaagacagggtcttgctatgtcatccaggctggagtgcagtggcacgatcatagctcatttcaacttcaaactcctgggctcaagtgatcctctctcctcagcattccaagtagctgtcaggactataggtgcacaccaccacactcagataatttttcaatttttttgtagcaatagggtcttgctatgttgaccaggctggtctcaaactcctggcctcaagcaatccacctgctttggcctcctaaagtgctaggattatagttgtaatccactgcacttggcctgaaaccttccttttaaaaagtgtccacagctggatacagtaacttgcacctaaaatcccagctactcaagaggctgtggcagaaggaagtgtttgaggcctggtgttggagaccagcctgggcaacatagtgagatcctttctctaaaaaaaaatttaaaaattagccagacatgacatgccccttagtcccagccactggggagactgaggtaagaggatcacttgagtctaggggtttgaggctgcagtgctatgattgtgccaatgtattccagcctgggcaacagagtgagaccttgtctctaaaaaaaaattaaaattaaatttaagaataaaaaatgtgctggggacaaagaaggtattctaggtagaaggaacagcatacaaaatgttattatatgtataacatcacatggtctgctcttaaaacaagctaagcattacatgtagagcaccggaagatgtgaaatctgtggaggaatggcagggaataaactttatataccatacaaaagggttgtttttcaggttagctgttgaaggtggcacaattaactaatgcgaatctgttggcttaagaaactgaaggtaaataaatcaattaagaggcaagaaatgaataaacggaggggggaaggaagaatcaattgaatctggtgacaaaatagtgtaatgtgtatagactgtgtctgtgtgcgcatgtgcacaagtattaggtaggggattgggggcaggaacaagtataaatcatataaattcattttccatagcccttctctttggtaaggagcttctaaaattagatatagtcatataataaggatttaatcaatacaaacacaaaggttagattaacccattttctgatatattatccaaatatataaaagtatggaatcagagtaggaaactacaaatacatacacatcaaatacagaaaatgtgagatggcagaaacaggaaaataaaagacaatttacttaagagtccaataaaaccccataaatactggagttgggagtcagacacaaatcaaaaaaaggtcctagagccaaagagggcaaggataagaaatagaagtgtcttattggaagatattccatcaacaaaaggtcctgaaaacgtttcaaggaatagtttcatgcaaaatcctcatccaaaggaaataaacagaaaagtgagtactgccttatgtactggtaactacaataagacatccctccaaattaactcgtagatttttaaatgaccgtacataaaatggtgaccctgtgctgacatcagttttgcatttttatttatttattttctgagacagagtctcgctctgtcgcccaggctggagtacagtggcttaatctcagcttactgcaacctctgtctcctgggttcaagcaaattctctgcctcagcctcctgagtagctaggattacaggcatgcaccaccacacctggctaaattttgtatttttagtagagatggggtttcaccatcttggccaggctggtcttgaactcctgacctcgtgatccatccgcctcggccttccaaagtgctgggattacaggcgttaagccaccacacctggcctgtggttttaatttccttttggaagttattttctataaaagcaagttttataaaatgatgtttacatgacaacagctgataatttgttttaatacttaaactttctgtagattggattttactacattataatttcatggacagatagaatttaaattataaatactttaaaattttgaagaaatatgattacaaagaaaatccaatcactatgacaaatgtaattataacctgctattatatactaactgtaaaaggttaagaatgacacagcatttcattaacaaacatactatagctgcatgaggtggaaaattagagccatcttatttcataggaagttgattcatctcatggtaaaagatctacaaaaacttatttcttattcatttcaccctgaaatttactgaaatgagacgacatttttaactaaactacaattattgaaactgaaagaacaccgaataggaagtcaagcaacaagtgaggtctgtcttcaggcctacttttgctgttaaaccagtggtatatgctcaagcaatttacctgtcctctctgcattcaaatgtactcatttatggatctaaagtttttctttattgccttatttctattatcctaacatcactgatgcatcacttatatgaacactgttaatttcctaaaaatatactaaaaggaattttacttaacgtatgaaaatgtattacccagtaatgacaaataatagcacttttctatgagtaatctgaaccaaattccaaatgttacagtaaagtttctttctgcccctagatccttggttcttaatcttctttgtgatcaagtcccaaatcctaggaaaattagggattttttttttaaataaaatgctcatgttaaaatgttgcataaaatttcaagcaattcatggtctcctaaagctccactggaccaagtcaccctgttcttcacagaatgtttgccatatagattctggcctttatgttgtgaatttgctttatgttttgacacaatggaagtattcagatattactaacaaaactttaataaatgtcaaaactggcaaaactgggcattttacagggggtcagtatctgttaaagtacacatactcacagaaagacacacaagagcacagcataaataagcaagaaatggaaatataattgacaatatgtattacctaagaagctctggatacagattccaaagagatggtacttaaatcttgatctttttcaaagttctgagatgtaattacccaattaatttaggtaaataaggacaactctgttgggtggctttcttaaaactaccttttattggcattctgaaaatgaaaaaccttatgagggaactagaagaatttacctcactgaatgtgaaatctctttaaggtcatcattttcaggccatctttggtaataccttttaatccaagacactgatactcacactgacataactttgttctaaaatctgacaaacatttatgaatttgagtaactaagacaaacacaccccaggtgttcctttgcactgcaaacaaccatttgctagaattgcaaaatgttgatgaaaacttcaagttgcaaagaaaactgtggcagtcatgtttgaaatattattttaaaatctacccttccaatggaatctttacatacaagacttcaaatgaaacttggtttgtttaaagttgaaggatggtatttaatactccatttatatgcaaaataaggcaagtgtgcctttaaaaagacaggcaactcttagcaatgtgtattaataaacaagcacagagaaataaatactatactagattgctgttctttcttcagcggagtaggagaaatcacctaggctctaactctaagaggaaagagcaatagggaagagtatatatatatggaaaaaaagaagaaaaatcagggtcagcacacaggtgagctagggagctcaggtaaaatgtactgcatgaaaagtattatacttggtggcccccccaagagagaagccacagcagaagccagcacatcccatgtcctattgcgacatctgtggttccaattattccagcagtgtagtctggctactcaggtcaagaacaatgtgctgcaaatactacgtactcaatattatttcacaaaattgaaaataatttatactggaattggaagaaaagcatggaaactccccatatcctgaatttacttgtgttttgtatctatttttttgtatactctatagttataagctttcaatgtgtatctgttgaatatataatctacttacagttaatcaggaggcaatcaaattatttcctagtagttcttacacagtcttagtaggctggaagggttcttacagatataaggaaattggatcctaatgatattaggtaacttgccttaggttacacatagttattgagacagtgagacacagactagtcaatggactaaaaattctgtattctttatgttacaatattttcttatttaaggatatcaccagtgtataatcactgctattatcattttcatcatcagctacatttaatttttgccacaactctgtaatgtaggtattagtcccattgcatagacaaaggcacttaagtttcagagagacagtgaactgcccaaggtcacacagctttttttagtaatgaaaaaatcagaatttgaatccagtctgttaaggagaatataaatgtagatcatgctgctactactaatttattcattgaagaaatatttgagtacctactatgtgccggcaccattctagaagctggaaaagcagtagtgatgaaaacaatgtccctgctctcttggagcttacattgggttgaggggaaggtggtgggaaagaaaaggagagaccaaaaaataaaaaccaaataactatatcagatagtattaagagctatgaagcaggtaaggaagacagagagaaagacagaggaagaaggaagatgctgttttacaatgtgaagacaaggaaagcctccctggttaggcaacatctaggtggtgaagaagcaagttatgtggatacgtgagggaagactgagccaaactcagacaagtgcagaaaccctgagcaagatgtgagtttgctcaaagagtgagaaggccaaagggagcaaagtgaacaggaggaaaaatacaggtcatggctgtgaaaagactgcaggatccagatcatacagagctctgaatgggtagaaagcagaaagaccagttagcaacctagcacagaaatggagcctagaaaaatcatggcttggactggaatagtcacagtggatgtcataagaattgatcagattctgcatgtatttggaaggtagaatgataaaggattaaaaatatttcaatacagagaactaaacacaaaatttgtcactgtacagtatcaagcattctaaagaatgaaatagaggcataagataacatactctactgatcaatgtatttatttcttagaaggcagaatgatataataaaacatttcagtataaagaaatcaattattaaaaataaaatttatcattatatactaacaaacattctaaagaatgaaacagaaacataaaacaacttactttactggacaatgtatttatttctcgttcagctttatgcaatttattaattaaaaaggtattttgttcactgcttgattgtagctctttttccaaacgttctgcccgtaaattagctgattgtttttcagcctttcatacaaacaaaatagtttaaaattcatcatttttcaagtatttcaaaatcaaataagcactatttaaaatacatttataattatactaaaattattcaaaacctcaacttaacatataccaatgtaacaaaaattttctcaaactaattggcagaattcaaacgaaagatagtgttccaggaaatatgcaacaaaggcatctagacaaacaacatatgaatgaccatcaataaaataaagtttatacacttctctcacgacagaaagtacctaaggcattcatttgatgtctatttactcttaacactgacttatttcaaacattttggaagtttccagtctataacagataagaaaaagcatattagaaactagaagacagggctcattgatagtaacaagtaaaaattgaaaatctaaaatcaatgattttaaaaaaagaaacagggaaagatatgatttcaaaatcctcagctcatctgcagactttttaagtacgagcaaagaggctcttgatctcatgacacaattaagattgttaatgaagtctgcaggttgtcaaaaaagtttctggatggtaatatcgatagtactctttcatgaggggagggaaactaaaatcttttttgaaaaaacatgtctattcaacataatatatatacatatatacacacacacacacacacacacacacacacacacacacacacatatatatatatatattttttttttgagacaaggtcttgctctgtctcccaggctgcagtgcaatggcacgatcttggctcaccacaacctccgcctcccaagctcaaacaattctcctgcctcagcctcccgagtagctaggacttcaggtgcacaccatggcacctggctaatttttgtactttttgtagagacagggtttcacccgtgttgttcaggctcatctcaaactcctgagctcaggtgatccagctacctcagcctcccaaactgctgggattacaggcataagcgaccacacctgacctcaacataattaaaatgaagacattttggcatttaaaggataaatttcagttttataacatctcatttcgtacatatagatgctgttcgacttatgatggggttacatcctgataaacccatcacaaattgaaaatacctaagtccataacttagactagcctaacttaagcatcctcaacacacgtgcattagcctacagttggaaaaaatcatttggcgacacagtactctgtaaagaggttatttaccctcatgaccacatgactgactgggaactgtggctcagtgcagctacccagcattaagagtatcacaccacatatcagtaacccaggaaaagatcaaaattcaaagtacataaatgcatatatggctttcacaccatcggacagtcaaaaaatagtaagtcaaaccaccttaagttggggaacatctagcttaaatgtggtaaggactatattcgacaaacaattagggaaaaaaactattttcttcatatatgaaataatactctctgggcacaatgatagccaagaaagttaaagaagaaagaaatgcttgctgtcatacgcttattttcatttcatctgacaaataataaaattaaatataggctcttctgaaaatgtcacaaataaatcttctgtcatcattcaacttgccctgaaaataatcactctaaaggacctcaatggaaagtttcacatcaggactgtatgctatattcaactgcaatcatctcacttattctgtcactgtgtaaaatacattaaggatggaaggatggcaacataaatagtctcacaatgaactgcttcatgtttaaggtacaatgatactgacaacttttaattcagaaaaccagtaaatactgacagagcgtcatgtaacaaaataaaaagtaacttctactcttcaaaacataccattgtactcctgtaccactggctggggaaaaaaaaaatcaccatcttggatttggatattgattttaactacaaattaaatgcccgctaatgtcccccccacccaaatcattttataactattccaaaggaaaaagaaacactttgaactatacaaaataaataaaaacaattaaacaggtatgtttgctacaagttaggcactaagaactaagaagaataagtgtatctgaataaaatggaaaccaagaattttcataaggcaatacccgtaggagtaccagtcaggtctgccaacacttatctttctctaatgaacccagggaaataattctgtaaaggcatgtatacctttacagttggattttactactctggcaagaagctgtcgtaagatacatcagtatggtatttctgttcaaacaggatttgtgactttaagacctcaaatcccagtgtaaggaatgtactatcttgaaagaaattattctttctggtttgagatgactttacgctcagaaactcaaatacatatatttttattttgcatattctattatgtggcattttaagagttaagacatttcagataggtgacttgactcccaaagaataaatacccctttgtaaatgtggtagcatacgtattgcttatgaatcaatagctttcttctttactaaaagaataaatactcttgggattacacaaatgcatcagcattagcttggggggcatacatttatgctctaaaaatcaaaggcttgtcaactgcactttaaaaaagtatgccatactctactgggaagtaattagaatcttacctccagggatctgactgtagcctgcatctcagccaactgccgcacctgtattctttgggcattttccacctgagcctcagaattctccttttcagcctttaattccgctacttcagcctctaaaccttttaatttttgacacaaatagactttttctcgagcaagttgttccactcgtttgctgtcttttgtgagatcaacattaagcagctggttacgtagttcttctttatcttcctccagtcttgcaatctaataataattttaaagaaagcatacaaggttaaattattaaattttcagtcatgaacatgctttacaagtcagtaaaattaaaaaatgcacaaaatcaaagctcaggtgctgaaacaaagtacaaaggaaaaaattttaagtatcactatctttttgttcttagtgggactcaaatgtgaggtcaaggactgtgtcctgttttccctgtatctccacgtggtgtctagaacagggcttaatcagttgctgactaaaatttaaaattataatactgtaagtactaaacatacatcaagtattttaaaattcatcataacattataggggttcatgaccaaaactctgactactccaaagcttttcctcacatgactgtaattcttgagctagtctatactaataaaattatctatgtcagggcaacttaattcacacaaaaactgcctgtctgtgtacataaaagcaaatgtgattgatgagagtttttaaatgatagctgagagtttattaaagtcctaattgtaatgatggcctagttcttagttcttagattcaagaagaattgaaaaatcattactccagggcaggtgttaaagtcactggggaacttgcagagcagagacaccagtggtcttgtcattcatgccaattatcactgctggacttcgtgggcctccaaatcagtgggtttcaaactgtttcctaacctctgaggcatttcagaagctcctcacctctggagaccaggggcaagcaatcagggtctagaactcattctttccctttcctgatctccccaactatctatcccctaccaccacccccaccaaatttctggcattaaccatacgcttctatttttagtctctttctggggtttcttcaaatgattcaacttaagtaaatgattcagctgggttttttgtttgttaagaagaagttgaaaaccactgctcaaaacaggacaagaggttgtttgtagccaggatgaacatcaaagactcactgtaagctccccggccctgcaaaaaaaaaaaaaaaaaaacaaaaaacaaaaacagaaaaaactaaagaaatgctccaaaaccttaggcaaaagtggtccaagaaacaactgtttgatcacagcactatcaatgaatctaaaaagtttaagacctccaccccagggcaggatctgttctccacacctgtaaaatgggaaactgaattacatgcactctaacaacctttttagttttaacacatagtgattccagtttgtttttggacatgctgaatttaaatgccaatgagaaatataggtagagctatccagcagacaaatattattttgcagagaataaaatttatccttgaaggcagctgtggcatttagagttaagtcctcaaaagcccaactaattagtatttctctcctatttttcctcccacgctttacaaataactattacttcctggtttggtcccggattacttttttatccactgtattctgtcctcagtttaaatgaagaacttgggctagctgatctttaagatactgtttaccttttacatgaggtaacctgatatggttttaatgtgctatattagaggtgtgatggctcatctaaggtcaggagtcaatgtgtaactcaagttcagacaatggtgccctttactgagtacttactatggatcaaatactgagctaagtgctctacatgtaaaatcaacattaacaataatttctcttgtagtccccattttacacatagggtcacacagttcacaatgttcttgacctgcatacttcccatattattgctttctttccacgttttgggaggcatctgtgtgatagctgaagtgatagttgaagctatgagactggatgacagctagctgatgactgaaaattagattccatgtttataactcctaaaccagacatatcaaatcattcttacaaaactgccatctaattttgctattcatttatttattcaggcaacaaatatttactgagtacttactaagtacccaaaactgttttaggtagtaaggatacaacccagcagataagcaaacacaaaacctctgctgatgcagagcttattacattcaatcactgccataacaccacttgtgtcccagacatttggcacagatcttggatacagcctcagctctttctttttccgccattctcaatcagacttacatgtcatcttccttgatgtcctcaatttcttgtgctctcaatctttcctctaaatttccaaagggctttgtttaaatttctcttttatgaactttatttaaatctgcctgtattgcagctacctctacatttactctattctattctaaatacaaacttacttgacagataagacaatgtgttaactaatattactttttaaaaagttattgaagtaaaggaaactaaacagaaacaatagggactaggaatagtgactgatttccttttcaaaaaatgatagcacttcaattccccaaggcacacaagagggaaaggtagtgttacctaattactccatccttctttgttgttattacctttacgatataacatagggatatgggtaagagaaaaggctctggaatcaaactgcctaggtttcttttttcttttggtattttaaagatattgctttactgtcttctggcttttattacttgtaaaaataagtctgtcgtcattatctgttcctctgtataagatgtcttttctttcttcagttacttcttttaaaattaaactttttcagataatggcaggttcacaaggaattattataaggattaatatagcgggatcctgtatatcctttaaccaagattcccctattggtaacattcctcttccctttttggggaagacattatgtagaattggtactgatacttctttaaacacctggtaaaattctctagttaactattcattttgggagttttaaaattacagattgaatttccctaacagtaataggtctatacaaactgccaatttcacattaaatgagttgtggtcgtttgtgccttttaagaaattgattcatttcatctgcattgtcaaatttattagagtagagttgttcaaaggattatctgatttcccttctaatgtctgcaaggtcatgagtgatactctttcattcctgagataggtaaaatttttatcttccatcttttttgttagttttgctaaaagttggtcaattttattgtcttttcaaagaaccagctctttgtttcactgattttctctattatttttgttttcaatttctgctatgtttattatttccctccttctgcttgctttacttttattttgatactctttttctaggttcttgaggtgggagcttacattactgacttgttccctcatttctaatgcatgtatttagtgctataaatgtttcttggcactgctttagctgtgtcctaaaatttttgatatgctgcattttcattttcatccaatgtattttttgaaatgtaatctcattgaaatgtttttctttgaaatttccaccttgacccataaatttttttaagtatgtcatttcatttccaagtgtttgaagatttccctgttattttctgttattaatttctagtttgattctattgtggtcagaaaactcactcattatgatttcaagttgtataagtttgttgaggtttatttcatagcccaggatatggtctatcttgtatatgttcagtgagcatttatatacattcagcgaatacttcaaaagaacatgtctgggtgttctccttgggtggcatgttttataaatgttatttaggttctgatggttgatggtgttattgcgttcttatttatccttgctgatttttaattgttctatcacttgttgagagaggggtatgaagtcaccaactataattatagatttgtctatttcaccttttagttctttcaatttttgcttcaaacattttgcacctctggtgcacatacatttagtattcctgtgtcttcttgctgggttgacctcttttgtcactatataatctctttctatataaatctggtatttttctttgttattttcctttgccctgaagtctgctctatctgatattaatactgatgctcctgcttttaattaatgattccatgatatagctttgtatatccttttatttacaaactgcctatactgttatacttggagtttcttatagacatcatacagttaccccttgacttatgatgcaattacatcccaataaactcatgaaaagtgaaaaatgcagtttatgccggcaacacagcatatggaccctgacttatgatggttcaagttacaacttttcaactttacaatggtataaaatgacatgcattcagtagaaaccatatgtcataaggagcaccctgacttacaatggagttacatcccaataaacccattgttaagttgaaaaatcatccaagttcaaacactgtaatctggggactgtcagtacagttaggtcatttttaaaaatctacactgtaaatatctgtattttaattcatgtattcagaccatttacatttattatgattgatacgttaagccattttggtctgtttcttctcttagtttctctgttttctttttcttgcctgttacatgaacatatttcaggattccattttatctataatgttttaaatgtatctccttgtatagctttcttagtggttgttctagttattatatttatgtaacttatcatggtctactgaattcattttgtcagtttgagtgatatgtagaaacttcacctccttttatatccctttgtccttgctcatttataatataattacctaaaatattttctctatatatttagaaccacatcagagttaaaatttttacttcaaccaccaaacaaaatttagaaaattcatgaagcaaaaggaagtctattacatatacccacagttctgtttaccatgtacatttatccttcctaatactttgagattccttctttttactgttttcttcctatttagacaaacttctcttttggataggtctactggcaaaaagttccttcattttccttcatttgagaatgtcttgatttcccctacattcctgaaggatatttttgctggatatagaattatgagttgacagtccttatctttcagcacttgataatgtgccacttccttctggcctctgatttctgatgagaaatgagctagttttctaattgttttccccaatgggtaagatataatttcttgggctgctttcaagattttcctatagtttttttttaaacctgactatggtatctcttgctgtgaatgtgttcagcttcttgaagctacatgtttgtgcctttaccaaacttggaaagtttttagtcattatttcttccattaccttctcaccctgccctcttttctcctttcagggacagaaatcttagatcttttgttatagtcctacaggatactgagaatctgtttatttgctttttaaatctattttctctagtctgttcagattgggtaatttctaatgttctacctttaagctcagtagttttttcctctatcccttccattctgcagttgagcctggcaactcaggctttcttagtcactctttcagttctaaaatttccaattttcttctctttattctctgtttctttgctaagtcttttgggttttgtttgtttgtttgtttcaaccacgtttataattcctcattgaatcattcttaccatggctgctttgaaatgtttgtcaaataattctaacacctctgcatctcagtgttggcatctattagtgtgttttacattcagtttcagaccttcctagttcgtggtgtgacaagcaattttcaatggaaacttggacatttggggaattaagttatgagactccagatcttaaacaaagtttgtattagctggctttttgtgatattgctatggtaggggatgggtggtgttgccacctcattactaccacgaggaggtagtagtcccgattctccactctacttctgttgatacccaaggtgggagggcttctcatgatacccataatgaacaggggtgggagttctggttccccattaggcctcaactgacacctccctggatgggaagcgtaggagtaatttattattgctcctcatgttacctccatcgataccacagggccagatgtggcctccattgataacacgcagctgggtagtggttaaagtcctgaccctgtactaggcctcctctgacatgacccaggatgtcatgtcagagcaggatgagggcagggtacctcattactgccagttgagagtggatgtccaagctcctcatactgtctctagtgacagcatggcagaggatgggagcccttgttattacccaggtgaagatgtctttgtctggttttggtattaggataatgctggccttgtagaatgagttaggaggcatttcctctgattctgtcttctggaagagattatagagaattaacataaattctcccttaaatggctgatagagttcaccaatgaacccacctgggctgcccagtcatttctgattggatgtcagacattgtgaatttaatgtttttttcagagctggattctttgttttcctttacttatttctgaatcttcattctggaatgcagctaagatatagtaatgagccacataatgaagtttcagtcaacaacagtccacatacatatgacaggggtcccatgagtataatattgtatttttactgtttaaaccttttctatgtttagatatgtttaggtacacaaatattaaccattatgttacaatgcctacagtattcagtacagtgatatgctttacaggtttgtagcctaggagtaataggctgtaccatataggataggtatgtagtatactgtgccatctaggtgcatatatgtatagtccatgatgtttgcacatgacaaaatcgcctaatgacacatttctcagaacatatccctgtcattaagctacacgttactgtacttagaaacagtctgatcttttcaaatcttacttttattcttgttaaccagaaccagaatagcctttagtctatggctaatttggccctgctactgaggcaaaatccttctgagatttctactcaaagtactatgcattaagagtatctttccactctgtctaacggaaaaataaattttcccagtcccatgtgaactctagagactgtcccacctaaataattttctttctctggccttgtatagtttcctccacacatgcgctaatcaatactgcaaagttaccctctgcagaactctggagctctgcaatactctgcttttcaaattctagtttccttggcctctcaaattctgaactccaactcctcagctcaaagatcatgtagctcaatttaggttttttatctctgcacagtggcctggaaactctccagaacctaagatggggcaatcatagagctcttatcatttgttttccttccctcagatctgccctgtgctgcctattttccaatgtctgaaaactgtggtttcctatttttgtcccagttttcagtaaacgccttaaagtaaattccatccctattccatcctagccagaagcagaaatccccagactacttagatttgaatcctgaccatatactagttgtgcaaccttgggccagtctctcagtgtttttatcttctcatttataaaatgaagatgattatctaactcctagcattgttgagatgattttttaaaagtatatataaagatactggtacaaaaacagacacacagccaaatggaacagaatacagtaaccagaaataaagctgcatatctacaacaatctgatgctcaacaaagttgacaaaaacaaacaatggggaaaggactccctatttaataactggtgttgggaaaactggctagccatatgcaaaggaatgaaactggatctctacttttaaccacacccaaaagataactcaagataaattaggaaataccattctggacattagccttggcaaaaaatttatgactaaatttatgaccctctaaagcaagggtccccaaaccctaggccatggaccattaccagtccatggcctgtcaggaatggggccacacagcaggaagtgagcagcaggtgagcgaccattactgcctgagctctacctcctgtcagatcagtgggagcattagattctcatagtggtgtgaaccctattgcgaactgcacatctgagggatctaggttgcatgctccttatgagaatttaatgccctaatgcctgatgatctaaggtggaacaatttcatcctgaaaccattcctcccagagccttggttcatggagtaattgtcttccacgaaaccagtccccagtgtcaaatggcaccagggactttggggaccactgctctaaagcaattacaacaaagacaaaaagtgataactgggacctaattaaactaatgagctttggtttggcaaaagaaactatcaacagagtaaacagacaacccacagaatgggagaaaatacctgcaaactatgcatctgacaaagttctaatatctagaatctataaggaatttacataactcaacaaggaaaaaacaaccccataataaagtaggcaaagtacataaacagacacttctcaaaagaagacatataagcagccaacaaacatgaaaaaaatgcttaacatcactaatcatcagagaaatgcaaattaaaaaacacaatgagataccatctcacaccagtcagaatagctattactaaaaggaaaaaaaaaataacagatgctagcaaggctgcagaaaaaagggaacattatacactattgatggctacgtaaattagttcagccactgtggaaaacagtttggagatttctcaaataactaaaaatagaactaccattccagcaatcccattactgggtatatactgaaaggagagtaaatcattctattaaattgacacacacactcatatgttcatcacagcactattcacaatagcaaaaacatggaatcaacctgggttcccatcaatggtgaactggataaagaaaatatggtacatatacaccacggaatactatacagccataaaaatgaatgaaatcttgtcctttgcagcaacacagatacagctggagactatcatccaaagcaaattaacaaaggaacagaaaaccaaataccaataccacatgttctcacttgtaagtgggagctaaacactgactacatatggacataaagatgggaacaatagaactggggactaccagagaggggagaggatgagggggaaagggctcaaaaacttcctattaggcactatgctcagtatctaggtgacggaatctttattaccccaaagttctgcctcagcatcatgcaatacacctgtgtaacaaatctacacatgtaacccctgaatctaaaataaaacttgaaattattttttaaaaaaagaaaagttaagtagaataaagtattacaagtagtgaaaagagaaaataatttggaaacttttttttacactgactttaatttgtgcttttgatgaaaatacatttcactttttacattttgaatacaattgcattttaattctgtgtgttattattaatggaaaacaaacatgtaaaaagcttctttacaagagtatagtgattttgctaaattgaaaaaaaatgtggctgggtgcagtggctcatgcctgtaatcccagtactttgggagtctgaggtaggtagatcacttgaggtcaggagttcaagatcagcctagcccacatgacgaaaccccacctctactaaaaatagaaaaattagctgggtgtggtgatgcacacctatactcccagctattcaggaggctgaggcaggagaattgcttaaaccaaggaggcagaggttgcagtgagccaagatcgcgccactgcactccagcctggggaacagagtaagactttgtcttaaaaaagaaagaaagaaaatgccatgaaataaatatgtaataatctttaaactatatataaagtgtttcactgaataaattaaaggtaaatgggtctcctgtctctatttctttctttcacttcttcaacttctgtaaattctgatttacaaatctgaaatcaacttaaaagtatctgtatatttattatgttaattggtaccatgataataactgtgaggtatgaatgatactaataccattaattaagtatctactatgtgtcaggcattatggtaagtattttgcacattaagtttcaagttcccagatcttagtttttaaattattacattaactttttatattacttaagaaaacaataggagacggttggtccaagatggccaactaggaacagctccggtctgcagctcccagtgtgatggacgcagaagatgggtgatttctgcatttccaactgaggtacctggttcatctcactgggactggtggacagtgagtgcagcccacagagggtgagctgaagcagggcggggcatcacctcacccgggaagtgcaaggggtcggggtatttccctttcctggccaagggaagctgtaacagactacctggaaaaacaggacactcctgcccaaatactgcattttcccaaggtcttagcaaccagcaaacaaggagattctctcccatgcctggctcggtgggtcccacgcccacggagccttgctcactgctagcacagcagtctgagatcgaactgcgaggcggcaccctggcagggggaggggtgtcccccattgctgaggcttgagtaggtaaacaaaacggccaggaagctcgaactgggcggagcccactgcagctcaacaggacctactgcctctagacaccacctctgtgggtggggcatagctgaacaaaaggcagcagacaacttccgcaaacttaaacatccctgtctgacagctctgaagagagcagtggttctcccagcatagcatttgagctctgagaatggacagactgcctcctcaagtgggtccctggcacccgtgtagcataactgggagacacctctcagtaggggccaacagacacctcacataggcaagctgaccctctgggacgaagcctccagaggaaggattaggcaacaacatttgctgttctgtgacgtctgctggtgatacccaggcaaacagggtctggagtggaactcccgcaagctccaacagacctgcagctgagggaactgactgttaggaggaaaactaacaaacagaaagaaatagcagcaggatcaacaaaaaggtcacctacaccaaaaccccatctttaggtcaacaacatcaaagaccaaaggtagataaaaccaaaaagatggggagaaaccagagcagaaaagctgaaaactctaaaaatcaaagcgcctcttctcctccaaaggatggcagctcctcgccagcaatggaataaagctggacagtgaatgactctgacaagttgacagaagtaggcttcagaaggtcagtaataacaaacttctccaagctaagggatgatgttcgaacccatcgcaaggaagctaagaaccttgaaaaaagattagatgaatggctaactagaataaacagtgtagagaagaccttcaatgacctgatggagtgcaaaccatggcacgagaacttcgtgatgcatgcagaagcttcaatagctgattcaatcaagtggaagaaagggcatcagtgattgaagatcaaatgaatgaaataaaccgagaagacaaagttagagaaaaaagagcaaaaagaaacgaacaaagcctctaagaaatatgggactatgtgaaaagaccaaatctacgtctgactggtgtatctgaaagtgacagggagaatggaaccaagcaggaaaacattcttcaggatattatccagaagaacttccccaacttagcaaggcaggccaacattcaaattcaggaaatacagagaatgccacaaagacactcctcgagaagagcaactccaagacacataattttcagatgcaccaaggttgaaatgaaggaaaaagtgttaagggcaggcagagagaaaggttgagttacccacaaagggaagcccatcaaactaacagcggatctctcggcagaaaccctacaagccagaagagagagggggccaatattcaacattcttatagaaaagaattttccatccagaatttcatatccagccaaactaagcttcgtaagtgaaggagaaataaaatcctttacagacaagcaaatgctcagagatttttgtcaccaccaagcctcccttacaagagctcctgaaggaagcactaaacatggaaagaaacaaccggtatcagccactgcaaaaacaggccaaattgtaaagaccatcgatgctatgaagacactgcatcaattaacaggcaaaataaccagcgaacatcgtaatgacaggatcaaattcacacacaacaatattaaccttaaatgtaaatgagctaaatgcaccaattaaaagacacagactggcaaattggataaagagtcaagacccatcagtgtgctgtattcaggagacccatctcacgtgcaaagacgcacataggctcaaaataaacagaaggaggaagatctaccaagcaaaggtagatcaagcaaaaaaaaaaagcaggggttgaaatcctagtctctgataaaacaaactttaaaacaaagatcaaaggagacaaagaaggccatggtaaatggatcaatggcaaagggatcaattcaacaagaagacctaactaacctaaatacatatgcacccaatataggagcacccagattcataaagtaagtccttagagacctacaaagagacttagactcccacacaataatgatgggagactttaacactccactgtcaatattagacagatcaacgagacagaaggttaacaaagatatacaggacttgaactcagctctgcaacaagcagacctaatagacatctacagaactgtccaccccacatcaacagaacatacattcttctcagcaccacattgcacttattctaaaattgaccatataattgaactaaagcactcctcagcaaatgcaaaagaacagaaatcacaacaaattgtctctcagaccacagtgcaataaaattagacctcatgattaacaaactcactcaaaaccacgcaactacatggaaactgaacaacttgctcctgaatgactactgggtaaataacgaaatgaaggcagaaataaagatgttctttgaaaccaatgagaagaaagacacaatgtaccagaatctctgggacacatttacagcagtgtgtaaagggaaatttatagcactaaatgcccacaagacaaagcaggaaagatctaaaattgacaccctaacatcacaattaaaagaactagagaagcaagagcaaacacattcaaaagctagcagaaggcaagaaataactaagatcagagcagaattgaaagagatagagacacaaagaacccttcaaaaaaatcaatgaatccaggagctggttttttgaaaagatcaacaaaattgataaactgctagcaagactaataaagaatcaaatagatacaataaaaaatgataaaggggatatcgccaccgatcccacagaaatacaaactaccatcagagaatactatagacagctctatgcaaataaactgcaaaatctaggagaaatggataaattcctggacaaatacaccctcccaagactaaaccaggaagaagttgaatctctgaatagaccaataacaggttctgaaattgaggcaataattaatagcctaccaaccaaaaaaagtccaggaccagatggattcacagctgaattctaccagaggtacaaagaggaactggtaccattccttctgaaactattccaatcaatagaaaaagagggaatcctccctaactcattttatgaggccagcatcatcctgataccaaagcctggaagagacacaacaaaaaagagaattttagaccaatatccctgatgaacattgatgcgaaaatcctcaataaaatactggcaaaccaaatccagcagcacatcaaaaagcttatccaccatgatcaagcgggcttcatccctgggatgcaaggctggttcaacatatgcaaatcaataaacataatccagcatataaacagaaccaaagacaaaaaccacatgattatctcaatagatgcagaaaagacctttgacaaaattcaacagaacttcatgctaaaagctctcaataaactaggtattgatggaacgtatctcaaaataataaaagctatttatgacaaacccacagccaatatcatactgaatgggcaaaaactggaagcatttcctttaaaaaccagcacaagacaaggatgccctttctcaccactcatattcaacagtgttggacgttctggccagggcaaccagacaagagaaagaaataaagggtattcaattaggaaatgaggaagtcaaattgtccctgtttgcagatgatatgattgtatatttagaaaactccatcatctcagccccaaatctccttaagctgataagcaacttcagcaaagtctcaggatacaaaatcaatgggcaaaaatcacaagcattcctatacaccattaacggacaaacagagagccaaatcatgagtgaactcccattcacaattgctacaaagagaataaaatacttaggaatccaacttacaagggatgtgaaggacctcttcaaggagaactacaaaccactgctcaacgaaataaaagaggacacaaacaaatggaaaaacattccatgcttatggataggaagaatcaatatcgtgaaaatggccatactgcccaaggtaatttagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacgctacctgacttctaactatactacaaggctacagcaactaaaacagcttttggtactggtaccaaaacagagatatagaccaatggaacagaacagaggcctcagaaataataccacacatctacaaccatctgatatttgatacacctgataaaaacaagcaatggagaaaggattccctatttaataaatggtgctgggaaaactggctagccatatgtagaaagctgaaactggatcccttccttacaccttgtaaaaaaattaattcaagatggattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatgggatctaatttaactaaagagcttctgcatggcaaaagaaattaccatcagagtgaacacgcaacctacagaatggaagaaaatttttacaatctactcatctgacaaagggctaatatccagaatctacaaagaactcaaagttacaagaaaaaaacaaacaactccatcaaaaagtgggcaaaggatatgaacagacacttctcaaaagaagacatctatgcagacaacagccacatgtaaaaatgctcatcatcactggtcatcagagaaatgcaaatcaaaaccacaatgagataccatctcacgccagttagaatagcaatcattaaaaagtcaggaaacaacagatgctggagaggatgtagagaaataggaatgctttacactgttggtgggagtgtaaattagttcaaccactgtggaagacagtgtggcaatccctcaaggatctagaactagaaataccatttgatccagcaatcccattattgggtacatacccaaaggattataaattatgctactataaagacacatcacacactggggcctgtcagggggtgggggcctgggggagggatagcattaggagaaatacctaatgtaaatgatgagttgatgggtgcagcaacccgacatggcacatgtatacctatgtatcaaacctacacgttgtgcacatgtaccctagaacttaaagtataataaaaaaaaatcagacatatgaaaaagtaacaaattaaaaaaaaaaataatcactattatgatgagtttcctctttttcccttttatgtactataatttatttttcctaaattaatgatggcatgttttatacaaaaatattttgtcattccttacatgaagaaaatatcacttaaattacttacatacttaaagttcatattttggctgggtgtggtgactcgggacgcctgtaatcccaacactgtgggaggccaaggtgggcagatcatgaggtcaggagatcaagaccatcctgcctaacacagtgaaaccccgtctctactaaaaacacaaaaaaattagccaggcatggtgggtgcctgtagtcccagctactcgggaggctgaggcaggagaatggcatgaacccagaaggcagagcttgcagtgagccaagatggcgccgctgcgctccagcctggaggacagagtgagattctgtctcaagaaaaaaaaagaagaaataaaccccagcatttccagggaaccaggggagttctctttttgccataggaactttggctcctcacctgacacataaagccaaggaagagcacaaccagtttgcgaagcatgatggaagaaactcagtgacctgtcattatggactgtcactttgatggtttttcacaggatgtagtgctcctcgtccctccctctctcctgagatcttagtattttgtctccactgaattaccattgattatttcactcagtctaccattataattacctgcgcctacaactctgtattgtcattactatttccagaaaatatgagtcctaatataataaaaacaaaatagtcccacttttgaataatgactatatatgcaacttcagcatttcacctgtatgaagtcccagacttaatatgttcttacagtcacatgaaaaagcatgacttttttttttttttttttttttttttgagacagagcctcattctgtcacccaggctggagtgcggtggcacaatcttggctcactgcaacctccacctcctgggttcaagcgattctcctgcctcagcctccagagtagctgggactacaggtgcgtgccaccacaccaggctaattttttgtatttttagtagagacggggtttcactgtgttagccaggatggtctcgatctcctgaccccgtgatccacccgcctcagcctccccaagtgctgggattacaaatatgaggcaccacacctggccaacactgtatttattcgtaagatgagatatgttctttcacatattatttcatatattctttttagtttataatatcatcagggacatgtgtattcctggagtccctctcaggaaaaactttaaaaatcttcctaaagtattcccctaagaaccaacacactaaataatattgttactttcatctgtgtaagtaaaaatgtgcaagtactgtgtaagtcctaattaacacaagaaaatccaattatttttattacatgaatcccttttacactagtttaaattgtaaaattggaagatgacaagattcagctctactttgaagttttcaaactaaatttgttgtttctataaagtatatttgaaactatttgctgtttcatgatccacaatcatctcaccaggttttactgtttttgtatatagaaaatgaagtatgaaggtgattgaacaaaagtaaatccacaattatacactcagtaatactgctcctacataatcaattgggaagtaaaatgaaagaaacttcagtcttatttttccaccctctactaattatggcttcttaacttgcagtttatcttcagattcttaagactatcataaaacatcacatatgaaaattaatgatggccagatgtggtagctcaccacctgtaatccctgaactttgagaggttgaggtgggaggatcacttgaggtcaggaatttgagaccagcctggccaacatggtgaaaccccatctctactaaaaatacaataattagccaggcatggtggcacctgcctgaatcccagctactcgggaaactgaggcaggagaatcacttgaacctgggaggcagaggctgcagtaagccgagattgcatcactgcaccccagcctgggcgacagagcaagactccatctcaaaaataataataataataatgataaattaatgactataccaaccccttaaaaattttaatgagaatcacttagtccttcataagtgaaaaatagattagtcatcagatttcgaatgcaggtttcactatttcaaaaacaacaaaactaagaaactagagaatacaaataatccttaccagataagtatcatcattagattttaaaaggaaagtacaaaataaagcaccactatatgaaaccttagggttttctcttcaatatactaaatcttcgttttaggctagaaatctttatcattcctattttccacaaatttttacatgcaattcctttaagtctatcataattatggattcaaaacccttcataccacatgtagtgtatatattaccagctatttaacaaaattgcagttgctggatggcccataatcagagtggcaacttcaaactgccggtcaccttcgaatgggtaaggtccaggttttgtgttgaccacacactgtcgagactcaggtatagggcatatagaatacgagtggtggactggtttgtgggtttgagggtctgggtggaagattacaaattcttctttgtgcaaagtgtaggagtacaacattgaacatggacttagcatatgtatggtctcccccactccttcttaagccgaagctggagagaatgggcattttgtaaatgttatggcatatgcaaatataatataatggcattaaataaaaacaataagggaactgactaaaacaaaacaggctgtgggctgggagttggtatatctgagttctactataacctggctgctgacattctctgagactttgaacaattcatgttgtgggaagtcagggaccccaaatggagggaccggctggagtcatggcagaggaacataaattatgaagatttcattttaatatggacatttatcagttcccaaattaatacttttatcatttcttatgcctgtcttacttcaatctcttaatcctgttatcttcataagctgaggatgtacatcacctcaggaccactataactgtgttaactgtacaaatttgattgtaaaacgtgtgtttgaacaatatgaaatcagtgcaccttgaaaaagaatagaataacagcgattttcagggaacaagggaagacaaccataaggtctgactgcctgcggggtcagacaaaatagagccatatttttcttcttgcagagagcctataaacagacatgcaataaggaagatatcgctaaattcttttcctggcaaggaatattaataattaataccctggggaaggaatgcattcctggggggaggtctataaacggctgctctgggagtgtctgtcttatgcggttgagataaggactgaaatacaccctggtctcctgcagtaccctcaggcttattaagattgggaaaccccaccctggtaaatttggggtcagaccagttctctgctctcgaactctgttttctgttgtttaagatgtttatcaagacaatacatgcaccactgaacatagagccttatcagtaattctgcttttgccctttgccttgtgatctttgtttctgccctttgccttttgatctttgttctcctttttgccctttgaagcatgtgatctttttgtgacctactccctgttcttatgccccctccccttttgaaatccttaataaatcttgctggctttgaggctcaggtgggcatcacagtcctaccaatatgtgacggcacccccaggggccgagctgtaaaattcctctctttgtactctttatttctcagccggccaacacttacagaaaatagaaagaacctacattgaaatattgggggtgggttcccccaataaattcacttatcttgtgccttagtttattcatttaaaatgaagaaaataagggctgggcacgatagtctatgcctctaattccagcactttgagaggctgaggcaggaggatcacttgaggccagtagtccgagatcagctggggcaacatagcaaggccccatctctacaagagtttttgtattttttgtttatttgtttgttttattagccaggtgaggtagtacatgcctgtggtcctagctacttgggtacctgaggcaggaggatcacttgagctgaagttatagtgagttattattgcgccactgcattccagcctgggccacagagcaagacctcctcttgatcaatcaatcaaagaaaataagacagtctagccccatctcactgactattgtaatagaagtgagataatatgtgaataaagcacttaaagccttaaagctataaagagttttttttaatgtgaaaaactattataaatatttatagtgttctggtactacactgtcaatggacacaaatgttccaaggttcatatagcttcttacagatgaaacactcatggcactttgctcactaataagaataaatcagtccgatccaaatagaacagttttagtttttattagatgcctagaacactgtaaatatttagtaattggtaaaggaaggtaagtatattttaactcttaattctaaataaagacaatgcaataaatttaaaatgtagatatgtttgtaaacagaatatttcacataactatagataccaacctattttttatgaatatggcaggataaaattagtattcctctctttcaatttgaaaaatattccaaaagcaacacgaccaatgaaaaacagaaaccccattttgggcaaaactaggagacaaaccacaaaacgagtagaaaggctgccaaaagcaatggagatgaagtgggaatgtatgctgtaggcagcataaagagaacattccagttgcaaatggcagaaaaaaacaaagtctatttcttgaagttgatgggtacactttaaggtataaaccccttgtttatatcaaagtgcacaggctgacagctagtgctttcccatatgtggtttggttccaagaagcagaaagaacaatgctaagtaaggaatcacactaactatatttgcagagagaagtccatctctgtggctacataagacaaaagactttgtacaatgaaactccccaaagttgtctatctccattggctggacaaaataaaggataaatagaatttaaaagatctacacccaaaacagaactttcacaaaaaaactgttgatacgaagctgatgaaaatcatgatgaatactccaccattaatgaataaaactatacaatcgactctaatttgaaatttttaaaaatatataattataaaattgtgttgaccagaacaataacaaagaaactcgtataatcaatcacttacctctgattcatattttatttttccttcatctaaaatacgtgcatactcttccttctggtgttcaaattctgacttgagaaatgtatgttcatagcgaagcttattatatacagctctatacttttctacctcctaaagggagaatgcatttatcatagatttataaacaaaattcgtactcactccaatagtcacttttacaaatataattttaaattacattataatgatagccactctaaaagtaaaaaataaatttaacagaaatacaaatgaatttggaaaggtcttcataacaagtatcctacatacagaagtagtacattcctgaaaagatatccaaaaagtaaattaccattcaattaatcttatttcttcactggttctcattatgataaagtgtatagtatgaggaaagtgttgatctctggacttaaataaaataacatgtaagaatgtagcacacctttcaaaatatagattttttaaatgtataatttagtataagtaaaacaaattcaaaagagatgtaaggttattgtaatatttagtacagcattttaacatctaattaaatattacaatgatagtttaactcaacagaccaacctgaagaatacgtgcagcatcatctctactgactaaccaggaacacatgcaattccctggagtgttctcatcctgcttcctaacagtactctatgaaagctgctggcattctgaatacccaacaagaaactcaggccacaaagcagaaagatacaggagacactaacaggaaattcgataacaaggaaagcatgtctcctaaaatacccagctcaccataaatctttagttcaaagatttctaagccagtttgtaaaccaagaaaatgggtttcattattttactgcagatatactttgctttgatttaaaaaaaaaagtttttattgaacttggtcacttatcttgggtctgatcttgtttatttacaaaaattaaacctactcccaaaccataatggcttgccattaggactgtattagaaagatcatattatcaagccagtaagccattataaaagacgattctacaactgttttgggcaattaccgcatcactagactacagctctccaaaggggcccattttgaaggggacaataatcatttgtatgtataaggccaggtatatttgttaaataaggtaacatatataaaatgtctaccaagtatctaatatacttgttatctgcagtcttatcctgtcccctttattaagcatttagtcatattatatcaacacttcaccaaaggagactagtctcaacctgaagtaaaactgtaacagatttttacttttatgaagtggcatgaaactcattctctctttcaacaaatattaattgagcacctactgtataccaaaatctgttctaggaacttggaatataacaatgaacaaaacaggtaaaggttcctcctctcatgcaacttccattctagaggtggtaaaacagaaaataaacacaataaataagcaaattatacagcacagtagaaggtatgtataccagaaaaaaaaataaaaaacagagcaaggtaagggggtctaaaggtctaagcagtaatgggaaaggcaggttgcagtattaaataggtagatgggagcagtcaaagtaggccccattgagaaagtgacattttagcagacttacaagagatgaagtttgccacgacgtatctggagggagagtattcaaggcaaaagagatgtgccaattaggctgggcatggtggctcaggcctgtaatcccaacactttgggaggccgaggcgggcagatcacttgagatcaggagttcaaaaccagctggccaatatggtgaaaccccgtttctactaaaaatacaaaaattagccaggtacggtggtgcgtgcctgtaatcccagctacttgggaggctgaagcaagagaatcgcttgaacccgagaggcggaggttgaagtgagccgagatcacgccactgcactccaggctgggcaacagagccagactctgtcgcaaaaaaattaaaaaagaaataaaattaaaaataaaaataaagaaacgcaccaattctggaatgccaaagaaacatcagtaggccaatgtggaaaaaggaaaggagatcagagaggtaatgggagttcaatcctgtgaagccttagaggccactgcaatgactgagtaaaagggggaactactgcagggttttggggtaggggaatgatgcttttcatcaagactttgatcccatgaggataaatgcatagtaaacaacataagttacttacttcatctagattcctaaaacgttctctcattggagtttctaattcttgttgtatttgggctcttagcaattccaatttttgtggagttaatatctaatatgtagagaaatgcaaacaatataaaatcacattaaaatcaagaattctccatatttcaaagcctctctcctaattatgacaatggaattcatgaaagtttttgcaatatagtttttttacagtgatcactatacaaatagaatcatcatttgaaataatactttaagaatctcaatttcaggctcttggagatgtcaaaaattccattaacatgaagtaaagacaattactgattattattgctattgttaggaataactatgttggcagctaagactatcatgttgtatacaatggctaatagtctagttattttccaaagcaggcaaaataaaggtgtaacaatttgttataccaaagagaacctttcagacttattttcaattagaaaaggctcatttttactctcacactgtacctaatttaggcttctccttgtcacactcttttatagaactcgtattttaataagtaattaaatatttatgtaagtcccatgtgggaaaacacagtctttattcaccgttgtattcccaatacctcccaccaatgtctggcacataggaaccactcaactatttcatgaatgaaggaggaacaaatactagttgtaaaaaaaaaaaaaaaaaatctaaagtttgcatgtatattaatttctataaaaatgataatgttcagtttccttttttatgaagagtccaaatattgtattcaaaatattacattttactgaatggagagcttactatatataaagcattgtacaatgcactgtaacctacataccatcctgttctaagcacattatatgcattactttatttaattcctacaacaatgccacagtatagctatgctgaggcacacaaggtatctaaataactttataaagatcacaaaaactcacatgaagcacatatctccccataaaaacttcaaactctggtgttaaaaataactcatacacacaaataactataaaagtaggcaatacaggcttaccagacaggtaaaaaagagaaaacacatttaggatagaaggcatgacacgtcaaaggaatgggaaaactaaagcttatatagaacccttatatagaaagcttatagaacccaaactcaagccaggtaacattttaatttgcctgggtgtcagagactgtatgggagaaaagtgattctcaaaggtgagttaaagccattttgaatgggaccacattaagtactacagaaaatttaaaattgtgggaccctatatgcacactggtagaaatatctaaacactgtaacatttccaaatgccaccttggagggctgcactctggctggaaacaaaaggaaaattaggttgcagccaaagagtgaaaggttcctgaataccaggtttagactcttattatttattcagtattcaatagtatttactttaaaaatttattttatttaaaatgaatatatacaattacataaataaaataattcaaacaaaagactaaaaagtcttctcacttcagtaatccaatttccttttattgaagcaatcattgtcaataacttatgtacccttcctaaaacaatctacagatacacaagcatgtatatcacttttgatttctatacaaaaaggatattgtacatatatttttctgtaccttatttattgaaggtttttaagcttaagagtgacactaccatatctatattttacgaagaagcaagatgaatcaaaagctttagtgggagagtagctgtagctgtgggaagaagaggcagtaaatggagccaaagaaaccagacagaaagctcatgtcataatctggtttacggtatcaagtatcaagtctgggtgacaacatcaagagtccaaactaagatgaggtagcaattaaaaggaagagattaataggtaaagcttacatggctcctgtttcaaatgatctaacttcaaaactaggcaagcaaaaccatgggaaaattaagaaaatctgaacaaaggtgggatattaaaaggtattaatgaataagtattttaaatatggcaaaggtattgtgattatgcttttaagacagactgcactgatttgttatagagatatatactcaattatttgttgaaagaatattatttgattcaaaataatccagaaacattgaggaaaaaagtggaagtgggtgggagaaagtagtagataaaacaagcctggctcagaatgaataattattaatgctggatgatgggtacatgggaatgcattacatgtttgagatttccaaaaccaaaagttaaactgaaagtaaaaagccttccactttcagccaagatagaataagagcccagattcgctctcttgcctgaaacaaacaaaagaacagacaaaaattaaacagtttgcaagacactagacataagaaagcaaaaggcagatccctgagagacacaaaacatagaagataagctttgagagttttcaggacctggcaccggaaaggatacctatgcagtcatgagggactccctgagttgaggagatgaaactgagcatccaaggacagtggggtggttagagtcctaagacagggtagcagagaaaagagggcacagaaagacaactatgaagacctacaaaaagtcttgactcattcagtagagtactgattaacacatgtgtgcaaggaaactacctaaggctaggcaaatacacacctgaaaggattagaaggatgaatacgcagagctcacaaagacctaagaatagtttctgttccccaaaaacagattaaaatcctttgtttcataaagaaattgttatactactcagaagagtcttgcctcagtggtgggaaataattagcactacactaaatactactctgctcccacttaaatcttaaaagcaagacccagaaagataaaactgtttccaaataatttaactgtgtcccaaaataaagctcaagaacatgtatcagaatataaaaatattgggaggtggagattgcagtgagctgagatcactccattgcactccagcctgtgcaacaagagtaaaactccgtctcaaaaacaaaacaaaacaaaacaaaaacaacaacaacaacaacaacaacaaaaatccagcattttaaaaacaaagttcacagtatctaacatccaataaaaatttaccaggcatgcagagaagcatgagagagagagagagagtgagagtgagtgtgtgtgtgtgtggtgggggcaggggggataaacttaaaacaggcccagaaatgacacagatgtcattaaaactttattgtacagttattgtaactgaattccatatgttcaaagaactagagaaaagactgaacatgttggatagagataaaaagaccaaggccgggcaaggtggctcacgcctgtaatcccagcactttgggaggccgaggcaggcagatcacgagctcaggagattgagaccatcctggctaacatggtgaaaccccatgtctactaacaataaaaaatttaaaaattaaccaggcgtggtggcgggcacctatagtcccagctactcaggaggctaaggcagtagaatggtatgaacacaggaggcggagcttgcagtgagccaagatcgcgccactgcactccagcctgggcgacacagagagactctgtctcaaaacaaaaaaaaaaaaacaaaattgagcttccagagacgaaaactacaatttctgagatgaaaattacactgcatggaattaatggcaggttagatactgcagaagaaaaaatcaatcaatctgaaaacatggcaacagaaactaaccaaaatgaagcacagagacaaaaaatactaaaaataaattaataaacaacatcagcaagctatggcagaactttaagtggtctaatattagaatgtaattaagagtctccaaaggaggtgaaagaggagaaagaaaatatttttagaagtaatctccaaaaattttcagtttgataaaaactgtaaacccatagacctatggaactcaataaaccccaagcactacagatataaaaaaaactgcaaagtatgtcaatcaaattgcttaaaaccagcaataaagagaacagcagccaaaaaaccagacaaagtgcactgcaaagaacaaagataacctgtgctcactaccctgtagagtgatgtagctgcacaatatccatgcagcttctagcattatatgttcaattacatcacagatgcctcttggaaacaacagtgctttaaatcctgtaatggtgtgcacctcaccactggcctgtgcaatctaatagcatacaacagtttaggggtcttctgatctgaggtctctgacaaagcatctctaactttttcttacctcctaggaatcttattaaaaacaaatacacacataataaattctctcttcctctgtctctccccatctctccctctcctatcccctatacctccaaagcacacataaaccaagacaccgactgaattagaggatttttcccatcccattttaggaaaaaatattctctcttaggctactttttgtttgtttgtttgttttggagagagaaagagtctcgctctgtcgcccaggctggggtgcagtggcacgatcttggctcactgcaacctccgcctccaggttcaaacaattctcatgcctcaccctcctgagcagctgggaagacaagcatgtaccactacacccagctaatatttgtattttcaatggagacagggtttcaccatgttggccaggctggtctcgaactcctgacctcaggtgatccacacaactcggcctcccaaagatctgggattagtcatgagccactgcacccagcagtgtcttagacttctaatggaatattgccactacttgtctccaaagaaacataagaatgctttatcatacaacagtctaggtgtcattacctattttaaatctataaaaacaaatctttaacactgcagtacttgccatttaataatctaaaataggccaatcttttacaaagaatactttaaggcggcaaatactgctatgccaaaaattcttaataaattaatgactgaaactgagtattatactttgatctgagcttcccagcagccaaaacaaaatgggaacctgtatactaggttatacagttttcattagcacaaaaagagtatattaatcattggtaaagtaatttccgttttattagaatatatcaaatgatccccatatttaaaaaggttttgctaacatggtacatagtaacacaataacaacatgtactgaccacttactagatcaaagtaccatactaatacttttttttgagtcagggtctcgcgctgttgcccagggtaaagtgtggtggtgtaaccatggctccctgaagcctcaaactcctaggctcaaacaagtctcctgactcagcctctctagtagctgggactacaggtgcatgccactatgtcaggctaacttattttactttactttttagagacagagttacccagttacgttacccaggctggtttcaaactcctagcctcaagtgatcctcctgcctcctgaagttctcaaggtgggagccaccatgctcagcctgaactaacactttctatgcactgtctcatttcatccttacagtcatcctatgagctaggcactattatcattaccattcactactgatgcagaaatgttctttaaatgaatatctcttatatctttttcctataaaagccaaagagatgacattaaatcttagaaaaagcatttttgtaggcagactagataatgcacgtatattttaaaaataatcatctttcataaaccttcattgaaatatttcttgatctttgttgaatttacttttctaaacttacaatttgcgcaaattgcaagcatccattaaacaaatagctaaattgcttcaaaatgtgtgtttatatgtatacatgatgtttctttagcttatttttgccaaataaatatcacacagaaactagatatgtttatcttaaaaaacagaagccttactagatatgtttatcttaaaaaacagaagccttactagataaattatatttgtgagcaaacatttgggaagttttcacatggaggaacatccaaagttaccaacagggaggctatagggtagatgacttcattttaataggagagagaaaatgtttaacatactttaatctataaatacaattggatcactttaaaaagttcaccaggttctctagcactgaaagcactgaagcagaaaatgaagagagtcctgtctgaaagatgttctaaaaaggattctgctttggacagtgtattcgtttcctaggttgccataataaaataccagaaacgacgcagctttaaataacagaagtttgttctttcacagttttggaggctattagtctgaaatcaaggtgtgttgacaggccttgctccccctaaaatctgcagggaagaaactttccttgcctctttctagcttctggagcacttaaatctctgcctccaccatcacatagtgctcctctctaccccatctgtctccatctctcttctcctctttttttaaggacaccagtaatattgagttaaaggctcatcatactccaatatgacctcatcagcttaactaattacatctgtaatgaacctacatccaaataaggtcaccttctgaggtactaggagttaggacttcaacatatcctggttggggatacaactcaacccataatagattcaaagaaaaactagatgattaccaactctaagatgctgaggctgtaggtatgtttgacacagacagtgcaatatatgaacaacaatcccaattcattcatttatttcaatttttcacgtcattcattcaacaaatagatgtttactaggcattatcctaaacactgaagacacactgaaaaaaagttcctgccttcatggagcctgaattcaaataaacatgtcataatctatgaatatttactatgtggaaagtatggcagtaaaaatgtagatgttatctcattagtcctcacaactcttgttaagcagaaacttttatccgctttaccacatgagaaaactaggcatagagacatagttacttgttgaagttatcatcttctggaagaactgtcccttttttttcattataaacatcctttttatctttagtgatactctttgtctggaagtctcttttatctgaattaatataactactccagccttctggatgtgctttacttactttctggatgtgcttggtacaaataatcacatttagatgtcactctcatgaaacagaataattaaatttgcaatacctgaagaatctctcaaatatcttgggttcagcattcacagcttccactcatacagggctctaaatttttgcaaaacaaattaatgcattgattctacaggcttaaattacatttccctcttcgatttacatttctgaggtttatatttgtatatttaaatgtcctaaatatacctaggaatgaaacagtgagcatagtggaggctccaagccaggcttagtggtgttcccagcaatggtagatttgaaaaagttattgaatgacaaacttacaaggcttctgtcaaaggatatctaagagttgggtgatatgccagactaggtgacttgaaagatgccttcttactctatgaacttctgactctaatattaataataccttattatttgtaccaatcagattgttaggcagaaataaatagctggtgctcttcagagattaaataaatatgggaaaatattattcgtgagaacctactaatctgaaatttacaggaaatttgactggagtttaaagtctggctttgctcaattttccagacaaatgaaaaaatgaatagcgtgaaaatgatctaaagaaactgtacttcagcactttggagacaactatcttttgctttacaaacccatttgtgttacaatgtacacataaattatgttcacatactgtttttacagtctcttttaagaagctctttaagaatagctgtccttttttagctttcagttataatgcatatacaaatactagtaactcttttaaaaaaattctttaattctgaatttttatcaattcaaactcactttttccctaattattcttaatggttaaatattatttatatcagaataggcaatataataccaatttacataaaataacagtttcatggctcccttacatggtagctaacattctaaaatatatgaaagaagattaaattgtaccacttggagatacagcaaagtaatcattaaggatatagacagaaattgccatattcaccaaaactacttacttccactacgtatctgactgcttttatactaactcaaaactcaaatatattttctcacctgcagtttcatttcttctaaatctttagttttctctactaattctcctcttagttcttcaagcaggagctgaagtttttcctgctgagtttgcttttcattaaacaggtgcttgagttcattttgtaactttacatgttcattctgcaacctggttttttttaaagagaattcaattttgagtaaatcctttctttctaattgcattactttatgtaaagtcaatcaacaccacagaaaaacaagaccaatatcacacattcctttaaacccacaagtatcttttatttacagagtttcatttaattattaacactgtagttttggaatgcaattttactttggtgggagatggggaacacatttagccatctggatacatttaatcttatacgtcctgctactttcaaaataaggcttataaattcataacccacttgatatcatacttagtttggaacaaagtaattttaaagtaaaaattttactatattaaaaaagttttaaatgtatacattgcaaaataacaaaattatactatattctatagcaaacattcagccaagataatgccaataactttttaaaaccaaaccccacttctagatttaagtaatttaccttgtgtgttcagccttcagtgtctgataattagctttatgatgctcacatcgtaacctttcatcaattaacattttctggaactccgactgagaacctgtcaatccactgtctccaccaggaggaaaattattgggaaaagtgtccatatcggtaaatgtgctgacaaccatgtaaaaataagttttggctttcttactgttttagttttctttccaagggtatttcccactcctttcttgctaaggcagaatctcaggaagccaaattatacctgcacagagaaataaacataattacataatttgcgatcagtaaacgtaagcctcctttaatgttacatatttttatcacttttattattcttttttttttcttttttttttttttttgagaggagtctgctctgttgcccaggctagagtgcaatggtgtgatctcggctcactgcaacctccactcccaagttcaagcaattctcctgcctcagcttcctgaatagctgggattacaggcgcctgccaccatacccggctaatttttttttttttttgagacggagtctcgctcgttcgcccaggctggagtacagtggcgctatctcgactcactgcaacctccgcctcccgggttcacgccattctcctgcctcagcctcccgagtagctgggactacaggagcccgccaccacgctcggctaattttttgtatttttagtagagacagggtttcaccatgctggctaagctggtctcgaactcctgacatcaggcattctgcctgcctcggcctcccaaagtgctgggattacaggcgtgagccaccacgctcagcctctccttatcatttttattacaaagcccaattctcagattttaatttgttcataaaacaaaatgcaaatataaagctgaatcacaccttgaacaattttctttacctccatgcagcttctatgcttctatgaccatcaaaatcacatcttcaagtattaacctagctccactagaagcagactttcccagtttaggtagtcttaaattcacaaaccagagtcatgtttcctgaagctaccacagtaagcttcaagtatagatcctggtataaaatccatactcccaaatcagaggaaaagctatttggaacttggtaactggctagggagaatcaaggtcttcaaaaggtgaccttcagcaagtaactatgcctatgattaatgctttgaagggtcttttacttgacacaaggcaagctgcacccagactacagattcacatgagaaatttgtcaacacataaatattgatcaactcctatgtgttatacactgtgttaagaaaactaaatctcacctatctccaaaagcactgactcagtattacaaacgtcactgtttatttcatctagaaataaaaaatgatgtttcaaagtgttcttataactaagaacaaaaattttaattaaaatagttgtctcctttaatttctttctctagtcccataatacatacacacacacacacacacacacacacacacacacacacacatacatacatatttttttcctgatagaatcttccttagccatgggttattacaaatcacttcttataacaaaaaaaaatctttgtcctatgcaaaccgaccattaaattattcagccttgcttgaattataccatctctgataaattagtgtgatatctacgtattacttaagacaatctttaaactataattgcagttgttttggtttcctctgaaattatattttaatacagagggaaaagtccctcaagaacactatactccttactcttagatttaacacgcactgggattcaatctttgtaaatacagaatgcgctatctgtagcagctaccacaaaattatcctgccaaaagtacacatttgccaaggaattaatgaattgcatcataaaactggcattcaatttttactctactgtgggtaaaatgctatcaaatagaatctcatgctccaaagaaatctttcatgaaaggaagagtcaactgatgtggcaaacttcactgttgtctcattttaagaaactgctacagccatcccaaccttcagcaaccatctaaatagttagcagccatcagcagaaaggccagacccttcacctgctaatagatgattactcactgaaggctcaggtgatcaatagcattttttagcaacaaagtactttccaattaaggtatctacattttaaagacataattatattgtaaacttaacagactacagtatactgtaaacataacttttccatgcactgagaaaccagaaaattcttgtgacttgttttattgcagtagcaatccaaataagttaaaataaggaaacactaattcctaaatgtaagtttagatttactcttgacttctaaagctttacaggaagaaaaaatatttgggggttaataaatatgtttggttccacattaaaaattattctgtggaaaaaatacatttttaaagattataaaatgtgtctttataaaatgttgatatgtgacagctcaaaattgcttacttcctaggttttcactaaaagttaagattactaagatttaactaaaaattaagattgctaagagttaaaattctagttaatacatagaattctgtatgcaaagggtacaagaaaaaaacaaaatttgtttttggtgaaaaaagtgttttaaatggcataaaaatgtgtttttatttaaaaagtaatttgtctaattcagaagttattgaaagattatttcaaaatatgaatttggaaaaacatgaaaacaaggcagaaaggaacaagtgaaaaacagacacaaaaaactatgagaatgtatttttggtaagaaaagagaatgacagtaatttttgtataaaaaaacttatgtggttgaaatgatagaaaaaaagggaagtaaatttttgtcctaaggtaaaatgattgtttcagtataaacaagagaaatataagacaaaactaaaggactgagcaagctgtagaaggtctgggcaaattatgaaaggtttgtgagagatgaatcttatgaaagaaattttatttgtgaacaaattggctaaaatgaaaagtaaattgtttataggtttgtcttaaaattgagtcctcatatcaaaagtacactgatacaacactaaaatttgatcttctcttttaaaacaagattttcttattgattgctctcaatgaaaaaataataaaagtagattttaaaaggcaaaaaacccccactatttaaaatggagagagaaattaataatgataaaggttaaatacaccagaaagatgtgacaattttaaatttacatgcacttactatggccactaaatagtaaggcagaagttgtcaaaactataaggagaaatagacaaattcacaatgataggaggagaatttcaccactattcttggtaactaatgggacaagaagatttaaaaaaataatcagtaagaacacagataatttaaacaacacaattaaccatgctgacctaactgacatatggaagactataccctgtaactacagaatacacactcctcacaagtatacacataacatttataaatgttgaccacatgccaggtatttaaaaaaaatttcaaacattttaaaagaccaagatcatacaagataccttctctgaccacaatgctattaaactaaactcaatacaaaaaataatcagaaaagccacatatgcttacaaagtaagaaatacatttctaaataacttatgaatcaaagaaaaggtcaaaatagaaattagaaaatatgtagtactaaatgaaaattgatactccattttaaaacttatggaataaaggtttctactttgaggaagatggaacagatatacattttccttttatactcattaatataactaagagtcctggatttaggtatatgacaaacgtaagactctgaataatggagactagaaggctgactagctatggacctgagaatgtaaggacaaatacagtggtgagtttatttccctgggttttctttttcatatatctcagacacagagctgaagaaactggcaaccaggaaacaccaattaattcagacaaataagtcttgaacaaaaaagcctactctctagccaaaggaacaaaaaagagggagcctagcaagataatatgtagacaattacaatctactctatccaaataccatacacacacacacacacacacacaaaaaaaaaaaaactgtagttccacccccatccacacaagcaaagattaggtggaagccaagctaggctgtaataaaataccctaatactgggccaagatggtgcacaagaaggctcaccagaaaacagaaacttccattgcttcctgaaccgtaataaagctcaatgatcctgcaatgtcagaggagaccacatggaaaacctaaactttcaccccccaccaagagtaacaaagaggacctccctcaccccactgaaatgctggcacagaaggcctagtggagacttatgacaggcagaaccaccaacagtaatgaggctaccctctccagggtatcagggaagatcacatggggagccagaactacagctacctggcaataacaaagacccctcccgcaacccccctcccaaaaaaaactaaggtgtcaacagaggccatcttagaaacctcgacttgctaggcactatggcttgtgactgcaaatcccagccactcagaaagtgaggtgggaggattggttgagaccaggagttcgagaccagcctgggcaacacagtgagaccttgtctcaaaaacaaacaaaaaaaagtcattagctaggcatggtggcatgtgcctatatgcccaggtacttgggaggctaaggtaggaggattgcttaagcccagttcaaggctgcagtgagctatgattatgccaccacactctagcccaggcaacaaagcaagattcccacctcttaaaaaaaaacaaaaacacaaacaaaaaaaccttgtacttccatctccacctggcaaaaacaaggtagtatgccctctttcctctaccagaaaagtgtcagaaaaagccagctaaaacaaaaagtttagatagaatccacaatattataatatcccaaatgtccaagtttcgatagagaaccactggtcggccaggcacagtggcttacacctgtaatcccagcactttgggaggccgaggcaggtggatcacctgaggtcaggagttcgagaccagcctggccaacatggcaaaaccccatctctactaaaaatacaaaaattagcagggtgtggtggtgcacgtctgtcatctcagctactcaggaggctgaggcaggagaacgcttgaacccaggaggcaggggttgcagtgagctgtgatcacaccacagcactcccgcctgggcaacagaggaagactccatctcaaaaatacatacatacatacatacatacatacattaaaaaaagaaatccactgatcatatcaagaatgaagatttcaaactgaatgaaaaaagataacaagccaacactatgatgacaggaatgttatggttatctgacaaagactttaaagcactgatgataaaaatgcttaaacaaacaatgacaaacaagcttgaaataaatgaaaagagggtcacagcaaagaaatacaagtctcagaaaagaaggtaaaaagaagaaccaagtggaaattttaaaactgaaaaatacggctaagcctggtggctcatgcctgtaatcctagcactttgggaggctgaggcaggtgggttacttgaggccaggagttcgagatcagcctggccaacatggtgaaaccctgtctctactaaaaacacaaaaattagccaggtgatgtggcatgcgcctgtagtccagctactcaggaggctgaggcaggagaactgcttgaatctgggaggcagaggctgcagtgagccaagattgtgtcactgcactccagcctgggtgacagactgagactctgtctttaaaaagaaaagaaaaaaatacaatgaccaaaataaaaatattagatgagctcatcagcagaaatagagaggaagaggaaaagaattaatgcactgggaagatacaactacagaaattactcggctgaacaatagacagaaaatagacatacaaaataaataagcagctcagggactgtcagaactaacaaaaaatacctaccattcctgtgcttggtgtatgattccatttatatgaaatatccagaatagataaatacatagaaggtaggctgatgatttccagggactaagggaatggggaaatgggagttgactgcttaatggttacaaggttttctttgatgtggtaaaatgttttggaactagataatggtagttgttacgcaatgctgtgaatgtaataaatgccactaaattatatactttaaaatagttaatgttatgctatattaatttcacctcaataaaaaaagagaaaaataaacctagcaaactagaaacttaaaagtgcatcaatctcatcaaaggtgtatataaaaagagtattttaaaacaccacacctgactttaaaatcttaaaacatctttttctgagagtgtgatcaaaacaagaaagtccattattgctacttttattcaatattgtattgaagaactagaacaaaacaaaggaatagaaggtataaaaactaaaaaaaaaaaatctttatatacacatgttctgattgtgtatgtagaaaatctaaacaaatttacagaaaaataattagaaaaagcaagttagcaagattggcagatagagcaatatacaaaaattaattgcattccatatgccagcaacaaaatattttttatttttttcaatagtgatattctttaacaacaatgtatgtttaaagacattcttaataatataaaaaatatcaaaaacctaggtaaaaagatgtgcaaactatttattataggaaaactgtggctagctactgaaacaaactaaaaaagacctaatagagatatggactaggtgtatggattagaaaacattctaaagagacaaattctccccaatctacagatgatgtgatatcaattaatatccaaatgagtgtgtctctatgtgtgagaaacttaacatgctgattcaaaaatttatgtggaaatacaaaagacaggccaacaacagtggaaatgattttaaagaaaaaaatgagaagactttactatatatcagtacttactacaaatatacagtaattaagatggtatagtatgccattggcttaattatagacaaagagaccaataaaacaggacacagcccataaactgacctacccatataagataatttagaacaaaggtggttttgctgaaccgtaaggagaagagagtcttcaataaaggccactgggacaactagataaccttgtagaaaaaaagaaacttgcgcctttctttttattacacactaaaattaattctagttggactgaagatctaaatgtgaaaagcagaagcacaaagttgccacaatataggaaaaaatattcagtaactcaaggcaggaaaaatagcacgtctaaaatctaaaaggtgattcccagataaataatgagaccgagcaccttttctttgtttactggccatttagatatcttcttttataaaatatccatttgcatcttttgcccaattttttctattgaattgtcttttcaattactaatttgtaaaaattattcataatatttaaatctcaatgagaaaaccaaaaagactgacgataagtctggagaggagaggaagcaaaggttgtagtgtaaactggcatattcactttgggaaaaaaactagcattatctactaaggttaaaaaaaaatacatatactatgactcagtaattcctctcctgggcatatatccacttgaaatgtggtatacacaggtccacaaaaagatttatatgatactgttcatagcagtattattcctaacaactgaaacctagaaacaaatccaatgaccatcaacagttgaagaaacgaatagtggtataatggaactagcactatactgcaataaaaataagctatagatcaagtttgtccaacctgtagcccatgggccacatacagcctatgatggctttgaacgcagcccaatacaaattcataaactttcttaaaaccttatgagagtttgttttgcatggttttttttgttttgttttgttttttagttcatcagctttcgttactgttagtgtattttatgtgtggcccaagataattcttcttccagtgtggcccagggaagccgaaagactggacacccctgctatagatactctatatatatagggtgaatattacagacatattgtccagaagaagccaaacataaaagaatatacactaaattattacaaatagattattacaaatatataaagtttaaaaattaaatacaagcactatagtatataggggatacatgcttaggtataagcatgtataaagaaaggaactatattatcattaaagtcaggaaaatattacttgatgaggctagtaacgttctacttcttgatttttgtggatatatggaggtttgctttgtaacttgctttgtaaatcactcagctgtacattgttgtgtacttttctatatgtatattataattcataattttttttgagacattctcattctgtcatccacgctggagtgcaatggcatgatcacagcttactgcaccatcaatctcccaagctcaagtcacctcagtctcccaagtagctggtactacaggcacatgtcattaggcctggctttttaaattttttttatttattttaatttttatttttattttgtagagacaaggtcccactatgttgcccaggcttggcttgaactcccacactcaagccatcctcccaccttgacctgctaaaatgttaggattacaggaatgagccactgcaaccaaccttataattcacaattttttaaaaagggacttagaagggagagtaattcaaaaattgggctcagcatcatgtcaaggactgtagtccttttcatttttcttccaacaaatcctgttggcttaattctcctcatggttgtgaggctaccacatggatatgtaatattcattttttaaaaatttattctactatttctcctttattcatgtgcttgtttatagtcctttaagtaaaatttacacataatgaaatgcacaaatattatctccatgcatcacttaacaaggatatgctctgataaactcattgttaagtaatttcattgttgtgtgaacatcaaagaatgtacggtacttacacaaacctagatgatatcgcctattatacacctaagatatatggtatatagcctattgcttgtaggctacaaacctgtacaacatgttactgtactaaatattggaggcaactgtacaaaatgaagtagaggttcctcttcaaagggactttccttccagtctaattgagaataaatagtagcctctcttagaagcaaaatttactcaaagacctgtggtaatattcttaaatatctgctagccataataaagaaaccaatatgctttgtgtgcttagcccccaccttttggcctagatatttgccctggcatgcctatataggcccaagcaagcattaggttatagcctgtttctcttccttatttggaggtgttttggcctttctcagcattccacaagttacttcctcctttcctttgttctcccctacctttacctcttttgggaggttctaagttgctagccaatcaggacaagaacagaatgtgaagtcccgttccagccaatggaaactggacacagccatagcatggacgcattagattataaatgaccctgtctcctttgtttgtatgtgctctcatggcaagactgctagtgagtggcaccctttctgcagaaagtaaattagccttgctgggagatcctttatcatagtgttgatttccgcgacactgaatacccatttccaacagcaactgtaacacaaatcactaggcaatagaaattttttagctccattataatcttatggtaccactgttgtgtatgtggttatatgcagcacatgaatgcacacaatttcatgagttcacaaaaggaagaattcaagaaagcctcaatttcatcaagatataaaacagtcccatcactccagaaagttccttcatactccttccccatcaccccacccacaagaggcaaccacttttgtggttattctcaccatagctccacctgatccagaacatattaaagtgaaatcatacagtacgtactctcatgtatttgccttgtttcacccaaatagctgtgagattcacctatgtttttgtgtatctcagtagtctgttcctttttaaggctaaatagcatttcatcatttaaatataacacatattgtttatccattctcctgctgatgcgcatttggttgtttctggttacaatgaatatagctgctatgaatattcttgtacaagactttctgtggacacattttcagtttgggggtgggtggtggtaaacatttaagagtggaattgctgggtcatggagcaggtttatatttaactttgtgtaagaaactgccaaatctttttccaacgtggttgtaccattttctattccaaccaaaaacatatgagaatttttttttttttctgagatggagtttcactcttgttgcccaggctggagtgcaatggcgcaatctcagttcatcacagcctctgcctcctaggttcaagtgattctcctgcctccacctcccaagtagctgggattacaggcatgtgccagcacacccggctgattttgtatttttagtagagatggggtttctccatgttggtcaggctggtcttgaattcccgacatcaagtgatccgcccatctcagcctcccaaagtactgggattacaggtgtgagccaccatgtccagccaacatattgagaattctgtttgcgccacatttttcccaataccttgtagctgcaccagaccaatctggttcaactttttttttttttttttgcaaaagaaaaaaagtttttttgatctccttgaatgtagcacacaaaaaaagtgatggctcccccaggctccatcagcaacagtaaagggcaggaacatagagatttctttttccaggcccaggcctgtgaaaaacgatggctaagtgttagtccttagcagggccgacggatggtctccattcctggttaaccctctggaatttgggagcatgagtatctccaagaattcatttctactcagtaaagatggggaggggaatcccactgttacttgttgaactggaaagaatagaccccatgctctgagggtgtgtccactgccacttggttctgttggccgctgctctcctcgactgaaacactggaaggaaggcacaggggtgtactgggagatgtaagctccttgcatagctgcagccgtcagcatatacatgcctgtgctgctgaggcagagatggcccagttgctgggtaaggggtcccatcatggaggcaggctggagagaaatgggatggtccatccctggtgtcagaactgaacctgaaggctgcatgaggtatgaatggtggtgcatccaggatgggttaggtacttgtagaggagatgtctgagtcactctctgatacgaagacacaggagaggaaaggtatggggagagtgcagaccgagcaagcatcctgttgggggtgatgttataaggggctgggtaaaacccattctgaagagctgtggtggggtcataggtcaaggccatgatgcccatgtctccattccttggccaagcccgtccattttgcacaaatattccttggttctgtcgtttctttggcccgccatcagcaaatttgcaaagcaagggatcggatggggctggtactccagggggtgtcttaatatattttccattaaagtgggtgatgatggcttcacacttctctgtggactccatccttgcaaagccaacacctctgctggtcccactggtatctcgaaggatacgggtggagataacctggccaaagggcttcagcatcccctccagttcctgctcatccattgacagtgggaggtttgagatgtataaatttgtggggtcctgttcctgttgctttaccatctgtgcctgtacaccactggccttcagtgctgttacagctttctgtgctgctgaagggctgtcaaaatctacaaagccatagcctttacatttgtttgtggtcttgtccagtacggccttagtggaaacaatcttgccatatggctgacacagcttgacaagatcttggtcagtagtgcctggttgcaatcctcggatgtataggttggttttgctcagctggtcatttccattgcttccactactgctgttaggtgtactgttgcttgggctaggtggtgccatctgctgagccaatgacacatatggcttcttgttgtttctattgtagccaaaagtagaaatcccgggcctggaagtcacggatagcagcattttctctttaatgttagggaacgagtgagagagagagagagagagaaagggagggggtaagaaagacggggagggagggaggaggggatcgagggaaagggggagagggagggaggaaaaaagggagggggaggagaaaggaggagaaaaggagcaggaggagagagatgaaggggggctgcctctggttcaacttttatgtaataaattgtgagttatttttcagctgccatggaccctcagctcacataacctgagcatgctcagatgagccaagactgcaatctcaggaggaacctaagtgcttggaccaagaaatggggactgaattaagaagcagacattgcatggcaggatccaggatccaatcagatcaagctctggcatcatcccatggagggatcctgtcagatcatgcctccagtaccacctcattgcaagatccaatcagatcatgccttgttatcctacacttataaaacctgactcaggcccctgctttaggaactatccccatgttctccttacttgttgcaagtaataaaatcctcatgctaaatcctctttggttgtgagcactgagttgatgatacctgccaagcaaccaaacccatctgtcgtgtgggtaataatgtgatgttgtgagtccctttaattgtagcccttctaggaggcataaagtggtatctccttatgattttaatttacgttttcctgaagcactttttcatgtatttaatggctgttcacagaccgtcttaatctatgaaaagatttttgctttaagaaccatcacagcaaagaatatttatgctgtagctggcaaaatgggagattttaatagctaatgtgtatataagaaatgaaaacaggccagtgcggtggctcacgcctgtaatcccagcactttgggaggccaaggtgggcggatcacgaggtcaggagcttgagaccatcctggctaacacagtgaaaccccatctctactaaaaatacaaaaaaaattagctgggcgtggtgacaggcgcctgtagtcccagctactcgggaggctgaggcaggagaatggtgtgaacctgggaggtggagcttgcagtgagccaagatcacaccactgcactccagcctgggtgacagagcgaaactccgtctcaaaaaaaaaaaaaagaaatgaaaacaaatctaaaatttgtctcattgcactaattaccatttagcttcctgagcacatactgctgttttctaccgccatggctttgtaaatgctaatttccttgctcagaaggctttttccatctctttgtattctgatctagtgaattcctattcagccttcaaaacccagctcaggaatgcattacttcctccatgaagtaaagaccctcccaaatagttcattattctgtgttttatcttgcattttagtatatacaacacatggaatgtaactttgtccatgacaagaaacatgtcttactcatgttcataatcccaacacctaaaaaaccacaggcacatattaagagctcaaaaataacaaatgaacaaataatgtgctcaccattctaatgctactttagcctcgattcacttttctcctccaaattcagaaacagtcttccaaacaatagtgggctgaatgctagccctcaaaatatgtcatttcctaatctctggatgctatgaatattaccttatatacttttaaaaaaagggtggggtgattaaattaaggatcttaagaggagaggcttatgctggattatgtatccaaaacaatcacatgtatccttctaagagagaaggagagggagtttgagactgaagaggaagaggcaatgtgaccacggagacagagactggaaagatgtagccataagccaaggaaaacctacagccacaaaaagctggaaaaggcaaggaaaagattctaacccagagccttcagagggaacgtggcttggccaacaacttgatttctgacttctaatctctaaaatgttgaaagaataatttttttgttgttttgagacacctattatatggtaatttgtaacagcagccacaagtaactaatacaatggctttctcttgtatttatatttacttataaaaaggtttatcaaactcaaaatttctaacacaattttaaattcctaccatggttagacttctttgatttcaatcagtcaatacacagctatcaattatctgcaagacacttacacatacattagatgcttgaaatacacaataaaacgtctcctactgtgcagtttactaaatacagaaattcatattgaaaattttttaaagtaaagtacagagttcaaacagcaataagtgaaaaaaagtgaaacattatctcgattggcctgttaatcagtgagcacttgttgggctagtctcagtgaaaggcagtttttaaaagactagtacaacctttttccaaattcttcatcttctctttgcaaccattacaaatacataatcacatccacgtgtccttcctaccacttcttttgactagtcccagctttacagacctccatatgacattttattttgcataggcactgtattttttaagcagtgagtagtacaatgtctgccccaaagtatggtaattcaaaatattcaaaaaagcacagctgctgatgctcatggaaagcttccaaaacacattccattaaaagcacatgctatgcctttgaatatttcaaaacaatgttttaaatactacatgccctcaaagtgaatgatgttttttaaaaaacaacattaaaagtctagggaggacctacaccaggcatttactttacttataaacaaaacattagaaatgaatttcttcaaaatccagagataatcctgcactagtcacccaaacagcctttggatagccatccaggatgtcttgcgtacaaaaaaaaagtcacaacttgacgccctgccagaacctgaagtgcagctgggagcagacccttcaaagccctggtaaggtgccaggctctgtaattgtgatttagaaagaaacaagggagagcaaggaatgagaaaaggaagaagatatgtattcaagtggttagcaatcaaccaccaagcactctaaattaaaatgttattctatttttacgattgtactgtctgcctctgcacagcttaattcacacaaaagaatctagaaagtaggacatagtaatgactcaacctcaaatgcttagtgtaaattaccaaagtctctgaaagttgtgatctgaaaggcaaagatgattcttgtccaaattcattttaacatttcttaatgtaaggtctgttacaataacatggggactttccagaagatttatgagcacttagcacctctgtgtgagttgtatattcttctttgctcacagtcccacctttcttctgaaatagaaaaggctacccataatatggctgctaatacacaataaagattatctactgatgcaacagcatatcctgaaaattgttttttaaataaatcctgatttaattttacttctatgagatttatgccgtaatctgaaaagttaaagagaaattgatacttaaaactgagtttaactgatattttactgcagttaacacaaacattctcttcattattttgaatctgtcacaaagcaagtataaaatttttcacagccagaaaaaggagataaataaaagccatcctcaagacacacaggttaatgttaaaaccatatactttaaaaaactgattaaacaaccaatatttattaagtgactgctataccacatttactgaatggtctacttacagtaaaagggttttgagagatataaaaaatatacagaccatcaagtcaagcacacttctcatgaggaaagaagagcctgcccatattcagagtactccatggatattttctaagtacctttaatatgctagacactttgttggatacaggaatacagaaataaataaaagaaaatccttgtcctcaaggagtttatgatggtcagtggaatatacttgttaaccaacaattgctgactgaataaggatgagagaaaatggactatttaaactttctggacttaaaatttttttaccatgtgcacatattacctatacaaagtcataaattcaggaagtttttaaattgtaaaacattaaggaattcaacaaagaggtgacaggaaacacctaaatcaaggaaagagagagaagtgaggcagcctgcttatccgagattagctaagagcctggagagaattcccagtcaggggaaagggtaaatgagagatgcccaggggtccacattcccaccatggatacttgcaatcctagccacagtagaggccctggaccctcacaggccctgaaactaacaaagggaactgcatgaagagtgcacaacagcattgctccagagagggagctcacgctggggcacaccaacctctccactccccatcccagtcctgcagctatagtaagacaccattttgagaactcagtcccaacagactgcaccttgtgcttgggcttaacagcacctgtctcttcacatccctggagtcccactgacatacccagcccacagctaccaccatgcctggttcctgatgctggggccaaagtgcacgcctctggctccaatctcagccactgcttccagcagtggagccaccactcattttcatgtgcccagagtccctcacccacagctgccatcactgtgctaccaggactaaggaataagcaaagcatgagcttccactgcccaggctaaagcacaagccaagcatgagctgccaccaccaggactaaaatgtgagtgaaacacaggctgcaccaccaggactgaaacacaagccaagtatggtctgccaccaccagggctaaaatgcaagtgaaatgcatgttcctaatacttgcctgcatatagctggtatcactgaaagcaactctgccctccccagcagtagggctgcagcacagacactgcctctcacaacatgaacattgtgctgggggcctaaggatcaccccaccccttcctaacacagccagcacctatacgcaccactggggagtctaaagacaagcccacctggcctcacccaccccccatgccagagcacacaatccagaggcctggagatcacacaactcagccaccattggcaactaaggactcttcccaggaacctgagattgggctcacccacccagctactaacatcacagcaagaaaatatcatacctccaaaggaacataataattctccagcaacaaatcccaatcaaaaataaattcacaaaattctggaaaaagaatttaaaatattgattttaaagaagctcagtgagatacaagagaatactgaaaaataacataaagaaatcagaaaaacaattcctagaatatgaatgagaaatttatgaaaaagataggtatcattaaaaaaaaagaatcaaattctggaactgaagacttcactgagtgaaatacaaaatacatttgaaagcttcaacaacagactagatcaagcagaagaaagaatctcagaacctgaagataggtctttcaaataacccaatcagacaaaaggtaaagaataaaaaacagtgagcaaagcctttgtgacatatgggcaccacaaggcaactaaatattctcattttcagagtctcataaggcaaagagaaaataaaatgcatagaaaacctacttaatgaaataacagataaaaacttccgaagtctagcaagggatttaaacatccagatacaagaggctcagagattcccaaatacagtgcagaaaggtcttccacaaagcacgttatagtcaaactgtcaacaatcaaagacaaaaagagaattccaaaaacagcgaaattcatttcacctataacaacacatagactgaaagtaaagggatggaaaaagacattctatgcaaacagaaactaaaagggagcaggagtaggagtagctatacatatatctgttaaaacaggctttaagtcaaaaacagtaaaaagagacaaaggtcatgatataatagtaagaggatcaattcagcaagaggataacaattctaaacatatatgcacccaacacaagagcacccagatatacaaaggaaacattattacacccagaaagaaatccacaaatagccatctaattttgacaaaggcactaaggacatacatttgggaaagaatgtccccttcaataaatggtgctgggaaaactgaatatccatatgcagaaaaattaaattggatccctacctctcacatatacaaaaatcaactcaagatggatcaaagatacaaacgtaagacccaagactataaaattactagaagaaaacatagggaaaacacttcaggacattggtctcagcaaaaatagtatggctaacacttcaaaagcacagaaaacaagaacaaaaatagacaagtgggactatattaaactaaaaagcttcaacacagcaaaggaaacaatcaacagagtgaagaaaaaacccactgaatgggagaaaatatttgcaaaccattcacctgacaagggactaatacctagaatatacaagaaaatcaaaacttaacggtaaaaaaaaaaaagcctcattaaaaagtgggtaaaggccacaaacatttctcaaaagaatacatacaaacgaccaatgggtatatgaaaaaattctcaacatcattaattaccagggaaatgcaaatcaaaaccacagcaacatatcatcttatcccaattagaatggctactataaaaaaataacaacagatgctggcaaggatgtggagaaaaagggaactcttatatgctgctggtaggaatgtaaattagtacagctactatgaaaaacagcacgaagatttctcaaaaaactaaaaatagaactagtatacaatctagtaatcccacaatggggtatttattcaaaggaaaagatatcagcatgtcaaagggatacctggactcaggttattgcagcactattcacaatagcaaagatacagaatcgacataagtgtccattaatggattaactttttcttttttttttttttgagacggagtctcgctctgtagcccaggctggagtgcagtggcgcgatctcagctcactgcaagctctgcctcccaggttcacaccattctcctgcctcagcctcctgagtagctgggactacaggcacccaccaccacgcccagctaattttttttttttttgtatttttagtagagacagggtttcaccgttttagccaggacagtctcaacctcctggcctcgtgatccgcccacctcggcctcccaaagtactgggattacaggcatcagccaccacccctggcctgaactgttttttttaaatgtggtatatatacatggtgaaatactattcagctatgagaaagaatgaaatcatgtcatttgtagcaatatggataaagatggagatcattacaataagtgaaataagccaggcacaaaaagacaaatatcacatgtactcatgtgggagcttaaaaaaagttgatctcatggaggtagagaataaaatgatatcaaaggccaggaagtatgtgtgtgggggaaggtgggataaagggaggttgcttaatgaatacagatatccagttagatagacaatacaagttctaatgtcgcagagcagagtacagttaataattaatttgaatcatatatatttcaaagtagctacaagagaggactttaaatgttcccaacataaatgataaatactcaaggtgatgaataccccaagtaccctgacttgatcattacacattctatgcatgtaacaaatacacatgtacctcataaatatgtaaactatgtgccaatttaaaaagagaggaacttcaaaaaaattataaaatattataacatatttaccagtagtatgaatggacaagggagagaaccctaattctgctagtgaagctgccagggaaaacttcacaaagcagcagctaaaattaacaaagggatgcaaggaagaaacatcaagtgcaaaataatggagattaaggagaagaacattagtggtggagggcagaggagaggagaacaccctggggaggtaaggtagggcctagaaggccacatgcagaagactggaatttattccatggtcttggagagccagtgaaagattttaaacttttagatggatagaagacattacggggtagactcacatttacatttcagaaaaataagtcgtttatttgcagaggatagatttgaggaggaagaatagaagaaagagaaaaagaaaaggagatcaaaggtccaggaaagtaataatgagggccttaactaagacagtagcagcaggtagtcaataatcttgaaaattaatttgaagccaggcgcagtggctcatacctataatcctagcactttaggaggtcaaggcaggcagatgccttgagctcaggagttcaagaacagcctgggcaacatggtgaaagcctgtttctaagaaaaatacaaaaattagcccggtgtggtagcatgtgcctatggtcccagctactcaggtggctgaggtgggaagatcgcttgagcccaggagggtcgaggctgcagtgagccaagatcgcaccactgcactccagcctgggtgacgaggtgagaccctgtctcaaaaaaaaaaaagaaaagaaaagaaaattaatttgggggcagcaagagcaggagttaataattagatacctatacccatcccccagcaaaaagtattttaatgtcactagttaaaaggcctatcaggaaaccaagataggaaagcaaagaataaacactaaaatggaatccagttaaagtgaaagaaaggttgtttcaaagattacaattacttcaagcactaatcctacataagaatgaggaatcctgtacactgacctttggcaaatgaatcttagtaaactgcaaataccatcactgtaaaacactcagaataactaccttttttccatagggatttcataagcagaggggcaaactctaaagctggctctgtcgggaacaaagacataaaataaggattttgttccttaaatgtccacctgctgctactcctcctcattctttccttcaaacaaatcatctctatagcaacacactcttaaagaatttgtgggtggaaagcatatgtttgtgcaaaaatatgagaactcaagaacatgagctattttattttttcctttaatacaagagatacacaatctattaggatacaactaaaaaataagagatatgaaacaaaaaaatgtttatacacaaaaaaatgtaaaaattgtacaaatgataacgcaaatgtttacatggaaattctttttataggttacaatgacaccttgtggtaagacttttcaagttatacaaattatcttagaaaatattttttacagcagagacgtaagaaaaccggtttagaaaataggaaagctcaaaaccatagtaatgagttaatgtgtacaagtataataatacatttgaaaagttaaggttgaaaaatcaaacttttaaaaatgtcacaatattaggtaggcaaaagcactttactaactgtaaatacaagttgaatatcccttatgtaaaatgcctgggaccagaaggatttcagattttgaattttttcagattttagaatatttgcatgtacataatgagtatcttggggatgggacgcaagtctaaacataaaattcatttatgttccatatataccttatacatacacatagcctgaaggtaattttatttttcccttgaaggtgcttaataaactgcgtgttgtatgcctgcattttgactgcaacccatcacatgaggtcaggtttgaaattttccacacggtgtcatgttggtgttcaaaaagtttcagatttcagagcattctggattatgggattagggatcctcaacctgtataaagcattatactagtcccttcacttgaactgaaattattaaatactcttccttattctctggtcccttattcccatcttgtaagaaaagtcaagctgcacctctcaaagcttcatctattactttatctgaatgacactgaaatttgcaccctagttcctaacctctctctgcttatgaatccccctctacttacatgttctctctataacagaagctcaaagatgggatttaagacagactacccaaaatatggcaccttggcatttgagaaaaaagcagaagcaagaaggtttatctcaccttcctctaaagtaggtcataagatcctcaatccagaggtgtcctccctatacctgtaggagagaagacacaaagaggaatctgaacaaacaggacttactaagtttcccccagtttgttactgctagagcatacccatttgtcctctaacgatacttctgcatgactgtccacaaaaaaacagagagacagaccctttgaaaaaagcagtttactgctgcaaatgccacaagacagccaaaaaactccaaagacaaaagacatgaactctcgggagctctatgggcctgtccatcatctgagaaaccccagtacttatcctgccaatgcagggcaagattatatcccccttctactaccgcagctgctcctctcttgaaattgccacttcctgactggaggccaaccaactcaagccatttcagcaactcctaacagaacaactctgttccaacggagaaaacagcagctaattcaactgcctgcaactccctggctaatcagaggtcctgagtctgtccacatgacaacttcaaccgctagcctaaccagcattcactctcctgccacctccactacagcaggtgctggtatccacagctgggagacctgaagacagattatatcacaagacaacttgcagacattcgccagcaccagcctggagcccagtaaccctgctgggtggctagacccagaacggtaataacaatcacctcagtctggctcctaggaagccccatccctaggggaagggggtgactccacatcaaggaatcaccctgtgggacaaaaaaaaaaaatctgaacagcagtccttcagttctagatctttccactgaaacatacaaataaaaaggaaccaggaaagtaattctggtaatatggcaaaacgaagtttgataacacccccaaaagatcacactagctctccagcaatggatccaaaacaagaacaaatctctgaattgccagataaagaatttggaaggttgattattaagctactcaagggggcactagagaaaagtgaaaaacaacttgaacaaataaaaaaaaaaataaaaaacaggatatggatgaaaaagtctccagagaaatatacatcataaaaaaaagacaaccacaacttctggaaattaaatacacacttagagaaatgcaaaatgcactgaaaagttccaacaacagaactgaacaagtagaagaattttagagcccaaagacagggctctcgaattaacccaatctgacaaagacaaagaaaaaataattttggctgggagcagtggctcagcttataatcccagcacctcaggaggctgaggcaggtggaccacaaggtcaggagatcaagaccatcctggctaacatggtgaaatcccatctccactaaaaatacaaaaattagccaggcacagtggcgtgcacctgtagtcccagctactcgggaggctgaggcaggagaatcacttgaacccggaggaggttgcagtgagccaagatcacgccattgcactccagcctgggcaacagggggagactccatctcaaaaaaaaaaaaaagaaagaaggaaagaaaaagaaaagaaaagagaagaaaaaattattttagaaaatgaataaagcctccaagaaacttgggacgttaaaagacccaacataagaataattgctgtccctaaggaagaagagaaatccaaaagtttaggaaactatttgagggaataattgaggaaaacttccccggttttgatagatatctagacatccaaatacaagcagcttggccaggcgtggtggctcatgcctgtaatccagcacttcgggaggccaaggcaggaggatcactcaaggtcaggagtttgagaccagcctggccaaaatggtgaaaccccaactaaactaaaaaaaaaaaaaaattacctaggcatggtggtgtgggcctgtagtcccagctactaggaggctgaggcaggacaatcacctgaacctggcaggtggaggctgcaatgagccaagatcgtgccactgcactccagcctgggcaacagggcaagacttggtctaaaacacatacacacacacaaacaaatacaagaagctcaaagaacacccaggaaattcatcacaaaaagatcacctaggcacacagtcatcaggttatctaaagtcaagacaaagaaaagaatcttaacagctgtgaggcaaaagcattaggtaacctacaaaggaaaacctaacagattaacagcagatttctcagcagaaaccctacaagctagaaggaattgggtcctatcttcagtctctttaaacaaaaaattatcagccaataattccatatctagcaaaactaaattttataatgaaagagcaatagagtctttttcatacaaacgaatgctcagagaattcaccactgccaagccagcactacaagaactgctaaaaggagttctgactcttgaaacaatctcaaaacatcaaaatagaacctttcttaaagcataaatctcacaagacctacagaacaataacacaatgcaaacaaaaaaaggtaattaggcagcaactagtatgatgaataaaatagtatctcacatctcaatactgatgttgaatgtaaattgcctaaatgttccactgaaaagatacagaggccagcacagtggctcacacctgtaatcccagcactttgggaggccaaggtgggcagatcacctgaggtcaggagttcaagaccagcctggccaacacggcaaaagcccatctctactaaaaatacaaaaaaattacccaggcatggtggcaggtgcctgtaaacccagctactcgggaggcagaggcacgagaatcgcttgaacccagggagcagaggttgcagtgagccgagatcatgtcattgcactctagcctgggtgactgagtgagactgtcccaattaaaaaaaagaaaaaaaaaaaagatgcagaacagcagaatggataaaaatctaccaagtatctgctgccttcaagagactcacctaatacataaggactcatataaacttataaggtaaaggggtggaaaaagatattccacgcaaatggaaaccaaacgtgagcaggaacagctattcttatatcagacaaaacaaactttaaagcaacatcagtttaaaaaggcaaagatagacattatataatgataaaaggattagtccaacaggaaaatatcacaatcccaaaaacatatgcacctaacactggagctccgaaatttataaaacaattactactagacctaagaaatgagatacatggcaacaaaacagtgagagacttcaatactccactaacagcactagacaagtcattaagacagaaagtcaacaaggaaacaacagactataccctaaaacaaatggacttaacagatatttacagaacattctacccaacaattgcagaatatattcttttcatcaacacatggaacattctccaagatagaccacaaaacaagtctcaataaatttaagaaaatcaaaattatatcaaatattctctaagatcacagcagaataaaactagaaattaactccaaaggaagcttcaaaactatacaaatatatggaaatttaaacctgctcctgaatgacctctgggtcaacaatgaaatcaagatggaaattttaaaattctttgaactgaacgataacagtgacacaacctatcaaccctctgcaatacagcaaaaacagtggtgctaagaggaaagttcatagcaatcactgtctacaacaaaaattctgaaaaagcacaaatagattatctaacctcacaactcacagaattagagaaacaagaacagaccaaaccaaaacccagcagaagaaaagaaataacaaagatcagaactaaatgaaattgaaacacaacaacaagaacaacaacaaaatacaaaagataaattagacaaaaagctggctctttgaaaagacaaaatcgacagaccattagcgagattatcaagagaagagagtagatccaaacagctcaattagaaacaaaataggagatatcaaaagtgataccacagaaatacaaaagattgtgcttttgtatggctactatgaacatctttatgcacacaaactagaaaacctagaggagatggataaattcctgaaaagatacaaccctcctagattaaactaggaagaaatagaaacaaactgaacaggtcaataacaagtagcaagattgaaacagtaataaacaaaaaaaatgccaacaaaaaaaaaaaaagtccaggacctgatggattcacagctgaattctatcagacattcaaagaagaattggtatgaatcctactgaagctattccaaaacacagaaaaagagggaatcctccctaaatcattctatgaagccagtattatcctaatagcaaaaccaggaaaggacataacaaaaaaagaaaaccacacaccaatatccctgatgaacatagatgcaaaaatcctcaacaaaatactagctaaccaagtccaacagcatgtcaaaaagaaaatacaccatgaacaagtgggttttataccagggatgcagggttggcttaacaaatggaagtcaataaatgtaatacaccatataaacagaattaaaaacaaaaaccacatcatctcaacagacgcagaaaaagcatgacaaaattcagatccctttatgattaaaaccgtctgcaacatcggcatagaagggacataccttaagataataaaagccctctatgacaaacccacagccaacattacactgaacagagaaaagtttaaagcattccccctgagaactagaacaagacaaggatgtccactttcaccacttctattcaacacactactggaagtcctagccagaacaatcagacaagagaaagaaatcaagagcatccaaagtggtaaagatgaagtcaaagtgttgcagtttgctgatgatatgatcatatacctagaaaaccctaaaaactcatccaaaaagctcctataactggtaaatgaattcggcaaagttttaggatacaaaattgatgtacacagatgagtagctctgctgtataccaacagccaccaagctgagaaccaaatcaagaactcaaccccttttacaatagctgcaaaaaataaaataaaatacttaggaatatacctaaccaaggaggcgaaaagacctctacaaggaaaactacaaaaaaaaaaagctgaaagaaatcacagatgacacaaatggaaatatatcccatgcgcatggatgggtagaatcaatattgtgaaaatgaccatactgccaagagcaatctacaaattcaatgcaattcccatcaaaataccaccatcgttcttcacagatctagaaaaaaaatcctaaaattcatatgaaaccaaaaaagggcctgcaaagcaatactaagcacaaagaacagatctggaggtatcacattacccaacttcaaactataccaaggctatagttaccaaaacagcatggtactggcataaaaacaggcacatagatcaatggaacagaacagagaacccagaaacaaagccaagtacttacagccaactgatatttgacaaagcaaacaaaaacataaagtagagaaacgacaacctattcaacaaatggtgctgggacaattgacaagccacatgtaaaagaatgaaagtggaatctcaactctcaccttacacaaaaatcaactcaagatggattaaagacttaaatctaagacctgaaaccataaaaattctagaaaataatatcagaaaaactcttctagacattggcttaggcaaagagttcacgaccaagaaccaaatgcaacaaaaatgaaataaatggatgggacttaatgaaactaaaaagcttctgcacagcaaaagaaataatcagcagagtgaacaggcaacccacagagtgggagaaaatattcacaaactatgcatcccacaaaggactaatatccagaatctacgaggaactcaaacaaatctgcaagaaaaaaaccaaatattcccatcaaaaattagggaaaggacatgaatagacaattctcaaaagatatacaaatggccaacagacatatgaaaaaatgttcaacatcactatcagggaaatgcaaatcaaaaccacaatgcactaccaccttactcctgcaagaatggccataatttaaaaatcaaaaaataatagatggtgacaaggatgtagtgaaaagggaacacttttacactgctggtgggaaggtaaactagtacaaccactatagaaaacagtgtggagattccttaacgaatgaaaagtaggctgggcgttgtggctcacgcctgtaatcccagcactttgggaggccgaggcgggtggatcacaaggccaggagatcaagaccatcttgactaacatggtaaaaccccgtctctactaaaaatacaaaaaattagctgggtgtggtggtgggcacctgtagccccagctactcgggaggctgaggcaggagaatggtgtgaacccaggaggcagagcttgcagtgagccgagatcgcaccactgcactccagcctgggcgacagagcgagactccgtctcaaaaaaaaaaaaaaaaaaaaaaactaaaagtagaactaccatttgatccagcaatctcactattgggtatctacccagaggaaaagaagtcattatatgaaaaagacacttgaacatgcatgtttatagcagcacatttgcaactgcaaaaatatggaaccagactaaatgcccatcaaccaatgagtagataaagaaaatgtggtaggtatatatatatataatgcaatactactcagccataaaaaggaatgaaataatggcattcacagcaactgagatggcattggaggccattattcacagcaaccgagatggaattggaggccattattctaactgaagtaactcaggaatggaaaaccaaacaccgtatcttctcacaagtggaagctaagctatgagaatgcaaaggcataagactgatataatggactctggggacctggggggaaggagggaggggggtgagggttaaaagactacacaccgggtgcagtgtacactgctcaagtgatgggtgcaggaaaatctcagaaatcaccactaaataagttatccatgtaaccaaacaccacctgttcccccaaaactattgaaataatgattttttttttagaaaaaacacggaaagaaaggtttccctgtttctttcagtcttcacttctgaagactcatataaagtaaaggtttcattaaataaatgtgtatgctttcctcttgataatctgtcttttgttataggggtctcagtcatgaatctagtaataggtgaggaaaagttatcacattttatccgctacatcaacttaacaaaaattcagttcattaggttcaaattttctacttgtctccttaaaaaagtcagttaccactatcctcctctcatttcctaaccactacccatcctctatcctctatttataacaaattaatcctactgattcttcttcatctgtttgttgaatttaatcattcttccccatttctagagccatcacactccagtgccgaatcttaaatattttacacttaacagaagcctcctagacagtgtcccagactttagtattttctcattcttacatagcctacaaatatcaccaaaacaatctttctcatacattgccttcgtcactataactcctatgataatccttattctttcctgactcaaatctaaatttcccagctaaactcacagccccgtattagccagctccctatacaaattcaaacattttgctgccccacaggacccctttgctagagtcaattaagtttacagacccccaggacccctttgctagagtcaattaagtttacagaccctcaaacacatttctctttgccttcacaactttgttcatacagttatgccaaattaaaataccttcttaaaccttgtctattaatccacaaatcacagagtcaaacctgaaaccctacagtctgcaaaatcacaaaactattttcggagttttagttgctctaaaagtgaacagaaagagtagcttttgtccatgtgctttataggttcctgccttccttgtgcttgccccaggatatttattctatataaacatatatttttttgagacagaacctcaccctgtcacccaggctagagtacaatggcgcaatctcagctcactgcaacctccgtcccgcgggttcaagtgattctcctgcctcagcctcccgagtggctgggattacaggcatgcaccacgcccggctattttttgtatttttagagatagggtttcaccatgttggcaaggctggtctcgaactcctgacttcaagtgatccacccaccttggcctcgcaaagtgctgggattacaggcatgagccactgtgcccggcctaatttattctatattctataatgtctgcacttttcccctccagatgctttataactatataaactacgttttccaaagaaactataaattcctcaaaggaaaaactacatataatcttctactgttttgttcatcttcatagttcccaattccagtaaactgttaatgacagtaaagtgatccacaaaatttctatgatgtgaatcctactctcccataggcttgtaatgtaatttcagagaaaccttggggaaggatgtcaccaagaacactgtttgctaaccaattatgcatgcgttatagttagttatcaagaaatttctacctcaggccgggcgtggtggctcacgcccgtaattccagtactttgggagaccgaggtgggcagatcacctgaggtcagaaattcaagatcagcctggccaacgtggtgaaaccctttctcaactaaagatacaaaaattagccaggcatggtggcaagcacctgtaatcccagtactcaggaggctgagagaggataatcacttgaacgtgggatgcagaggttccagtgagccgagatcaggccattgtactccagcctgggcaacaagaacaaaactccaactccgaaaagaaaagaaaagaaatttctacctcaaaagttaaaaattctggaggacagtctactaagcaaaagctttcaaaatgaatatatcttttcatttagtaattctaattttaggaattaatcctgagaaactaattagagatgcacaaacatttatgttcaagaatcttcttttatttgtcattcagtaaatgtttactgagtgcatcctaaattccaggtaggaatggaggatagaatcagttcttatcctcatggtactaacttaatagtggtgtttacaatggaaaaagagactattaaaaaagcaggtcatggccaggtgtggtggctcatgcccgtaatctcagcattttgggaggtcgaggtgggaggctcacttcaccccaggagttcaagatcagcctgggcaacatagtgagactctatatctattttataattgtttttaaaaagcaggttacaatagcaagaaatgccatatttgtggatcagaaaattcaatattgttaagatgttaatttctcccaaattcaatgcagtgtcattcaaaataccaagttttcatagaaattaacaagctgattctaaaattcatatggaaacacaagggacccagaagagccaaaaaaaaaactttgaaaaagaacaaagttagaagacttgcattacctgacttcacttattaaagtgccatagaaatgaaaactatgtagtattaaatcagtcacaaaaatccattaaacaaaaaagactgtccagaaatagagtcaaatagaaacagtcaattgatttctgacaaaaatgcagtcaattcagtgaagaaaggatagtcttttcaacaaatggtcctggaacaattgccttttccatacacacacacacacacacacaaagaacttcaagttgctccccacgccatatacaaaaataggatcaaaataaatcagaggcctgaattaaaaacctaaactataaacctcctaaaaaaaaatacaggagaaaatcattttgatcttgggttaagacttctcagatataacaccaaaagcacagtccataaaagaaaaaactgacaaactggatttcatcaaaatgaagaacttcaaaatccactactcttcaaaatccactgttacataaatgacaagatataccagactcaggggaaaaactgcaaatcataaatcttataaagcacttgcatccagaataaagaactctcaaaactaaatgataggaaaataaacaatcaaaatttttttaatgggcaaaacattcaaatggacacttcaccaaaaaagattaagtaaacatttgtttgtattttccaagtactccagtttcctcttctcatatcctaaagatgtgcacattagattcactgggagattgaaattgtcccagtaggaatgagtatgggtgtgtatttaagtgcaccacgcaatggaatgtcatcctgtccagggttggttctgtgccaggataggctctagccaccagaaagcctgaaccctagagcaggctggaaaatgaatgaatgaatgaatacaaattattgtaaaatgaaatttcaaataaagtatataatcatgtaaatgcatgacaatactatgtagtacaaaagcactcttatcaagcctgccatatttgtgattatttttgaactgcatgatagtaagaggtgtcccttatattttttgctttgcaaacatttatttcttgggttaacccaccaccactatgaccattgtcactcactggttcaccaaaaattaggtaagtaactatcttacttgttttttttactaatctttcttaaacattatagctcacatttatttcaacgtttaatgttggaagtgtcttgggtctttatttagaagtttgatgatgttttttgaccagagatatgccataggaatttaactattgtttttatcaattagtctagggtaaagttggtttcatgatacatcatttcacttaaagtcagtttccaagaacctatcaataatgttaagtgacggccgggcgtggtggctcatgcctgtaatcccagcactttgggagggcaaggcaggcagatcatgaggtcaggagatcgagaccatcctggccaacagggtgaaaccccatctctactaaaattacaaaaattagccgggtgtggtggtgcgcacctatagtcccagctacttggaaggctgaggcaagagaatcgcttgaacctgagaggtggaagctgcactaagctgagatcatgccactgcactccaccctggcaagagagcaagaccccacctcaaagaaaaagaaaaataaaaaataatgttaagtgacgacatactgtacacgaaatatgcagtgggagttctagaaggtcagtaaagagagaaagaggcagaaaagaagttttgaagaaataatcgccaaaaacttccctaatttaatgaaaaacattaattgacacatctaaacagcccaacaaatccaaagaaacctgcaaatgctgaaacacaaagaggaaatctttaaaaaggagcgagagaaaaatgacttcacatacagggcaacaacaatattattaacgttgatttctcatcagaaatgacatggaaaaaacaaatttttttaaagaaacacaaaaaactcaccactaaaaattctatattcagcaaaactgcccttcaaaaatgaagatgaaataaagacattttcagatagataaccaaagacgaagacaagtcgctgctgtgagacatgccttatgagaaataacaatggaagtccctcaggataaaaggaagtcacaccataaagtttaatctaggctgggcacagtggctcatgcctgtaatcccagcactttgagaggccaaggtgggtggctcacttgagcccagaagttcgagaccagcctgggcaacatggcaaaaccccatctctacaaaaaatagccaggtgtggtggcacgtgcctgtagttccagctacttgagaggctgaggcaggaggattgcttgaactgggtaagcggtggctgcagtgagccaagatcgcactattgcactccagcctggaaaacaggagaacctgtctggaaaaaaaagaaaaataatactctacaggagaatgaagctcattggaaactgtaattacatcagtaaatattaaagactctaaaaatataattattttcacttcatctcgtttaaagacataagactacataaaggaataattatagtactgtgtcgctgagtttgtaatacatacagctgtaatatatataataataatagcaccaaaaagagaaaaaacagataacactggaggaaagtttctataatttatcagaatttagtattattctgaaggagactgtaattaagttaaaaggcatattgtaatccctaacaatatagcaaaagaaatcaacagaaataaaaagatacactaaagaatatttaacacagaaagatggtaaagaaaagaggaaaaagcaaaaaacaaatgagacaaatagaaaacaaatatgaaaaatgcagatgtaaatccaataatatcaacaattacattacatgtgaatgaactaaacactctattcaaaggggggattatattacaatggattacaaaacctaactataggctgtcaacaagagataaatcttcaattcaaagacataaacaggttaaaattaaaaggatttttttaaaaaaatacaccatagaaacagtaaccacaaaaaaaactagagtggctatagtaccaagaaaaatagattttaagataagaaatattacagacaaaggaggccatttcataatgaaaacagggtcactatatcaggaagatataacaataactgtccatctaaccaaagaaccccaaaatacatgaagcaaaaaaagagataattaaaaagagaaataggtaattcaacagaaacagctgaagactgcaatgactgatagaaaaagacagaaaatctgcaaggatatagaagtcttgactaacctcatcaataaacttgacataactgacagaaaataccacccaatgattgcagaatatacaacctttttacaaacacaaggaaaattttccaggatacaccacatactggggcacaagacaagtctcaataaaatttaaaagattgaactcataaaaaatgtgtgatctgatcacaatggaattagtcatccgaacaaaaataaatctaggaacacctcaattattggtaaattttaaaacatacctctaaataacccattgatcaaagaagaaattgcaaggaaaaattttaaaatatatttcgaattgaatgaaaacaaaacacagcaaaccaaaatgtacagaatgcaactaaagcagtgcttagaaggaaatgtatagttttaaacatttatatgagaaaagaaaaaaggtctcaaaccaataatctaagcttccatcttaggaaactagaaaaataaggagcagaggggatattaaacccaaaacaagcagaaaaataataattttgtagtgtggaaatcagtgaaatagaaaatatagatatgaaaaataatcagtgaaataaaaggttggttctttggaaagatcaacaaaatcgaaaaaaaaaaaaaaacttcactatactgaccaagaaaataagagatacaaattaccaaaatcaagaatgaaagagggaaaattattgccaaccttaaattattaaaggatttcttaatacaaacttcgtatcaacaaattagataatttatatgaaatggactacacttcctagaacatacaaattaccaaaactctagaagaaagagaaaatctgaatagacctataacaagaagtgaagaaactgaaccaataattttaaatattcccacaaagaaatggccaggcccccacaactgcactaatgaatgctatcaaacatttaaagcagtaagagcaagatcacgagcaaccaacagactaatatccctcaggaacatatacccaaaattccttaataataatcagacaaaccatattcaacaacatataacagagattatacagcacggactgggcatggtggcttaagcctgtagtcccagcactttgggaggccacgcaggtaaatcgcttgagccaaggagttcaagaacagcccaggcaacatggcaaaaccctgtctctacaaaaaataccgaaaaaaaaaaaaaaagaaaaatagccaggtgtggtggcatgagcctgtagccccagccacttgggaggcggaagccggagaatcgcatgagcccaggagtttgaggctgcagtgagccaaaatcacaccactgcacttcagcctgggtcacagagcaagagtctgtctcaaacaataaaaaaaaaaaaaaaaaaaaaaaaaaaaagattttacagcatgaccaagtgtgatctgtcccaggaatacagggtgggtttaatctccaacaatcaattaatatatagcatactaacaataaaaatcatataaccatatcatcagatgcaggaaaaaacatgacaaaatctaacacccactcatgattaaaaacttgcaacaaactaggaacataagggagcttccttaaccttcttcaaagggcatctatagaaaatctacagctaacattatacctgatggcaaaaatctgcatgttttccccctaagactgggagtaatgcaatgcacattcaacacttctcttcaacatcttactggagggtctaacccaagaattaaagcaaaaatgaagaaataaataacattgagattggaaagaaaaagtatcgttttgagacatgatcatctatgtacaaacaatatgcaaaaattggttgcatttttttttagacagattctcgctctgtcttctaggctggagtgcagtggcacaatctcagctcactgcaagctccgcctcccgggttcacgccattctcctgcctcagcctcccgagtagctgggactacaggtgcccgccaccactcccagctaacttttttgtatttttagtagagacggggtttcaccgtgttagccaagatggtctcgatctcctgacctcgtgatccacctgccttggatcccaaagtgctgggattacaggcgtgagccaccaagcctggacgattgcatttttttgtgctaacaatgaacaatttgaaatcaaatcatgaaaactccatttccaagagcatcaaaattataacagtcttaggaataaatttaaccaaataagtgcacgatttgtacactgaaaagtaaaaaacattattaagagaaatgaaagatctaagtaaatggagagatattacatgttcatggattggaagactcaagatggttaagttagtgattcttcccatattgatggatagattcaatgcaaatcctacaaacatcagatgtgtttttgtagaaattaacaagctgatcctaaattgtatatggaaatggaaagagcatagaaccaattttgaaaaagaagaaaatgttacactacttattttgaaacttactataaaactgcagtaatcaagacagaatagtgttggagtaaggataggtttatagacatgagtcttggaataaattcttacattatagtcaactgatattttacaaagatgccaatacaattgaagggaaaagaacagtctttttaacaaatggtactggataatttggcattcacatttttaaaaaatgaacttagatcctcttcttacatcaaatgcacggttaattcaatatgaatcttatatttaaaggaaagagctcaaagaagacctttgggagctcaaagaaaaatctttgggaccttggattaggcaaaaagttcgtatacataacatgaaagtacgtgccacacacacaaaagaaatgacttcattaaaaacttttgcacttcaaaagacaacagtaaaaatatgaaaagccaagacaccaactgggagaaatatttgcaaatcttatctctgatattaaaaacaatacaaactttcatccagcatatataaagaactcttacaactcagtaagaccaaaaaaaaaaaaaaaaaaacccagctaaaaaatgggcaaatgccttaaacagatattccaccaaatggccaataaccacagaaaaaggtgtccaacattactgtgcagggaaatgcaaattaaaattacaatgggatactactagatactaactagaatggctataattaaaaagataataccaactgttggtgaggatgtggagaaactggaatcatcatacattgctggtaggatgtaattggtacagctactttggaaaacattttgacagtttctttaaaagttaaaaataagcttaccatataattcaacaattccactcctaggaatttacccaaaacaaatgaatacatatgctcacacaaggaattacagacaaatcttcatagcagcattattcataacagccaaaaactggaaaccatccaatgtctatcacctagtgaatgggaaatactattcactggttaccagtaaatgggaaatactattcaccaatactattcaactggtgaatggaaaatacacacgaatactatgcaacaattaaaaagaacaaaacattgatatacatacattaaataaacctcaaaagcatgaagttaaagaagccagatgcaaaagactactgtattgattccatttatatgaaatatgtagaaaagacaaatttatagtgatagaaagtagatcagtggttctctggggctgtgggaaggagttaccttaaatgcaaataagcttgagagaatctaggagactgataaaatgtcagaaattgccttgtgatgacagtcgcacaactctataaagttgctaaaaaccattaaattgtacacttacaatgagtggtttttatggtaggtaaaatatatctcaataaagctgtttaaaaagggctaggtagaagaaagaagttatctcttccaaactttggaaaatttgttgatagttgtagtaatcaaggctgagttcaaaggatgaccaagcaaaaagaatccaggttcttaaagattatcactaagccacttaattgacaatcttagaaccacctatctccagacttcttacatgtgagataatacaatttccttcttaaggctttaaaaaagaaaaagaaaaaagaataacgttgctaattctaagggacacaggacatgttcattccattacagaaaatttgtaatatcatccatagaggaagatatcaaagaaaaggcaggaattttggtggatcttgaaggatgaaagaatatgacgggggatggggaaggaaaagaagggtatgtagttcagaagagtcattaataatggcaaggataaaaatcaacaatgcccactaaaagtcaagtttacagcttaccttattttaatccatacattaaggaccaaaaaattaagtaactggttcaaaaagttacgcagctagtaatctaaccttcactctcaggatccaggctccaaagtacatactctttcctctgttacgctgctaaacaaggacttaaactacccccatttgcaagttcagatctttgtagagggcatctttatttagataggtttacatttataggactacacactcaatgtttcttgagcaacaatttccatttaatcaataaactaaatgtgatgtgcattctttctttggtttccaaaacgttaccctactctggttttcctaccttctttctcccccttcctattacatgctggtgttcacaagctctcttctgattctacacaactctcactaggaacctcatctatacctggtatttcaactaccactaacgttgatgactcttctctctctccaacttcaagaattgttttcctagttttctttgactaacttcctccgggccaagttgaatactgctctgtacaccctacaactacacttacaagattctaaagagacattcctcaatttttgtgtattctttctagttctaggccaggtattcttcctacatgccccaaaacacattcttatctatccttatagcatttaacatgctttattacaaattactaattactttgtccatttctcccatcagagaataaggtgcttgagacttagcactatgtcttattcacaatctccccagtgcctagcatagcatgagacacataataggcactcaaatattgattaaacccatatataagagaaataaaatttgctttaaattggaagcataccatttctgaaggaaactttcagagatttatgttttcaaatgagaaaataggccatgaaaggtgaagtgactcacccagtcaagccttggtctcctgaatcacaattctcttcccacaaaattacagtgcctaggccgggcgcagtggctcacacctgtaatcccagcactttgggaggccaaggcaggtgggtcataaggtcaggagatcaagaccatcctggctaacatagtgaaattccgtctctcttaaaaatcaaaaaattagctgggcatggttgcatgtgcctgtagtcccagctacttgggaggctaaggcaggagaatcgcttgaacccaggaggcagaggttgcagtgagctgagatcacaccactgcactctagcctgctgacagagtaagactatgtctcaaaaaaaaaaaaaaaaattagagtacctattaaattgtgcttagtgatctcagctttctatgaagctctagaagtaatacaaaaatgttataaagaaccatttcaacttcatccactccagctctggctggctatatcagttgtagagaagtctgttattacataatactttttctgcccagaataatctttaattgaaccagtattttcacgtgtccttcacacaaaaaataattcaatacatacttattgagacatgaagccagctgggattctgggtccggtgtggacttggagaacttttctgtctagctaaaggattgcaaatgcaccaatcagcgctctgtgtctaactaaaggtttgtaaacgcaccaatcagcactctgtaaaaacggaccaatcagcactctgtaaaatggaccaatcagctctctgtaaaatggaccaattagcaggatgtgggtggggccaaataagggaagaagagctaggcacctgagccagcagcagcaacccacacgggtccccttccatgccgtggaagctctgttcttttgctcttcgcaataaatcttgctgctgctcactctttgggtccacactgcctttatgagctgtaacactcaccacgaaggtccgcagcttcactcctgaagccagcgagaccacgaacccaccgggaggaatgaacaatgccggacgcgccacctttaagagctgtaacactcactgcgaaagtctgcagcttcactcctgaagccagcaataccacgaacccaccgggaggaatgaacaactccggacgcgccacctttaagagctgtagcactcactgcaaaagtctgcagcctcactcctgaagtcagcaagaccatgaacccaccagaaggaagaaactccggacacatctgaacatctgaaggaacaaactccggacacaccatctttaagaactgcaacattcaccacgagggtccgcagcttcattcttgaagtcagcgagaccaagaacccaccagaatgaaccaattccggacacattatcatgcatctctatgtggaaaacaatgtgaaagaagttataattcatcagtactctaaaaaatatccttaagagcatatattgcatgccccttaagtttaacaatatctgaaatagctgccttaaaacaaaatgcaatcacacttgagagaggctgaatatgaacatcagagataggcaatgcaacttcatcaggaaaatccctatagtccaatgctactgttttcaagggttgctatattatactgcaattgtgttactgggcaacaactcagaagctagaatggcaaattcactcaagaagtaactgaatcaaacgaatatttatgaaagcattctgagactcaacttcactttctatatcttcaactgaagtaactctttgttataagcattagatacaggatttttggtgagactgtaaaaactacatggacattttatagacatattttgagacagaagataggtgctttccaaaagggaatggccaggtttaggttcctactaactctgaattttaatccaaaagcaatctgaagtcacaatatacagaaggcaaataactgggcatttccttaatttcttccatcctggattatagctcagttaaaagaaatagtaggccgggcgcattggctcacacctacaatcccagcactttgggaggccaaggtgggtgaatcacttgaggccaggagttccgagaccagcctggccaatgtggtgaaaccctgtctctattcaaaatacaaaaaaaaagccaggtgtggtggcatgcacctgttagccccagccacttgggaggctgaggcaggagaatcacgtgaacccacgagttcaaggttgcagtgaacaaagattgcaccactacgctccagcctgggcgacagagcaaaactccatctcaaaaaaaaaaaaaagaaaaaagaaatagtactagacttgacagtcagtgatctctccatgacctagagagggcagtcctgatgaaaaaaatataattaataaactgatattctactaggaaccaggaaattgaccaaactccccaagcccactgaagaatagtgccagcattcctgagagtccttactgctggtattgccatgggaaattctcaaatactcactttctaggaacagaatctttatttctgattccgtgaattcccactcttcaatcttttttatagtttactgttgccatttccccttcacttactctcttctctcaacaaccttactttcatgatacttacaaaagtgggggaaagtagaaatgcctatctgtcattgtattagtccattttcatattgctataaagaactgcctgagattgggtaatttataaaggaaagaggtttaattgattcacagttccacatggctggagaggcgtcagaaaacttacaatcatggcagaaggtgaaggggaagcaaggcaccttcttcacaaggtagcaggaaggagaatgaatgcaggaggaactaccaaacacttataaaaccaccagatctcatgagaactcactgtcacgaggaacagtatgggggaaaccgccgccatgatccaattccctccacctggtctcttccctgacacatggggattatggggattataattcaaggtgagatttgggtggggacacaaagcctaatcatatcagtcatctttaagaaacatttattcagcaacttgtatttggaaaagactaaggatacagctcatcgagatctgaagtcctgcccttaataagcttacaatctagttaggaagtcaagaaagctaaaataatacaataaaaagtataagtatcaaataaatttaactcacaaatacatactattcctatgtatgtatgtatgaggtcatggtggagttgaaccttatagaaaaggtacaatttagattttaagaaagaagggaataagatcaggtcacgggggatagaaagatatgcagactaatatggaaaggataaagtacagagcaggtttaggggatagtgaagaaaccaatctgggcagagacaccttttccataaagaacatacacttgaaaaggcaaggtgagaggatttcaaataattcaccttaagtcaagaaacatgaacttgggttaaaaggaagttttttacacagatttacacacattccctaaaagcacataggttaaacaatgtgggcaatttacttatggaacctaatatgtatgacaaaattaaaagcaagctcatctacttttaggcaaagagacagtacctgggggtggggaaattctgacaattcactaaaattcactaatctttctgttaagatttcactctaagcttcttgaattagaacatcccatgacataatgctgatttctgattactaaggattatacgagtcattcttgatttgtctcctccatcttgcccaacttttgaatatttcattacttcaacatcagcatatagaaaaaaggaggagagaactaaaattaagtccatggattttagcaatacataagggtatctgacataaagaacattaaacttcaagttccaattcccattattaatagatttcaaagaagtcatttagtctcatcatgtctcaaattttctcacatacttgcttacttgaaaggttattgattgaaaagatcattcaaaaagtgctctaaaaactaacaacttgccataaaaattttatcattaagggttcaataagaggagacagtgaggtgactggtaaaccaaggattaaaaactacctgtgaataggccaggcacgctggctcacacctgtaatcccagcactttgggaggtcaaggtgggcagatcgcctgaagtcaggagttcgtgaccagcctgggcaatatggtgaaaccccatctctactaaaaatacaaaaattagcagggcatggtggcatgcacctgtaaccccagctactcgggaggctgagaggagagaatcacttgaaactgggaggcggaagttgcagtgagctgagatcccaccactgcactccagcctgagcgacaagaatgaaactctgtctcaaaaaaagaaaaaaaaaaaaactacctgtgaataatcagtgtttcattctcccagtgctgcatggaattctaaattgtatttcactattatttgagaatgttctaaatacagtccgcgcacttcatctgatctggaaagaaaacactcaaagtaaggggaatacccagcatactctgtcctaaataaccaaaggacaactcaaaaccatttgcaactctcaggagagtcctgtgtgacacttataatttaaagcattctggcctggtgcggtggctcacacctgtaatcccagcactttgggaggccgaggtgggcggatcacctgaggtcgggagtttgagaccagcctggccaacatggtgaaaccccatctctactaaaataaaaaaattagccgggcatggtggcacgcacctgtaatcccagctactcgggaggctgaggcaggagaatcgcttgaacccaggaggcggaggttgcagtgagccgagatcgcgctactgcactccagcctgggcgacagagtgagactcagtcataaataaataaataaagcattctaacaattctgaacaaactgagtttgaaatcaaacctcaatacaaaaggtgagtattaattctaaccacttacaggctaaattcataaatatggaaaattctaaatccaggtaactgtaggatagatacctttaattgtgttttagttaaatgtcagacttgtttacagacatgttgcttggtaacagaagcactgctttaacaacccactctgttttagagctgcttaaagtctgaacagattatgaagtatatatcatatacacgaaattcagacaagtctttccttatcctagagatctgtaagatttgaaagagcttcctcatttcagctaactaaaggctttacaaatacttagcagtggatattcttaagagcaaaatgcccattgattatggtcaaaagttggacactgaggattaaccaaagtatttaaacccagcatatgctaacatattttaggtgtttatctcagtaatgacagtcgacatcactgttcattcaaattgtcttcaaagccaaggaaaatggtagcatagctttttcatcgtaaattaagctggaggtacttaaacgtctggccaattaccaaactggctacacaaccaccaagccagagtgcatccaaaagctccatgaagagtttcacgtgcgtctctctgcctacttttctagcacgagcttccactactttaacaggaaaataaaaaaaggattcaagggcagtttgtggagggacaaaatgagtattccaaaatacaaacaagacaccgtccccagaaagagaggttacataccagacgcacgcacgctccttgcaacccgcacacggaaaacttaagtgaccgcagttctggccgcgctcgccaccggggacacctccacagctccaaccacaggcacccactcaactccgcttacggaggcattgggactaagggttacggtcctacagcggggtgtcggcccagcgagaggaagagggccgaacggacccctcgggctcccgtccctagggaaatgtgaagtatcccgggagaggtccgagggcggcggcggcggcggtgaaaagccccactcctccgcgtggaccgggatcctcaggggtgcggcgccaccccacgtgctgacgtatggcccagaagccgcctcatcgcaccgccccaccagcctggaggagcgggctctgtcccttggcccagcggcacgcgaagcaggaagtcccaccccccacgccgacgtcacccacgccaccgacgccggttgctgccggagccgttagagggaggagacaaacgaaccgaggcgggagcggccacgggtgacagcggcagcggcggggccgggctgcgctcccgaaggcgttcctggagggccctgggatggactcagagatccccagagccccaggggacggaaaatctagccccgggcacttgccttggagtctgagtgatgcgcgtcgttggagcgcgaagccggtctccctagcctccgcccgacacagcgtctccaggggttttcctccttttcgcgcctctccttccctcttccccacaccatttgagagcctcaaatggtagtcctgccgccacctctctcccttcgccagcctgccatcgtccccatgggtgcagatatgcgctcccgaagccgcctgcctgccgcgtctgcctcgggcatcagcccacgagtggggagtcggctcagcttgccacgagggaacctcgggttaggaccaatcgcccgggagagagccctcctcgcccccgcacctcctgctccaagtctcctgtcctggttatcccaagttcagggcccacctggggtcacatggggaactacttgtcttaaggctgtaaacaatagttggaagaggagttgctagcttttgagaacttccatgatcatccaaagtctgaaacaaagtaggcggtcagcctttcaaaatacgtgttggaagaaacagacaccttcccatccccagcgtttgttcagtgccttggttgggctttgattctcactgctttgtgaagtacagcttatttttacccccaagattatgattttcaggctgtagttattattggacaactgagaggtgattttgttgttgttgaaatgagggaaaacgggccattagaaaggaccgtgtctcttaagaggagggaaaaaaaggacagcgagttggtaatggaatgttgctggatggattacatagatgagacatgggagatagaatagagaatccagaaattctcatgtatgtgtgcgtgtttagtataataacagtagctcacatttgctgagcatttgtgtggcaagtactggagtactttttcaggttatcttatttaactctaacatttctgtaaggtaggtgcaattgttatctccatttcacagagttgcccaaaaccattacttttaaacgctggagccagacaactccagaaatctctgtggtagccagtaaactatacatgacaaattattggtcagtaggaaaaagatcattcgggaaatggcggtggctcacgcctgtaatcccagcacgctgggaggccaaggcaggtggatcacctgaggtcaggagttcgagacgaccctggccaacatggtgaaatcccatctattaaaaatacaaaaagccaagaaaaacaaatattcaattaacaaacggaaagttgtcccacttccaaacagttgttttttgtctatcattgttgataggggtgtgggatacaattactgtcaggcatttttggtgtgaaggtgaaattggtacaaccctatttaccaaaatttaacatatgcattagcctttgccccacagctgtctcatttccgaggcatataccctaaggaaaataagggattcataaggatactatttgccaccttttttaaaaataatgcttctagaaacaagtgtccatcactaggacactagttaagaaaattatgattggtacatgcaatggaatactcttgacccattaaaaactgatggaaagttctttatttgcattaaagtatgtccaaaaaatatagtttcccctcaggaaaaaaaaagcagaatgtagtttagcaagtacagtgctgtcctaatgtgaatatatgtgtgtacatatgttaatataagtgtacaaaaatatctggaagaaggtcagtcaaaatacaagtgttttacattttgtcttttggactttttatctggttggtgttttttgtaatttattattttacaaaaacaaagttgtgttttatgttttaattaaagctgtgccagtgaaaagggagccagttgactcttgaccttcacaagtaggtaaccatgatgaagtaactatgtctggggatctgagtctcagcttttttgtgtctataaatttgattatattcatttacctatagttggacaagctaacctaccacctggacatcatagttttgactccccaaattggactgggtatccattctatgtgttctctgtgtgcctgtcatggtatttgtcacactgtactgtaattccctctgtgccagtagattgtttgctcctgccatacatatacacatgcacatacatactttttctgctatatgttacacatttcttttgatttattatttgtcatctacatttgtatacagaagttttaattttcattagccaaaatgctaatgaaatcacatagatattaaagggatacttggaacaactttatgccaataaattcagtaacttaagcaaaatggacaaattcctaaaaaaataaataaataaattaccaaaaatgacacaaaagaaggaaaagaaaatctaaatgtttcagtgtctgttaaaaaaattgaatttataagcaaaacacttgccacaaagaaaactccgggcagatgactgcaccagtgaattttatcagacatttaagggggacaaagtaccaatcctacaccatttcaggaaacagagcagggagaaatacttctatactcattttatgaggcaagcataatcatgccaaattatttttcctgataccaaaatttgacattttgcaagaaaattatagactgatagtcctcatgaatatatatatatatataaattcttaagtattagcagattgaacttgcaatatagaggattacataccatgaccaaggagagtgaacttaacattgaaaaatcagtgtaattcatcacattaacagaacaaaagagaaaaaaaattgtttcaataaatgcagaaaaaggatttgacaaaattcaaagcccattaatgttttagaaaaaaaaaaaaaaaccaactctaagcagcctaggaatagaagggaatttcctcaatgatttgaaaaagttaatggtgaaatattaaatcattttctcctaagatcaggaataacaaatgtaagacaagaattttctgctctcaccgcttctatttaggaaattggaggccctaatcaatgcaaaaaagcaataagaaaaagcgtaaagactgggaagactcagatatcctgatttcagaacttgctatgaagctacagtaatcaagatagtactatactcttataaagataggagtacagatcaatggaatataattgagtccagaaataaagccttatatttatggtcagatgactttcagcaaaacaccaatacaactcaattggagaaagagtagtcttttcaacaaatggaactggtaaaactggatagccacatgaggaaaaaaattaaattggaactctacctcacaccatttatgactattaagatgaaccaaagatccgaacacaagagctaaaattataaaactcttagaaaaaaatataactaaatccttatcaccttgaattaggcagtggcttctttgatgtgacaaaaagcacaaccaagggaaaaatgaatgcattaaaattaaaacatcaaaatcaaaacctttatgcttcaggctgggcgccatggctcatgcctgtaatcccagcactttgggaggtcaaggcaggtggatcacctgaagtcaggagttcaagaccagcctggtcaacatggcgaaaccccgtctctactaaaaatacaaaaattagccaggtataatggcgtgcacctgtgatcccagctactcgggaggctgaggcaggagaattgcttgaacccaggaggcagaagttgcagtgagccaagattgtgccactgtcctccagcctgggtgacagagcaagactccatctcaaaaaaaaaaaaaaatgcttcaaagaacagtatcaagaaagtgaacagacaacccacagaatgggagaaaatattctgaaaatcatatatctggtaagggtgcactgttcagaatataaagaactcataattcaacaataaaaatccaatttaaaaatggacaaaggatttcaataaacatcaaagaagatatacaaatggccataagcacatgaaaagatgctcaatgtaattagtcattagggaaatacacatcaaaaccaggtgataccacttcactaggatggctgtaatttttttaacgaatggacaagaacaagtgttaggacatggagaaattggaaccctcatactctggtgatgggaattaaaaatgttgccactactttgggaatagtttggcagttcctcaagaggttaaacataagtttaccatatgacccagcaatttcactcttagatatatacctatgtaaattggaaaatacattcactcaaaaacttgtgcacaaacgttcatagcaacattattcataatgaccaaaagtagaaacaacacaaatgcccatcaactggtgaatgaatgaacagactatggtgtatccatacaatggaatactattcagccattaaaaggaatgaactactgattcatgctacaaattgatgaaccttaaacacattatatgctaagtgaaagccacattttatataattccatttatatgaaatgtcaataatgggcaaatccatagggaaagaaaatagattaataggggctggggactgggacagtggagattgactgctagtaagtatggagtttatatttggaatgatgaagatatcctgaagtaaaatagtggtgatggttgtacaactttctgaatatgctaaaaatcaccaaattatatgccttaaaagtgaattttatggcatgtgaatcaaatctcaatttttaaaatgggaaggaataagtacagttgttcccccttatctgctggggatacattccaagacccccagtggaaacctgaaacaatggattgtgccaaaccctatatacactctattttttttctatgtatacatacctatgataaagtttaatttataaattaggcccagtaagagactaacaacaataatgaaatagaacagttataacaatatgctgtaataaaaggtatgtgactggtctcccaagatactgtactattcttgcaataatgtgaggtgataaaatacctacatgacaagaggaagtaaagtgaatgaggtaggcattgtgacatagttttaggctactatggaccttgaacaccagcatcataataatgatgatcttataaccaagttggctactaagtgactaacaggtgggtagcatatacagcatggatatactagacaaagagatgattccaggcacgatggaacagagtagcatgagatttcatcatgctactcaggacagcccgcaatttaaaacatgaattatttctagaattttccatttagtatttttggaccaaggttgaccacaggtaactgaaaccacagaaaccgaaactgcaggtaaggggagactattgtaaaattatattcacagacaatatgattgtgtgcatacaaaaccctatggaatatataaaaaaggtaagagaggccaggtgtggggtgcggtggctcacgcctgtaatcccagcactttgggaggccgaggcgggcagatcacctgaggtcaggagtttgagaccagcctgaccaacatggagaaaccctgtctctaccaaaattacagaaaattagctgggcgtggtggtgcatgcctgtaatcccagctacttgggaggctgaggcaaaagaatcgcttgaactcgggaggtggaggttgcagtgagccgagatcatgccattgcactacagcttgggcagcaagagcaaaactctgtctaaaaaaaaaaaaaaaaaagtacaagaaatagtaacttcatttaacaagtgataagatacatgctcagtatagcaaaaatcaattctatatactagcaatagaaagtggaattgtaaacaataccatttataatgtatccagaaacatctgaaaccttggaataaacttaacacaagatgtgcaagatctctgtattgaaaaacaataaaatgagtccgggtgcagtgggtcatgcctataattccagcactttgggaggctgaggcaggtggactgcttgaggtcaggagtttgagacagcctggccaacatggcaaaaccccgtctctactaaaaatacaaaaattaaccgagtgtggtggtgtgcacctgtgatcccagctactctggaggctgaggcacaagaatcacttgaacccaggaggtgaaggctgcagtgagctgagatcgtgcaactgcactccagcctgggtgacagagtgagaccctgtctcaaaaaaaaaaaaagagcaaacacaaaacatggatagaagataattaaagaagacttaaataatagagaaatattttatattcatggatgggaacactcagtaatattatcctgtctattcttcctaaattgatttgtggattttccatatcagaattccagcaggttaaggaataaaaaactatgcattgagtacagtgtatactactaggttgatggttgcaccaaaatctaataaatcaccactaaagaacttatccatgtaacaaaaaccacctttttccaaaaactattgaaataaaaatacaaaattatctcacaaaaaaaaatccagcaggcttttttttttaggacaaaatccaaaatttatgtgaaaaaatgaaggatctagaatagccaaaataatctttaaaaagaacaaaattggaagacatactacctgatttcaagccttttataaagttatagtaatcaagactgttatttccaaaggataaactagtagttaaatagaacagattaaagtctaaaaatagatctatacatataaagtcatttcatttttgaccaaggcatcaaagcaattcaataagaaaaaaaattgattaataaatattactaaaacaactgtataactatttagggaaaacaaaaagaacttcaacctttcatctccatacccagaaattcaagatgcctcctaggcctaacataaaaccaagatccataaaacttctaaaagaaaacagaagaatctcttaataaccttggagtaggcagatatttattgcatgagacataaaaaacactaaccataaaaagaaaaaaattgaaagattggagtttattgaaatacttgctcttcaaagttaccattaagctacagactgggaaatattcactacatatgtatctggcaaaggacttctacaagctaacaataaaaatagttattaacaataactcatttaagctaatagcaaagacatgaactttcccttcatgaaagatatacaaatggttaataaatacatttaaaaattcctgaatatctgtcacagatgataagatcttgaagaaaatcctaaagatttcacaaaacagaactaatgaatgaattcagaaagtagcaggatacaaagtcaacacacaaaaatcagctcttactatttatacactaacaacaatctgaaaagaaaattccaaaagtatcattttgatgtatgataacatcaaaaagaataaaatgcttaggaattaaccaaggaggtgaaagacttacacatgcaagctacaaaacattgcaaaataaattaaagaagatataaataaatggaaacacatctatgttcatggattggagcagtattaaaatgtcaatactgtatgaaacaatcaacacattatgcaatccttattaaaatcccaatgacaatttttgcagaaatggaaaaatcatcctaaaattcatatggaatctcaagggaactgaaatagtcaaaacaatcttgaaaaaagaacaaggctcaagtactcacacttactgatttcaaaacttactacaaagctatagtaattaaaacagtgtagtattggtgtaaagacagacatagaccaatgaaatagaatggagagcctaaaaataaactccctcatttatgatcaaatagtttttgataagggtgccaagaccattcaatggggaaaggacagtcttttcaacaaatagtgctgggaaaaccagacccagaatgaagttgaacccttacccaacaccatatacaaaaattaactcaaaatggataaaagacataaacataagacttaaaactataaaactcttagaagaaaacacagaacaaaagcttcatagcattggatttgacattgatttcttggatattaaaccaaaggcctaggcaacaaaagaaaaaatagacaaatttcactttatgaaaattttaaaattttgtatatcagatgacactatcaacagagtaaaaaggcaagccacagaacaggagaaaatattttcaagtcatatctgataagtgattgatattcagaatatatagagaactcctaacaaagaatacaattttaaaatgggcaaaggaggccgggcatggtggctgatgcctgtaatcccagcactttaggagaccaaggggggcagatcagttgaactcaagagttcaagaccagcctggacaatatggtaaaaccccatctctaccaaaaatacaaaaaattagccaggcatggtggtgcttgcctataatcccagctactcaggaggctgagatgggaggatcacttgagcctgggaggcagaggctgcagtgagccaagatcacaccactgcactccaccctaggtgacagagcaagactccatctctaaataagtaaatagatggcaagggacacgaatagacatttctccaaagaaaatatacaaatggccaataagcatatgaaaaaatgcccaatttaactaatcattaggatgcaaatcaaaagtataatgagacaccacctcacactcattagggtggctactatttaaaaaaaatattagcaaggatgtggaaaaattggaatccttgtgcactgttgatgggaattaaaatagtagagccattacagaaaacagtatggaggctcctcaaaaaattaaaaatagagttatataatctagcaattccatttatgggtatatacctaaaataattgaaaatacgtctctccatactcagaaatggagctagaaaaaaaagagatttgcacacccatgttcacaaccagcattattcacaatagctaaaatgtggaaacatcacaagtctccatccacagataaatgaatgagcaatatagtatatacatacaatagaacagtggtccccaacctttttggcaccagtttcgtggaagacaatttttccacagattgatgggtgggggggtggtttcaggatgattcgggcacattacatttgtgtattttatttctattatgacactgtaatatgaaataattatacaactcaccataatgtagaatcagtgggagccctgagcttgttttcctgtaactagatggtcccatctgggggtgatggaagacagtgacagatcatgattctcataaggagcatacaacctcgatccctcacatgcacagttcacaacagggttcgcactcctatgagaatctaatgccgccgctgatctgacaggacgcagcgctcaggcggtaatgtgagcgatggggaatggctgtaaatacaaatgaagctttgcttgctcacctgttgctccctgctttgcagcccagttcctaacaggccatggaatggtactggtccatattattccacttatctgagatacttaaaggagtcaaaagtacagagacagtagaatggtgtttgccaggggctggtggggtgggggatctggggagttactgcttaatgggtatagtttcagttttacaagataaagagaattctggagatagatgctggtgatggttgcacatttatgaatgtacagtgtttaatacgatggaactgtacactacaaaatggtttttatgttatgtgtattttaacacaacaaaaaaatggaggaagtacttaatatctttgatcatcaagggaatgaaaattaaatctacagaggacttcatttcacagacattccaaggtgctgaaataaagtgtagtagcccaaacattaacaaagatgtgaaacagctggaacttacacattgctgatgtgagtgtaaaatactttggaaaagtacttggcaatttcttttcattgtactttcatctaccttattcatggctcatcaatttcacttagttacccaagagacacgaaaatgcaacttcacaagaaaacttacacaaagaatgtttagagcaaccttattcataataaccaaaaactaataacctaaatgtatatcaacaggaaaacagatacaatttaaaaatgatatatattcttacaacggaatacaactcagcaatacaaaggaacaaactgctggtatacctgacaacatgagtaagtctcacaaatattttgataaacagaagaagccaggcacaacagaatacaaaccgtattgttctatttgcatgaaatccaagaaagaccatctagttttagaaatttctaagtggttataggggacagtgattgaaaggagtccaagggaactttctaagatgatagattatattttgtttcaagtggtaattacacaggatatacagttgtcaaaattcatcaaattgagtaagatatgtgtattttattctgttaattataccaccataaaacatattttaaagtgctaatagaaatacttttctattcactgaaatactaatgtttgctagcaagagaactcttttccttatatcaagataacccaagaaatcagactagtaatcagaaagttggtgcactcatactcggagcaagggaaaggtcctagggataaatccaaactgcaaaaaaatttaatcagctctcaaacaataacaaatgggttactctactatggcagataaatgaaataaataattgctatgaattaaggacttcaatattgtgaagctaacaaaatttgtattacaggtaaatggaataatagggtttttaggaacccaataaggaaattatcatacaagtgtaattttaattttttatttcactgtacttcaatgtatacaaacaagtttcagggtgtttttttttgttttttggttttttggttttttttttgagacagagtctcgctctgttgcccaggctggagtgcagtggtgtgatctcggctcactacaacctctgcctccagagttcaagcgattctcctgcctcagcaccccccgtagctgggattacaggtgcgtaccaccacacccagctaatttttttgtatttttagtagacatgaggtttcaccatgttggccaggctgctctcgatcacttgacctcatgatccatccgcctcggcctcccaaagtaagtttaagctttaaatgaaaaaaagtacggacatttggagtatttgtgcaagaaacagaatgctttaggataaggaattcttataaacggtaggcattccagtattgcatttcctttaatactttgttgccagagccagaaataatgtaagaagaataagcttgtatttcagaatgtcaaggaaaaaaagctatatgtcatatggcttggtggtagacaaacctatttttgtcttaaaatttcatataccttctcctttaattatctcttctttcctcctttcctttttctttttcatcattctacttttattttctttccttctctttcatcttctttctttttctctccttttttcttcttctagaccgtatttcttagccttgttttcataattgatcccctaagcagccattttagacaccactttcctcattgctcctcccacccccatgaaatcttaaatcacagatatactgtatgtctgtttatgtactgtggctctttggagggccaaggaccattgtaatatctaaggttttttgcccccttgaggggtgatatctccccattaaaaataacatgttccaactaatgagttctttgaggggaaggatcatgtcctgtttaccattgtatgccttgtgcttaatataatgcttggcacacagtaggcaatcagtaaataaatgtattagatgaatatttattgaattaaagtgaaaatggtctctgctgtaaactcatcaaacaactaaacagctaaaattcttgaatcttttttagacaatactgtctactacttatactccacagtacctccgcatttgaagattgtcttcctgagactatatccatgtgacttgatggaatcttggaaagcaccttgatcacaaaagtaataaattcaaagccaagtccaagggtgagttacttatacagatggctaattttatctaccatatactgattttttttcctagcatcactttcagaaggtgatcatttcctaaatttttctctgaattgaggcttgcagcctctttgatacttacaactcactattcaaaacttatcagttccagttgacgtgcaagaattggattagggaatgagtagaaggtgacggcactataggaaaggagaaaataaatagaggaagtcattaaacttctctgttccttaatttttctttatctgtaagacctcttctagctctaaaatttgtgatcttgatttattctctgagtgagtggttctcaatagaaacattttattaaagaaatcagtggagggtgtcatcagttgcctcaagattggaaggacagtgctgccagcctttgtgggagaggccagggatgctagacatcctactgtaaatgggactttggtcagttcaggtccacagagaagcagacaccaagacagacatagaagagatggattgggggaaatggctgtagggaagaggaagcagttagcaggcagagtttgagactgggatgcagatctgacacccatgtcaatgtcatgagaagagggaggtggattcagtaggaacagccttagattataataacagctctaggaatgtcttggccaggccaatagggagccacagagcaaagactgaccatttgagggggttccaatttgaccagatgtggcctggctctattacccctgctgtgctcagccattgaggaagtttgggtagggtaaggccaaatcataaatgccatgatgaatctccaaggaataatactagaagactgtcagctagctacagtcctcacagcaggttctctctctctctctctttctctctctctccatctctctctctttctctttaaagcaaaacaaaaatgatactttactgagatacttttgcttgtaaagcaggagaacaagatgatatacataagtcataacatgtcaagacatgccaaggtgatgattttgatgttttctttatctttttcttttatctttttttaatccaggttaaagttggacacaaaatgagaagtttggggagataaggcttgggagttgagatcctgcatggaaaacaagatgaattaacttcccaggctgcgtaagtgttcacattttgtatcgaattatagcagatttgtttcttcttttgacctcaaaaaccgtttggaaaccttagggaaacttcatggcatcttttccattttgctgatggttgtcaggagggatagcaccagaccttaacagaggtggcttcaccttgcctagagcatcaataatcttatcacagattcacccctgttctttctcgtttagactctgagggtcccacttcattgtcaatttcatttgcagtcacaggtttagcataacagctaaccttatttttagttgatgatctggaacccttcacctgacttacaggcaaactcttgtgtattttttgttagaaaatcttcatatcgccattagcaaatgctgtactagtttgattacttggccattagctgcttctcaataggccaggttgggaggcattttcttggcatttttgttttgtatcttgagttttggaggtgaatcactgccatttttaatggatgctggaggcattttgtcaaaggattcctttttggttccttcatctttgtcatctgcttcatcttcatcagtattatttcctgatatttctgtaactttagaagcattttcatctatattgtcttcttcatggtttcctcaactctatttttcctttctagtccttccagcaggttctctgttgaacctctcatgttctgggagtagcttttctgattcctctggacctcacttcttgagggaaaacttagacaaagggggttattgggacaaaccataatccctgtcactcagttggtttcaaagctgcaactgctacttatcttcctcttccataccaatttcaagttctcctctccttcagcagtcacttccacagatcttagtggtgtaacctgggtgtgacccaaatcctcattcctgatgagaaatatatatttattggcaattacacatacctcatgtgattgttgtacatgtccttccacagttacaagtaagtctcaaaagactcccaagtggatcacctaggggctacatatttttctctgcccattgtgtaaaagaagcccttctgcttcctgttgatctaggtcagttacccctgccaagatggggattcctcttcctgcctgctggcaccttgacacaaagggtccaaaatgcccaaacagttgccatagcttgtagttcagtgggaccttccttgcatttcctggcaagaattcaccccactttggggaccaggacttctaaaccttcaaaacccagagttgcaggaacagaaagcacaaagttccccgatgagtcgtttgggtggatggtaagtagggccacttcttcttcctctgcctttttcctggacccatgtattcttcctattagggacagtgcctttagagctccctgatttagtatatatactgatcttgaaaagtggcactctgttcttgcagaatattgcctccaaatcggcactccagctgcaccttcagtaggttgcccagtgctctatcaggctggctgctccagatggtgcagtatgtgataaaaccagtagatcccttagtcattagttcatactcataccacctttactatgaaatggatcccctgtttggatcctgtgttgagttggatactatacctgtggatcaggccttctttaagcctctagatagtggtatgggctgtggctctgaagccaagaaaggcaaacccatacccagaataaatatgtatccctgtaaggataaactgctggccactccagaatggaaagggcacagtgttgttgacttgccaccaagtggctggtttatcttctcaagtaataatgccatatcagggactcagggttggtctctgttgctggcaaattagaccttcagagacaagtaggtatattggccttggtaagtaggaattcatgctcttgggctcatgtgtagccttcatctctgcactcacagtaggcagacttacatgttgcctacatgtgaaccaaagcagtattcctaggtatggaattcattgcttccagaacccaaaaaggcccaccaggcattgggcttcattatagtaggagatgcaagatgcagaaatttgccttttatcctggaggggatgtctccacaggccactgactactggaccttgaaaaaactttacggaagtcacaaattcttgaatcttcttaaaagtgtatctcccactctctggatacatgtcttaccaagacctctagtatacaagccacatcttgctcatcatgctcagtctgaatattgttgatataacatatcaatgtgatgttacacactggatgtccagacagtccagatctcttctgactgtattacaatagagagtagaagagttaacatggtccttggacaaagctggaaataaatattgtctcctccacatgaatgtgaattatttcttatccttatttctgattggaatataaaataatgcatccatcaaatcagtgtctacaaactatgtgactgaggccttattaatctgccttagcaattataccatgtccagcatagtttcagttgagagtactacttgtttaaacttgctgtggtagcctgcattcactctgtaggatacaaacgtggtactaatctcctgtgggacacaatgtcatttatattctatcttggctagggtgggggacagtttcaaaggctttcagttggtcttctcattatgatagctctttaacagctcaaggacccagtacttccactgccaatgatgtctgttgtaattatatactcagggacaaagaaatacctagcagatgggtcttcagacccagtgaattcactgtgtgcagactttagctaagactttattacttattctcataattttccacacacaggggaagccatgataacactttgggtctccagttaccaaagtcgacttagtccctaggcccaaagctcctctgaaatgactgggcactcccgtttcccagtgtaaatgccctacccaagtgtatgccctaactccttttggagaatgataggaggaatcattaaaatatctacttgccacaatgttgcagggtcctcctagggacctagctacctcctcagtcagtgggctctagatctgaaaatttgcttaagttcaggatgaacaacaaagacatttattgaaatgacctcccttagcctcctgcccctccattcttgccttctgcttgtacatgttaagcagcactcttaatctcttaatatctgcctattttgcccctaaagtaatgatgatctgtcgctggacccatcaactctatgactatgtccagttttgaataagctccaagagaggcctctcattctcacacttgggctctgtttgtaaacagccttcaaagtttctcattctctctccgtggggcatcaatacaacttagtaataaccactctgctcactaagatcttttaaatgcccaaatcattatacaggcaaggatattccctacactgagattttttcccagctcacaaccagtgaaaactttagcaattgaacttctaccttgtgtcaagtactatctgtgccccaaattccattcagaatgagttggccttaccagctgggtggtaagtgatggactctctaaaccctgtcttactatttgctttctgaggtcactcccagtagtagctgtcagtttgagtcttccatgaagcagacaccaagacagaattagatttattggggaaaatgtctgtgaaggataaaaagcaagagggagtaggcagaaagagcctccagagtgacacctgtgaatggagaaaaggaagaaaagaagaatagaaattcatggcataataggtgttaaaaaaagacttctggactgttaaaaaaaaaaaataggaagagccttaggctgtaatgcagttctgtgaaaataaccaagcctacagagagtcatcagaacaaagataacccattagaggagtcccacattgggcaggaatgatctgccttcaccagactcagtcactggctgaaagcagcggaggaagagccagaggaagagcgtgtactcagcatgaatcctgcaatgactccaaggtgtggcagttaagtggctgtccctaactacagtgtttaccgcaggttctcgaagagctgaccagtacactcctatagctgccacagcaacgctcacataacaaagaattgtactctatacctcatgattttcatatatctaggcagatactcatatatgtttttttaaaaacaaaacacaaaaacttttaccattatctggaattatccaggtctaaaacctattttagatacaaacaaaaggccaggtgtggtggctcacacctgtaatcgccgcactttgggaggccaaggcaggcggatctcaaggtcaagagattgagaccatcctggccaacgtagggaaaccccatctctactaaaaatacaaaaattagctgggtgtggtggtgtacgcctgtagtcccagctactagggaggctgaggcaagagaattgctggaacctgggaagaggagcttgcagtgagccgagatcgctccactgcactccagcctgtcggacagagcgacactccgtctcaaaaaaataaacaaaaatgattttgtacagttttaatatctaccgaatttttagtaatgcaaattccatgtaaatcaagagtaaaatgaagttcatgttatttgaactttaccaattgtttttgctattttgaaaaattaaatcacgggcaatgacaatgtcctgatatttgaatcaccaatacagtatgcctgtagctatatttgtgcctgtctcatgtatgtatatgaatatacctccttaaactatttcaaagtggaaatataaagaaaaatgacagttttcctttgaatgttgtcttctttaaaatccagccttactaatttcaagtatgtagaattttcacacattgatggtagaaatacaaaactgtacattttccataggaagaatttggcaatagctagcaaaattaaaaagttcatttactttttacccaaagtgcatcttctaggaatctaacccaaagaaaatataacaaaatatgaatatgcaaggatatgatggcaatatttgtaatagtataagacatctttcagtccaaatgttatcagcagagaatttggttgaatacactgtaatagatttgcacagtggagtactatgccactataagaaggactgagtaatatctctaaatattgttattaaacaatcctaggacataagttaaaaactttaaaagcaaggtactgaacagtggtatacagtaacttttatgtaagaaaggaagggaaggccaggcatggtggctcatgcctgtaatcccagcactttggaaggccgaggtgggcggatcatgaggtcaagagatcaagaccatcctggccaacatggtgaaaccttgtctctactaaaaatacaaaaattagctgggcatggtggcgtgcgcccatagtcccagctactcaggaggctgaggcagaagaatcgcttgaacctggtaggcggaggttgcggtgagccaagatcgctccactgcactccagcctggtggcagagcgagactctgtctcaaaaaaaaaaaaggaaaaaactacagagaaatcttgaattttagttatctttttattaatatactgatactgttatgaaaatatttttattgtatatatgggtaaagcaaataaatgattgtgttagtatcattaggaaccaaaaattttactgtaagaggaaagatatgcaagtataaaatcaaagacctaaaattcctatagtcttatatttaaattggaagcattagtatgttctcaagatttaattttctctttaaaaatatttatttcagtcaggtgtggtggttcacgcctataatcccagcactctaggaggccaaggccggtgaatcacttgaggtcaggagttcgagaccagcctggccaacatggtgaaaccccatctctactaaaaatacaaaaattagctgggcgtggtggcaggcacctgtaatcccagctactcaggaggctgagtcaggagaatcgcttgaacctggaaggcaggggttgcagtgaactgagatcacgccactgcactccagtctgggcaacagagtgagactctgtctcagaaaaagaaaaaagaaaaaaaatatgtatttcatagctctttccactgaaaaggactaggaataatagccttatagcaatgatctcccctaccactcaggttatggtctcttaaaaaccatttcccagtaaaaggaatcaagtctcctttgagaaatagttgactccagggttggtgtgggaaatgtataagatgagcttgaaatagctttcataaccaaaagtaagaaggcatcacgcactgttaaggttgtttcagaagaactcaggagccaacttgaagaaactccatctagtcaaacgtgagacaatttaagcatcataatgattactaaagtgaattgaaaatatcaaatatattaaaatccatagtgcatgacattcaaaagtaaacatttagaggatgtttcaaattcattatttgaagtctagttaacaaaggaattaaattgagcatttgctctgccttttctgtacaaactgtatttcctatacaaatacatgaaaaaaagttctttatatttcaggtaataaaatcaggaaatgataaaaattagaatatcatcattttttcatcccttaatgaaaaaaatggacctaggcaatgctcatcagtggctgctaggaccattagataaagggctgatgggaaacttttatataggctagattatgctttcaatacttaaacccactaactaaacttaactgaaaaagagaaacagcccagatattgatatgctttctgctatgatataatgggatgggcatagcttcatctatgaaatattccttccaaaaaagccaaacctgatagatcaagcctctagatctaacaaccagattacagcaaatacagaaaaaagaggaacatgacaaaatgacacacagggacacaattagcaaaatcctgaatgtgagatacaatgtgacaaatgcttcttcaacaaataaatggcaggaatttttttaaaaaggaatcattctagattgagggatatttaagaggcatatcaacctaatgcaatatatagaccttgtttgaactgatgcaagtaaatcaactgcaaaaagacatttgtgaaaatctgagaaaaattttaaattccatatatttgatgagattaaataattatagttttaagcttttcttaggtgacatagtagtatgtggttatattttttaaagttaaagtaattctttatggataaaatatatctgggtactatctgggatttgctttcaaataatctgagaaggtaggaatgttatctagatcagtagctctgagaccttagcggacctacagattagctggagagattgttaaaacatagactcctgaaccctacctcagagattctgattcagtggtctggagtaaggtcaatgaatttgcatttctaaccatcttccaggtaacactaatgctgctgatccagggaccacattttaggtagcattggtaagaatgaaaaagattagctattgataattgataatcgttgaagctggatattgtggaaacatgtagttcattatactactctctctagtatatgtttgaaatttttataataaattattaaatgtatattccaatatctgacaattatgtctgtcaacgttcccacgcatttatatactaccatatatatttttgttataaattaatctcatttatcctttataatatagtcagggcattacattgattttttaaatttatatatgtagtcaggttgcactctctgtatatttcatttgtggatgataaagagttataaaaatatttattttaaaatagaaatgttgagtctggtaaaggtgagaactgctaatttaagacaatctggagaaataaaagctatgtagaaaagcaagccctgctggctgaaaaggaggcttcagtggtaatcaaagcagaaagacctcaccagacctgccaggatttccactttcctaaaaaagagggttaactaatgggaagtattcttgaattctgctaggacatcttcttgttcaccatttggcactttctgactatttaagatgggaaaatgatcctgaaaacattcatctgtctctacccagcagcagcctagttattagcactccaggaacttgtcagagagctccgttttcaatagagagctgtccagtcccagaaaaaaacatagttgagaactgtttcagaaagatagcctaaggcagtggctgcactttggaatcatcaggggaaattttaaaaatcctgatgtctggatcctaccctcagagattctgacttaattgtgaagaataattaggcattagagattctaaactccccaggtgtggccaggtgggggcggttcatgcttgtaatcccagcactttgggaagccagggtagtggaatcacttgaaccaaggagttcaagaccagcctggacaacacagtgagacctgtgtctctacagaaaaaaataaaaataaaaattagccaggcatagtggcacacacctatagtccaagctaccccagaggctgaggtgggaggatcatttgagcctaggaagttgaggctgcaatgagctgtgatcatgccactgcactccagcctcggtgacaaaatgagaccctgtctccaaaacaaacaaacaaacaaaaaatataaacttcccagctgattctaatctgcaaccaaaacagaaccattgctctaagtttgaagtggtggttctcaaacttagatggaatcagaaccacctggagggtcataaaacacagaccactggcctcacctacagtttctgatttagtaggtctacagtggacccaacaatttgtatacttaacaagttcctaggtggtgctgatgctgctggtctggagaccacagttcaagaacataaagcttctgctgtacaccttaagtacaatggttgtctcaaggaaaagcacttgtgtaattgccagtggttgaactagtcactttattgaataccatctttatttgagagaatgctggcaaacagtgtttattcagacttgggtatttggaagacattttctcaaaaataaagtcagctagtcactgcaaggaaaacaactgagaaaattttttggccagtgacaaaatctaagctttcaaatgaaaattagaaattttcaacatttaaagacttttgtgttaagattggtagtgatattaatgaatgtgattttggatacagtgtaacgaaatgtgtcaacatttggagtatctggataactcagtgaaccagtatttttcaaatgaatgtcatgttataacattacacatgagtgacaaagccattcaaagggcaagttagacaaatttattttaatgtaatagtattatcatttcagattccatattacaactaacctttatttttaattttttaaaattgctttatttatttttgagacaaggtatcattctgtcacccaggctagagggcagtggcgtcgtgatcatggcccactgaagcctcaaattcctaggctcaagcaatcctcctgcctcagcctcctgagtaactgggactaacaggcacatgccacctgaccaggctaattttttaaattatttttttcgtagagacagcttcttggctatgttgcccaggctggcctcgaactcctgcctcagcctcccaagtagctgagattactggcatgagccaccactaactgcgtcatgggccgcaacgaacctttaaaaactagcacttgtttgtatcctgagactttgctgaagttgcttatcagcttaaggagattttgggctgagacaatggggttttctagatatacaatcatgtcatctacaaacagggacaatttgacgtcctcttttcctaactgaatactctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaaggttgttgaattttgtcaaaggccttttctgcatctattgagataatcatgtggtttttgtttttggttctgtttatatgctggattacatttattgatttgtgtatattgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctcttccaggctttggtatcaggatgatgctggcctcataaaatgagttagggaagattccctctttttctactgattggaatagtttcagaaggaatggtaccagttcctccatgtacctctggtagaattcggctgtgaatccatctggtcctggactctttttgcttggtaagctattgattattgccacaatttcagctcctgttattggtctattcagagattcaacttcttcctggtttagtcttgggagagtgtatgtgtcgaggaatttatccatttcttctagattttctaatttatttgcgtagaggtgtttgtagtattctctgatggtagtttgtatttctgtgggatcggtgttgatatcccctttatcattttttattgcatctatttgattcttctaatgtacaaaaatcaaagcattcttatacaccaataacagacaaacagagaaccaaatcatgagtgaactctcattcacaattgcttcaaagagaataaaatacttaggaatccaacttacaagggacgtgaaggacctcttcaaggagaactacaaaccactgctcaatgaaataaaagaggatacaaacaaatggaagaacattccatgctcatgggtaggaagaatcagtatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagacatatagatcaatggaacagaacagagccctcagaaataacgccacatatctatgactatctgatctttgacaaacctgagaaaaacaagcaatggggaaaggattccctatttaataaatggtgctggtaaaactggctagccatatgtagaaagctgaaactggatcccttccttacaccttatacaaaaattaattcaagatggattaaagacttaaatattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctacttatctgacaaagggctaatatccagaatctacaatgaactcaaacaaatttacaagaaaaaaacaaacaaccccatcaaaaagtgggcaaagaatatgaacagacacttctcaaaagaagacctttatgcagccaaaagacacatgaaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacgttgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaagaatgatgagttcatgtcctttgtagggacatggatgaaattggaaatcatcattcttagtaaactatcacaaggacaaaaaaccgaacaccgcatgttctcacttatggatgggaattgaacaatgagaacacatggacacaggaaggggaacatcacactctggggactgttgtggggtggggggaggggggagggatagcattaggagatatacctaacgctaaatgacgagttaatgggtgcagcacaccagcatggcacatatatacatatgtaactaaccggcacattgtgcacatgtaccctaaaacttaaactataataataataaataaaaaagaagctcaaaaaaaaaaaaaaaaaactagcacttgtggaattctggtatagtacaaagaatatccacagttatctgaaaaggctattaaaatactcccacttttccaactacatatctgtgtggggccagattttctccatataattaagccaaaacaacatcataacagactgcagaatcagatgtaagaatcaagttgtcttctattaaatcagacatttaagaaatttgaaaaaaaagtgactatcactcctctcaataattttttttgtttgttttggcaaatagttaatattcataaagtattatttaggttaacatgtagtaaatgtattattgttatttttaaagtgaattaatattttttcattctcagttttaatttccaataatgaaaatactgctagttataggccatgtacacctaatttcattggggtcctcaataatttttaaaagcataaaaggggccgggtgcggtggctcacacctgtaatcccagcactttgggaggctgaggtgggaggatcacgaggtcagcaaatcaagaccatcctggctaacacagtgaagcctcatctctactaaaaaaaacagaaaattagccgggcgtggtggcgggcgcctgtagtcccagctacttaggaggctgagacaggagaacagcgtgaacccggacccaggaggcagagcttgcagtgagccgagagatggcagcactgcactccagcctgggcgacagagtggttttttatttttttatttttttttgagacggagtcttgctctgtcactcaggctggagtgcagcagcacgatcttggctctctgcaacctctgcctcccaggttcatgtgattcttgtgccacagcctcccaagtagctgggattgcaggcgtgcaccaccacacctggctactttctgtatttttagtagagacagggtttcaccatgttgaccaggctggtctccaactcctggccctacctgatccacccgcctcagcctcacaaactgctgggattacaggcatgagccaccacgcccagccttctagagttctaggagtgttctatctcttggttttggtggtggctatgtggatgttagttttgcagttattccttaaaatttagatataaattttatgtacttttgtgaatgttatgtttcataagatttttcaaaaattgcgattaaggaagttgcctcttggtatagcagaaagaattgggttttggaaataaaagatgcaagagatgcttatatattttggctactaataaagaaaggttttctgtatttgaaaaaaaaagattcatgattcaagttctctgtgttaacctactgtgcggtttgggggccaaaaaaatagttgtaatactaccttctgtaaagcataaactgtaaagtggtatgcaaatgttggccactattatttttttcttttcttttcttatttatttatttattttgagacagagtctcactctgttgcccaggctggagtgccaaggtgcgatatcagctcaccgcaacctccacctcccaggttcaagtgattctcctgcctcagcctcccaagtagctgggattacaggtgcctaccaccatgcccagctaatttttgtatttttagtagagacagggtttcaccatgttagccaggcgggtctcgaaccctcgacctcaggtgatctgccctccttttggcctccaaaagtgctgggattacaggtgtgagccaccacgcccagctgaccactgctattattgcacaggaacaacatatatatctgcttaaaagtttctctcctaattaacctgtttgtgacctttaagcatacttcatagaattcctgaaaccattatgtttttctttgttttttgttttttgtttttttacttccaaaatacttggggttaaatttcttacatggtgttaataactctgttttgttatacattacttttctgttatacattacttctccgaatagtatttaatcatctgatttattttctttaaactgcctcaagttatacgtgtcttaatatttatgacctcaaatactttgtagaaaaagaagaaatgggtaagttatatataaacagttaaggattctgacaggatgggagaaaacgtggcccttacatgtcttctctctaaaggttgtgaggcacattgtggcagtctcacttccccctttctgcagcacatcaccctcagataaataaataaagcagaggactttcatttccagccagttgtcatagcaacttttgactatccagagaagaaggaattctcatatcttaagccctgactccagaagagctaaaaagacacaaagactaaaaggaacattaaagaatgatttgcaagatgtgataaaattgaatatctgttattcagaacttttccagtatatgtatgtgctttttcccctgacatatttatatttcttcttatagaattcagaactcaacagcaatagactaatagctaccatttatcacttattacatgccagatgcatagaacattacatatattgttttttaatacacccaacaacactgtcggtgttatactatttttatccacattttacagatgaggagcttgagtttagatagatggagcagtttactcaaagtcacaggataagtgctcatcctctcagccttcaacacagttgatcacttcttaaaacattctccacttttctgcatttttctcctgctttattggccaaacacttttctgactctcttggttctgtctgatctgtaaatgatagaatgcctagaacttacactcttctctatccagttaatatcttcctttcctatggctttaaatgttttctatatgttgacaatccccacatggatatctccttcccagatattgcacatgcatttcagattctggtatgcaagtgttcactgacacttagatatctaataggtattttaaaggtaataaatctaaaacagttcctgtctgtatatcttacctatctcagtaaatgtcagcactgtctaacccagatgcttaagccaaaatccctaagagtcatccttgatttattttcccctcacacccccactaccctgtcccaggactgctaatgtataaataagtaatttcagaattatccacaaaatctatcttaagtctacttcatttcacctccattgccaccactttaatgaaggccaccatcttttcctggactcctgtctgagtccattttgtgctgctataacagaataccacagactggttaatttataatgaacagaaatgtattggctcacaattttggaggctgggaattccaagatcaagaggcaaacatctggcaagggccttcttgctgtgtcataccatgacagaagagcaaagagagggcaagagagagagtaaaagagggtcaagttcccccttttataatgaaccttctcccttgaaaatggcatgaatccattctctccaccttcctggcctaatcacatttcactgggcccatctcctaacactgttgcattggggattaagttttcaacacatgtttttgggaggacacattcaaaccatagcaactcctaaccaggaactttctaacccatattcctgcttccattctccaaagagcagccagaatgagcttttgagaccataaatcagatcttgctagcgttaaaggcttcaatggcttccattgctcttagagtatgatttgaacttctaactgtagtgtaaaaagctatgcatgagctagttaatgccttttgctccaggatactacagttgtccccctccatcattctgcattagccacagtgtcctcctttctttccctcaaacacgtcaagctttttttttttttttttttttgactcagattttgcagtatgaactaccttaaacttctcttagcttattatcctagccggctatttttcctccttcaggtttcagctcaaatatctccttagagattaccttatctaaagttgcctcctgttggggctctcagttaatcacatcatttttcttttcttttcttttttttcttagagacatgtcttaatgcttcgctgcattgcccaggctggacttgaactcctgggctcaagcaatcctcccgcctcaccctcccaagtaactgggactacacatttttattttcttaatagcacttatcaatatcagaaatctttactagtgtaagttccacagggtcagggaaacttgtctttttcattgctgtattttccaaacttaggagtatataggaggtgctcaatgaataatccttgaaggaaggaatgaaggaaaagggaaaaagtgagaaattcagtgctggaattacattccagggtgggtttactccaaaattgctttgacctaccttcctttcgatggggttcgggaaacaccaccccaacatatggtaccttcagaaaatctcagaagcaggaaggtcactttaccttcccctcaactttcctccgtgaagcgggttataagaccttcattccagaggcactcacccaaacctggaagaaaggaatgtccttatctctgaagacacaaggatacaaagaagaacctgaacaaacaggacttcctaagtttcctgcagttatcataaccttttgtccaatcatacttctgcagaactgtctgctcttcatcaaccctaagcataaaaatacacacatatccctgtttctttgggtcttcatttctgaaagctcctgtgtcacataaaacttatattaagtaaatttgtatgcttctctcttgtcaatctgtgttttgttatagggacctcatttatgaacctagctatgggtgagaaaagatttattctttcctacactatttttagcttttcaagatgatttctagctatgttagttgttttgttctaactgtagactgatgcctgaatccccccaaaacactgagtttgagatggggatgaaaggagacggctgtgaaagaatgcaattggaagggctctcaaacaactgcaaactctttaactttgggggaaggaagacaaaagaaagagaacaccatgccacagtttttacttcttcagaaatgaaagttaaattccttgaaagaactcaacatatgccccatcacatccctccctgccaaattcccatggtttttaggtaagttgttctcaagcaaaaatcaatattccaaaatgtgaactttggagtttgaatgcaaccataccagcccattgccgctcattctcactctttaattattggcaataaaattgtatctaaaaaacttatgaggaaagaagacagaagaaaggcgcaggataacaaaacctgaagcattaagatacaaagggcagcctgagcaaatcaatggatgtttctcacagctgatctctccacactagcccaaaattggttgtgaagtccagtcagttcctaggggaagaaagaggaaagatgatgcaaggatacttttccacagagaatatagttctaatttataaaagtttacaaagagtttgaatctcaaatatctcactctacttctggcaccaaaaggaagcatgccaaggcctaagagaaataaattgttataatttacatgttagttggctttcagtaggtttggctcctgagccttttaaatgtcaaggattttagcgttaaaacacttagctttcaacactttagaaactcccaatgctaatgtttttgttttgtattttaactaacaattctttggctgaagactttcatttttgaaacacttaaattcctaataagtaaaaacctggcagggggtttggagagtttgggccataatgatagactgaaaattacttttactcttgaccttcatattgacttgttgtgatctaacaaagatcatttatcttcctgggctttcaattttttcattataaactataaaaaataatatggatattattttgagatcatttatcttcctgtggtttcagttttttcattataaactataaaaaataatatggatattgttttgagatcactggagaaaatggacaagcccagcatggttatttgtagaggtacttatatcaaattcaattatgtaaatcctgtttttaaacaactttctaattctgttcaatatgatttctaagttttatacagtgaaaacaaaatttaacttgatagtctgtcaaaatctaatattatatctatagttttcttttgttaccagaaaggagtcccaacccagaccccaagagagggttcttggacctcatgcaagaaagaattcagggtgagtccgtagagtaaagcaaaagcaagtctattaagaaagtaaaggaattaaaaaaatggctactccataggcagagcagcaacatgggctgcttaactaagtatacttatagttatttcttgattatatactaaacaaggggtggattattcatgagttttccaggaaaaggatgggcaattcccagaactgaggattcctcccctttgtagactatgtagggtaacttcttgacattgccatggcatctgtaaactctcatggcactggtaggagtgtcttttagcatgctaatgcattacaattagcatataatgagcagtgaagacgaccagaggtcacttttgtcatcctcttggttttggtgggttttggctgccttctttaccacaacctgttttatcagcaaggtctttatgacctatatcttgtgctgacctccctatctcatcctgtgactaagaatgcctaaccttggccgggcgcagtgtctcatgcctgtaatcctaacactttgggaggccgaggcaggtggaccatgaggtcaggagttcgagaccagcctgaccaacatgtggaaaaccaatctctactaaaaatacaaaaattagccaggcatagtggtatgtgcctgtaatcccagctacccgggaggctaaggcaggagaatcgcttgaacctgggaggtggaggttgcagtgagccaagatcgtgccactgcactccaacctggtgacagatcgagactccatctcaaaaaaaaaaaaaaaaaaaagaatgcctaacctcctgggaatgcagcccagtaggtctcatcctcattttacccagcccctattcaagatggagttagttgctctggttcaaacacctctgacacattcaattagagtgaaagagacttagtaaaattgaaataacatctccagagttaattttcttttcttcttctgcacagaaccatccctatttactctgtatgaaaactttcattacctgatgctccactctcacgcctccaatcttgggtctacaagtaccacaattttatgtgaaaagacattttatatgaaaagacattttacgtaagaagaaatacaaacaccaagaaaacattaaaactatacgatttctctagtagtaggcaaataatgcaaagtaaaattagataactttttcaccttatcttttgacaaatactaaaattaaaattggcaaatatttaaaaattaaagtttcagtattgtctaaggtgtaaagacatagtttttcatatatggctgatgggagtgtaaattgttaagatctttttgagtgaaaacccctttgcaaaagtatgacataagagaaatctaacatggctgactccatcttgcttctagcctcacggactggctgtctttgctcatttctggaaatttttctttgggagaaatttagtttacagtttaaataataataacccttccccaaaactaaactgcccttgtaaaactaatgaaaggtcaccaagttagaaggacgagaggggcctgaattctaaataattactagccattactctgaaggtcatacgatttgcaacttttccaattactcttgcagataacatcattattgtagaccctaagattggtcttttgaaatgtcttttcagttttttgcatttctgacaagtggatggccccatccgaacttgtgactcaatcagtcctgtggcccccacccagaagcagatcagtgcatgaggaccattttccacaccccatgttgacatccccaaccaatcagcatgtctcctaccctagccctgtgcccaccaaactatctttgaaagactcctaacctctgaacctttagggagactgatttgagttataactccatctcccatgtagcataaccagcctcacatcaatcaaacgctttctttactgcaatgccatggtctcagggggtcgattttgttcctgcagcaggcaggaagaacccatcaggcagttacacgaggagcaatttggcaaaacctattataggtttaaaattttactttgagtagcttggtagtacacaaagatacaaatataaagtatcaagtgttggtgggaatgtagtcattggaacactcatacactgttagtgggactgtaaactggcaggaccacttcgtttttctgttttttggttttttgagacaggctctcactttgtcacccagactggagtatagtggcatgatctcggctcactgcagcctccacctcctgggctcaagcaaccctcccacctcagccccctaagtagctgagactacaggtgcacaccaccatgcctgactaattttttgtattttatgcagaaacagggtttcaccatcttgctgtcagaggcgtttaaaccacagcaactccatcttgaataggggctgggtaaaataaggctgagacctactgggctgcactcccagaaggttaggaattctaagtcacaggatgagataggaggtcagcccaagatacaggtcataaagaccttgctgataaaacaggttgcaataaagaagctggccaaattctaccaaaaccaagatggcaatgagagtgacctctggtcgtcttcactgctcattatatgctaattataatgcattagcatgctaagagacactcccaccagtgccatgacagtttacacatgccatggcaatgccaggaagttaccctatatagtctaaagagtggaggaaccctcagtcccaggaattgcccacccctttccgggaaaactcatgaataatccaccccttgttaagcatataatcaagaaataatcataaaattgagcaaccagcagcccttggggctgctgtgtctatgcaatagccattcttttattcctttactttcttaataagctcgctttcactttgtactatggacttgcctgaaattctttcttgtgtgagattcaagaaccctctcttggggtctggatcgggacccctttctggtaccattgccaagactggtcttgaactcctgagctcaagctatctgcctgccttggcctcccaaagagctagaattataggcatgagccactgcacccggccaggaaggatcacttgggaaaacaatttggcattatctactaaggctgaagatgtgaatgtcttataactcagcagttccacttctgggcatagactcaagagaaactcttgtacatgtgtttatatccacactgtttgttaagaccaagaaagaagaactaatcctaattgtccatcaacaatacaatagataaatacagcagtgaaaatgaagaaattatagctacacacaatgacatggatgatctcaggaatattgtgttgtgagaaaaagcaagttgcagaataatatatacagtatggttctgcagggtgccagactatgccacctcaaaatacgcctctttaccactggattatcttgagctaaacacaactgagaaatagtagatacaagtaaagctctttacctccctcttactacctaaaaatgcagtataaaattccccttttggaaaggaatttatatttataaagcaaatttatatttgtaaaatttgtctccttaccaggaagaaagctattcatagagatgacccttatcacctggatgactcttatctgcaaaacaagatagcctttatttatcacacatttcatcccctcactttcccataagcttgcctccctgacccagaaatcccaaaccccttttcctttgtttagcctaagatgataaataagcctcaatcatctaaccacatccttgagtctcatttcttatttaaactaatgtgcattaagtgtgtaatcaaaacctttttttctcttgctaatctgtgtttcgttattttaattcacaggctcagcctgttaggagggtagaggaaaaaggattcctcttcccctacaatttcatttgtataaaatccaaaagcacataaaactaattgcttgggaaaacagatgtgatggtaggggcaaagggaacattccttccacactccaaagatttgataattaatttttattttttatttttgagatggagtcttgctctgtcactcaggctggagtgggtgcgatagctcactgcaacctctgcttcccaggttcaagcgatcctcccacctcagcctcccaagttgctgggattacaggcatgcaccatcatgcctggctaatttttgtattttttgtacatatgaggtttcacaatgttggccaggctggtcttgaactcctgacctcaagtgatctgcccatttcagccccacaaaatgcttggattacaggcatgaaccaccatgcctggccaaggtttgataatttgagtctctggaataaactgacaacaaacagattaacaggagaaaaggcatacaaatttattatatgcacatgagccacacaaaatatgaaacttagagaaggaccagttgagctggctaaagtttatttttgtttgtttgtttttgagatggagtcttgccctgttgcccaggctggagtgcaatggcacgatcttggctcactgcaacctccaccttctgggttcaagcaattctcctgccttagcctcccgagtagctgggattataggagtgtgccaccacgcctggctaatttttgtatttttagtagagacggggtttcaccatgttggccaggctggtctcgaactcctgactttgtgatctgcccgccttggcctcccaaagtgttgggattacaggtatgagccaccacacctggccaaagttctatatgatatggaaaggaatagggggctgggagctcctgaaggatggtgataacaagctatgggagggtaagggggaaatgcattgtcaacaaattcttttttgttgtttgtttttttagagacagtgtctctattttcaggctggagtacagtggcatgatcatagctcactgcagccttgaactcctaggctcaggggatccttggactacagctaatttttcaacacccaactaatttaaaatttttttttagagatggagtctcctcatgttgcccagtgtcaggttccagctcaagctggggtctgaggggagtcagtgaacaggtggcaggtagctgaaagaacactcaggggtctgtaggcaagtgcaatatggctttattctctcgccttctccatcagcctttgtctcagctgcctgctctggccacagtccctctcagtgccagctccatggctcctgctgcccccacgcctgcagctatgctccctagtgtgggcaccacttcctggctccctcctgttcacctgcaaggcagccagctttatcaagcacgctctcacagtgtcagtgatacatctatgcacgtcacagataacagtgactcagaaccaggtgatgagtccatccataacatggttacataactgtgattatataatgcacgggattgtgcacctgcgctccaatccggctgtgccatgctgcactggatgtttacttcggcccactcttgactgtagtgcagccatttcccttacacccaggatgatctcgaactcctgggctcaagtgatccttctgcctcagcttcccaaagtgctgggattacagcctgagccactgagcccaaccagactgtcttattatgcagataaagtctctcaggtagcagccctgaaggtggtagcctctgataagagtttctccagcatggtgtcagaactttcttctcttttcctgtgagctagtcttctctggttaatgattgcattccttctggagaaacttcccttggataaaggaagatcagagcaaggccttccctgcattactgctctccaggtgctctcagtctgaagtctaatgcaacatgttttgttttctgagccccaacacaataaagctaaaagtagagtaacaataaacctaaattaaggatagttgttacctttcagagaagaaaaggaggatggggttggagagaagcacacagggtactttaaaggtaatgagtgaggaaagtgaaaatgacttggagaccattgaacagggcccagagacaaaaactccttatctgaggaatttagaaggcagcaaagaacacctggtgaccatcaaacaggccatccaaaggcaaaagttatctaggaaatttaaaagtaattaaacttcccagcagggtgcaatggttcacacctgtaatcccagcactctgggaggccgaggcatgcggatcacctgaggtcaggggttcgagaccagcctggccaacatggtaaaacccccgcctacaaaaaatacaaaaattatatttgggcatagtggtgggcacctgtaatcccagcttctcaggaggctgaggtgggagaattgcttcaacctgggagatggaggttgcagtgagccaagatcgtaccactgcactccagcctgggtgatggaaactccatctcaaacaataacaataataataataataataaaacttccctactatctaaagttggcatctggttccaggcctctttcaacttttattaagtaactagaatttttatacatcttgggaattccatgccgaaactcattgtgcaacccttgctgacgttaagccacccaaatgtctatacatgtaataatttatcatgacctatgtagctaatatggcccaaattacctttaagctcttaccttaaggtccataaaaggtcctaaggaaaatccaccatttcacacccagtcctcccactgaggcgccccgctgcaccctttagcaatattccttctttctaataaactttcctttttcaaacctatactgttgtcggtaagttgactacttcccaatggcggggctctgacacctcgcctggcactaataatgttttgggtttttttccttacatttggtgataaattcagaggtttttggttgtaaatgtgtttcattttacttcataaatatttttgtgtctagtcaatgtttaataaaagcaacttaaagaacttaagtgtccaacaatcagttatacgtcaacataaatagaacaattttatttatataaaactctatatatattatgtggataaacagcaatgaaagatgtgtacaaggacatataataatgtattaatcattgtatcacttagtgagtggatttggactgattttgctctccttgttttactttactatattgtttattttgtccatataaaggacatgtattttcttataaagaaaataaaactggttggcatgatgacacatgcctgtttaatcagcactttgggaggctgaggcaggagggctgcttgagtccaggagtttgagaccagcctgggcaacatggcaaaaccctgtctttacaaaaatacaaaaagctagttgggtatggtggtgcacccctgtagtcccagctactcaggaggctgaggcaagaggatcaattgagtctggggagttgaggctttagtgagccatgatcaggccagtgcactccagcctgggcaaagaacaagaccctggcaaaaaaaaaaaagaaaaaattttaaaaagaaagaaaagaaaggaaggaagggagggagggaggaaagaaagaaggaaggaaaggggaggaaagaaagaaggaaggaaaggaaaggaaaggaaggaaaggaaaggaactatttctttaaaaaaaaagatataactattaggatgttcacaacagttagatagatgtatagatagataaacatattgtgtaagaaagaattaaccttactcaaagtaaggtatggcctttgctgtcagcccctaggaggtaatctctaagcccttgggatgtcttgcctgatgaaagtgtccttgtttacttgggggccttgagccatgccagatagtctgattacaataatttgtggtaggggctttggggcacatgctatcagctcaacctccagagaagctggaggttaaggtcatccacatgggcagtcaactatgtctatgtggtgatgccccagtaaaaactttggacaccaaacttctctggttggcagtactccatgagtattgccacacactattgctgggaggcacaatggctggctctgactccaatgggagaggacatttagaagtgtcatgcttgaaactctcctgaactctgccccttgcacctcttcctttggtttattttaatttgtacacatcactgtaataacccataaccgtgagtgtagcagctttcagtgagttctgtgagtctttctagtgattattgaaactgagagtgttcttgggaatccttgcactttcatttggtgccagagtgagggtgatcttggggacacctgaactttggagttggtgttagaagtggaatttgcaagaatgactgtattagtccattttcacactgctgataaagacatacccaagattgggcaatttacaaaagaaagaggtttaattggacttacagttccacatggctggggacatctcacaatcatggttgaaggcgaaagacatgtcttacatcacagcaggcaagagagagaatgagagtcaagcaaaacgggtttccccttatcaaacatcagatctcatgagacttattcactaccacaagaacagtatgggagaaactgcccctatgattcaattatcttccaccaggaccctcccacaacaagtgggaattatgggagtacaattcaagatgagatttggatggggacacagagccaaaccatatcattccattcctggcccttgccaaatctcatgtcctcacatttcaaaaccaatcatgccttcccaaccatcctccaaagtcttaactcatttcagcattaactcaaaagtccatggtccaaagcaaaagagacaaagcaagtcccttctgcctatgaacctgtaaaatcaaaagcaagttggttacttcctagatacagtgggggtacaggcattgggtaaatacaaccattccaaatgggagaaattggccaaaacaaaggggctacggtccccatgcaagtctgaaatccagcagggcagtcaaatttgaaacctccaaaatgatctcctttgactccatgtctcacatccaggtcatgctgatccaagaggtaggttcccatggtcgtgggcagctctgcccctgtggctttgcaagctatagctcctcttctggctgcttccatgggctgtcattgagtgtctgtggcttttccaggcacatggtacaagctgtcagtggatctaccattctggggtctggaggatggtggccctcttcttacagctccatgaggtagtaccctagtagggactctgtgtgggggctctgaccccacattttccttctgtactgccctagcagaggttctccatgagggccccaccccacagcaaacttttgcacgggcatctaggcatttccatacatcttctgaaatctaggtggaggttcccaaacctcaattcttgtgtgcacccgcaggttcaacaccatgtagaagctgccaaggcttggggcttccaccctctgaagcaacagcctgagctgtaccttggccccttttggtcatggctggagtggctgggatgcagggtagcaagtccctagactgcacacagcatggggcctgagccagtccatgaaaccattttctcctaggcctctgggcctgtgatgggaggggctgccgtgaagacctctgacatgccctggagacattttccccattgtcttggggattaatattcagttcctcattacttatgcaaatttctgcagccagcttgaagttctcagaaaatggggttttcttttctatcccattgtcaggctgcaaattttccaaattgttatgctctgcttcccttataaaactgaatgcctttaacagcacccaagtcacctcttgaatgctttgctgcttagaaatttcttctgccagataccctaaataatctctctcaagttcaaagttccagggtctcactgtgttgcccaggctggagtgcagtggcataatctcagctcactgcaacctcagcctcctgggctcagatgatcctcccacctcagcctcccaactagctgggaccgaaggtgcacaccaccatgcccagctaatttttgtatttttttgtagagatagggtttccttattttgctcaggctgggctcaagcgatcttctctccttggcctcccaaactgctgggattacaggtgtgatccaggtggccgcagttccttattttcttgtctgtgtccataactcctcaacaatccctcccaactggtctataaaatcattttgtagacaaagtgatatttgtttgtttcttaaatatttctgcagaatggttttaaaaggctaaaagatttagttttagataaaaagatttacattgctcacatatcagagtatattaaatggtgtacagtgagaaatcactctttccttccccacaccattccccattcactttgttttcttcctctgtgagtagtgattataggttctgttgatccttctgaaaaatgtttatgcatatttaagactatatgtgtgtatgtgcattcagtttttccacaaacatttcacataaatggtagcatactatacacactctctctgcattaaggatctttctctatcaatacattaatatgtacataatatcttctgtgtgtgtgtgtgtgtgtgtgtgtgtgtgtgtgtgtgtgtgtgttgtgctgaactacactgtgttcaccattacaagggctttagtaagactgttgaaatgaataaaattacaatacagggagttgataataataagtgttgatgacatcaaagtgactaataaacacatgaaaatgtgctcaacatcattattcaagagggatatacaaattaaaagcacagtgagattttactacccacccactagaatgaataaaataagcaaaatgaaacatctgacaataccaagggttggagaagatatgttgcaaccggaactctcagacactctgctgagaatgtaaattgatagagccactttggaaaactgatcttaactactaaatctgaacatatgcatagcctatggcacagtaactccactcttaggtatgctaagagtagagctgccaacaggaatgctacatatgttcaccaaaagacatacaagtaaaggattaatcttgtccaaagcaatgtttggcccttgatcagtttctaggaggcaacctctaagcccttggaataagagcatccttacctggggctttgggtcacaccaaatagcctatgttaacaatgtcacttatagccagagtattgggccacatggcatcagcttaacctctggagaagctagagactaagagcagccacgtggttgttgccatttccatgtaaccaacccccagtaaaatccctggacaccaaggctaggggagcctccatgctaggttggcgttactccatgcatctgccactcatcattgccgacaaaagtaaactctgtctgcgggactccactgaaagagaacgactggaagctcatgcctgggaacttgcctggactctgtcctctgtgccttttcccactgctgattttaatctgtattctttcactgtaataaaccatcatcgtgaatataacagctttctttctgagttctgtgagtccttctagtgaattattgaacctaaggatagccttggggatctcccaaatggcaacaagaatgttcatagaggcattattcataatagacaaaacctggaaacaacccaaatgaccatgaatagaatagatgtatattcatataaaggaatattctacagcaagaaaactaactgcaacaacatgcaacaatattgatgaatcactcaaccataatattgagcaaaagaagccacagaaaggagtatgcagtatattattttatttatgtaaggttcaaaaattagtctatgttgagagaagccagaataaggttacctttgagatggggtattggctgaaaatctcaagcttgatacttataatctgtgcacttttctgtgtgtagattatgcctcaacagaaagtttacttcctacacacctattatcattgttaaaaaaaaaaagagtgagagagagagagagaagaggggagggggaaggaaactggattggattctggcaaggttgcagagtaactgcaactctcatacactgctaatgggaatgtaaaatggtaccactactttagagaatagtttgatagttccttataaagttaaacatacacttaccatatgacccagcaattctatcccaaggagttacccaagagaaatgaaattttatatttatgcaaaaacctataggccactcatcctcttcaaaaaaaactcgaagaacccaaatatccttcaacagatgaatggatacataaactatgatgcgtccacatagtggaatactattatactactcagcaccgaaaaggagtgaactattgacacatgcaacccctcagatgaatctcgtgtattaagtgaaagaagtcagacccaaaaggctgcacactataggattcaatttatatgacattctggaaaaggcaaaactttagagacagaaaagagactggtggttgcctggggtggggggttataggaggcattgaccacaaaggggcacaagagaattaattatttgggggtgatgataacattttgtaacttgactgtggtggtagtgattacacagcagaatgtgtcaaaacttaaactatacactaaaaagggtgagtttcattatatacaaagtgtacctcagtaaaactgacagatatataaacatgtttaaagcttacttttaagtaataataataataggtgccacgagagatgtaaagaggaaggagactatgaaaaatttatttcccagtgagaattagagaattgtcacggaagtgttcatatgcatgttgagcctcaaatatacatgaataatatctggggagtgaccatcttgaagaactaatttccaatttcaaattcatggaagaaagtatcagagaatcatatttctgtacttttgccatagcaccttccactgagccacaaaccaagtagatctaagagccacttagtctcatctgtcatggcacacctttgggcgagagtcacactgcctccacctgagaaacagctccaagcccagaaaacaaggggcttagagagtcagaatccttaggtctaccagggacttcaaaacttcctccacaatatttgtcctttcagaataagaggaaataatccattaataattaaagctaacacttatgtagcactgactagatgccgggccctgttccttaatttcatatatatatatatatcaattcttacaacaactccatgaggtaggtagttttgaaaacaaccccattttacagatgggaacctgaagaacagagtggttaaggaacttgctcagggtacaaaattagtaagtggtagaggcaaaattcaaatctgagcattctggctccagagacatcttcctaatcattgcagtctagtcccgctccgtgcacagttagggtaggggttgggtggccagtatatcctagtccaagtctctcaaagtataaactgccattcactagtgtgatggaatcaactgaatgggttgtgaccagcttttagaaagtggaattgaaaataagtaaatatattttggaatgggatgaatagataatatcagagtacattccagatatatgtactgagtcactatataggttgtatttattactgtgtgtcaagatctgaaaagtttaaagcactttccaggtccaccctcagaggataaaagctcaagatgtcctaagcctgaaatccaggctatctcttctccaagaacgtcagtcctcccccatgatacatccagcagtctccctaatgcttttgggtcttgagggcagagtcccacaacctttggccattgactactgcagaggagtaagctgggtgtaattctgctcaaaatgagagtcaggctaagccccggctttagtagtggccagaaagctaaagtcattctctgaaacagaaaatgtggattctttgcactctcgccaggtgcacgttataactggtggggaagctccagctgaaatgcctacagccctttgaactaaagtgctttacattccctgtcttctcacaaggaggaatggtagaaatataggtgacaggggaccggtatcactgagcaccatgatactgttcactggacacctggtggctcaggtgtgtaggagacagcggcagtgtctgcagtggcacattgaggctgcaggaagaggccatgcctgacccaggaggccactccctcaaagcctccagcagccaccagaaataggagagacttgtcttgctcagacacaggatcctcatgcgtatctgggccacagcccaaagtactgacagtctagctctccaatcttctcatgtgcacacctaggtaccttcgagggcatatgactgtgtcatacctggttctcgggcgttcatttcctcatagattgtgtttttcagggtgatatttgcctggcatgcaaccttctacgtggtgatccaggggcccggacgcttccattctgtgactgtgccctcctttagggtctctaggacctctgagtcctctgcattcagcctgcagatggagaaagagtggagaagatatgcccttgtcttaagctccttggctatttattgagaacatagcccctttcaggtgcaaagcaggagctgagaaatactgcctccagctgggctactgtttccagcatcagctgtcctctgcagtgagagtgtcaggaatcttcatctctgcttcatggaccaagaaccactgtgtcccataccaccctgggaatgatcccccttttcttgcagaacaactaagctgcctcctccaccctttatgagggaaactcttaatgatttcctaactatgcatattgtagctggtaagtctcttcctctagaaaacatagggaaaaagccacaagttgactctcaaagcaagactccccttctgttttctatggtatctgaacattaggaaatagtctagaaggatgccattgctagacactaggaacacagactcggaaggtagggttaggcgaagagtttcatcttttactttacaccattctgtatatttggtttaaacactaatgagcaaaagaagtattaggcagcatagctatttatatgaaattcgagaataggccaaacaaattgattatgataaaaatcagaatagtggctatctctggggaggaaatgggttttgactgggaagaggcaggaaatgttctccatctcagtgtgagtgatggctacacaggcgtccacacaggtaattaaccatggtctacacttaaaattagcacagttcatgttctttggcatatatacattatacctcaatttaaaaaaatatatatatattagtttaaaaattccctgccctaatttactccctgtgttagtgtgtttgcattgctataaaggaattcctgaggctgggtaagttataaaggaaagaggtttatttggctcacagttctgcaggctggataaggagcatggtgccagcatctgcttctggtgagggcctcaggaagcttacaatcatggtggaaggtgaagggaaaccagagcattacatggcaagagagggagcaagagagtgagggagcaggtgccagccttttttaaacaatcagatctttttttttttttttttttttgggatggggtcttgctttgtcacccaggctggagtgcagtagtgcgatcttggctcactgcagcctttgcctaccgggttccagtgatactcctgcctcagcctcacaggtagctgggattacaggcatgcgccaacacgcccagctaattttcttttctttttttggggcgggggatgaagtctcgctctgtagcccaggctggagtgcagtggcatgatcttggctcactacaacctccacctcctgggtcccggttcaagcaattctcctacctcagcctcccaggtagctgggattacaggcacacaccaccatgcccagctaatttttgtattttcagtagagatggcgtttcaccatgttggccaggctggtcttgaactcctgatctcatgatccatccgccttggcctcccaaagtgctgggattacaggcgtgagccaccgtgcctggccttaaacaaccgaatcttgcatgaactcatagagtgagaactcactgaaggacagcaccaagccactcatgagggatcggcccccgtgagccaaacacctcccactaggcccacctccaacattggaggcccacatttcaacttgagatttggaggggacaaaacatccaaaccatatccccccccaaacttttagtggcccctttttaagaatcctgttggagacattgatgatgacaggcaaagtgtttccctccccttccacccccataaattaaactctgccttgggtccattagatgtccctgcagttgcagaaaactgtacagaaaggagcaggcccaacatggtctcaaagagccccaagttatcactgaaaagaagtgtgatgtaatagaaagaactcgaacttgggagtcagccagctccgtgttcaaattccagatctgccccttagctgcaagatctaggcaagtgacttaggctttctgagcttctgtttcctccttataaagtcactttcatgtggttgaggtaagaggtgaatgaaatacttctgcctcaaatactccttgatgaggtgatatagtttggatctgtgtccccgcccaaatctcatatcaaattgcaatccccaatgttggaggtagagcctggtgagagagaattggatcatggggctgtgtttctcatgaatagattagcatcatccctgctgattctgttctcatgatagtgagtgagtttgcctgaaatctggttgtttaaaagtgtgtagcacctcccctctctctctcttgcctgtgctcctgccatgtaagacacctgctgctcctttgccttctgccatgactgaaagcttcctgaggcctcccccaaagcagaagctgctatccttcctgtacagcctgcagaaccgtgagccaataaaaccccttttctttataaatgacccagtttcaggtatttctttatagcaacatgagaacgaactaatacagaaaaatgagggatgaatctgatgtgagcaatgcatatttgagatcgaccatgtccagcccttgctctgtgcatggcgtgaagaaggaggggctcgcgtttcctgcccttccacagccatcagcagggaagacaaagtggccaagagatgctcacttctctatggaagtgtcagctgccccatgaccagtgatgtctttgccaagtgataagtcaccgagctggaagtggctgagcagaatagtgctaagagctaagagtgctaagcagagtcagtcaatccttgtgacaccccagcttccccattcagtcactaagagacccaaggaaaagattctgcctccctgtgctttagcctctttacctgtaaggtgagaacagcaagaccaccgaccaaatacactaatacccttaaagaattttggacttggcacagagtcagagctccacaggagcttcacaataaggccactgctttttgcaaacatctcccttgtcatcctgacattgcaaaggccacctgttggctgtggcctctcccttccctgtctctgtcataggcctttttctgttctgtctgcggtagcttcgccacagccttagccatagcagcagttgtttgttttgtttgtttttattgtttgaccaacatctacccaatccccccatcccctagcccctgtaactaccattctactctctgcttctatgagttcaactttttttcagattctacgtataactgagatcttgcagtatttgtctttctatgcctggcttatttcacttaacataatgtcctctaggtttattcatgttgttgcaaatgacaagatttccttcttttctttacagctgaatgttattccactgtgtatacatgccaccttctctttattcattcatccactgatgaacacttaggtcgtttgcatacattgtgactatcgtgaatagtgcttcaatgaacatgggagatatctctttgacatattgatttcacttcccttggatatgtactcaaaagtgggattgctggaatcatatggtagttctatttttaatttttttcaggaatctccatactattttccataatggttgtactaatttacattcccaccaacagtgtacaagggttcccctttctccaacacttgttatcttttgtttttttgataatagccattctaacaggtgcaaagtatagttttaatctgcatgtgcctgatgattcgtgatactgagcattttttcatatacctgttggccatgccagcagtttcccagttacttcctactgcctgtactttttccttttctagctattatcacatatttcttcagttcataaatatagcattaaaaaaatcatgggctcctttcctctcccatctggcaccactgtgatgtgtcccccaaggaactggagtctaggcccgaatgcagtctaggataaggaataggaaaatgaattcttttgttataaccttttacttgatgcagtttttggagaggaagcttgtcactttctgcttcctgcagctctgtgtcagggctgtgatttcaggcctttttaaggctgcaaataggcttgacccatctggcaaatctcaaagtcaactttccctatagtgtgccagcactctgaactggagttatttaaattcaaccttctgcctgacctggaggagaaaaaataaatagcagagtgttgctttatgggttcaaactaagaccccaatgctgaggatgagatgatgtaaacaggagggcctgggagaggagatgtattttctcccaggtcatttgcacattgtttaatgtgccagaagaaataatttggaagaaccttttgaacctgaaagaatgtccccaaagtaagtgggtatttttaaaaactctgtatggccttctcctcatttaaaatttcactgctctctgggaggcagaaaaaatcttttacccatcctgtatcttcttttttcttccttgctgtcaaaatcaaactcccattatagagtttgaaaatgccatatatttgcttcctccacctctcttgcagcccagcatgggcacgtaacctaatttcaggcaatggaatttggagaaatctgataccaggggttctaaggaaggtttctctcctaataaataagaagcccatggaaagccttcccttcttatttgttgaacaggtggctgcctgtaacgtcccaggcacatcttgtctccatcctttctcttaaatgtgggaaacttcttctggggtcaggcctacctgaccctgtgcccactcttagaaatctcagccactcacatggctttatctgtgtgatattgtgaaatatctatttggtcttcatccagcttctaaaatccttgaaatctccagaatggtaacagtgtcttttgcataagaagatggcttcaggatgagggctggtcaccagaaaaaccaagacatgaataaagggttggaactttcaaccttacatcctgacttccagaaagcggctgaaggtcgaggttgatcaccaatagccaataatgtaatcaatcatgcctatgtaatgaagcctccataaaaacccaaaaggacaggtttcagatgagcttccagatagttaagcatgtggaggttcctggagagggcatggaagttccatgccccttcccccataacttcccctatgcaactcttccatttgactgttcatctgtaccctttgcaatatccttcatactaaactgagaaatgtaagtgtatttgtctgttctcacgctgctaataaagacatacccaagactgggtaatttataaagaaaaagaggtttaatggactcagagttccacatggctggggaggcctcacaatcatgacagaagacgaaggaggagcaaggacacgtcttacatggcagcaggcaagagagtgtgtgcaggagagctcccctttatcaaaccatcagatctcatgagacttattcactatcatgagaacagcacgagaaagacctgcccccatgattcaatttccttgtaccaggtccctcctaccacacgtggggattataggagtgacaattcaaaatgagatttgggtgggggacacagccaaaccatattagtaagtaagcatttccttgagttctatgagcagctctagcaattcaattgaaccctaggagggggctgtaggaaccccaatttatagccacccagtctaaagcacaggtcacagtctgaggcttgcaactggcatctgaagtggggggcgatcttgcgggactgagccctcaatccctgggacctgatgccatctcaggtagatagtgtcagatctgcaaatgtgttgataacagagtatgcttatttcagtaattcagcaaacatttactgagcacctactttatgccatgttctaaaagcgaggacaagataggcaaggtctctacatccatgaaacttacaatctaataggcttctagcacaataactgtctccacttggcttttctgtttggtgtcctaactattcctgacataacacatctaaagttaaactcactctcttttctccgaaactgacttctctatttctggtcatggatcccaggttcaaaatcatgacatcatctttgtctcttcattcacccttgttgccagcatacctcatttctatttagtcattaagtctactcccaataagtgccaggagctggagctacaaagatacataatggtccctgatacatacacatatatataatcacaatacagagtaagatgtgcaacaatagaggtccatggtagatgagaggggaaagtgcctcaattcttgagaaagccaggaaaggagaaaacgaggagagtaagaagagacaaaactgaaaatagaatcttgcaaaaatactaatatttacagggttgaacagtgtcagatgggcagagaagtcaggttatgataaggcctgaaaatgtcttgtggttttgtaaactaggaggtgatcttggtgagaacagtttcagtggagtggcgggttagccactccaagaatgaatggaagatagtgaggaggactggtttaacatttctagcatctattcttccttctgggaacattgtcttgagtttcctttggggccacccctttccctctctaaccatgctcaggtggaggtggccccaccactagatccagggcccagccaacaaaatcaccacatatccatgcccattggagatttgttcaggggtggaattatgaccaagactgggccaatgagaaatccattgctggaactctcaggaaacaggtgctcttgttctacaccagtttgaagctcaggatctcaccttgtcagagctggactattgcatcagtccttttactagtctccttgtcttcgaattcttcatatcaaccaaagcttccaagctcttcttttcaacactgcttttacattattcaaaaactattgagcacccaccattaaattcatggcacttagtgcttcatattccattatctggagcaagtctacctttccttgtacctccctgtcatcaaagctttacatatctttcctactcctggactgcctacccgtttcctttctactatttaaatccatctcatctttcaatgtcctagctcaaacgtcatcttcctccatctggtaccagtatcacttgacagcaatttttggaaaatatgatttattgtctagttttattacctctcattttacatctttagtttttttctctcccaattaccttgcaggaaatatgaaggcaatagccatgtcataattattggtatactgtgaggcattgataacagagctctgtacagccaacactcaaaattttcacagaataatgaatagacattttcggttcagcagcaggtggcaagaaatggagattaatgtaaagctaccatttatatgatgagaagagatgtggtcagcagtgaagagagggaaaaaaaatttaatggatacaaatagtctggtcaagaagatagagctaggagcattgtaagtggaaaatttttgtgcaaagtcaaacttgacaaggcaaggagataaacccaaaacaacaggatgggggccacagggacaagctctgaaaatgctggagtgtctgtaatccaaagggtggtgagaagcgcaaagagaagctaagtgacttcaaggatcagcatagccagtgacttcagcagcaaggactcacatgactcagagcaggaagaggttgtgaggaccctgggagatggcacttattggacaaatagtacttacattttatcactctctttaactccctccaaagctcctctagaagaatgaagaaaagctgggtgtggtggcgcgtgcctgttgtcccagctacttgggaggctgaggcaggaggaccacttgagcccaggagttctgggcagtagtgcgctgtgccgatctggtgtctgcattaactttggcatcgatatagtgacctcccaggagcagaagaccagcaggttgcctaaggaggggtgaaccagccccagtcagaaacagagcagatcaaaactcctgtactgatcagtagtgggatcacgcctgtgaatagcctgggtaacatagccacgtcccatctctaaaaaagaaaagaattttttggccgggcgcggtggctcacgcctgtaatcccagcactttgggaggccgaggtgggcggaacacaaggtcaggagtttgagaccagcctggccaatatggtgaaactctgtccctactaaaaatacaaaaaatagccaggtgtggtggtgtgcacctgtagtcccagctactcgggaggctgaggcagaagaatcgcttgaacccaggaggcggaggttgcagtgagctgagatcataccactgcattccagcctgggtgacagagcaagactccagctcaaaacaaaaaaaaaaaagaaaagaaaagaaaagaaaagaaacgaattttaatttatttaaaaaaaaaaagaatgaagataagctctcagaaatgacttccccagggatgtggaatggtgatgagaaaccactgttgacaaggtcccaggagacacccacgttgcaattctcatggtcatctccagtcttcaccttccttggtgatctctcttcctgaaacattctctgtcctgggcctctgggacaccccctttcatagttctgctcctaaggaactgttccctcctcctcaatctcttctattggatcttctttatcttcctgacttttgagcaccagagggtcctagagcttcattctcaggctctttttgtctagatttgcagtcaggtactggggggagtctcatccagattcagagcttgaaataccttttatgagttgatgatatccagttttgtatctcaagccataacctctctcttctcccttaaattctagaatcacaggtctactgtccattctatatctccacctggatgactaatcatcattccaagcttgacagttcagaagtgagcttttacccctctcccatcccaccactgaactctactgtgcttccattcttggccatttctgtaaattactacgccactctaacagctgtcaggccaaactctttgaatcaacctcgtctgtactctttctcatacctgacatccaatccattagcaaatttggtcagcgttgccttaaaaatatatcttgactctgaaatgtgtctcttcactgccaccattaccaccctagtccagtctactctcatttctgacctggactataatcatgaacttttaattggtctttgtgctttcacctttgtggtcgcctccagtctcttcccacagagcagccagagttatccctctgaagtgtgagtaaagtctcattactcatcagctcaaaaccctctgtattagttagggctctccagagagacagagcaatgggatatatatagatgtagatacatgagaggggacttacgaggagaattggttcatgttattatagaggctaagttccactatagacggtctgcaaactggaggccctgggatgccagcagtgtgactcagtccaagtctgaaagccttagaactagggaagacaatggtgtaattgtcagtccaaggctgaagccctgtgaacctggaatggctgctgatatacatgctggaatatcctaagaccagagagtctgggattctgatgtccaaaggcaggaggagaagagtgtatccagctccaggagagagaatgagagacaaattcccttttcctaggatcgtgttctatctgggccctcagccagttggatggtgcccacccacatggagggcagatcttcccgacttagtccactgagactcacatgccaatctgctctagaaacatcctcgaagacacaccccaaaataatgttttgccacttctctgggtattccttaatccagtcaagtcgacactctaaattaaccttcacgtcctccgataaaagtctgacacatgttacttcatggatgataccttgaagacattaaccttcaaaactaagtgaaataagccagacatcaaaggataaatagtatatgagtccacttaaatgaaatacctagaatagtcaaacttatagaggcagaaagtaacatagtatttaccaggggctgcctggaggggagaatgggagttactgttgaattggtacaaagcttcattttgggatgacgaaaaagttctggagatggatagtggttacagttgcataataatgtgcttaatggcactaaactgaacaccgtatacttaaaataattaaaatggtaaatttggccaggcacggtggctcacgcctgtaatcccagcactttgggaggccgaggtgggcggatcacaaggtcaagagatggagagcatcctggccaacatggtgaaaccccgtctctaccaaaaatacaaaaattagctggatgtggtggcacatgcctatagtcccagctactcaagaggttgaggtaggagaatggcttgaacccgggaggcggaggttgcagtgagccgccgagatcgcgccactgcactccagcctggtgacagagtgagactctgtcaaaaaaaaaaatttaaaaaaaggtaaatttaaagttatatatatattatcaaaatttaaaaacaaaaaattctgtaatggctttccatctcactcagggtcaaatccaaagtcctcacaaaggccttttaggccctgcatccttggacctctgccacccctcaacctcctcttccaccactctttgcccctaccataccactctgctgcagccacactgaccttgcgattccccagacaagtcaaggacactcccgctcaaacatgcctagcactgtcctgccttaggccttttcattggctgttctttctgcctgaagtatttttccccctagaagtttgcatgcttatctcttttactttatttagttctctactcaaaagtcactgttagagcagtcattccatagctaacatagcacctcataacccctccattgttcacaatcccttacccagatttatgctttaaagcacttatcacagactgactcttttttccattcactcagttattgtcacattctccccattagaatgtaagctctctgagaacaaggatgttgtttgttccactgatagatcctagtttcctagaaccatacctagcatacagtaggcactcaataagtatttttcttgaatgaataaatgaatgaatgacattcttagcaagtgccaaaagatagtatctgtattagtctgttcttgtgttactataaatacctgaggctgggcaatttatgaagaaaagaggtttagttctgcaggatgtacaggaagtatggtgccagcatctgctcagcttccagtgaggcctcaaagagcttttactcatggcagaaggcaaagaaggagcaggcacatcacatagtgagagagggagcaagagcggtggcggggtataggagatgccaagctctttaaacaatcagttctcatgtcaactaccagagagagaactcactcattatcatggggatggcaccaaaccatccatgagggatcagcccccatgatccaatacctcctaccagaccccactttcaacactggggattacatttcaacataagatctggaagggacaagcatccaagccatatcagtaacccaaaagactgtttaggtaactgcctaatttctggataagtaaaaataattctcttggaagaggcatgctgaacccagttgcttttgtattttgttttggggttttgtttcttttactaattctgaaaaacatgttcatgacaaaaacacagctaataccaaaaagtaaagaaaaaaataaaggacactcaattccacaattactactgtagatatcagaaggttttattcaagttttttaatgtatattcattcttcttagcctgagggctcataaaagcagagcctgaggcaaggattacagcactgatactttaattgggaagtgcaagcacagggttgaaaggagaagagaaaaggccaggcgagacaaggaaagatgcaaacatgattgtgggatgttgattttcaaccctacttcagaactgggaagaaaaggatgggaataagggaaatcaaaatgccacaaaactcactgcttttattgaaattcagctatttttcttgaatcaacattctctggtcaatgctgacaattgtgctagctttcttcttgttgctttcatggtggagagaatttttggagatccttactcttccatttttctctgacataactcacacagttttatgcatttttttattacacatgagcattttccatatccttaagtattctccaaaaagatagaggttaatggatgtatattatcgatatttatttaatcattcttctatattgaacttttacattatcttctagttttctccttatagataataccttgatacatattctttgaccatatcttggattactttcttgtgctaaattgatagcaatggaactacttactgaattaaagactatgaacatttttaagctgtctgagttaggtagtaatagaaagttaggttgattacagaggagatctaccaaaaaaacaacaaaaaagtaaactgcaagtaatagaaaaactaacaactaggatttattacttacataaccaagaaatatgaaggaagatagggagatataatcaagaaattagactttttatttttttgctccaacttcttcagaatgttgacttttcatccaggtacttatttgcctcttggcagcaaatgtctcccagcatcacactgtcacacaaaattcaggaagacaggggtatatgaagccaggacagtgagagaggctctttacataccactctttaggaaggaaaatgtttaccagaaaccccccacaggagaattctcctcagggcttatttccaagtactgagtcttgtggtcatcattaactgttgggtaggctaggtaaacaagtatctggtcttttccacattcaatagtgaaattagacaagatttgatataggtgttgaattggaactgtattagatagcaaaagccacaacagtgctgtgtaacaaaccatcccagaacttaggtgtaaaaaacagtaagcatttatttcatgttcacagtttggattaattgaagcctgtctgatctatgttgggtttggctagccttgtctgtgggagggctcaggtctgttctatgtgtgatcattattgggttttttttttaatttactttttaaatgtttacaatttaataaatctcttcattgcagacatgtatggctgtttggtagtattcagaaacatcacagcaatggcagtttttccaattggtgtgtagtcctcaataattatatataaaattgctgtcaaatcagtaagactgcatttatgcatgcatcattttcaggattgttagtaacctgggcataatttccccaaataactttgcctccttgcatcacaaggcccaattcgctcatatttacttcaatgacagtacctttggtaataacatcgaaagttgtatacagtggggacaaggggctcttctttacaccaagtattcgtaggcaaaaggtggctttcatttcaggatgtgttacatgggctttcttgaaatgcaagcccattggcctgatgaatctttcatatttaggtggttttcttgtaaacccatctccaacaaagcagactttagtaaccatcctcttccatgccttcttctttctctttcctgttcgaataacttttaatacttctgtttctccctgggcacgtactttaggcagagggacttcccattttcccactttctcttttcgtttctgtttaatcctattggaaagtactttagctcgagattgttcctctctgtccagcagataggcaggtactgctccctgtggagtcttttcatcattcttttgtttgatgtttctcttttcatgcatcttgatagtcttttcatttgtattttctcagcatggcgctgtttatggtaaagcttagccttcagaccaatcattttctttcccttctttgaacattcatgagcctctcgactttccttctttccctttttctcatggtaatccaaatggtatccatagtgtttacagtgtaattcaatatattcgttctgtggcatggtgacagccacagagctgccaggagcagtccctggggtgcgaaaacgctctccatttttgggtctcagagacccacgagcccacgccgcacaggccgggacaggaaagcattattggttttgtttttactttttattttaaaacaaaatataaataaagaaaacagctgggtatggtggctcacacctgtaatcctagctacttgggaggctgaggcaggagaatcgcttgaaccccagaggtggaggttgcagtgagctcagatagcaacactgcactccagcctgggtgacagaacaagactctgtctcaaaaagaaaaagaaagagaagaaaaaagaaaaaaaaaaaagagagagagagagacagtgtctccctctgttgcccaggctggagtgcaggaacacaatcatagctcactataacctcaaactcataggctcatgtgatcctctcctcttggcctcccaagtaggtgggactacaggtgcacaccactatatccagttatttttatttttttatagggatggggtctccctatgctgctcaggctggtctcgaactctgagctcaaacaatcctcccacctcagccttccaaataattaagattacaggtgtgagccaccacacctggcctccgtcatctgctagtggttacccagtagtatagtttatataggaaagtcaggataacgcccaattcctttcctttatttatccattttttgaaataatgaattaattgttatccttcaaaggagaccaattttttattactatgaattcagaaatgtaaatatattcgatgtatttcagttcattccaattcttgtccttattgaagctaaaattgtctgatttgtggccactaggaatctcttcaagttgacgcctgagtcattttgaaatgaccctagtagttgatagagtccttgctatctggtattacaaaatgttctaggttaagtttgtactttttttggtttgttttttgtttttttgggtttttctttttttttttttttttgagacagagtctcactctgtcacccaagctggagtgtaatggcatgatctcagctcgctgcagcctctgcctcctgggttcaagcgattctcctgcctcaacctcctgggtagctgggactacaggtgcgcaccactacgcccagctaattttcatatttttagtagagacagggtttcaccatgttggcaaggtgggtctcgaactcctgacttaagtgatcctcccgccttggcctcccaaagtgctgggattacaagcgtgagccaccatgcccagcctagtttgtacttttttttgccacaggtttggaatcagtcatttatccaagaagctctggttttcttttagtgaaaagtgtaatttctttatcacaagctgggctccagggatgccctatgttacttggtagacttgtcaatatatgggggctattttagtaaacagaactagagaatatattttgaaggtaaaaaacatttcatgacttgacagcgatatttctaattcacactcaagtctacagtgctatgccttaacattttttttgtttgtgtttcttatagagagagtgtctcgctatgttgccctggctggtcttgaactcctgagctcaaataatcctctcgcctcagcctcccaaagtggtagaattacaggcatgagccaccatgcctgggcccttaacttcttttatattgtctctgcaactccttcttccacaccaagaatcctggttctggttcttagaacaggagaagtgatggaatattccataactgctcatttactttatcctacattatatacagaagagtttcaaaataacaatacttacaataaccattacaaattatgactactgacatttttttaaactttttcataccttattcccactcttgcctcattttttaaagttatactcgatctacattgtcaaggcacataatcatcacatattattctttccctttttactctcatttagtcttcatctacaagtacctatatatttaatacttaccatcagtccttataccagagactgtctagtcactttggttgtctaaagcttattctgtaacaggttcctcaggaagtacgcataggaacaatattccctgagtttttgcatgttcataacagcttctctgtgccctttatacttaaagagttatatgtctttccttgagagtcctaagtgtgctattccattttcttctgacaccaaaagtctaataataatcaaaaagtctaataaaaatcttccttcccttataacctcatgttgtttttgcctagatacttaaagattttttttcctttttctttaaaatccagaaattttactagaatatgtcttagtattggtcattcaggttcactattctcatatggaagtccccttccatcctcccttcttctttctttctttccttctttccttccttccttccttccttcctttccttcctctctctctctctctctctctctctctctctttctctttctttcttgataaaatctcactctgttgcccaggctggagtgcagtggcatgatcttggctcactgcaacctctgcctcccaggttcaagcaattctcctgcctcagcctcccaagtagctgagattacaggcatgcaccaccacactcagctaattttcatatctttaggagagatggggtttcaccatgttggccaggtgggctcaaactcttgacctcagaagattcacctgccttggcctcccaaagtgctaggattccaggcgtgagccaccgcgcccagcccatagtctcttttaatacgtaccttcaaatctattttatttaaaatttctttcttgaattataacacttaatatttgattttcttgctttggttttcttattcagacacttttgttatccacatgttggttctttgcctatattcattcaatagctgtattgttcctcaatctttctctctctcttaggttctttttgattttttaaatattttccttacttttaccttctgtttctcttaaggcattgtctcctatgtttatttactgggtcccttatagttgagtcttcatttattttatttttatatttttcttgagttctgtcacttcacttctgagttttcctaattctgattatgttgttctttcatgttttgtatcattttcttaatgtcttccagcttattttgaaatagagcattatagttgcatttttctttttaaagcaaatctttctgatctgctttcattacctgtagggatattattttgctctattctcattttccttacaataactttgcatgaggtttgaccgcaatactttattgttgcttatttttatatggatttaggtttcttgagcttttagattgaggctttgttcagaataactgttacaactttacaaaattacctattctgctgtgtttcatgtagtgcaaaaaaaaaaaaaaaagcagcttgctttataaggtttcctggagattctcatcacttttgtctaccttctttccttcatctctgtaatgcctattctgttcaattttaattctagtcccagtagtatctttagggaacaaacctgtcctaaaagagattcctacctggtgggttttgagagttcacaggggccggacttctccatacctttcagacctcactgaagggctccccactgctctcaccagcaaattggaataggcaaaaccgtttcagctactcttccaaaattggcctgctgagccttccagtgaatacctgtagtatattttaggggtttcctgttctcaggtttgttaaatgcctcattactctcctctgctttctcctgcccagatgaggatgccatgcaggtcttgtgactatcaattatttattcttgcctgcttctattttcagggttcaaagggataccttctcatttggtttggttggaaatgtctgcagatttttggttttgctatgagcttgttccggctatttttatgtgagaattaggaaagtttcaagagcaattctgccaccaccattccaacttcccaaacccacgttttcactctagagcccatgttgaaggggcaggactacataggggaagctctttttgtggtaaagggagaaatgcaacagaacaaacttgacaccagaggatgtttaaacctctgtgtgcagcacacatttgttaactttccactggccaaaaacagccacaaggccaaccaccacatcaatatgcaagaaaatagactcttcttctagtgggaggaactacaaaatcatgaaaacagcacggatataggcagcaacaaggaattgagaataatgattcagtactccacaccaaccaactgcatctgccccaaagccattttctaagtcttgctaaattattttccagaaatggtttgttaattagacttccacccatacataagagagtgcccttcattactgaacattttttaattgctaatttaaactgttaatttaataagtaaaaaatatcttagtgtcatttaatgtttaaattgcacctctttttttttgtgtgagctttaatacttttacattcacttattagttatttgtctttcttccttaatgacttgactgcttatgtcttttattcatttcattgtggcagttggtgtttttccttttaatttacaagacttcatttcatattaaagattttcatctttattgttcctatttcttacacatatttactccaatttgtcatttctcttttgtatcatttttctaattctgcataacaaatccccttaaaacttagtgttctaaacaacaacaaaaaagttactattgcttacaagtcaatggagcagcaggccatatctgataacttggatcaggcttggctgatctcagctgggctcattcacgtgcgtgggtcagctagtgccatggctggggaaaggttggtctaagatggtctcactcacacgctggctgttggcttgctgtccactggtgcaatggggattagtggaccctgttactaccataccttttgattgaatttgtgttgtttttggtatacatttaaaattttgatatattcaaatttgtcattttttcctatgtgatttctttatcgtttttatatttgtaaaattctttcccagtccccaaggtctgataaatatgtacttaagttttcttttacgatttcattcttttatatttcattcttttatctcttatacctctcttttatccatcagaaattgagggatgtgaagcataagagagaaaaagtggtatcttttcctcacccattgctaggttcatggctgacactctcataacaaaagatgcattaacaagagagaagcataatttttttttttttttttttttttgagatagggtctcactctgtcacccaggcttaagtgcagtgacgagatcatggctcactgaagcctccacctactgggctcaagcaatcttcccacctcagcctcccaagtagctgggactacaggtatgtgccaccgcatccagcaaatttttgtttctgtttttgagacaaggtgttgctctgttgcccaggctgaagtgcagtggtataatcttggctcactgcaacctccacctcctgggttcaagtgattttcctgcttcagcctcccaagtagctgggattataggcacaagccaccacgcccagctaccttttttgtatttttagtagagacagagtttcaacatgccggccaagctggtctcaaactcctgacctcaagtgatccacccaccttggcctctcaaagtgctgggattacagcacgtgagccaccacgcttggccaaatttttgtatttttttttttttttatagagacagagttttgccattttatccaggatggtcttgaactcctgggctcaagcgatcctcccatctcagcctcccaaagtgatgggattacaggcatgagccactatacacagccagcagaacatatttatttaatataaatgttatgtaacacaggagccttcagaaataaaaacctgaagaattaggaatatttgtgtatttgtatggacagtcgtgcagaagtatgattggaggacaatctaatggtaaaaaactggggagggccaggcacagtggctcacacctgtaatcccagcactctgggaggccgaggcgggtggattacctgaggtcaggtgttcaagaccagcctggtcaacatggtgaaaccccgtctctactaataatacaaaaattagccaggcatagtggtgcatgcctgtaatcccagctacttgggaggttgaggaaggagaattgcttgaacccaggaggcggagttcacccagttgcagtgagccgagatcgcgccattgcattccagcctgggcaacaaggagaaactccatccaaaataacccgctcccccgctccccacaaaaaaactggggagaatttagcatgatccatttgttcagattcttcttggcaccccactgtgacatttcttccctctgggtatagggcaagacacctgccacatgaaggtcttcggggagaagggagggagaaagtcaaagagtgacttttctcggttttatggcctgcttcacggaaaaagggttgaggggagttctagtttctgtggccttgcttcaggagagagggggcgggggaaggtcagagagaccttgctactgtgatttttttcaatttccttcagcttaaaaaatactcagtatgccaaggtgtcatattttggggtattgtgttttgagcctcatcagaaacgggaatttaaatggctgtttttccacatgtagttaaccaattattcaagcactgtttatggaatactttgccttttctcatgaattcgagatatcatcttcatcacagagtgaattatgattcatccttgggtctgttctggactcctgcctttgtcccatggatgtgtctatctatgggttcttgtactgcctaaatctatagtcaaggagtggcaggaactcagggttgaggtgagattatcaccattatgactacaatttaagttcgtttgtatagcccttctgaagcccagagctcaagctgagtgctgaaagttcaggagggaggccaggcgaggtggctcacgcctataatcccagaagtttgggaggccgaggcgggcagatcacctgagctaagagtcccagactagcctgggcaacactacgaaaccccatctccaccaaaaatacaaaaacatggctgggcgtggtggcatgcacctgtggtcccagctactcaggaggctgaggtgggaggatcacttgagcctgggaggcagaggttgcagtgagctgagatcacaccactgcactcctgcctgggtgacagagtgagacctcatctcaaaaaaaaggaaggaaggaaggaaggaaggaaggaaggcaggcaggcaggcaggcagacatggtcgaggtagaggtggagagtgggggtgaggagaggtgtcagaggttgggagtcggtattgatccagacgtctcagggggcagaagtctctgagcagaggaagggcacttaagatgaatattctaacccaatacttgtgtgggagcagaagaacgaactacaattacaaatttgatgaaaagagaaactcttggctttccccaccattatctgaggtacccaagacacttctgcaagactgaagtcccaaagaaccatgtgatcatcccacacacataggaactaactgtgcagtgtaaaaaggcaggcttgtagtctttcacccgtggcagaacatatatttattgattcacctttgagtaacaggtttagtaaagattgtcaattctctgggaagataaacatgaagtaatttttttaccccaataaaatcaatcaattatgctctgtggaacctctctttcccactgggtagcaggctccattagctacatatatcccagtctgattctacaacttttcattttagttatcacaacagtttctctccagttattaagattcaactctgttcaatgtaaaatttcattcttatattggattcaaagctttcctcctcgcctctagtgcagactagactcatggctttaaaagatttgggagtggcggggtggagacatggtctacttctctcccacccgattcttgcctgtgctttcccctgtagctttgggggaaaaggaagaaaagagaaagttgaatatgttcttttgtgattgcctatggcagaattgttggtctccatggcttagcaagtggtccccaagacttgccctggcactaaatgcccaagcagctcccaggggtcccttgggacatgtggccttcctcttccagctgaccccagctgatggcctcgtgcaacatctctccaatgcctacttctctttgcccaacacgtgaccatcctctgccaagtccccagctccaaaacctgagcctgtgggcagactgatacattctttgtaccttttagcaaccaggagcttgagagaataattctactcatacctcacatcatcccattacatttccattttatagaaacttccttctgaccccagtgccagcttcctatagatctcagagctgtcgatggcccctgactccacatactagtgtgggctcttgatgatccaaatgtccccaacatagaagtcatattatatgtactccggccagttgagttatgaagcatttgtctcaccctaagatcttaagattcaatcgagatatgaagtcacctctctaaggccacccaccaaatcagcaccatgttcaaattagaatgtaaagtgtcagaatctatgagcaggtttttttccattgggctaggattgcttaggcttctaggaaaacaggagctaagtccctgggctttggggtcagatggctctgtctgaggcctggttgaaccacttcctagctgggtaaatgttgttgttgctgttgttgttgtgtgagagagagagtctcactctgttgcccaggctggagtgtagtggctcgatctcagctcactgcaaccactgcctcgcaggttcaagcgattctcctgcctcagcctcccgaatagctgggattataggtatgcaccaccatacccagctaatttttgtatttttagtagagacagggtttcaccatgttgcctaggctgatctcgaactcctggcctcaagtgatctgcctgcctcagcctctcaaagtgctgggattacaggtgtgagccactatgcccagctcacctagctgggtaattttgaacaactttcttagcccctcatagtttcagtttcctcaactgtaaaatatggataataataatagcatctactttacagaatcgttttattgcctagatgagattctacaagggaagccccagtgtctggtgcctaaggagttctcatgaatggtagttattgttctaaaaaagagagcatcctcaggctactgataattcaaatctgtccaaatgtcgctgcctcgcagatggttgaattgtgtgtcgttggggttaattcccaagcaacgtacccagtgtgctctgttgcctccacctctgtggggactgtcccactcaggggctgggacggcatgggggcagatgtgaggagaagcttctacagctactgtgtgtgcataatcacattaatttgcaaaaaattaaaaataaaatagaaaataaattggctgggtgcagtggctcacacctataatcccaatgcttgggaggctggggccagaaagttgcttgatccaaggagttcaagaccagcctgggaaacatagtgagaccctgtctctaccaaaaaaaaaaaaaaaaagaaaaaaaattagccaagtgtggtggtgtgcacctgtagtcctcgttactggggaggctgaggtgggagcctgcagtgagttatgatcgtgccactgcactcctgcctgggcaacagagcaagaccctgtctcaaaaataataataataaggctgagcacagtggctcacacctgtaatctcagcactttgggaggccaaggggggtggatcacctgaggtcaggagttggagacaagcctggccaacatgataaaaccctgtctctactaaaaatacaaaaatgagcaaggtgaggtggtgtgctcctgtagtcccagctactggggaggctgaggcaggagaatcgtttgaacccaggaggcagaggttgcagtgagccgagtttgcgccactgcactccacccagcctgggcaacagagtgagactccctctcaaaaaaataaataaataaggccaggtgcagtggctcacgcctgtaatcccagcactttgggaggccgaggcaggtggatcacaaggtcaggagatcgagaccatcctggctaacacggtgaaacccggttctactaaaaatacaaaaaattagctgggcgtggtggcaggcgcctgtagtcccagctactcaggaggctgaggcaggagaatggcgtgaacccgggaggcgaagcttgcagtgagtcaagatcgtgccactgcactccagcctgggcgacagagcgagactccacctcaaaaaaataaataaataaataaataaataaataagaataataaagaaaaaaagaaaaaacaagtgaacttttttttaatgttttccagctgcagaggccatgtactagaaaactcttgaaatattattcagtgtttctcaatacttaagctgactgccttctgacaaattgccaagtagtggtcagaatttaattcacaccaaaagagaacacaaagattatgagacaattgaccctataaaaatgcattcgtggcatgctctttagtcactttgcatctgctctcaacccaccctccagggctcttatgtcacacttatttccagataaatggcccaattagaaacctattggctaaggttgtactaaaggcaatgaccctgcacaccagaatctcgtccttcttaacatcacccttaagccaaagcacagtggcgtgtgcattctcattcctggacaaactctgccccctggcgctgactcacacacttgcgcaccggcgaggagggtctcctttgttaggtttcctcatgggacagggatagaagagcctgtcacccccacctgccgtctccccaaacccctaattgccatcagtctgctccacacagataatccaccaaaaggctccgagtttgtttctgctccgtgtatttgaaatgagtctaccacatcaatctcattctgtgttaaaaagtgtttctcagcagatgagtagggataaaatctccatgggagaaagtgaaggagatgcctgatctgtccagggcttcccgggtcagtggcgcttcggccagaagccaggcagcaggccttgggcaggtggctggaccccttctgtgccacggtatctttgtctgtgagatgaggggggcagtccccaccatactgtgtttacacaatagagggagaatttaggtggtgactgtgctgtagtaaaaagaacagagggtgtggaaataggggatttgggtctaaactctggctccaggccagatgcagtggctcacactataatcccagcactttgggaggctgaggcaggaggatcgcttgagcccaggagtttgagaccagcctggacaacacagtgagacctcatctctacaaaaaatacaaaattaggtgggcgtggtggtgcctgcctgtagtcccagcgactcaggaggctgaggtgggaggatcacttgagcctgggaggcagaagttgtggtgagccatgatcgtgccactgccctccagcctgggtgacagactccctctcaaaataaatacataagtaagtacaataaataaattaattaattaattaatttcagctctagctgtggaaccttggactagaaattcactgttctcactgttctctagaaattcaccattcccttgagtttcctatcttataaaatgggatagtgacttgccctgctagtcactttctcgagaagagacacctccaactgcagcgggtgtggcgcagcctttccctccaggctccaggagcccctgcctcccaatcggaaggagagttgtttcagatgaatattcctaggttttagcccaggaggttgagtcagaatcctgcctcagaggcgtggcaggagaaacaaaataatgaacccccaaaggtgtccatgtcccggttcccagaacctgcaaatatgtgaccttgcatgggaaaagggcctaacagatgcgactaaattaagaatcttaagatggggggattatcctcgattaccccggtgggcccactggatcatgggggtcctaacaaagggaagagggaggcaggagaggcggagatgtgatgaggagaagggattggagggaaacaccacgcactgaggatgaaggtggccttgaacgctggaaaaggcgaggaagagatcctcccccagagcctccaggaggaactcagagctgccaacacctcactcccagccctgcaagacccactttaggacttctgacctctaaagctgtagatgattaatccgtgttgttttaagccactaagtttgtaattatttgtttcagcagctctgggaagccaatatggcgccatggaggggctcctagatctgcatttttgagtgactcctggtagaattgttaggcatgctaaattttgagggctagaggtgtagtaggaagagactgaggaacaggaggtctgtatttctagccctggcgtcatgagctatgtgacttcggcaaagtcactgcctcattcactgggcctcagattcactgtctgtaagctgaggcagttggctacagggggcagaggggaagagatctctggctgcagtattctgagaagctgagagaaaacagtgaagctctttgaaaacagtgaagtctggccagtgtagatcttaggactgggatttcctagaagaaagagatactggtaattcttttaacagctcatttttatacctctcttcctgtgtgccaggtcttggtctaaacccttcccttccatgaactcctgtctgtgaggtcatcttggcacagcaatcagtcttctatgcgatgaataattaactgctctgaggagatgatttcaaatcgggagtcagatcaataagctactaaggggggatgggcgggtgggcaccatcttcagctaatgaagggggcgattccctgtctccgctatgaaaagaaaaatgtcacagacattacatgccgcctgaggggtatggatagaagggggaaggggctgcggttgccaggcaaccggctcatcactaatcatgcgcgtaaaagccttgggcctctgttatgagcacagctagtgggccaccctccttctctccgccccctgcttgacagctggccttgggttctggttccagacacttagaccctgaaacaggcccaggtccccctcagtatccccgggtcgattctgttgctagaaagcaaactgggagagcaaagactctttgtgtccactccagacgacaaaggtctggcacccatattccaggacactctttcctacaccatggccttttgaatgagctgtcaccccagaggcttacttagatttgaggaaaatcccttcctgacccctccattcaagggaggctcttgctgtttgccgtgtggatactgagcaaacacgtgggtccccaggctggctcttgatgtgctctgtaaacactcctctctggatacagccaactgtccaattatgcaggagtcaacccgcttcccctggggatttgttgtcttaaagaacgaggacccactgtgactagaaagttgacatagcacatgtcacacagagaaagtgcacccccggtggaagccggggttccctgggggcccagccgtctttccaaacagaagggcagaaggctgtttgatctgtgaccacttctggaacatataggctcaggaacagccaatattagaagagatgtttgcatctgtttccttccaagacacacaggctctctaagagaaaggaggatggcttttgtgctacggggacaagcgctatgtttgggacgtggtactagaattgtcaaagggctgccttgtcccagaaagttatttcagagagaagtcattacacccattggctaaaaagagacaggcatcactgagaatgttggatgtcccaacccatttctcttctacagttcacaccacccccagcaggcccaggcagcctgcactgtgcccgagaacagttgatgcagggacacattccagcgccggcctcagtccctttccctctccctgcttcagccgcactggcttcctcactcttcctcaatcatacctatgtcagctctttgcacttgctgtgtcctggatacttgcacccctgatatctggatgacacgagactttccctggccaccaccccatgtaaataatagatacgccaaccccatttaccctttccatgtgccatttttaactttcttcaagcactgcacctctttttctttctgtgtagcggactgtttgtccatctatcttacttgtttattgcctgtttcattctctagggtgtaagttccaggagggcaggacacttgtctgctctattaactgctgcacccctggcacctgccactgtgctcggcacaaggccagccctcaactagcatttgctgagttgattaggattcctgtgatccactctgtaccaggaagacactgggctctttcttacatcctcacacccagagcctctctctggaggcagtggatgtcatgagtttccgatagatccttacagatacttcatgcttattcagaaagatacacacacagctacattcttcctatcttttttttttttttttttttttttgaggcagagtcttgctctgtcacccagcctggagggcagtgcaacaatctcagctcactgcagcctctgcctcctgggttaaagtgattctcctgtctcagcctcccaagcagctgggattataggcacccgccaccacacctggctaatttttgtatttttagtacacaggggattttgccatgttggccaggctggtcttgaactcctgacctcaggtgatctgcctgcctcggcctcccaaagtgctgggattacaggcatgagccaccgtgcccagccccacctgttctttttaaagcgtagtgtactttatatatcttctatatattgctgttttcacttgtatatcttgaagattatttcatgtccatttaaacaaagctcccccattcttctctatggctgagtaatattccaatatatggatatctagtaatttatttacttggccactctagatggacatgtaggctatctcccatcttttgttattacagagtgttggaaacaatcttgtatatacatgtcatgtcattcatatgtgaccatacccataaaatacattctaagaagttaaactgctgcatcaaagggtatatgcacttataatatgaatagaaattgacaaattgctctccacagaaattgtatctctaccactaccagtgatttttaaattttttatttttgaggcagggtctcgctctgtcacccaggctggagtgcagcagtgtgattatagctcactgcagcctcaaactcctgggctcaagggatcctcctacctcaacctcccgagtagctgggactacagctgtgcaccccaatgcctggctaattatttttatttttttattttttattttttgtagagagggggtttcactatgttgcccagggtggtcttgaactcctaggctcaggcaatcctcctgcctcagcctctcaaagcttttggattacaggcttgagccaccgtgccaagccccaccaacaatttatgagacactttgtttccatacatccttatcaaactttcttttatctttgccagttgaaaagtgatattgcggccagacgtggtggctcatgcctgtaatcccagcactttgggaggccgaggtgggcggatcacctgaggtcagcagttcgagaccagcttgggcaacatggtgaaactccatctctactaaaaatacaaaaaatgagccaggtgtggtgacaggcacctgtaatcccaggtacttgagggggctgaggcaggagaattacttgaacccaggaggcagaggttgtagtgaactgagattgtgccactgtactccagcctgggtgacacagcaagactttgtctcaaaaaaaaaaaaaaaaagtgatattgcagagtaattttatttttcattttcttactcaaagatttaatatttttacctatatctaggaggcatttctatttcctttcttatgaactacctaattttctattagattttgggtttaaaaaatcaatttataggagtgctgatacattaggaaaattattttttggctatgagttacacatgttttccctatgtgtcatttgtccttgcataaaaatcattagatgttttctgcctcatagtttttttagtctaatgtattcatctgtgtatgtatgtatgcatgtggaactgccacttttaaatttgctttttaaatactttatcatatgtcattatccttttagctgtattattggaaagtgcatttttttattagttacatttaaattggtgcttcctggatggggtttgagtatacactctcaactcttgatgaattgaggggctaccttattccttgaggactcttgtgagatctgggaggcacccaacctgtgattaccctcatccatttgatgctggctcttaaaaatctcagttacagagagtgacatgtttttgactctttttcaggattctggaacataccacctgttttagtctttaatcatctctccactcattacaggtgcagaaggttgaagcagctggaaacatctgttcccagagaaaaggagcccctctctcctgtcactctccatgacaggaacccatcatgcagtatcaacctcaacgagcctgtcctcccacactcagcttttcacatcctccatcctcagtgtccccacctgtctccctctctacctgcttgccatgattcctcggctctcagcccctgttctagggaggctggccacctacatctcttcactgtagcctgcgtatgggagctattccagttagtggggcctgaataatggggtgctcttttaaagacaatgaatgcaaaattgcaggccaggcccagtggcgcatgcttgtaatctcagcacttcgggaggcctaggtgggaggatcccttgaatcaggagttggaaaacagcctgggcaacatagcaagaccatctctacaaaataaataaatacataaagcaggcatggtggtgcacacctagctacttgggaggctgaggtgggagcatgtcctagctacttgggaggctgaggtgggagggtcatttgagcccaggagcttgaggctgcagtgagctataattgtaccactacatgtagcctgtgtgacacagtgagacctcaactcttaaaaaaaaattatgaatacaaaattaaatatcaaaatgaatagaattagaaaatacattataacaggccgggcgtggtggctcatgcctgtaatcccagcactttgggagaccgaggcgggtggatcacgaggtcaggagatcgagaccatcctggctaacacagtgaaaccccatctctactaaaaatacaaaaaaattaaccgagcatggtggggggcacctgtagtcccaactactcgggaggctgaagcaggagaatggcgtgaacccgggaggcggagcttgcagtgagccgagattgcaccactgcactccagcctgggcgacagagcaagactctgtctcaaaaaaaaaaaaaaaattaaaacaaatcacaaagcttaaaagcccgcaaataccagaaaaatacaaaatatagaaaaataatatgagtttgtgttaatgaattatctgacacacttctacagacttttttcattcctttttggatgcatgctctttgactgtctcttcatgtgacaagaagtttgaaataccattatccataaagggaatagaaagagatttcaggctgttttctagcatggttgatagtttagaaaagtttattttagcttcacaatctgttattggtaatgtcttgctaagacatagtccaatacattaggatataggaatcacgcaattttacacaaaaacatactcactatttgctttaattctgtgggtttattatcaggttccacagaaatcctaataaatttaaatttgtacaatttccatcaaaaaatgaaaaaaaaatgtataatgtgtctagatagctttatctagtatattccagacaggaaagaatttcaattctgaccagaaataaagaatccaactgtccattttacaagtttgatgattgtaagaatttttcaacagactggcctttggccccgttcatttccaacttgtttctcatccattccccatgtgtttctggtggccagcactgtggggcacattcatactccaatatgacctcttgccctgcaccttcttgttatgaggctggatgggtcagtgcagaaagagcagagcttttctctctttttttgagacggagtttcactccgtcgcccaggctggagtgcagtggcacaatctcatttcactacaacctccacctcctgggttcaagcaattctcctgcctcagcctcccgagtacctgggattacaggtgcctgtcaccacacccggctcattttttgtatttttagtagagatggggtttcaccatgttggccaggctggtctcgaactcctgacctcaggtaatccacctgtcttggcctcccaaagcactgggattacaggcgtgagccactgcgtccagccgagaaagagcttttctaaaaaccatatctataccccaccaactagcaaacttaacaaaatgactataaatatatcctatttaacacaaattaaacatgtcctcgacttgatttcttcatagctgtttttttaaatgcacatgttcacttcagggctaggtatggggaagatttaatagagtcccctctattgaaatggaaggaggctgatgtggtcttaatattttgttttattttattgtattttatatttggggaatggggtatcactatgttgcccaggctgttctcaaactcctgggctcaagcattcctcccacctcagcctcctgagtagctgggaccacaggtacacaccactgtacctggctagttgtggtcctaataattgcaactaatatatcttctaaaaattctgcaaagtgtatgaacacgactcccatctagggccttagagggactcacataaggtagtagccctgaagctcaagcttcattaggttcaagataactcatctctgcttctgctgtctccgcactcccgtactgtctaggcttcattcaaaatagctgctgtatatgtcaagatgattttgatctgcagggacagaaacccaactgaaccaaaacaactggaggatatactgacccctaaactgctggctttgggaacaattggaaccgatgataaaaatgccaccagaactatttccttcttgctacacctcagtttccatctccacaaatgcagatgaaaacttcaaccttacaggaggctggacctctgccagtccctgactcaaatcgcactgctttgccactccagggaaacccctccaagggccacattggccagtgtgggccatgtgaacactctcatggggggctctgagggacagcgcccactaggtcttcaaggttggagtggggaagaaggaagatgtgctgtggtcaaaagaacaatcccttccctgtccctgcccaagatgtccatgtcctaatccctgggattttgcaaacttgattaagaatcttgaggctgggcgtgttggctcatgcttgtaatcccagcactttggaaggctgaggcaggcagatcacctgaggttgggagcttgagaccaacctgaccaatgtggagaaactccatctcttctaaaaatataaaattagccaggcatggtgggtaattttgtgcctacaggctaattacacacctgtaatcccagctactcagaaagctgaggcaggagaatcacttgaacccaggaagtggaggttacagtgagccaaaatcacgccattgtactccagcctgggtaacaagagggaaactccgtctcaaaaaaaaaaaaaaaatcttgaaatgggcagatgatcctggattatctgggtgggcttaatataatcacaaggatcctgacaaaaaagaggcaggaggccaggcgtggtgatgtgcacctatagtcccagagctttgggaggccaaggcaagaggatcgctggagcccagcagttccaggctgcagtaggttataatcacaccactgtactccagcctggatgacagggtgagaccctgtctctgttcaaaaaacaaaaagacagaagaaagtcagagacagaggagacataaagatgaatgtgaaggtcagatcatgtggggccatgagccaaggaacatgggcagcctctataaactggaaaaggcaaagcgctagatccctcctgcagcctccagaaggattgtagctctgccagtgcttcattttagaacttccagaactggaaaaaaatgaatttgtgttgttaaaaccaatacatttgtggcaatttgttataatagcaacaagaaatggatacaggtgctaagaagatagcaaaatgcatgcccactgtaccttctctctcctccttcctggtcctatctatctgttatgggctgaattgtgtccttccaaaattcacatgttgaagtcctaacctccagtacttgggaatatgatactgtttggagatagagtctttaaagaggtgattaaggtaaaatgaggtcatagaggtgagccctaattcaatatgactggtatccttgtaagaacaggagattaggatgcagacaggtacaggcgaagaccatgtgaggccacagcaagaaggtggcccccaacaagccaaggagagagccctccaaagaaatcaacctgccgacactgatctcaaacttctaacctgcagaattgtgagaaaatcaatttctgttgtttaagccagctagtctgtggtgttccttatggcaaccctagcaaactaatacatgatccttcaaggcagaggtgaaaatctgcctcctttctcaaactgcctttgatcagcctgctcccagagcagccattgtctcagaatacctagtggccaagagtttaacccaaggatcacaaactcaaatgcctataggggccaggaagaactaacatgagtgaagtgcttgactataagaaactgtatttgccaattgatatggtttggatccgtgtccctacccaaacctcatgttcaattgtaatccccagagttggaggtggggcctggtgggaggtgattggattataggggtggatccttcacgaagggtttagtaccaacccttgggtgctgttctcgtgatagagttctcatgagaattggttattctcaacaggttatttactggttgtgtaaccagttacatgagaactggctagcacttacccacctctctctcttgctccttctcccaccatgagatgcctcactccgcccccttcatcttctgccatgattgtaagttccctgaggcctcccaggagctgatgccgtcatgcttcctgtacagcctgcagaaccatgatccagttaaacctctttttaaaataaaaataaattacccagtctcaggtatttctttacagcagtgtgagaatggactaatctaccaattaaacataatcagtatacactatcacaaaaatgacattcactccctatctccctgtctgcttttagttttgccacattttatcaaggatgaatacaaggaaaatcctctcttcctgaccgttcagtggggaaaagtggcagtgctggggtgagaggcacctgcttttattttttgtgttaaggaacctacaggagaggtgcgagctgagctggaaattgcaggccctgccctgtgccaaggggcagttgctacttagctctagccaactgttaccagggacaaggacaggccagaccagccagagttttccaatttttcaaaaaaactgaaaatatacatttttaaagtgaaatttgattttaagacattgataactaattttttaaaaattaactgtgttggccacctcacatccattacaacggctactagtaaaaaacaaaaccaaacaaaaacaaaatagaaaataagtgttggtgaggatgtagagaaattggagcgctgttggtgggaatggaaaacggtgcagctgctgtagaaaacagtatggcagttcctcaaacatttaaaaatagaattagcatatgatccagcaattccacttctgggtatatactcaaaagaactgaaagcagagtcttgaagatatatttgtacacccatattcatagcagcattattcatgagagctaaaatgcggatgcaacccaagtgtccattgacaaatgaatagataagcaaaatgtgacacacatatatatatatcacatgatggaatattatttagccttacgaggagggaaatgctgatatatgcaacacagatgaatcctcaggacattctgctaaatgaaataagtcagtaatagaaggataaattactgttcgattccattcgtatgagctgcaatacttagtcaaaaccacagagacagtgaaatggtggttgccaggaagtgggtggggggcaagaatggggaattagtgattaatgggtacaaagtttcagattcgcaagatgaaaaaagttctaggctgggtgcagtggctcacgcctgtaatcccagcactttgggaggccgaggtgggtagatcacctgaggtcaggagtttgagaccagcctggccaacatggtgaaacctcatgtccactaaaaatacaaaaaattatctgggcacagtggcaggtgcctgtagtcccagctacttgggaggctgagacaggagaatcgcttgaacctgggaggcggaggttgcagtgagccgagatcgcgccactgcactccagcctgggtgacagagtgagactccatcttaaaaaaaaaaaaaaattatgaaaaaagttctggaggtagacggtggggatggctgcacaccaatatgaatgtacttagtgccactgaatttcacacttaaaaatggttgaaatagtaaatttaatgttatatgtattttaccagaattttaaaaattggaaaatgacaactgagctggctaagattgttattttgaaacaagacacattttttaaggcctagcttcagctcatagtccaccagtttgcaacctctgttttaacacttccttgttttctagtcatttcatgtgttcatgtcttacccaactagaaggtaaaattccctggaagtaggaactgtgtcttaaccttctttggtatctttcaaagtgggtacttggagctttgcagtgggcaaatcacagttgccctgctgaatactggatgatacccacacactcataactaattattagacactgccatgctgtacacagagctgtggccacatgggattaattgtaacatttcaagaataagaagagagcttttgaagtacaaaaagaaattcattctgactagcaggtggggatggtgtgtcaggagagacgagggtgaagagggcagggagacgggaaaggggccttataggccacaagaaggggaaatgggaaattgccacaggctgtaagcagagggtgacgagattggattggattttgagataaatcataaaaactagagcctggaacgcccctgctaagagattcaggaaaatggtaaatgccgcttggcaacagctctccagggccacatgtgaacacaaacacacttgtttgtgttcagcgaatgaggaggttggggacatagggaagaactaggggaactcggggggcttcaacaagaggagtgaggcaaatgcacacccccttcagagcaggggctgtgtgcgcacgtgtgtatgttgcgtgtgtgcagttagagtgggggtgattcttaggtgggtctaggcaagctgacaccctaagttgcagaccatgggcagcagatggaggcgacgctaaagtccagccatcagaccctccgtgctcccctggaacacctgtaggaaaccctgagaactccaactttaaagggatccaagacactgtagccagcacagtaacccgtggcaacccctagaggttgctataacctcagcaatggggagcgttataccgaaggaacctgccggttccccagacacaaaaatggctgaaccttggtgatcacagcacatgaccaggaaccgccaatacactcatggaactgtcccgctgacaatgtctagagggaaaatgccctgtcctctaacacccttctctgagggggaaaaaagccacattagaagaagtgatatgaccaaaagacaagctttctccaaaggccaatggccttggaatgtttattaagtgttttgtctgtttgctcaagtgctatccttcaacaccgggactagaaacaatttcttcagaaataactaaccagccacaattagtaaaacttcataaagcctggagaatactgtcatcagaagagctacatttggggcagtctggggaagggtgaagtgtgaggatggggaccattatctccagaggtctagtgattaagaactgggtgactctggacagctggtcccagggactttgcacttgtggtggaggctgaattcgtcattcccaatccggatgctatgcaatcatcgtcaagtactccaatccatctgcatgtctgaatatggatggggatgctctgcactgtccccatcggccgctgggtcctccactctctctctgctctggatctctggatctcatctttctacttcctctgcaggtggcatcatggggactgtctggtgactcccctaagcaaccagcatcagacactagaaacttccagtcaagtctcctggtccctgattccaaccagacgaccacatcttcaccccaggatggactttagacctcagcagcagagacagccatacttcctgtgtgacactggggcaaccacgtttctcacaggcccccaggtggggctgagatgagagcaggccatctgaaggtgcacaaaataggcaggatgggatggaggccaagaacatcccagtgaaatgggtgctcccaatttgcatttgggaaagaagggctcccacctttcccaagccctgcatttcacatattttgcccctattctactctacactcaacccccaactctctgagttccactccacatgaccccgcccccatcttaacttgctgtgtcctcaccctactccacagatccctgcctcccgtgcctttgctccaggtgaggccatacacttggcggaggcctatttgctgtggccattttgacccagggaatgtctgatgtgaccatttgaaaacactctccacaaaattgctcgaaacactgttttatattaaaaattcaaagcaggcctaagtgaaaaagacaaacaagggacaagggatgtgggcctgatgactactgaatgtactacttagtaacaataattaaaaactaaatatttaatagtttggctttccccccagctacctaaaaaaaagcaaacaaacaaaaaaactgcctctcagactaaaatagctgcttcaagagcgccacatcaacatgtgataagtttgctcacattgttaccttcatcttcctactccctgtgtcaattacaaatggcttatgatgcaactaatggccattatcaaaggcataaggaaagacatttaagacttcacatcacaagaagtctccagacagatgattcccagcattgactcaactgctcaacggggctcacagagacccagctcctgtccggctttcttctgccatccttagctgcttggcttttagttctcattctcatcacttcatggttgcaagatggctgccacggttccacgcatcacatcttcacacaaggcaggaaaaaagggaaaggggcagtagttaaaaggctgttagagtgctaggtttcctgtttaagatagcgtcccccatggcagcgcaggcctggaagcttctgcaagccctagcgctgctgccccgcttcctggtggccaggtcccgggcagttcaattaacctccagaagatggctgagcctgcaggaatgccagagcaagaaactgatgtctgataacagagtgacagttcaaagattctttgtagcagacactgcgaatgaagctcttgaggccgctaagagactaaatgcaaaagaaattgttttaaaagcccagatcttagctggaggaagaggaaaaggtgtcttcaatagtggtttgaaaagaggtgttcatttaacaaaagaccctaatgttgtgggacagctggctaaacagatgattgggtacaatctagcgacaaaacaaactccaaaagaaggtgtgaaagttaacaaggtgatggttgctgaagccttggacatttccagagaaacctacctggcaattctgatggaccagtcctgcaatggccccatgctggtgggcagcccccaggagggcatcgacattgaagaggtggctgcttcaaacccagagctcatttttaaggagcaaattgacatttttgaaggaataaaggacagccaagctcagcggatggcagaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaatgcagaattccaacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtaggaagccagccagcttcttggatcttggaggtggtgtaaaggaagctcaagtatatcaagcattcacattgcccacagctgatcctaaggttgaagccatccttgtcaatatttttggtggtatcgtcaactgtgccatcattgccaatgggatcaccaaagcctgccaggagctagaactcaaggtgccccttgtggtttggcttgaaggaaccaacgtccaagaggcccaggaaatactcaacagcagactccccattacttcagccgttgacctggaggatgcagccaagaaggctgtggccagtgtggccaagaagtgatgtctttgtcctgatccgatggagaaacaaagccatttttccataaaaagggatggttcatcattgtgaaagaaatggttatctcgttggggaggaaaagggggggtgaaggcaagaatcactgaaaaatcttaaatctgtgttttctggaataagctatctagacagcctaaatctgattttagtctttataaaaataatatctcgtattctcatacttttctgtcactgtaagcctgcccagtaggcagtgttttgcagactttggggagcggtctatgtgaccaaatattgtgtgtatagacagaatttgaaatcgggtcctgcttcatttacaagaattttggtgggcatctaatcctacataatgaaaaagaagaacagaccatttaaaaactcagacaagattatatttaatatattaattactaaaaaggcacaagattacactgaacattagctactaaaaaggcactgccaagacattcaaacaaatagctattacacactgcagcagattttacaggtttctaattccaacatatgtttgaaaaatccatgagtgttccaaaatatacttaataatggaaggtctgcattaatataccatccatgtgtttttaccatttggtttaatattgaatatactgtttacctcacactaaaaataaaaccagaaaccttatttgtgactttggagtggaagcttccatttttgggtcaaaaatgaatcctgattcttatggaaatctctgttattaagtcatttcaagatgagacaacactgaagatcaaattgtgttgggtatcagtatcttctctcctcgtttatctcttacacctcatcctcccaggatctaccagttgatggtagaaagatgggaaccttatctgaatgttttttttttccatgatgtccaattttgttgtgggaaaggatttggataaagtttttgtttaaattttggtagatttttatctatacaagtttaaataaaattatgttttgtaagttgtaaaagaaaaaaaaaaggctgttagaactgtcctgggaagaactggaccagaactagtgcagctgcggttgagatggagagatgatgattttgagatgtatttagaaggtagaattgacatgggttgatggtggtaatgacaaggaagatggttctgaggtttctagcttgggtggtggtggtgccttttaatggaaataaagagtacagaaagagcagacttggtgtaagggaaaaaacaatgaccttggtgttttcgtttgaggttctctaggaacatcctgaaccaatattatataagaaatttaaaatatagatccactgcttataaaagaggtagatgctactagctatgtaactgtagtagtatttgccacacaggcggcagctgggtccacagagggtgtgtaggaaggacggggagccacagaaccctgaagagtggtggagaggtacacggagacctggagagaaaacaccctaagggattaagcttcaaagaacaggaagaggtctccagtgttgaccaatctagaaaccaagtaaggccaggctgtgaaatgcatgcactggttttggcaattaggtggtcgatgacctcattggatgcaattcttgggagggaggtactgattctagtttacagtggtttgaggaaacttaggcagtaaggaagtggagacgttcaggaaatgtgctggagggatggacatgtgaccaagttctggctcaagagtcataaagttggtctttcgggggcacttctagaagagattttcctctctgtaaaagggaaggagagcctgtctagcatgtttttctgtgtgaggatgtgatgcctggatccagggcagccatcttgtggccaggaggggagacattactgatagacggaggccagtagagcaagagcaagaggacggctgagcatggtccttggccttcactgagctaataaatcaaccctgcagccacctgcctcccaacttctttttaggtgagaaaaataaaccctcggccgggtgcggtggctcatgcctataatcccagcactgtgggaggccgaggtgggtggattacctgaggtcaggagttcgagaccagcctggccaacatggtgaaaccccgtctctactgaaaatacaaaaattagccgggtgtggtggtgggcacctgtaatcccagctactcgggagcctgaggcaggagaattgcttgaacccgggaggtggaggttgcagtgatctgagatcgtgccactgcactccagcctgggcgacaagagtgaaactccgtctcaaaaaataaaaataaaaataaacctctgttgcttcagccactttagctctgcttgtaactggaatgtcaaggacacagctcattaggtgtgatgaaaatgaactctactgttgctcccattggccctggaaactcttcagtggggtgatattcccctactggatgaaaactctggcaggtccatgacttttgtcctcaccctcaggtaacagataacccaaagtcactttccctagccaacagatttgcagttgtggaatcagaatagtacaagatgaataaaagcctgaatctgattttgcatcgtgtctccgttccatcaccaggcctgtctcaggcccacagcctgaagtgtaaagaggccatggctggtgtttctttctttttctgcctcatgcttcttctccttccacccaacgctcacccctacgaggctgctagggtgtgcttgatcccttagggccagggcgtgggaaagacaaccggtagagtctttcctaagtgggtactgctaaaagccagctggggtctctgttgtgacccaactgatttttttctcacggatacttctgcaggctcttaggagattgctactccgggattccctgcaggtctcttgaggggatgcatctgtcctggggtctcctccctcagcctcacaggggtgctgtgcccacttcccactttcttctgaggggatcccctgccctcattggactagcagcatttctctcctgagtgctgcatgccagagccggagaagcactcagcatcacagtggctgcctccagcataggcctcctgtctggcagccacaggtctcgatagctctctcacttgtcagtcaagaagtaggtctcaatgctctgtctgagacctgccttaagttgagggcagtaaaacctccatcctgggcacctcagaagaaatctgaagaaaaaaaacagttgaagaatcttctctttcccctctctcaatcctgaaaagggtgaggagttcaggaacacagggagaggccctcaaacctgcgctttggaaattctacctatagtgacttggctttgaaatgttatcttctgtgttttagcatcttgggcaaaactggtttaatcacccacctctggaatgcttttttttttttttttttttttttttttttttgagacagagtctcattctgtcccccaggttggagcacagtggcacgatctcaacacattgcaacctctgcctcccgggttctagcaatttttgtgcctcaacctcccaagtatctggaattataggcatgagccaccatgcctggctaatttttttttttttttttttttttggtagagacggtgtttcaacatgttggccagcccggtcttgaactcctgacctcagatgattcaccagcctcagcctccgaaagtgctgggattacaggcgtgagccagcgcacccggccttggaatgcttattattgagaaaaataaacctctattgttttagccagttttggctcaacattctattactagccaccaaaagcagctgaactgcttcactgtgctgggttggcttcatgactcccctggcacaataaagacaaagcccatcatttatgatagtaaaaaactgcagatacccaacaacaggagatgaaaccaatgaaacacatacatgatggaaaattgtgcaggcacttcaagtgacaacttataggaaaaagttcatattttgctagattatatacatgcagagcaaaaagactaagaggaaatatgtaagaaaggtaaaattcaatttggttgagaaatggagtaaacatatattatatatgcatagaaaatagctggaagaatacacaatacacagatatcaacagttgcatctggggaggggtcttggggatctgggtgggaaggaaggttacttctgaatttttcaaccatgtgcacatattcttttttttttttttttttttttttttttttttttgagatggagtctcactctgtcgcccaggctggagtgcaatggtgcaatctcagctcactgcaaactccgcctcctgggttaaagcaattctcaagcctcagcctccccgagcagctgggattacaggtgcgggccaccatgcctggccaatttttatatttttagcagagacaaggtttcgccacgttggccaggctgttctcaaactcctgacctcgtgattcgcctgcctcggcctcacaaagtgccgggattccaggcgtgagccaccgtgcccggcatgtgcatatattcttttctcaactgaggaaagtagtagtttcgtgggtagggttgggtggtgaaggttgtttttgtttaagttcaacgtttttggagggaaagggataataatggttttctctaggtggaagaattaatgcggatttttatctttctctgtctcttctatatttccccaaatgtctccaagtcattttgtattactaaaataatcaggaaaaaacccacaataaaatgctcttcctttccttgttccctttccttccagaataattcagttttaaagccattagcagttagttgaacagagtaaggcagggacccatggtgggaggggctggtagcctagagcagggtggccgagctcaggcatggggaggaggacacaggggagggggtacccggcagagtcatcaatccagaagggtggaagagggcttccttgaatgggcagcctggagcatgtgtcaaagccagagagggtggcagggaggtacatgcactggggccaccagcaaggttgtcttagatccaagtagggcgaggcagtcagcactgttagtacccaaccatcacccacatggtggagatgtgggcagcagagatgggaaatttgttatacagagggagtggagaaaatgagtaaatatgttagagacaatggaagtccgtgctttcactgtaggagaaagaagttacaaatatggaaaggagagcttgaataaacccagaggtgttgattggtattggaggtattagtgcgcactcatgattttcaatatagacatagatgcagaaatcagcagagatttaaatttttatataaatgcatataagtatataaataaatacagacattgtcttagtcagctcaggttactatcacaaaatacactagattgggtggcttacacaacagacatgtattgcccatagttctggagactgggaagtccgagatcaagatgctggctagggccctcttcctggcttgctccctaccttcacactgtgtccttacatcatgggacagaaagagagaatgagaaagagagactgctgctctttttttttttttttttttgagacgaagtcttgctctgttgcccaggctggagtgcagtggtgcaatcttggctcacagcaatttctgcctcccaggttcaagcgattctcctgtctcagcctcccgagtagctgggattataggcatgtgccatcatgcccagctaattttttgtatttttagtagagacgcggtttcaccatttggccaggctggtcttgaactcctgacctcaagtgatccacttgccttggtctcccagagtgttgggattacaggtgtgagccacctcgcccagccatgccctctcttcttataaggccactaatgccatcatgaagaccccaccctaataacctaatttaaccttgattaccttccacaagccccatttctaaatactatcacaattgggactagggcttcaacatatgaattttgggggactcaaagattcagtccataacagatgtctatgtatgtacctgtatcattacatactatacacacatacatatatccatatacaaaatgtattccctaccctgtctactatgacgacctgggagtggtgatgccctaatagcagagcaaacctagaatccagatcttggctttaaaatgcagttttccaccaaatgcaacccaggctccttacaagaacggtcagttctaggtctagggcaaggaaagtacaacatgagcctggagcacgtgcttgctcaaagaataatgaggacatggcaaaaggacacaaaacattgcttaaatgagttcccacagctgtacagggttcaacttgttattaaaatgaataataatcatggattacaaccctttgaataaaataggaaacagtgattccatactaatattagcaaatagatgaataaattgaaagtttggtgagaaatgggaggtacaacatacttctccactaaatcctcattaattactcatggggacaaaacatctttacagtgaaggggcctagaagacaccttaattatcaaagcaaaatcatcaataatgggacaaatggaaactgagctctatgtgacaggatgcaatgagaacagtatcatttctgtgatgttctggccaaagatggataacttgagtttaatcacaaagaaacaccagattgtgggacattatacaaaatgactggcctataatcttcaaaagtgccatgatcatgaaagtcaaggaaagatgggaggaattctttcattcaggagacaaaagagataactaaaggtaacctgtaattctgaactaggtcattttgctgcaaaggcaattattgggacaattggtgaaacttgagtggggtctaaggactggatgtcagtaagacatctatttaccttcctgattctgacagctgtattatggttttgaaggagagcgtctttatctgtaggaattacacgttagagtaactgcatgtgaccggatatcaggttggcaactgatggttactctcaggtggttcaggaaaaatataattctttgtacagaacatccaacttttcactaagtttatgatcagttcaaaatttttaaaaatttaaacaaataaattgatttacatatagaactgaacatctctaaatatatagtaaacgttattacatattatatttttatttatgcattaataatgtataaatataaagtactaaaacctgggagcagatctcaacttccttatgcccaatgggaatcttcaagcccctgaagttccaaagaggttccaaagagagcgagccaggccttgggaggctgcataactataactgaaggctgggtccctctctataccttctgaccatcctattctgagaagatggctttcaaacatcctagaaaactcaaaatcagaaattctaaatttctaatattctgtccctgggctctctattctgttccattggtctatctgtctgttgttacggaaggatcatgctgttttgtttaccacagttttatatatattttgaaatcaggtaatgtgatacctccagctttcttctttctgttcaagattgctttgactatttgtggtcttttgggatcccatatatatttcataagtgtttttttatttatgtgaagaatgtcatagatattttgattggtatttcattgaatctgtagattgctttgagtagtatggacattttaacaataataattattccaatccatgaacatgggatatctttccacttatttgtgtcttgttcaatctcattcatcagtggtttctagttttcagtgtacagatctttcacctccttaagtttattcccaagtattttaatttttggtagctattgtaaatggaattttcttaatttctgtttcagataatttgctgttagtgtacagaaacactgctaattgtatagtgttctcataaatcactgaaatcccagaaattctgctaattcaggatcccaaaggcatgccacagattgtttcatgtccctggaagtgacttgatggtttggcatcagacagaggagggtttgatttccaattctaccatttctgtaccatttctcaccctttcagcaccattgcctcttgttccttcatgtgtcaagtaagaagatgacagtagcttcttcttagggctgcagtgtagatgaagtgagataatatgtaaagccccttagccctctgcctggaaaatgacatattccatgaagaggaacttgttccctttatcatttagaagttctttgtaagtcatatttccctgttttgactccagaaatgtggtcataatttcaataaaagtggaaagtacctaaagtcagcctgggctgggctctgaggtgtgctctttttttagccagggtggacttcagactccagcaaattttatgagattagctttatagcccagagttcctcctagtgtggggtgaggagagaatgggaagggcatggtgaggtaaaggtcagtatcagggaaactgaagtcaaagaaagctgttcagaagtggcagcattctagttagatatctttatccctttgcatcgggggggtttttggaaggttgtagtaaacccaaccataatcaacactatttattgaacaccagctgtctaggtacggcagataagaaaaagacacactcccagtccaccaagtgctcacaatctaggggcaaaggaaaatagccccagtagatatcttttttttttttttttctttttgagatggagtctcacagtgttgtccaggctggagtgcagtggcaccatcccagctcactgcaacctctgtctcccaggttcaagcgattctcctgcctcagcctcaagagtagcttggattataggtgcctgccaccacacctggctaattttttttttaaatagagatggggtttcaccatgttggccaggttgatctcaaactcctgacctcaagtgatccactcgccttggcctcccaaagtgctaggattacaggtgtgagccactgtgcccagccagatatttcattctcacagtacctgggctgctttgctcattgcattgattaaacaccacctacatatgtgcctgacacttggcaaggtcctgtgggaggacgagatgagtgaaagagcaagggcatgctctggtcacaaggaactcactgtttacttcaggagcagacataaaagaaacacttctcaataactaggaaaaaggtatttagacagcatttctttacagaatacagagtcaggaggagaagaacatgagggctttgcagagctgacatctgaaagggtcttgaaggagaagaaatgtgattgcaggcagaggaggtgtttgtgtgtcacctaagggcatgaaatagcaaggtgggctcagggcttgaggcgtagagcatgcaatgggggtggggggtgggagatgaggctggggcattgcatggacttcagtacactgggaacctagtgggcttcactcagaaattcagacacgaccctctgggcaagagaagccactgaaaattttaagaagtggaataagatgatctgatttgcattttagatcacacaggtagtttacatggtggatgcattgggtatgggcaaaactgaagacccgggaccacataggagactgttacaactctcctggggggaaataatggtgccctgaaccaaggtaggaaagagtaaggtggacaagttttgggtgtctttagaaggtagagtttgacacgattagatggcactggttagaaagagggggaatggctttaagatttctagcttgggtgggtgaataaatggatggtgttggtgcctttatggaatgaggtagtgtagatagagcagatttgaagtaagggcaaaaaaatgaggttggttttatattttgaggtgctctaaggatgtctatgtagagatgaaggggaaatagaaatatggtctgtggctcagaaaagaggcaggtactcactacatagaggcagtggaattagtcttagagatgatggctgaatcacggggagtctgtgcaaagggggtgagatggagataatgcagccaaagaagactagagggtggtcaagaggtggcaagagaaccagagagcggcatcaaggaaatacccaacaggctgggcgcagtgactcacgcctgtaatcccagcactttgggaggctgaggtggacagatcacttgaggtcaggagttcaagaccagcctggccaacatggcaaaaccccatctctactaaaaatacagaaattagcggggcgtggtggcgcgcctataatcccagccacttgggaggctgaggcaggagaattgtttgaaccagggaggcagaggctgcagtgagccccactgtactccagcctgggtgacagagttagactccatcaaaaaaaaaaaaaaaaagagagagaaagaaagagagaaagagggagggagagagagagacagagagagagagagacagagagaaagaaagaaagagagagaaagaaagaaagaaagaaagaaagaaagaaagaaagaaagaaagaaagaaagaaagaagagagagagaaagaaaaagagagagagaaagaaagggagaaaagaaagaagatatccaagggaagcaaaatgtttcagatgggagggagcaccgcaaagggaaatgactagaagtttagtaaaaacacaggctgtgaagcatgcaccagaagtgcaaatgggtcctcggtgaccccattgagagaagttttaggggagtgctgggggctgacactagtttttagtggattaagaaatcctgggagagaggagtagagactattcttttaagaaacgtgatagtgacagggaagagaaggaatagtgagctgaggaaatgcaggatcataaaagtgggtttaggacagcagcagctggacatctgtgtatgctgaaatgaacccactggaaaacaggtgctgatgaaggaggtgccggctctcagaagaggcaggaggcccaggtgggagtctgtcttggacagaggcctggagtggtatgaaggaggggtgagccgaggggagagctgaggcctgatgaagtggggaccctagccctctgcagaagggaagctattcggcaagggggtgccagggaaggcagcggcttcctcagcacttgctgcgggaagaaacactgaagtcccaggcttccaggtaatgctgttttcatcagcagagccccgctggcctgagctggaattctgactgagcaggtgacatgggcaagggccgggggtgaggcacagagtctgctgcggaagcatctgcggggtgcagtagccagtagaggcggccccgtgtatgcctcggggctgggcgtcccgcagagggggttactcactgctgactcagccccaggtgctcatttgcatgttactcatttcaagccaaaaacactggagcaggagtacaggagcatctcatcccctttccaaacagaaccaccccaggtcttcccagcgctcctgctgctgtgccgagtctctctgacccagaaatatttctactttggaagagtctactaagctgtgctgtatagctatctgtgaaattgagctgaaaaattcaaagaaacactcagaaaattcattttctctgtaaggatatcaaggtaagtttaacatgccaagagcctgggccttcccccttccaaatattatcttattttcacctgacttctcccccaccagaatgtaacctccaagaggatagtaacattgttttgtactctgtgcccagaacagtgcacggcatgtagcaggtgctcaataaatggattaaattctgtaatcccagcactttgggaggccgaggtgggcagatcacttgaggccaggagtttgagaccagcctggccaacgtggtgcaacctcgtctttattaaaaatacaaaaaattagccgggcatggtggtgcctgcctgtggtcccagctactcaggaggctgaggcaggagaatagcttgaacctgggaggcggaggttgcatgagcagagattgtgccactgcactccagcctgggcaacagagcgagactctgtctcacataaataaactaattaattaatgcattaaattattgaaggcccttgggcaccccaggccttcaataatttaatgcatttattgagcatctacgatctcatctaacccctataatcctaggcagttaacagtttaggaaggggagattctcagaggtgaaacaccacccctcccatcccctcatcctcatttaatcaaattgccagtaaggggaaagcccccgagtttcgagctgggcttcccacatgtcatggagttcagaaatgcctctatcagtttatcaggtgctcactcctgtgaaactgattcatgctaacggattcactctgacaagaatatccccgagaagagaaagcgaatgtagtgatttacattcaagcatatacagctgccaaggagctgaaacgttctgccctgtcggacagctcagtctgtccccagtagaaagagttcactgaggctgccaagcagtcgccagcttggcttggagcctgcacagagtcgatagcctcagggaggccatgaacaagctctgtgaaccagaaacccagaagaccgagtgcagctggccaggcaggatccccgcctgctctagggacacagctgccactctccagctcacccagagagccagccaccggccccctgcaaccctctaccttctcttttgagaatgattgcttattgactgaatgggtcacctccattccctctcattcatggtttccatggactttcctttttcttttctttttttttttttttttttgagacagagtctcactctgttgcccaggctggagtgtagtggcgtgatcttggctcactgcaacctcttcctcccgggttcaagcgattcccccgcctcagcctctggagtagctgggaatacaggtgcgcgccaccatgcccagtaattttttgttgttgttgtatatttattagagatggagtttcatcatgttggccaggctggtctcgaactcctgacctcaagtgatccacccgcctcggcctcccaaagtgttgggattacaggcgtgagccactgtgcccggcctccatggattttcttagtcaattgtttgttgttgacaaggcatagcaggaagtcaccttgcaattctgaccatgtttggggacagccacctttctgaatccaagcatgtctttgggtctctgcttgcttaagccactgtgtgtggggatgtataaacttctacctgtggcctaagttttggggtcttacagttcactgttcccgggagctacaagacctgggcatcaaaacacagaataaatatgatgaaggaagagaattcaaaaccactttgggaggaaacccctggtagaaggctaggctagcactgttgcttgtgacattgacagtccaagaatcagagaaggatccaggcctccaagagcttctttggcaaatggggtcccttactgctagtacagaccagaaagtacatgactttattttatttctactactcagtggcttattttaaagcacaacgggaaaaaaaaaaaaaaggaaaagagaaaaaaagaaatccaattctcaatgcctaagccagagcggagtaaccaccaacaaaacagctgttaacatggctgacgcatgttcctgttaactgctttagtcaagttaaaggcctggcaagggagagattctggctggcttagcaaggagagagatttctgaggtagccaccacagatggtagcagatgtcacgcagcctcagagcagaagccaccagagacttcactgtcttggagctgagcaaaaaagctgagaaacactcagccacgtcaacagccaattacacacctcaagaatctcaggaagccagggagtgtgtaaaagtttctataattaattgctttccattctctttatccacaaatctgtcagctcatggctcttcaaaaatcaaggatgctagcttcaggtatctctgccctcaccttgtatggccagcagcatgaagatggaaatgcacaatttgtaaccacattattgattgctatagtcctaggattaaaagtgatccctgactgacaagaagccagttgttcaattccttctattatagtgtagggtagcggtcacccgtaaaggctagagtcacacaagcttggggatcccccagtacctgctgcctgatgctgctcactattttccctctctgaacctcagtttcttcatctacgaagcagaaataatagtgcctgtcttgttgggtgttggaatgattatatttgatagtgcaagtaaagcacctggcacagtacattgtacacagtaaatgtcaaagaatgccaggtatcatcccaaatctatgaatgcccagaaaggtgctgtttggtattgccatgttccttacatgacccacaaatttctacatctcataatcatacctatttagaaaataactctgtatgtggggctgcagatattcatagatttaattgcaaattttaaaaggctattattgttattaagactttaagttactttgtcaaatggtgactatggacctcctcaaatgtacaagataacttcttttttttttaattcttttttttttttttttttttttgagatggcaggggggttctcactatgttgcctaggctggtcttgaactcctgggctcaagcaatcctcccaccttggcctcccaaagtgctgggattacaggcatgagccacagcacccggcccaaaataatttcttacattagaaatccggtggggcatggctgctcatgcctgtaatcccaaaactttgggaggccaaggtgggagaatcacttgagcccaggagttcaagaccagcctgcacaacaaagtgagatcctgtctatacaaaaaataaaataattagctgggtatggtagcactcgcctgtagtcccagctatttgggaggctgaggcgggaggatcacttgagcctgggagatgaaggctgcaatgagctataatggcaccactgcactccaacctgggtaacaaaatgagaccctgtctcaaaaaagaaaaaatccatacattactcaaaactggtaaatactgctttattctatagcactatgcttaatgaagcttgaaaccaactaacataacttttccccatttctttttttttttttttttttttttcagggaaacacagaattggtaaggtgttttccctaatgcaacatttaggaatatgctgggctggacacatatttcattcaatcacttccattgtctgtattcatcctcagacatcaaatgacaaaagtgtgcaaaataacagttgttccccataagatttccaaatattcagctatgctccattttccagggcacagaatgggctactgtagttaagaatttttctatcatctgagagttctagttagtctgtctgtacagggtgagtgaccaaagtagaaaactggtcaggacatgaagtgaagagggctaaaaaggcaagatgagaaaaacagagtcgtgaattcttcaccagccaagacctcacgaaaggctcgtgtgtctgggcttccatcccacccgctgatagaggcagtcccctctcagccgcggcgctgcttctgtggtttcagttacccgcagcccaccaagatccaaatatagcaaatgaaaaattccagaaataggccgggcgcagtggctcatgcctgtaatcccagcactttgggaggccaagtcgggtggatcacctgaggtcaggagttcaagagcagcctggacaacatggtgaaaccccgtctctactaaaaatacaaaaactagccagacggagaggtgcatgccagtaatcccagctacttgggaggctgaggcaggggaaccgcttgaacccgggacgcggagtttgtagtgagctgaaatcgcaccactgcactccagcctgggtgacagagttgtctcaaaaaaaaaagaaaagaaaagaaaggaaaaattccagaaataaacaattggtaagttttcaactgtgcgccattctgatctggcagtatcctgtactgtcgcaactgggacctgaatcctccctttgtccagtgtatttatactgtagaccaagcttgtccaacccacagcccatgggatgcatgcggcccaggacggctctgaatgcagcccaatgcaaatttgtaaactttcttaacacattatgaggttttttgtgattttgttttagcttatcagctgtcgtgttagtgtattttatgcgtggcccaagacaattcttcttccaatatggccccgggaagccaaagaattggacacccctgtagacgcttcccgactgtgagtcacttagcagctgtcttggttataagatcaactgcttctgctcaagtaatttttattttactttactacagtacatggtcataatcactctattttattattagtcattaatctcttactgtgcctcatttataaactttatcatatgtatgtataagaaaaatggtgtatacagggctcagttctatctgaggtttcaggcatcccctgaggataaagggggaatattgtaggaatagcgttggtatctgtactactggactggttcataggagttcacacactgtgaaatcaagtgcattgtagacaccaaagccccagacaaactggagacagtgcactaaaccgactgctggagtcaggcgtctgctccctcctgtgctgctgccctgtgccccccccggattggcattgcccttggtgtctcattccagcttatgaaggctgtgctttgtcctcgccatcacttcccctttttcaacacaaggacatgtttgctagcatcttagcatgactgtgaataaactactcttccttctgccggggctcaagcaatgggccacacatcaccaacttcctacgatatatagaagacttgagattcatttaaaaattgactacagcgggagaggaggatgaatagatggagcacaggggatttttagggaagggcaactattctgtgtgatactgtaatgggggatacatgtagtcatacatttgtccaaacccacagaatgacaacaccatgaaccctaaactatgaactttggataatgatgtgtgtcaatgcaggtttatcaactgtaacaagtgcaccattctggtgggaaatatcgctaatgtggaggggaagctatgcctgtctaggggcaggggttataagggaaatctctgtaccttctgctcaattttgctgtgaacctgaaagtgccctaaaaaataaaatctattaaaaaaattggtcacacacacacatttgctactgagatgggctccaacaaatgtgaaaatttaagaaatctacctctttatttaacaccaaagctaacatcaagtgtttatttaaaaaaataatggcacctgctttggattcattgatgacaccacaatggggtgaagatctacagggaatttacaattttaggctgacatgaaactaagtagtaactcacaaaatggaaattctgcaacaagcctcacaataaacatttccagtttctactttcagagttgctaactactgcctaaacatatcttaaacacagagcacgttttgttgaaatatttctcttaggacaaacacagtagacatgctttaaataaattaaaattgcaacacataaatcattcctaaaacaatcaaggtgcattactttctagcttcttataaattaaactgtactgatttcaggaaactataggttagttctgtttcatatcttttttttttagcatcttatctagttttgatgtgaataagccaatttcattctttgcagtgatttatctttttaaaccaactcgttcctttgtgcatgtgctaaccttaaaacacctcttcatataagccctgaattttaagtggtgccatttcttcctacccccagcccactcctcagaattacagaaatatgtaaaataggttgtttaatcacacatgttcatatgaataaatatatttaaatgtttttccaaaccaatacaactatatctggattcactgcaaaaacattcccattcaatgcaaaataatttggtacaatccgaccaaaaaagacaaaagtaattagttgcctgagggaagctagttcctcattattactgagcccataattaaacctgatatgctagagaaatggcaaggcaataaacacagagtggggcaatatttaaatgaaaacaagagtgacagagctggaaagagcgaaaaccacatgaatgctaattgacagagaaggataacagcctcaccggctgaaatgaaagacggagtttcggaagatttccttctgtgaatagctgacaaggatcacgcaggcaaaaatgctaccgttccaagctacaaacttgggactaatcccatgttcattgtccaaacccagcaacggagtacttttttgctgtttcattatggatttccattttttttttttttttttggcagttgggggtggggtgttctggtttaatcatattcagagtttgagcttgaaataaccaactcaagacccacaggagactatgtcaccagataaacccagtgctagaatccaatgtccagcatcttcaaccactcaggagtgtttgctgagagaccaggtggtgcttacccacccaacaagcactttccatctttgggtttgcccaagatgtttaccataaatgaaaggggtggggaaaggattatagttgacacaaacataaattaaatatccaattccagcatatgttacagctacatcactatttttaattgtaatatttctaaaatgtcatttaatctccttacacattgaagagaacaaacagtgggagtgtttattccttaagagagaataaactgcagagattaaaagtttccttcgagtgtatcatcttattaaaaagtacaaagtttcatgaactttcaacaagactgcaaaataaatatgccaggtaggttgagcctatccaagtgaaaacaaggttatttgacatttagtgagagtcaatgaaaatatgaattatttcaaaggaattcatgatccaggtaggaggatttagatcctacggtatgttagaataaagctagtttctagcagattctgttaacagctccagactagaggggacggagtgtgctgctttccattctcttctctacttctgtcactggggagaagatacacggatcacaggtctgagaagtgtgcattaaagcacatttgctaggctgagcactggaatggtgtgggctggtgtgaaaatgaagcctacgtcttcttggaccctcccagagcccttcacctcaagggttagacatctctccttctctaaactaacagcagcactcaatccctggtgtgtccgaagtggtgcttggaaagattcacagataccaagaggggcccacccaggccccagcttgatttaggagtgtaagttacactcagcactcagcccacgctgagtctgatgcccacaggtaaagggtaatgctggccatcgaaatacaaaagctaaaggaagcacaacattctctctgcctccctgccttgcacctggcctccttatctgtctcccagacttgaaagatcagtgtatacacatcaacgcggtagaccagggggagtctgacaatgaaaggagagacagccatgagatcagggtgggactggtaagggagctcttctctgaatccaaaatactttatcaccaaagatttcatgaaatgacatttattgtttaaaaaagcgtgagtctggaattagatagtggtgatggttgaacaagtttgtgaatttactaaaaccactcaattgtacgcttaaaaaaaaaagcaagcttgagctgcctaagtcccgctcacacacactggacttgtactaaatgctcaacgattccattctctcagactatggaacattctgtcacatttttttccttcaggagatttccctaagaagagctgtttgcaaaatattgcacttaatttgaatccagggggacctgatgtctcctggaagaaaacgtacactcacatgccttcctgcctgcagcagatggcgggagtggtgggacaaggggctcaacagcagtttccatgaacattgtttccatcttcctctttgttatacacacagagacacagatttaaaggaaagtatcatctgggctgaaggcggtgaatggtatcccccaaacagggatgtgaacttttgaatgttttcagctcagaggcagtatggtcgtcctaatacctcaggacttatgttcagtgagatgttaagagacaggtggcaaccttggctcaaacactggacttaatttattttattcttgctagtctttcacttctcaaagacgatgctctcaatcttcatccaggtgaactgctcccactaatctagccaccattcagtcacaccctacgtcctcgtttcctcatgctttcagcgttccgacacctcagtgcacttgaactttagaggctatggttcggttgtccttcaaggaaaaaactgcaacatgaccatcatttgttttcatttcctgagtaagctttgcagtccctcacagacctgtgaataagatgaatcacataaagtgaatcatatcctccaggggggcttatcacaatcaagatttgccaaaaaacagccaggcatggtggcttgtgcctgcagtcccggctgcttgggaggctgaggtgggaggatcccttgaagcaaggagtttgcaaccagcctgagcaatatttagcagagccctgtctcaaaaaagaaaaaagatttgccaaaacacaaaccttcagagtagtgctcacaggattccaaattaatgttaaagtcacagtctgatgagggatttgaaaacattcctgcacactctgaaggctgggcatttgctagccagttgagacaaaatcaggtgttggttgcctgggtatgagaaggtgaaagccccattcataaatccctatgccttcccatttaaagtgtaacaaaacccctcaggtagacttgttggataacaggtgtgtgataagatttccacgttacagggtcatacacgactgactgctgtggacactgagtacatgacgggacctatggtcccctggagagaagcagggtggatcacacggggaccataggccacagtgtttaacactgcccaagcctgtgattcttcattccctgaatcatgcatatccttgctttttataggactcacagaaaacaaccattagcaattgtgaagctcaattctgacagagacttaggagagagacctctttcttcaggatcaccaattatgccaaggtctcaatatacagaggtttaccacgctgggctggtcaggtgggcaggaaatcggtctgattaaggcagtgagcaaggtaggagagctctgaaacagattcgtgttaacgaagtacaaggactgagttggcaactgctacggagttaagagaattgtagttatttacaccacacagtcctagtttttcttacacacgagtccgcacaatcattcactgtaaaatttggtagtatgcacagagttttctttaaaataaaaacttgaaagaacttgaaggcaggaaccagtggcttcatcttggtattatcatcctttctatggcacacaggatatggtcccagtttttacaaaatatagcaagaagagtcacggcaaagaaggtgccaagaatgtggcagcgactcttcatcatgggtgagacgaacttcgcgatggtggacacacacactaagatgacagtcatgaaggccaggatcacgttgatgcacctccccaggagaactttagcattcacggtgtctgtctgcagagcttgctgctcttgctggtggagctccagcttagaaatgcgagtctggcaggattccaaggcttcctgtgagcaagagggagagcaagggtcaaacggtgttgggatggtgagcaacacgtgagtgctcgctcagctgtacacaaaagccccagctcagaaagcccaatgcccaggcggctgcaaatccccaaaccgatgatgatggtgatagacaaagatgtggaacaagaatcccaggctcattttctcctgttgttcacgagtagaagagcatgtggatacaaccacaaaataccataaatgaggaagtatggctaagttttttgactttacctgttttttttgagatgtagtcttgctctgtcgccaggctggagtgcagtggtgcgatctcagctcactgcaacctccgcctcctgggttcaagcaactctcctgcctcagccccccaagtagctgggactacaggtgcgcaccaccatgtctggctaatttttgtatttttagtagagatggggtttcgccatattggcaaggaaggtctcgatctcctgacctcgtgatcggcccacctcggcctcccagaatgctgggattataggtgtgagccaccatgcccagccgacttcatcttttttttttttttttttttttgagacagagtttcactctgtcacccaggctggagtgcagtggcgtgatctcggctcactgcaacctctgccttctgggtttaagcaattctcctgcctcagcctcctgagtagctgggattacaggtgcacgccaccacgcttggctaatttttgtatttttagtagagacagggttttaccatgttggccaggctggtctcaaactcctgacctcaagtgatctgcctgccatggcctcccacagtggtggaattacaggcgtgagccaccatgcccagcctgactttacctatttttgaaataaagtgatataaaatattggtgcctgttggtgccatcagggacaaagcagagaaggagggaggttccactttgtgactactccacctttcagccaaggagtgtgtgggatctccaatggtcagtccttatttccaccgctcaaagatttttgtccatcagttagagattggcggaggaaggcgagagaagggaggggaagggactggggctgactgtggggcaactgtgctttcacctgctctctgaacgcggtgttactcaggacaccatccgaggctatctccctggatctcgtccatgccaagtcttcaattactaagacacagatggctacaagtgtatctctaggccagttcttcttctgagattgactcacagatctccatgcctctttgacatctccatcagagcttcctgaaagcacctcaaatgcaacacgtacaaatgtggcttcatgtattgcagctacccaacacctgcagtcaaccctcttcccttccagtgtccttcttctcagagtacagcaccatgatccacccagttcctcataccagaagcctaacgggcataccctgatacccttctcatccaacccgtcgcccagccacggaggcaacatccagtttctagctcaattggtccggttctctctccacccggtcagcaccccaatctaagtcaccgggatctcctgcctgcaataaccttacacgaatttccctatacactcttttgttccccacccttacgaatccattttccacacagccacccaagcggtcttttaaggatgcatatttggtatcactccttttcataaaacctttacaatctttaatatggccttctgaggccttgcaaggccaggttcagctccctctcctccctcacttaatgacttcatgccagccgcttgccctgtcacagtactctggccttttctaagttctttttttcttttaagagacagggtctcactctgttgcccaggctagggtgcaatggcacagtcagagctcacttcaacctcaacctctggtctcctgcctccattcctcctgaatgactggaattacaagtgcgagccaccacacacagctttattctaagttctgaaaaggagcacagactcacctcagggcttctgcatattcagtacactctgcctgagacatgtgcctcccccactccatcccttcttcacccgtggatctcccactcattttttaggtctcgccttgattgccacatccctggggaagcctttcctgatccatgagatgagatcaagtctcccttcagctctcctccccaaccacaagacatacgctgcctgaggacaggaactagcccatcttgcatttgctgtcctctccagcacagagccagcgccaggcatgcagcacgtgccacacactggctgaatatgaaagagacagctaggtgccagtaagagaatgtgaggcttgatgggtacagtggcgcatgcctgtaatcccagcattctgggaggccgaggcgggtggatcacttgagatcaggagttcaagaccagcctggccaatatggtgaaaccccctctttactaaaaaaaaaatacaaaaattagctgggcatggtggcatgcacctgtaataccagctactcaggaggttgaggcaggagaatcacttgaacccaggaggcggaggttgcagtgagccgagatcacgccactacactccagcccaggcaacacagtaagacggtctcaaaaaacaaaaaaaaaaaacagaatgtgaggcttgagagagaaaccttcaggcctgctgggtgaaaaggatctaactagaggtagtacaatgtgcccctctctgttctaactcatttgcccatctgtgtttgctcaattaaaatatagtcaccttttcaggttttaaacaagaataatggctccaagattgatttgcttttcttctgctgaataactctatgggccaaagaacaggttctctgttactatagtaacttctattatactaggctaccaacgaaaaggataaaacttcttcagatcttacattctagaaagtgctggctttcagcaataacaggcatgtactagaaatcatgtgttcttttcaactacttgggtccaaggtttcctctattttaggcataacacagaaaaggtgatggaacaagacaaaagaccaaccttttaggaaaatccatgaatctttgattataaaatgaattacgtgtacaaatagaccgatcttagaattgtcttacaactgctgtcaattttttttaaccaaaagaaaaatccaagaaaattaagggtgaattccaaggaatttgagtcacagcagccagagtattcagccccacaatttttggtacttccttgggtccagtaattaacttattggggatgatgaccataaaaaggggttatcttgaaacatttctaactgggaattcagggtttaaaaaaccactcagttgtttaaaacaacaaaaccctgacatccctgcaggcaacagcctccctgtctctggcagcccattccctttgtgtaaccgtgcctgtaagaacaaaacaaataagaaaaaatgatgaagtcaaaaggcccaactgctagaagccctgaggattgtggctactcccggatgtaataaaaagaatggacagtatttattttttgactgtttactatgtgccaggcaaagatttcaatactttacatgattattccatttaatcttccttgacaaccttttgaggtagagctcattaatatttccattttattaaggaggaaactgaggcacagagcactaactcatccagggtcacacagcataggtgaggagggccaggattctaaccaacgtgacagggaagacactccagtcattcacacagatgtcctctttacacttctgagtgagagatgaaaccagaaaacgtcgaaatgaacctctctggatttttaagttccctttgtgtggtccctccttcaccactaaaatatgtttgttaaaacacagaagaacaatattaacccaaactatcccctaaataagaaaaccatgcattcagataccacccagtgacacccgaaacatgctctaaaatagaacgacttcgtgaagcaattgtactgttcacttggcaacatttttatttgttttttggagacaaggtcttgctctgtcgcccagactggagtgcagtggtgtgatcacagctcactgcagccacaaactcctccctcgtcggcctctcaagtagctaagtttataggcatgccaccatgtccagctataataattaaaaaaaaaatttttttctaattatgttggccaggatggtcttgaactcctggcttcagatgatccttctacctcagcctcccaaagtgctgcgattataggcatgagccactgcactcggcccacttggcaacaattaacgtttaaatgggttcaagtttctcgaataagccagtggtgaagcaaagtctcttaatccagaacagggccagaaacctcccaagtgtcttttgagatgcggtctctgggggcagaatttcccatcagctctgatgtgttggttcccagaactgtcccaagtaggcatctgggattagcacaggctcagccctcagcagagtggaataaaaacgtggccagttgaaactccaggtcacacattgcaggataaagcactatctttatgtttaattttctcccttgtaaagtggggcttggacttacagccttcagccttcctagagctggagaaaatgactactgtccacagagaaaattcataaaaatgaagctgggcattgcttgaagagtacttttttaagagacacagggcctcactctgtcaccccccaggctggagtgcattggcacaatcactgtaaccttgaactcctgggctcaagccatcctcctacctcagactcctgagtttctgggactacaggtacacactgccacacccagctaatttaaaaaaaagttgtttttagagatagaggggtctcactatgttgcccaggctggtctcaaactcctggcttcaagtgatcctcctgcctcaacctaccaaagtgctgggattacaggtgtgagccaccagccctgggcaatttttttttaaaggcaatcaaggagcctggggttgtttcactacgtgctaggatcacattaggaaatactggagcacaactttgtttatattgatcccattatcctttccttccatccacccagatcctacccattccttccagtcccgccttctctaggacattcaattacattccttccttaagaatgacttgcaagaccttgtttaggccacttaacctctctgtgcctcggtctccatatctgagaagtggggataataacagaaactaccttaaagtgttgctgagaagtaaatgggaaaaaaagaaacctgtgaagtgttttgctagtattgagcacacagtatgtatcgaagtgctttaatttcttacaaatacgaatgctattattaattaattaattaatttattcattttttgagacagactctcactgtgtcgtccaggctggagtgcaatggcgcgatctcggctcattgcaacctctgcctcccggattcaagcaattctcccgcctcagcctcccgagtagctgggactacaggtgtgtgccatcacgcctggctaattttttgtatttttagtagagacggggtttcaccttgttagccaggatggtctcaatctcctgacctcgtgacccaaccgccttggcctcccaaagtgctgtgagccaccgcgcctggccatgtgaatgctattattttacagatgagtgaataggctcaagtcttactcagggccacacaactgatatgacagacgtgggactgaacgtggaaatgttttgctactacatgactgactgctcccatggtccacagcttgctagacaccacatggctaaatttctgtggctcacagagtccgtgtcgtgtaaattggccaatgtttgtgctgtcttgagttctttggcagttgcgctatcccacactctccacctaggcagtgagctgcttgaagccagagattgtctcctatttttacattttacagttttggtggtgatgggcttgaggtggataataaatacttgttcattgatttaggcataaagtataaagaatattgtctcttagccaggcacggtggctcacacctgtaatcccagcactttgggaggctaaggtgggcagatcacttgaggtcaggagtttgagaccagcctggccaacatggtgaaaccccgtctctactaaaaatacaaaaaaattagccaggcatggtggcatgtgcctatagccccagctactcaggaggctgaggcagaagaatcgtttgaactcgggaggcagaggtcgcagtgagctgagatcacccactgcactccagcctgggccacagagcgagactcacctcaaaaaaaaaaaaaaaaaaaaaagaaaaagaaaaagaaaaaaaaaagaatattgtctttttacttagtaatgtctataacatgaactagtggggttaacgtggtacagataaaatgtttgtgcagagaaaacattttgtgccatgtgccagaaaccctctaggacttaggcataaacatttagactgttaaatgaattaaggctcgggaagagcccaggcctgtgtctaatcacaaagggaaaggtacctggatgtcccgcgagcgctcgtaggcctggtaggccaccttctcctcaatgctggccagctcctgcttcaggttggctgtctcatgctgatgcaggtccgtcaggtcatgcagctggtcctccagtcgctcatacctttaaaagagaggagccgattcccagtgtgacctttcacagcacattgtggaacgatgtcctttttatcttcctgcgccagtaccttttggcttgctctcattccctgatgggctgtttttctaaaagagtaaggctagctgtgggaattgagcttttggataacactgagtcccagctctggaaagatccagtctctggggtcttgactctctgtccttgccactgaaggtgcacacgggtcagactagcaccttagctagctgcagtgacctcaagatagagctcatcagctgatgcacttgccagggccaggcaggagacagggctctgtgggatcctgctaaaggagggccaggacctctggtgtctgtggtgccttttccctattctgccctgacactgctgttggggttcatggccagagagcccacagggaaagcaccatgcttttagtatcaccttctactctggggtcaactctactatttcccagcatgcaaacacgcactgattatggatttcagctcttggaacttaactgacaatacaaaattaagcttattacaaattatagatggttcatcatgcagtgtttcaaaatgtccaaatctaaaggaacagaagtacaaagattctcattcctgtgccctgcccctctcactgaagattatttttctcatatttgaaaccttagctgggtgcagtggctcacgcctgtaatcctaacactctgggaggccaaggcaggtggatcacctggggtcaggagttcgagaccagtctggccaacatggtgaaaccccgtctctactaaaaatacaaaaattagctgggtgtggtggcacgtgcctataatcccagctactcgggaggctgagatgggagaattgcttgaacccagaaggtggaggctgcagtgagcccagatcgcgccactgcactctagcctaggcgacagagcaagactccatctcaaaacaacaacaacaaacaaaacaaaacaaaacaaaaaatcttatactgtgtattttgaaacaggatgtactgtttggagaagatgcattcattagactggaatgactttgatcaacgccaatttcagatgcttacataggtcacctgacagaatcattttataaagaggaccaaagagcttcatccagatttaatgcttattctcaggcatgacttctcagatgtcaaatgctgctactgctgtgaataagcctttaaaggtctcttcagtaatacaggtggtgactgtaacacgcgggtcacaaacgtaaccacaggacagatgcaaacagaaaccgtcctgaactcacataaatagggatctgtaacttgggagaaaatgtgcatctagaaagtgctatatcccagactatttcgatagaactgacgttcatactctggaaaagctgtgacttaaaatataattcttgtgtgacaaagattccaaagatgcatatggaaagatttttgtttcataaaattggagaattgaaaaggccacatttctaaattaatacagacataaaatcatacatcaattataaaacaataagtaaactaaatttaaacttttaatgttatagtatgtaataggcattttactattttatctacctttttagaagttaatgtattattaactttgactaaaaaacttttgaagtatctctttattggaaaaaatggggaaaatgaccttatatttgggcttacacactttgtgttaataagttataagcacctaaaagccagcctacaaaacatctactttaaaattacctaatataagccaaaggttttgaatgtatactttaatcttaagatgactttggaaagttctttattttactttagagtaaaaagtttaatgagcaaactacagaacataaaaaaatacattacataggctgggtgcagtggttcatgtctgtaatcccagcactttgggaggacaaggcgggcgaatcacctgaggtcaggtgtttgagaccagcctggccaatatggtgaaaccccatctctactaaaaatacaaaaattagctgggcgtggtggtgggtgcgtataatcccagctactcgggaggcttaggcaggaggatcgcttgaaaccagaaggcagaggttgcagtgagccaagatcgcaccactgcactccagcctgggagaaagagtgaaaactccatctcaaacaaacaaacaaacaaacaaacaaacattacataaggacttcaagattgatgtgccaaataagattaactttgttgggtaatgagtaagtgtgtacttgacagttgttatggagggaaatcaaatatagatctctgaattagcataatgacactataacggaagtctactgaatcagcatcttaagatgcacgtgagttgttgcctgtatccaataatttaaggacccacacataaatccttctctaattgtcagctaaaagccacaaattataaacttagaatcatgaaggatggaaattattgggtatcccttatctgaaatgcttgggaccagaagtgtttcagattttgatttttttcagattttggaatatttgcatatatatacggagatacctcaaaaatgggacccaagtctaaagacaaaattcatttgtttcctatgcatcatatacacatagcttgaaggtaaaagtgtaccatattttaaataattttgtgcctcaagtttgtgttaagtatttatttgtggaattttccagttgtggcattgtgctgacactccaaaagtttcagatttgggaacattctggatttcagagttttgcatgagggatgcatcaatacattagggatgtattgattgctaaacgccctttaatccatatccatatttattgaaaatgtaaccataaggcattcttatttcaagcaatctctctgcagtaactcatccttttaaaagaatgccacacctatcacgtacccactaagtatccgtggtaataaaaaagttttcaaaatgaaaaaataaaataacataaaataaaaaaataaataaataaaaaataaaaaacacgccaatggaatactttgaaatacctgtatctttcctcttgcagggtctgagaaataaaaccatattctctcttaaactgcaccttcagtgcctcgatgtcctcagccagctgagcttgggtatccttgatctccctcagttcctccaggatcacggcgagcttgccctggctgtccagtgtgctggctccaccagccccaaacgactggtttccgttactgtcggccgagcctgacgtgccactcgaacattcatcatcactgccatacttgggtttgttcacgatggtagcgctgcccccgtaggccctggcactcgcctctggcctaaactcctctaaggaatttttcaagtgagcaatgttgtcggcgctgccaaacttattccggatcaggttggcaaactctctggacttattgaaaacgaacacaggtggagtaagtgagacccctggcatgcccgatttgctgctctccatgcaatggggggcagttcgagatttcacgtgggcatctttcaaagagcgatgtatatccttcaggtggtctttggaaatgtcctttgagctcctagaggctccattctgctcgatctctctgagctttcgatgatactgctctaacttcttctgcagctgggcgatggagtgagctgatttctgattcttcttctcaaagacttgcttgatacgtcccgcctgctgcttgtctgcgttgttcactagtttcagatactccgcaacattcccatcgcgcgatgtttgctcaatttttatctgctctgttacctttagaattttttgcttcaggctgtctgcagtgagtttgaccttgtggaagtccaggatgccatccgggacatcaaagttgaggttggtgtctgacccccctcggcgtatgttcaggggcaggcttaaggtattcatgtcatgacgttctacctgaaagagacaggaaagaagcacattaaaatttgaagtcaaagagataattactgtgacagaatctatgcacatacaagatacatacatgaagtcccagtttttcgaactacaagtgtcacgggataaaatccccctgctgtcccctccagttgaacatagaggcagcctggctccttcctgcatccatctacactaagtagctgtgagattcagatctcccagggtatccactttttttgtgtaatgagactgtaacctggctcccagggtagaaaacgcaaaatagaatgaggtcaccagtcagtcccggtctcccaaagtgcccaggtaactggaatgcctgccataccacattcactgggaacttcaccactatggggaacgcatccaactcagaactcactcacttaatagaaggagaatctttttttttttttttttttttttttttttaaaaaagaaagatggggaaaaatagggaaaaagatacgagcaggtacatccatcaaacaagaacattattttcttaatggaatcattaaatagatgtgatagaataatatggtacaagattaactttaataattgggtaatacaacagtatttagatatggaaacaacctcaaaccacaccacagtgatattaaaaaaaaaaaaggccggggggtgggggcgtggcgctgctgggcgaggtggctcacacctataatcccagcactttgggaggcccaggcaggtggatcacctgaagtcgggagtttgagaccagcctggctaacatggtgaaaccccatctctactaaaaatacaaaattagttgggcatggtggtgggcacctgtaatcccagctactcgggaggctgaggcaggagaatcacttgaacccggaaggtggaggttgcagtgagccgagatcacaccactgtactctatctagactgggcaacagagtgagactctgtctcaaaaaataaataaataaaataatgagaaaactaagaccacataaaatagttttctcactcaagggccatttagggaaaagaactgcaacgcagcattgagtttcctggtgaagggggtggcaagtttgtgctctaaaaggaaaaggcagaagtagaccatatcccagggtctatggatgcctctcatgggttgtctcacttcactaccatgccagacaaagaacatgctagattcataaacatgtagacaccaagggttaaggccaggatttgaatccaagtcatcctaactgtaaccctctttccatgtcaggtcactccattgttgatgttcctggaggatgaaaaacagctctttgtagagttcaaacacaatctacaaacaagtcttaagatccaaactgaagcatctcatttgtcaatatccctttgattagattaatgacttgatatacagtcttaatagaaatcaaatgagaagcaagacaatattcagcatgttacctttttttttaaggaattagtgggctgacagcaaaaaaattagtaaaaaattaatgaatctcccactaagtgatatggtttggatctgtgtccctatccaaatctcatgttcaattgtaatccccagtgttggaggtgaggcctggtgggaggtgatcgaatcatgggggcggatttctcatgaatggtttagcaacatccctctgctgctgttctcatggtagtgagtcctcctgagatttggttgtttaaaagtgtgtagcacctcccgtctcttgcaggcatcctcctgctttcgccgtgggaagtgcctgctcccgctctgccttccaccatgagtaaaagctccccgcagcctccccagaaccagaggaagccatgcttcctgtacacagcctgcagaaccgtgagccaattaaacttcttttcttataaattatcaggattcaggtatttctttatagcaatgtgagaacagactaatgctctaggtgatccagacttgaatatggaccatatccaacaacgggtattaacacttcaccacgttataaatcctgcccagtgctttattccagaggagggagcacagcagcacagtgggacaccatcctagatgggcgggtcaggcctcctccacaacttacaaacattcgttagcattagctcttagcccctctcttccaatgcacaattttgtcatgaaggagagacactggttgctttatctggcagaggagcaccatataggaaaagctggagggaaataaatgcccaatcactacaagactagaaaacaggatatatgaaaaaaggataaagaagttgtgacttcacctggtcaagagggaaggatggggatagggaataaagaaggtatacaacaatctttaagtcctagagggtcgaccacaggaagctcaaggaatctagtatctgtggctcattagtggacccaaacaggaacaggttcaaattatagcaacagagaatgcatgaaacttagaaaatgtttattttgggcagatgggtaattaatggtaactgtacaatcactgaggctaaaaatttgattttgctggagatattatatctgatcatgctactctatgtcttagaaacttcctttggcttcctaatggctactaaatgaaataatataacctggcacatcatttcatttagcaggcattaggaaggaccttatagggctataaggccctagcccacctttcaggcgtcacctcacctgaaggaccccttaagaatatcttacaacctaaattcccagaatgtatatgaattttctatggattttctcatatgcatgatattcacaatgcctgccacccatttactcatgcttatcaaaatcctacgtattctttaaaacccatttcaagggccaggcgcagtggctcacgcctgtaatctcagcactttgggaggctgaggcgggtggatcataaggtcaggagatcgagaccatcctggctaatacggtgaaaccctgtctctactaaaaatacaaaaaaattagccaggcatggtggcacgtgcctgtagtcccagctacccgggaggctgaggcaggagaactgcttgaacccaggaggtggaggttgcagtgagccattgcactccagcctgagtgacagagcgagacaccgtctcaaacaaacaaacaaacaaacaaaacccatttcaaatgccccttctgccatgaagcttttcccagtcccagtggaacaccccctctccattctgtgacatgcctgttgctctgtgcttgtcttgtggcacttcctgactcctcctttgatcaccacccatgcactttaaccccctgcagactgcaagctcctttggggaggcatgatgtcatagctgtacctaacttgaagttcacgtacttccctaggaggctgtcaataaatgtttgtctactgaaccaaagtgccatcattctttattccaaggagtctgccctggaatcatttaagacacctttccattgagccaaaaaatcacctcagaagttctgctcgcatagccctgacaattccaggtgaagatggcttcccaatacctggataataaatctggcaccatttgaaactgattcaactaaacagagatttttttccgagtatcaatgtgcaacaagatacacaaatacaaataaggactttaaaactttaattgaagcataatttatactcagaaaagagcacatgtaataagtacaaagtgaaataagtactcgatgaatttttacaagctgaacacattgtgtgaccagcagccagttaaagaaatagaacagaagcctcccttgtgccctccttcaatctcaacgacatcacctccacctccaggggcaaccatgatcctcacttcaaaccgcatacattagttttgcctgttgtatacatgtattcttcttgtcatttttcactcagcactgtttgtgagtttcataagaacttggttttgccctcctggagctcacagataagacgagatgaagttatttaaaatctggctggcattctctattgagaagtccacaacaacatctagaggtagaaaggttttcatattttaccttaccaaaccgagcagtaaataaacacctgttcttactcctttaattctcaactgcatcagggctggtcatccaattctgagtctcaaggcaaagcctcatgctctcacagacctctcgttacaggacagccttgtatgcacaggaatgtttatgcacagatggccaaatgacttttggcttactttatgatttaacaatgctttgcatgttctcaagagtccaggttggcgaaagcaacagcatttaaagccccaaatcaatcgatcttactgcttgtcagcaaatctcagttaaaaatgtttgatgagggtataaagttggaactattactgggctgctccttttgcccttttataaccctagctagcactgcatgggataattgagagacagctacacctatcattgttagatgcctgtaaattccctgaacacaaactgaaattacatgtgcgtgctaaaagaaagctgccagtcctccacccttcgtttaatccagacttggcactgaccctatacaatacactatacattgcagcttggtttcagggttaggacgcaggaaggacaaaggtttctggttatctagactcagtgtacactgtgtggatcaggacactgtgtttctgtttgggcgctgacatttactatgtatgtgttcttgggtaaactgagtcacctctacgggcttccatttctgaatctatagaacaaggagacagaaccagacaattcagaactaatactgcacaactccatcaagtgtaatccaagctatcattactgtgagacagtactgcatcataaaaagcccaagggctccggaaacagactgctttggtttccatcttggcaccactcttaagagctgtgggaccttggaaaaatgacttagcctctctgtgtctcagtttcacttctgaaaatggacataatgattcttcaaagagttgtgaggaataaatgagaaaatgtatgtaaagtgttcacctcttcaagtgtgacctcctggcacactgaatgatttcaacaaatgtttgttactgttatcattccaatttcattctaaaatgtacctaaattcaatttcatttaaaaatgtatgtaaaaactgaaagggaaacaaactccaaagtgttaacaatgctgacctttgcaccgtggggttatgcggggtcattcttttgtattttcaagtcttttaaaaataaaatgtactactgttttggcagaaaagactttgcttttaagaatgactgctagcctctttcaattcttccagaatacttggctgttattactttagatgaaaggcagatccgcctactgaaacgccattcctcattgtgttttctttccggcactggagacatttccactgtcaccccaatgctctggaacaaaggctgaggaaaagcctgagtcccggacagacgtcaaaatctaaccctgcaccacctctgcaatgaaccaggcctccagcacaacacaccaagttagctcaccttactcaccggacacgggcacagcaactcagtcaccaccagtgcggcttggacacactgtgcaggattcacggaaggctgtctcccaggacactctgtattaacccgctaaagctccagagggagatgaaccaaaaaggaagggtaccaacacagaggcacaccacccaccccccagcaaacagaaccagaatgtagggctcctgtggaccctggaacgacagggactgaggcaggagtcctctgaggttctggaggccacagagtagccacaatgtgtagggatgcagagctatcacaacaatgtgacagatgacaacggcctgcttagtctcaaggctgaagacaatgaacctttgcttaaagaaaggctgtttgagcctcaggcattacaagaaaagggtcagatccttcaaatgggctggcatttccaaggcaacaggtatttccaagtacatgtgagtgaagatttatgcataggtccacaaggacctgcacgttcaatacctgaaggcttttacaagtcttcgtggccttggtatgtaagtcagtatcactgacattttttactattaatcactttagctgaactctatttcaggtctaaagtctaggccaaccttgtccaatccacggcccagcatggctttgaatgcagcccaacacaaattcgtaaactttcttaaatcggtatgagattttttttttttttttttgagacagtctcactctgtcacccaggttggagtgcagtggtgcaatctcggctcactgcaacctccacctcctgggttcaagtgattctcctgcctcagcctcccgagtagctggaactaaggcacatgccaccacacccagctaatttttgtatttttagtagagatggagtttcacaatgttggccaggctggtctcaaactcctgacctcaggtgatccgcccacatcggccccccaaagtgctgggattacaggcatgagccaccacgcctggccagtatgaggttgttgtttttttttagctcattggctatcgttagtgttagtgtattttatgtgtggcccaagacagttcttcttattccaatgtagctcagggacgccaaaagattggaaacccctggtctaggctgctcctatgatatgccacccagaatgtgctaggctttgccatcgtattaatgtcaaaatctcagtggctataaaagaaaggcttattccatgcaaatgctagaaagttggctgtgagtcagtgaggggacccaggttacggtggggcctctaccgtctggacgttctctaaaagacagagaactcattacactgaccctacctaacttctaggggacaggggagtataatcctattacatgcccacgaggtaaaatatcatgttagtgacatgtgtagtacctttcttaattgttaaaaactctctgaggtaggttctactattattactattttataaactagtcacagagaagttaagtaaattgcctgggggcacacagccagtaaccggcagagccaggctggaaattctggctgtctgtctccagtgcctacctgcctaaaaatgactgaatacttttattgtgaatcaggcactgtgctaaagattttttaatgcattcatatattcttcacaccaacccttttatgagaaaaccgagacttgtaaagggtatgtttcttgaagcccatgaataataaatagcttaggtggggctcaactcaggtttatgaaatatgcaagacttagcaagatctgtaccagctcagccccagatcccgcgagaacctctgcaatgcccttaacatggtcatccattgcatggataatctgggcttcgtttagactactctgtcagaaaattctccctcaggctgaacttgaaataatcgtggctgtaactttgtgtccacagctctggagccacatcagtcaggtctgatatagtctataaaatctattcttttttttttttttttgagacagtctctctctgtcgcccaggctggagtgcagtgtcgcgatctccgctcactgcaaattccaatgttcaagtgattcccgtctcagcctcccgagaagctgggattacaggtgagtgccaccacgccctgctaatttttttttttttttttttttttttagaagagatggggttttactatgttggccaggctggtcttgtactcctggctttaagtgatccactttgttccatattctaaaatataaacagtgatttgggccaaataactttatgaagataaaaaagcttactgcttgtattggaacaatgcctacgcatttacaatcactaagaggagagagagaatgagattaaaaacagaagataaaaataaaagataaaggacctctggagaaagaagccctgtccctaagggcctagcaagtgaggccatgtgggaaaaggcaaacagcagataagccctggatctgcctggagggaagggagagtgcccttctctgtgctggctgatacagctgggagaccgatgtggggctcagcatggccccacagtggggtacctttgtgtgttctcccagaagaacaggagcttttctatcagaaacaagcggggttgtgtcctcacgcttccggagactggagttgctcctgtgttctcaggagaggcgggagacggcgcagggtctgaaacatgggggacgatgtgcacccgcaacaaactaccaacactggagaggagcccctggatgttatcgggctcagcctagatgagtgagtttatgtgaaaatgagaaatgaccgagagcttcaaggcagatcacatgcttatgatcaacatttaaatatgatcttgggagatgaggaagaaaccgcgactactatagaaattgatgaagaaacatacgaagagatatataaatcaaggaaacagaatattccaatgctctttgtcctgggagatggtcgtgctggttgcccctccattgacagctggatgaaacaatttgtcctgtatggaaaatacgagacttcgtacagtagcctttctaaatgtacaaggcattcaaaagagaaacctgcatacattctgatattaagaaataattctggggattctcccactcctgaaatgaattgatttgcagataattcacaacttcttaagctaaatggcattttaacttttctaaagctcttcaataaatatgaccaccaagatgcagagctctttttcaggacttgttttgctctgttatccttacagacaatttctgatttttttttttctttaaattaaaattggtgtttcctcgtaggaaaaaaaaaaagaaatatataagatacagtggctggatgcagtggctcacacctgtaatctcagcactttgggaggggagattgctttagcccaggatttcgaaaccagcctgggcaatatggtgaaaccctgtctctaccaaaaaaaacaaacccaaaattagccaggcatggtggcatgcacttgtaatcctgactactcgggaggttgaggcacgagggtcaagagcctgggaggtggaggttgcagtgagcatgaatcacgccactgcactccagcctggcagcctgggcaacagagggagaccctgtctctaaataaataaatatacatatatgagagatacccctagcccatctccctcttgctatcctggggtcacacttgacatgcacttgcaaaatgtctagccagagtcagtgaacagggaagctaactgaaccaccggatcccagcatccttgctaacagagctaacctatactagaaaaataactccaggggctggataaggctccttgttatctgttactagaaacatattactaccttcatgggacacctacacagaatattcaatacctacatttgctagaagaaagctgcactttcccccactgtgtgctggaggggaaaaatcttaaggaccttcatatgatatccagaaggacattttattaggagagtgtcttagtacagtgtttgttctaacttgtttagacaaggaacatttcctttcatagttcaggtctgacaatagcacactctgaactttaaataagtgcaccgtgtacagcacgggaactgagtcaatagttttgccataaaggttttattcctcgcatccccccttcttcctctcttggcatcactgacaaaagaaattctgtagcctcaagaatcctatttccggccgggcgcagtggctcacacttgtaatctaagtactttgggaggctgaggtgggtggatcacttgaggtcaggagtttgagaccagcctggcctacatggtgaaaccctgtctctactaaaaatgcaaaaaaaaatgagccgggtgtggtggcaggtgcctgtaatcccagctactcaggaggctgaggcaggagaatcacttggaccccggaggcagaggctgcagtaagccaagattgcgccgctgcagtaagccaagattgcgccactgcatttgagcctggacaacaggctccatctcaaaaaaaaaaaaaaaaaaaaaattctatttcctgagagcaggtaaagtaaaatctcattactctggaattagggatcatttggaacaggagctagaatacacatatctttcatggcccaatcctttctccagacactgcaaattaatagtgtaaaggagattaggcagtgtttaagagtctcaaaaacaaattcttcaagcatcctcaagcactcacaaacacctgatactgtaattagagataattatcttcggccaggcgcggtggctcatgcctgtaatcccaacactctgggaggctgaggcgggcagatcacctgagctcaggagttcgagactagcctggccaacatggcaaaaccccgtctctaataaaaatagaaaaattagtcaggcatggtggcaggtgcctgtaatcccagctaatcgaaaggctgcggcaggagaatcgcttgcacctgggaggtggaggttacagtgagcagagattgcaccactgcactccagcctgggagacagagcaagactctgtctcaaaagaaaagaaaaaacaaaaagagccaggcatggtggcgggtgcctgtaatcccagctactcaggaggctgaggcaggagaatcacttggaccctggaggcagaggttgcagtgagccaagactgtgccactgcattcaagcctggacaacaggctccatctaaaaaaaaaaaaagaaaagaaaagaaagaagaaagaagaaagaagaagaaggaagaagaagaaggaagaagaaggagaaggagaaggagaaggagaagaagaagaagaagaagaagaattctatttcctgagagctggtaaagtaaaatctcgtcactctagaattagggatcatttggaacaggggctagaatacatatatctttcatggcccagtcctttctccagacactgcaaattaatagtgtaaaggagattaggcagtgtttaagattctgaaaaacaaattcttcaagcatcctcaagcactcacaaacacttgatactgtaattagaaataattatcttctcattaagcctctaccaggaaacagtggtaatctcctttgagttacacgcacttaaaaaatgtatctttcttcaaaacagcttataaatcacacttccaataaatacaaactaattctttacaaaattagtctgacctggtaaagatttgtacgtactaaatctacgtaagaattaaagggggagaaaggccagattcagcaagaatgtcccttgaaaagtagaagggaaggctacagtgatgaaaatagaccaaccttacatgagcaccaattgcaaggcaaggacagccacagtccctggggaggaaactgtggagggatgtgaggcaacacccaaaaaaggcaacttctaagaggagcagggagtctctggggaccctgtgtaccttgaaaacgagcaagtttgggaaagggaagtgtacatttatttaatatctgccccttacctctccaggcctgggaactaagaaccatgccttttaaatttaaatatatatatatatatatacacacacacacacacagagtgagagagagagaggtctctcactctgtcacccaggctggagtgcagtgataccatcactagctcactgcaaccttgaactcctgggctcaagttatcctctcaccctaacctcccaaagtgttgggattacaggcatgagccaccgtgtctggcagaaccaggcctaattttaggactaaacacagaacaaatgtccactgaagcttttagttcctaactcagaaggagagaaggggtgagcaagagctgctaggcactaaacttaaggtcttttgggggcagttctggaaaatttcccatccatgcttgttcattcccataggtttctggcagtgtctgtcagtaaaacctccccaggaagaggggaagccagcaaggaaggggatgtgggaatatcgagtttactctgggagaaccgcccccaggaaaaacgagtctctgaggcccttagtcagagagcagagaaaagaggccaagcctgggagcagagggtctgcctactgccctgccctggcagcccagtcttctacatttcccatcacattcattcaccacctcacttacccctaaaacacacagggtgggccttcttagaagggacctgtacttagtgtaagtttctaaacgatagttacaaatccagcacctgtcttgcagagtctttcggcatctccagcctgaacgaactctatcaggccatgctgtgttcattataggcaccctgcacaaaagggaaagtaacttgtctcctaaagtatagcttcctagataagtaagtgaatataacaagggtgtgcagtgttatctatcagataacaataattgtttccctttttgcctcggatgctaggaaattcagaatcaaacgtagagtaactgttagatctggtgatcagcctatatgttttccccttctttttcgacttttggatattagcactactctaactatattttccatgtgtcttatcataatcataatcttagtggaaagaggtgggtatactttaacctgcttattaagaggctaggtatgtcatcttgcccagagatgaacactataccagcattcctatgtttaatagggggaatgtggtcaaccatacccagctcatgaacctgcactgcgacttccccatccccattcctagagcatccagagaaagccacataatggtcacaacttggctcatgtcctttgaaaagttgctatgtaagactgagccaggaaatagcgtttggtactggagccccaaagtgcattcccaaagcatatgcaagcctcataattaaatttttctctgagggtgagggtttcatttattttttggtagtataacaaatactggagggaaaaacatgtactggatgatttgcagtatagaattttcttataaatggatcagaatactactagctatcagacagggcttagaaataagtagctattcaagagtagaagaaaaactgatcaacagtcatttcttcgccttttgcaatgctgaagctaattttgcacagttttattttttctaatatatgccagcagtattatcaccaaatggcaattagaactaaaaagctgcctttagttgtatcaaaataatatagcattccacttaaagaaaaaaaaaatgtccatgaaaagtacattcaatcgatattttggtacagtatttctggcatagaaaaacagccttactttgaagttgtgctcggccttcaaatgaggccctcaacataaaaactgatttccttgggttgaataaaatcatcttttcaaaagataaatcagattataccctgttctctcccaaagatctttaatgttccctaaagtgtgaaatacttaacaaagaatttaaggctctgttgatcagggtcctatcctagtcattttccagcaggtccatccatcctgatgttttgagtacatctatgtatagcccctagggtaaggctggacctttatatacactctcctttaatcctcatatctccatgtcattagctctgccttgcagatttgaaagggggaggcatcaaataagttatggtgacagctaagaagacacagagccaggatttgtactaatgtctagtttttaaccttcatcttattccatgtgtgtgacgagccagtcacacctgaacactgcatgcactttgctatttctatgtctgttcctcaccctagcatggtctccttcccaattcacctttcaaggaccaagtcaaacgatgtctcttccacagaggttctcccacccccacgcccagctaggattgactgcttcctttgtgcttctccccatttgcactgactcctcatacagtgcttattcttccaagtatgacaggtatttgaataacacatttgttcctccaacatttggatgcctccttggagagaaggatcatctatcatctactaggccacctgtgtctgctccacactctttcctcaataggaccttagtgcttattaagtgaatcagttgttgactagcagccaactagggcagccagttgtttagggacaagtggctgccctagttgtttacatttgctcagctgtttgcaatgagatcaagaagaacctgcaactgaggttgtgctgggttgctttcaaaacagaccgaaccacgaatggttcatggcttgtgacacatgtgagaggtcaaataggaaactgatgtttcatggctcttcactgctccaagcagaatataggtaatcaattaccaaatgataaatattgccagccatggtggctcatgcctataatcccagcactttgggaggcagaggcaggaggatcactggagcccaggagtttgagaccagcctgggcaacacagtaagtcactgtctctattaaaatacatatatatatatatatatatatatatatatatatgtatataaattagccaggcctgctggcgtgcctgtagtcgcagctactcaggaggctgaggtgggaggactgattgaacccaggagtttgaggctgcagtgaactatgattgctcccttgcactccagcctgggcgacaaagccagactctgtctctaagaaagaaaaagaaaaaaaaattaagatctcccacgtacagaatatgcaggtatgatcctttcctccctaagggaccttttccctgtagggaccgttgtaattgtggcagacaactcaggtgcctcctcctttggacacacccatatgttctgactcaatccattatttgtgatggcttaaggaagcagtcttaaataatttctcaggccaggtgcagcagctcacgcctgtaatcccagcactctgggaggctgaggcaggtggatcacctgaggtcaggagttcgagaccagcctggtccaatatggcaaaactccatctctactaaaaatacaaaaactagccaggaatggtggtgcatgtctataatcccagctactcagtggggctgaggcaggagaatcgcttgaacctgggaggcggaggttgcagtgagccaagatcgcgccattgcactccagcctggacaacagagagaggctctgtctcaaaaaataaataaataaataataaaaataaaataatttctctaatgcaccaggaaggttctgaaatgtagtttcttgtcacttaggaaatcacaatttgatagaacatgaacacagaaatgaaggaattcttttaccctccaaagtccaagaaggcaacgacttgtttaaaggacacaagcaggcctcaagaagaatggctcaagagaggacagaatcttgccaggatcattcaagtttatcagaaaagagaagccaccagttactaaagacttatcagcatcaaataatttcctaaatgtttccggtaccttattttatttttcctttcaagaatctgatattagaattaaaactcccatcttctcagaaaagtgacttactaggactcaaagctaataagtggcagagccatgtgattccagcccaagtgcacctggctccaggaatatcctaccttttcttgagctctttctgtgtacgccaaaccatttatcatacatatacctgtttcctttaacccctaaagcccctcaaatctacttagtttactcaaatcattgtgctaccattaaatatgcaaatgtgaaaaatatgtatgatagagaaacagaagaacaaaaacagactccttcagactccttggtgccacgaggcaattactggagatgttctcaatttggcattcataagttctcaattttggcattcataagtaggagaagaaatgaccttaaatcccaagataccttgcataataaaaaaatgtgggttacttctgttttacccactaccaaagatcctcaaggccagcttatacataaactccctctttggctaaagctccagcaggttctacagtcattaaatgctctgccgtcaataagaggaggctttcttctcccacagccacagacgtttaaaggctccaaagattcgtgtttcaggcagagaacagtcctcctctaagatcatactgttttgtgatctgggataaaagaaacgacaaagaaataaaacaaatggtgggctgtgattttaaagataaacactgtatcatgacccttcttagaacctaagtctgtatttgggttggctgtatctccaaaacacaggcaacagacttccaggacccactcaaaacactcgcagcaaccaggtagctcagacctcatgggaaagctctgattccagagccatgtatcctaaataaaggtttgcttccagggtggtagcataagttagtggttaaaggcacagatttcagagccagactgcctaggttcagcactgccatgtgaattgcctcgtcttgggcaagttactttctctatgctttgattttctcatctgtaaaatgaggacagcagtatctactagttcacagtgtgactgtgaggattacaggaattcatgatagggtcttgtacagagtaagtgctataagtgttggccatggtttattaaacctaacataccccagataggtgggttcttcagaagactccagagccaagaacagtgatgctgctgtcaccatcattaagctctttcaacagaagccaatcattgtccccgccgcccccacatgcacggagtatttgtgtgtacacaaactgctgcttatctatgcatcttgcagcagaaaggagggtggaaagtggagaacagggtctcaaattcataccagaaggtcccttaagaatcaagtttcaatgaacctgaacaggaaagataatttttaaaagatacccccccccccgcccacacacacacacaagcctaagatactgctttacagagtcttacctagtatttaatttgacttgtataaaggtactttatgtaaaataactaaactttacattctcaacagccagctcttaatgcttttataattgtcatgagttttctatattgctattttcagtaaaactaggactctgaagtaagaccctaaagacagatgtctaacgttttccacctccaagtctttaagcaaaacaagagaaaatcgtattagaaagacatatctaatgattataacttgctacttcctctataaaacctccttagcctactttttgagagtattatggcatgaccaggcacagtggcatgtgcctgtagccccagctacgcaggaagctgagccaggaggatcgtttgagcccaagagttggaggccagcctgggtaacacagcaagaccccatctctaaaaaaaggagtggtggtgggggaagagagagagagggagagagagaaaatgaatgaatatgaattatgcttggaagcttgtttttacagatattatgttgggggtttggggactgggttatacttaattccatgaccttaggggtaaacagcataattattttattgatgttctctctccttcatctcttctttaaaactgtcaccaaattctggtttttttttttttttttttttggcttggtggtttctctccagattgacccttccttgctatcctcagggccatctatcttaatccacatcctcatttcctatctcacctatagcaagggcaacagtttaactgggtttccttgttttcagtgttctattccttccatctagtctataggaagtcattacactgatcttctaaactcccacttccatcacactaaaacactgcttaagatgttcaacgattcttcctttaataaagagattggattcctccccttgctggtacttaagccctgagtaatttttcctattcaacttccaatgtcttcctccttccttcaccatccaccaagtggatctcagcactgtggtacatgaacatatttctggactttctgtttcacctcaacacttacaccattcccttccggacacagcatctcaaggcctctgtcatatccaaatcctaccattccttcaagatctcttccatgaggcctttccaaaggacttcttctccttcctgatccattttggctcttatatatactgttaggtgggttcctctttgttttatcatctttgctgggttttttactagttactgaaagcattcactttctcaggtaccatacaacactcagcacagaacgcgcagtatcactgagcagcaaatacctatatacgaacccaatttctctatgtcataacccagtatattacaaattctgaatgagacatccaagaaagaaatacatgtttaccaatatatacatacttatgtatgtgcacatatacatgcacacacctaattaaaacaaaagttttgtaaaatactacttatctttactacacacaatgtaactgtatttacagctacctaattttctggacaactggatattagaaattataattacctttgttaattttattatgtagaaaaagtccttgtttgcagatacatattagaaacaaagtgccctggccgggcgcggtggctcatgactgtaatcccaacactttgggaggctgaggcgggcagatcacttgaggccaggctttcgagaccaggctggccaacatggtgaaagcccatctctaccaaaaatacaaaaattagctgggcatgatggtagatgcctgtaatcccagctactcaggggattgctgaggcatgagaatcacttgaacctgggaggcggagattgcagtgacccgagatcatgccattacactcactacactccagcctgggcaacagagtgaggctgtgtctcaaaaaacaaaaaagaaggctgggcgcagtgactcattcctgtaatcccaacattgtgggggggcgaggtgggtggatcacatgaggtcaggagtttgagaccagcctggccaaccctatctctactaaaaaattggctgagcatggtggtgcacacctgtaatgccagctaattggggaggttgagacaggagaattgcttgaacccgggaggcagaggttgcagtgaaccaagattatgccactgcactccagcctgggtgacagagtgagacctggtctcaaaaaaaaaaaaaaaaaaaaaaaaaaaagagaagaaaaaagaaagggacctggtgtctgtatatcacttacttttaacaggttacaaacacaaacaaagaaaataagaacattttaaattgttgaatctgggtaaggtagatgagtatttgctgtgatgttccttctgcttttccatataagaatataaagtgatagttgttactcatcaaatttatttcatgaccataatcctgtttgaaaaacagtgtgttataattagaaaaaagacaagccacttgtccctgtgtttgttaatcatacttaaggaaggctctaacattctgaagaacgttctgtggttacttcctggcctataaaggatttaatgttccattgctgagtctactaatctctccttcaaaatcctttctacaaaacttctgtgaatcattacgaccttagcagaaaggtataagattagggattggttttttagttgcagagatcacagactcagaacttaccctaagacctcgcatactgagaacaatccttgtggttttcacagggctttaaaataactaaatctaggaacatcaaaagtttaagacagtgcgctaaagctgaaagtaccatagcaaacatgtgcactggttacattttccccttccttttcctttaagaataggttttaataaaagacgaagttccatgaacggtcagtaacatctcatttaattgacactaagggaagtattctagatgagtgaatgaaacttgtagataactgaaactccaagtcttgctaattagagatttctagattttcttctttcttttaatttcttttagagacaaggtcttgctctgttgcccaggctggcttccaactccggggctccagtgatcttcctcagcatcccaagtaaccgaggctacaggagtgcaccatcatgcccaggtggatttctaaatttccaagattgttttcctgttgactatggacatccacataatcaagtttgaattgtgacacagcaacagtgacctcaagaagacaactgaactagatcactcgggggacctgggatccaattaaccttaggtcctcgtaaagaagcaaggtggctgaactctgcaaactctaagggccttgcagctctcatatgcagcagttctgttactattaggtctgtaaggctggcatcctgcacgcaaaatgccaatagccttgttcataaaattattagcacagaccaactgacacaaactgagtattactctttataatgaatcttattttttatttttttgagacagagtcttgctctgtcacccaggctggagtgcagtggcgcaatctcggttcaccgcaacctctgcctcccaggctcaaacaattctcatgcctcagcttcccgagtacctgggattacagacgtgcaccaccacgcctggctaatttttttatttttagtagagatggggttttgccatcttgtattttagtacagacggggttttgccatcttggccagggtggtcttgaactcctggcctcatgtgatctgcctgccttggtctcccaaaatgctggtattatgggcatgagccatccctttataatgaatcttatttaccaaaataaaatttaataagcaacaagtcgttaaaaaccatatgcaacaaaaggaatgaaaaattgttcaacacacaacccagacaaatctcacgtgtgtaatacttaatgaaagaagccacacacaaaaatgtgatggtgtatgattagcgtgctgcggaggtgagaagagtggttaccctttgcggggaagtaggggtacggagaatgattcaccagtaggtggcaccagggagcactggggtgctaacaacattgatccaggtggcagtcactcaggacatacacataggtaaaaattatccaactgtacatttaagatgtatacactttactgtaagtgaaacctcaaaaaagtaataagatgcaaaaaaacttagataacaaaaatgcaggagctgtcaaaactattatctttatagtacctgtaacattacaaatgcacaatgaataaatgttaacatacagtattgctcaattctagcaagaaaaaaaaccacttaaatttcattagcatgtcaacctgtaatgcattttgtcagctctttaacatttttaaagtttcccaaactttcatgacactgtctcataaatatttgtttttagaatactaaagagccaatgaaaaagagcagaaatccacacgtgtactactagcaaggcattaatatctgtggtttaactgaatacatcagatttagacataaaaatatgcaatttagaattctgcaaaatgcagcaaaatcctaataccatgttgatccagattgctaatgccttgttttattacataatagtcatttagaaagccaatgtttctcaatgaggctgaatttaactaaaagcacacaaagtacaattagggcttgcttacttagaccaaattgtttttatgatagctaatggaactgattaatttaggttgcaaaccaagccccctaaaatacagaattgctacttgaaaatgtttttctgggcatcttttgtgaactaagtcctgtgctgaaagaactggagtcagagaaatatgataagctctgccctaagaggtcactcttggggcagggaggcgtacagaattaaaaaatgtaacaaggccaggcacagtggctcactcctgtaatcccagcactctggggaccgaggcaggaggattacttgaacccagcagtttgagaccagctagggcacaatagtgagaccccatctctaccaaaaaaaaaaaaaaaaaatgctgcgtgtggtagtgtctgtggtcccagctacttgagaggctgaggtgggaggatttcttgagcctaagaggtcaagtctgcagtgggccatgattgtgccattgcacttcagcctaagtgacagagtgagacttcatctcaaaaaaaaaaaaaaaaaaaaagaagtaataagtactataggaaccaaggggaggaaataagcagggggcttcaatgagaagcttctgagaaggtgataattgacttagaggcagctcaaaaatctgctgagagcctagcaaggagcacattgtatctgcagaaggaaaaactagaatatgtatttaggaaactaaaagttggagtgtctaaaattgagaatggctaaatgggtcattctaaatcaaggcatgattgagggctggggtgaaaaagaggtgcatggcaagcattcctaaagggaggcggcacaaggctcagaagaacaccgacaacctgcaacaggctctgcaaaccatgctaggctagacacctgaccatgcagacaaggggaagccaggaattttaaagcaggtggtgtttttataatcatgaaaataaaatacggagacatagagaatttggaatatcaaaaagaaaaggaggcttatcttaaatacagatactgtttaggttcttattaattttttaaaaatacagcactgtgactatactacacagagggattttggatttagttcaggtcacataagaatggttcattcatgaatctgtgtaattggtcatgacatgcgtatacacttgttgcataccaacattaagtaagcgtctatctgggatgctgggatcatgtaatttggacttttcctttttttaagcatcatttgaagctaaggatagctgagttcttacctaaaagaacactgtccatcacatatggaaaatcaggcattttgcctcataaatacacaattcataatttattccatctccactcatctctcttctacaggctcaatactattcaaactccaattattatcacagccttggtactttccatcgggggctagataaagaagagcaaagttttcacctacgatgaacaaaatggcaggacttaaagatgactttcctgaagagtgcaatgccttctgtcttttatttatggactgaaaagagaaatccctcaatgtacacggcaaatcacattcccctcactctaagccatacttacggaagacatcccagattctcctgaatgcaggaaagtaccacggttacaccaatctactccgtcaaaccaggtactaactatgactaaaattatatgtggaaaaaaaaaatccaaatgagattagtaacagaaaacaaacaaacaaacaaaaaaacaagtatgtgtgtaggggggtggatagaaggcagtcttgaaagcgtcaatgctagacgctttttttctctttactgggaattgcaatcaaccaaaccatgggtctgtacctgacctagagcctttaacaatgcaacaagactgtgagaactctcactcagggacacctgctcttagcctattatggaactactgcctgtgtgcagaagtatcatttggaaacatgaattttatgctcaaagggtaaaatgcccaagaggctttactcatgccaagttccctaagaaccatggggcttctttttgccttgggaaaggaggtgaacttttttcttattcttttttttttttttttgagacaatctcgctctgtcacccaggctggagtgcagtggggtgatctcagctcactgtaacctctgcctcccaggttcaagtgattctcctgtctcagcctcctgagtatgtgggactacaggtgtacaccaccatgcctggctaatttttgtatttttagtagagatgggtatcgggggaaccagccccaatatttcaaagtaggttctattttccctaagtgtcagccggtctgagaaataaagagaaagagtacaaagagaggaattttacagctgggcctctgggggtgacatcacatattggtaggaccgtgatgaccccgagctgcaaaaccagcaagtttttattagggattttaaaaggggagggggtgtacgaacagggcgtaggtcacaaagatcacatgcttcaaagggcaataaagatcacaagacaaaggcaaaattagaattactgatgagggtctatgtcctgctgtgcacgtactgtcttgataaacatcttaacaggaaacaggtgagagcagagaattggtctgaccaaaatttaccaggctggaatttcccaatcctagtaagcctgagggtactgcaggagaccaaggtgtatttcagtccttatctaaattgcataagacagacactcccagagtggccgtttacagacctccccccaggaatgcattccttccgcacggtattccttgctgggaaaataattcagcgataccctcttacttgcacatccatttataggctctctgcaagaagaaaactatggctctattctgcctgaccccgcaggcagtcagaacttatggttatcttcccttattccctgaaaatcactgttattctgttctttgtcaaggtgcactgatttcatattgttcaaacacacgttttacaatctattgtacaatagtggtcctgaggtgacatacattctcagcttatgaagataacgggattaagagattaaagacaggcataagaaattacaagagtattattacagaagtgataaatgtccatgaaaccctcacaatttatgttcagagattgcagtaaagacaggcataagaaattataaaagtattaattttgggaacttataaatgtccatgaaatcttcacaatttatgttctgcccatggttccaggcggtctctccattcggggtccctgacttcccgcaacagatggggtttcaccatgttggccaggctggtcttgaactgctgacctcaagtgatcttcccacctcagcctcccaaagtgctgggattacaggcatgagccaccgtgcccagcctgaaagaaggtgaacttaattagatgccaaggattgctaactacataacagtatttacaatgtggtacccttgattaatctgactcagtccacctaccttaatcagcatttcgaaatgttaggggaccatctgttcatgaactgagaacattatgaagtctctcattcaactcaggatatcaccctgaacttgatgaactaaaatttatttgatttctatactttaatgactctgatgtcattcattgctttcaatgttatgactgatgttttaataaggccattgtaaatataccataagtaccacaatctctgtgtcagagaaacactttgcttgattgcttttcttcctggataaacatgtagtgaacaatcagtgaatatatacttcatattataggattgactcaaagagttcaataatatctaatcagaggcaagggtatgtttattaagggacacatccttcaaaggaatcaaactttatatataaacagaggtaaagtgacaagcgtaattagacaagaattaaaagacaaacagatttgggtaacatcatttattttccacttatatagcatctttcattaaaaatgtcaataaatctttccaactgttcttgttcccacctaggatatgatgatctgaaagtcttacacatctgttctgaatttcacactccataactgacagctattcagtctttgggactcatcactcaatctcccctctcccttgcctcccacatactctaacatcagacctttttgctccctccaacacctgacacctgcctggtctaggtctgttacactgcacacctggaccatgcagcaatctaactcctctctctccaggttgatcctctcagtggtcaccaccgtagactggctacaggatgaggtttaaactcctgaagccggaagccaaagtcctcattatcttgactcaaacctgtctctgtccagatcctgtactctcagcctcttagctggaccacatagttggatccaggtgaactctgtccagctcaagcagagcatgccaaggtcattttacctaactcacttcaccctttattcaggagtgccacatgtatgtagacgttactgtgccttccacctccaccatctactctgcgcctgtatgtgcacatcagcatgacagatgtttgacacattttatttctagttctcacctcattatactagttatgtttagtgtatcaaacatatcaaggaatttgggccaggcgctgtggcccatacctgtaatcccagcactctggcttgagcccaggagttcgagaccagcctggacaactaagcaagacgacccctgatgccctccagtctctacaaaaaatttaaaaattagctgggtgtggtggcatgcacctgtagtctcagctacacagaaggctcaggcaggaagatcccttgagcccaggagttcgaggttgcagtgagctatgatcacaccactacacaccagcctgggtgacagagtgagactgttgtctccaaaattaaaaaaagaaaaagaaaaaagaaatcaaggaatttgacaaggtcacaaactagggagtagcaagccagggtttgaacccaggtgtgattcaacagcctgtgttctttctaaaacctggggcatcctcatccccagctccctatttaccaaaacccagaggttccttcagagtctgctcaatttcacctctcccacacagtcacttctgatcaccccaagtccagtaatcagtggttactcagaacttctgctgctctgacctcatattcttagcaacttgattttttgcagccccagagcctcatattaacagtctcttgaacacagcaggcactcaactatcttacctgagtgattttgctattttcatattattttctatgggtaaaattatgtatcaggtaagataacttcagtaactgaataaaatcagtttcaataataagggcacatctatggtctcctaaactaagaacagagggcagggctaattcaacggcttacagatatcaaagacccaatcgctctccattttttcactacactatcctcgggccatttgcttctgctcacatggaggcaagagagctactgtagttccagaaatcacgtgtagacagtttctggctatagatgaggatacttatcttctttcatattttattaggaaggaaaacattttccagaagctcctcaggggtccctttggccggggctgagtcccatgtccatgccctagttgcaagggaggctggggaggcagcagataacattttcggcctccactccaggaacaggctctgccagccagggagaaagggaaggaaaagagtgtttggaaaggcactccacagggtttgcaaacaccacctcgaatggatattatgcaacgacctactctgtataaggaaaactcccccatccaaatagattatcattagaaagccttgctaatcaggttacaaacaaataatccagttaccatagagtgtatttgcactggaggtagaagaaagggaatcggaaccttctttagccaccaagtgtaaatacattccttttccccagtgttttggttacatatcataatctccttcaccatcatgatcaccacaaggaaagaagggctaggaagaaaaaaccatctagcccttttgggcttccatatagttctgaaaacaccttaaggcaggcaaaaaaaaaaaaaatttttttttcaagagatataaagaacagaaatggagatgaaaatatttacaagtcttctgcctctttctctgattcttctatgctgcttctaaaaaaatgatagtctgccacccctaccaccaccaccaccaccaaccaccccatctgctgccaattctgcaaacagcatagacatccatcaatagagaacctctttttaaaattctagtacaatgggaaatgatgcagccactaaaatggaaacggatctgaatgggctaccatgggaagctattcaatctaaactgttaagagagaaaagcaagacgcagggctatgcctactgtgcacgctcatctgtgcttaaacgaggggtggagggatttatgatagatatgtacaattgtatactctatgtgtatgaacatttctagaagctgtcttaagaactgtggatggtagttacctctggggaataggactgggaatctgcagacacagatactttttgttttatattatctttttgagagagtaattcatcttattttcatattaaaaaaaaatccccagtgcctgaatttcaaagtgagactaatatgcaaatacctgcaaaatttcattagcacacttaagatacttccttgtctcctccagtgacctatgattttactaacagtagcaaaataaataatctataggatagtaggcatttttgtaactcatcctaactgaattttgtttatgtaattacttttagaaaagtaactccctactgaaaagagaaattttaaatcccatttcccaaggaaataaaaccatggcttaaaaggtagttctaaaacaaattttatgggactaagctggaattgccaagtcataaatataagttttcaagtaaaagtcccattaaaatattgaatactaatgttacatctttcttaaataacttcataaaatgctgtctttttaagggaccaatgccactgaaatatttctactgagaactgggttgcccaaggctcacagctttgaatctgtatttcatgggcaatgatgttttccataaagactcttcactgagaatactcatacaagcagaccatggcagtgtatgataggcgtatatatacagttgtcccttggaatccatgggggattggttctaggacctcctgcagataccaaaatctgcgagtgttcaagtccctgatataaaatggtgtagtatttgcatataatctacatacatcctcctgtatactttaaatcatctccagattacttataatacctaatacaatgtaaatgcttgtaaatagttgtattttttagggaataatgacaaaaaaaaaaacactcggtacctgttcagtacagatgcaatttttcttcctaaatatttttgacccctggttggttgaatccatgaatgtgaaatccgtggatgtggagggccaactgtatatccattcatggcaactgaagggtcacagagttcatctagagactgtttacatatagttcatgtgattcctgaggctagactgttttacctgtgattctcaggtttggtgtttttgtttgttttttgagacagtgtcttgctctatcaaccagactggagtgcagtggtgcaatcacagctcactgcagccttgatctcctgggctcaactgatccccctacttcagcctcctgagtatctgggactacaggtgcacaccatcatgctcggctaatttttgtatttttttgtagagacgaggtttcaccatgttgaccaggctggtctcgaactcctgggtttcaagcaatccgcctgccttggcctcctaaagctgggattacaggcatgagccagcgtgcccaaatggttctcaagtttattttatttattttttttgagatggagtctcgctctgtcaccaggctggagtgcagtggtgcgatctcggctcactgcaatctccgcctcccgagtccaagtgattctcctgcctcagcctcccgagtagctgagactacaggtgcccgccactacactcggctaattttttgtatttttggtagagacgaggtttcaccatgttggccaggctggtcacgatctcttgaccttgtgatccacccgcctcggcccccaaagtgctgggattacaggcgtgagccaccgcacctggcctcaagttttaaagtttggttttgtccttcaaaaattgtttctacagctacaactacaaaaaaggaataatgttatctccttaaggttaaagtcagtttctcagaagacaaagcaagacagaattacttgcacttttaaaattttttcagtggttctaggattcattttaaaatgaagcaatgctaaaagcagactgcaaggtatatttgcagtgtttgattttaactgattcttaaaacattaaaaactgtttggcatttgagcatgtgcatcccctagagacccagaaattccatttgtaggttagaggagcaagtgcccctgttaggagcacattgaaaatatacacagcagcatcacttgcaaaagaaaaacaataaaagcaataacaaaagacaacccacaaataatccaaagcctatgggcaataaaatggagagatatatatacacgcacattggagatatatatatatatacacacaataaaatggatacacacacacacacacacacacattgtgtttatttgtacagtggaatgaaataaaccagaactacaagaattaaaatgggccaggcacaatggctcccacctgtaatcccagcactttgggaggccgaggctggtggatcacataagcccagagttcgagatcaacatgggtaacatgatgaaatgctgtctctaccaataataataataataataattagccaggcatggtggcacacacgtctgtagttgcagctatttggaaagctgaggcaagaggatgagcctgggaggttgaagctgcagtgagccaagatcacgccactgcactccagcctgggtgacagagcgagaccccgtctcaaaaagaataaaatgattaaatcttaaaagaagcaaatcaaagaacacatactttatgaattctactttataaaggtcaaacgcaggcaaactcttttttaggtatgaacacacatgtgataaaaagagaaaaatcttgagaatagttaaaccttatggcagcgatgacctcttgggggtgggaaggcttgtgatgtagggatgctcaatcagggaaggtcacagggtcaagttcatctcctcaccctgggtataacgtacaggggtgtttcatgtattttttaatggaatatcttctttgtatgatattagtttacaaacattttaaaataaaaactatggagtaggccggacgcagtggctcatacctgtaatcctagcacttcaagaggccgagatgggcggatcacaaggtcaggagatcgagaccatcctggctgacacggtgaaaccccatctctactaaaaatacaaaaaaattagccgggcatggtggtgggtgcctgtggtcccagctactcgggaggctgaggcaggagaatggcgtgaacctgggaggcggagcttgtagtgagccgaggttgcaccactgcactccagcctgggcgacagagtgagactccatctccagaaaaaaaaaaaaaaaaaaactatggagtaaattacacagtaaaataaaatgtgtgtgtgtgtttgcttaagctgtagaatgaatgtcttctgtcaatcctattgctttatctctggctctatacttaactcgttgggtaataatgttaaaatctaaatttgagaccctacttaaattgtgacctggtctcaaaggtcctcgggtcaccactgcaatgatcttcttggatcattatcctcactggttacacacaggaatgtgaagcatgcagtcaggagaaagccctgtaattgcccccaggccacaagtaatccccctggaagcaaaaacaacctcctctccataaactgactagaaaggaacaggtgggaaggacagcagaggggtggccagcattgtcagggtttctccagaatggcctgtcaaccaggacaagccctgttcccacatctttttgaacagcctggcacagaaagcagctctgactgttttacaagcagcactcttgcagtttggggagccattttcccttttattccaattgaaactgtgtgcatcaagctctgtcaactgttgcactcacagtgttacgaggctattgcatgatatgctgtcggaacaactggcctctctgacttttttctttttttaaacaacagacagatttttttttttttttttggtttgagacagagtctcactctgtcacccaggctcgtgtgcagtggcgcgatctcagctcactgcaacctccaccttctgggttcaagtaattctacctcagcctcccgagtagctgggattacagacgctgctaccactcccagctaatttttgtattttaaacaacagaaatgtaacctccaagacccaaatgatcaaatgacaagcagcaaacttttccaactttccctcctctcccacccccaggtgttttggtttctgaagactggggatcactatcaacaatgggcaaacctttgctacagaactgattaggacaaaaccacctgaattaataaatgtgtgcaaatattttaatgttcagggaaggaaagaaagattgcattttgtgtcaatatagagaagtcttctatgacaaagagccacaagtgaacacagatttcctgtgagatcaaaggctcccccaggcagaaatcacatgaacctgagccttcaccaccctatggggaatgaatcccacactatggggtgtccaagcatggtccgaggaggcccagttcagacgcactctccatttcccccatggctgcttcctctcccacagctcgaggcagccaccacacccttcttccccaacgtgggctgggcagcatcacacaaagtcagttttacagagtttcaagtttccaggcaaaggcaggatgactcaaagatgcccacttgtcgaaagactagatattaaagtacaaagttagattccaactcagagcctggttagacccggggttactttcgaactcccagggaggtgggaggagacctggctcttctccagccagtagctggcacaatccaacccagatatttgtccatctgttaaatcactcacactggactgacatttttaaaaggacataacaataaggagactggtggttcattaggcgtttaggcagtttaagtatctagaaaccaactgagaaattagggagggatttgggcaagcacaaagataactattaagagcacaaagacaaattgcatttctttctggcatctcccaggatattaaagaccacaaagctccacaatacatatttacacactctggctgaaacggaagagttgtgaagagacttaccaagggccacacagcaaacccaggagcagagcaggatcggcagctagctcaccctcctgcccgaggcatttgaatctgcaaggcaggcaggctagatattccaaacagcacctaccatatgactcagcctggactttggagatactgctcacattatctcggggtattcctgtgtttgtctcagagaaactccacgccctgcactgtacccaatacaaatgtcagtaataatgcaccgtattcaacacattgctgtacaaatgggctctttgtgcagtcagcagaagagatccacattctatatctttgcagggaggtcgactagaagggcgcctgctatcaatcaccccgactctgggattgcaagaggacattcagtctggtactctctctttaccaataaggaaatgggctcggctcaacaaaccttgttaggcagagcaaatgccagcagtggactgggcacagtaaacaccaatgtgatgaaggcagagcaaaggggccagccagcaccaagggaagggaagtggcttaaagacagtgagcagtcaggagactctctgttgattcattcatgagacagacacttgctgggtgcctcctagtgtcaggcgcagcgaggcgtgctggggaggcaaaggggcatagccgcctcctggcgtagtggccgggggagagacacaatgacagccactgataagtgtcaggagagtacttggtgctaagcgagcacttggaaggagctgctaagggggagataagaggaaagggggaggggaaaaagtcaatggaaagcagaaaggcttgtcagaaggtgaatcagttagacagagaagtaaagatttggaggacttggtgcagttgaagactgggacagcagatgggtcacacccggagggtcccacttaactcatacagaggtgtttggggttcatcctgtaggtcccttggcagccgcatagaggattaggatgatcacatcctgttttaaacaagtccttctgagaaagcaagatggaaaatgcatttccatggagccaactggagcctggagcctgctgcagcaatctatggcaagagctggtgaaggctggatgtagggtggtcgtgagaggtctatgaaggaggtggaatgagaggacttgccaccacctggatgtgggggtgaagggacgagtcaaggaaaaccccacttctgtttcattccttctggtagctaagcttattcacaagataggcaagaggaattttcagcctcagacatgataaacttaaggttcctatgggaccttcaaacacagacgtcctgatgaacagagagagaaagggacagaggaaacagcactggagcccattggtgacagcgccttaggcaactctctgaggagacaagcatagacaaccagacctaatcaaatcccagcttctgcctcttagcagctatacgacctggggcaagtaaattaacctttttgggactctggtctcacctaaggaaattccttttgggatttaatgaaatcagaaaaggacatgatgtcatggcaaacagaagagatttaatattttcctcttgcccttttgtgatcatatactgctttgtattataattgagtacttaacctttgcagcagattataagttttcttgctgtcactcatctttaaatcccttttgaccatatttgtaggcacagattctcaaatatttgaattgccacaagtcatatgaaaaactaaggccagactgttctgggggaccaggggtttcctgcttttgacattaaataacaaatgcaaagatctcaaaattgctatgtggcttaagtggtgttgatttaactctgtgttgggggtgggatggagagaaaagggcagtggggtttggaaaagagggagaattttgtcagcctaataaaggctagtcaaagcctactctgtgaaaactctactgtaatatttaagaggaagagtgtctatcaaagttaatattgcatagcctctatcctctggctcagttcaagtaaaggtcttaagtcatgttaaataatgaattccagcaaatggatcttgccttaaaccaaatgttaagtcaatagtacactccgtatatgagacgtatatactttctttgctaggtcattttgctaattctaactcttaaaatgaatattttaaaactacaataagatttttaaaaccagactgaccagtaaggcatacataattcagttccacagagctaagcttgttcatttttcttcagcgtttgcctttaaatttgggatctaacttgtctttacctatttttacggctgccttcctagtctgaaaatatcttggtcactagatattttgtttcatctccagcttagctcctaaaatacattcaggatcacttcttccttcccccttcttccctggtagcttcatatattcccatccattcacccatagcccagttcagtatacctacctcacattctgtgtctcagtcacaaatatcttttttaaaaacctgcccaagtttctaatacagaatgatgtggcaactgcctcaaagctcactgtttggctcatttaatcatttggattaaacgtagacaatgatccaattcagagctaatggtctttaggactactcttattcctggctgtcttcaacctgggcacatgtgacatgcctcaagcatgaccagtttgagaggacactttggtccccaagggccgaggaagaacaagttcctcctcgctcacatatgtagtctgaacctgaggttcttgattctctaggatgtttctgaactctgggtggttcccattaaacacacaatacacatctccatccttcttagccaacctctaagattttgacaccccactgacatatagaaccaagataccttccagttcttctctgccttgaatagacttgaacttcccagctgtgaatagactcaactttttgtcgtgtctacaagatgctctcctaccccactgccaatagggggaaaaatgaaagcagacagatggccacattagatggaatctgccattgaggtggcaacttccccatggcacccagcccgtggtctacttgagttattcctcagacactgacgagaggtgcagagtctcagggagagactactgagacgtaatcctttccctttaaacatgactttgacatatgcattacacacacttacacacgtctgactccaccatgactcacactggaggtggtgtttaaaatgaacagcatctccgtgctattatgatgcttcactcaaaattgctttacggcttctactacaggagcaggtcacatccaggaaatggtttgcctgatctagagcaggattttctcactattaccttatgccccagggctgccttactttcttcaaaacccagatcaggacctgcaacctatgacccaaagcactctccttgtaaattcaggattccctactaagccagtccctagctttttctctctctgaactctttaaacaccttttacattctcctctttctcatagctcatgtcattcctccaggcagaggcccctgagtttcctgtggttagtagacatggatagctgcctgctgcatcagactcagctgagcccaggaatccttctgaaaataaaagatttatcctacaaattggtgcaacctttgggaggacaatgtgtttgcctctattctcatttaaaaggcacatgccctttgacctaacagttttgcttttggaaatttatctaaatatggttatagagaaaaatgtacacaagttttcaatacagtattacaaagcaaaagaaacatgaaaaaacatcatcctgggaggaacttaaatcgcatatcaataggcgactggttaaataaataatagatatgtatattttgtgtcaagactatttctgtaaagacacataagaaacataacattgcagccaggcgcagtagctcacgcctatagtcccaacacttcaggaggccgaggcaggtggataacctgaggtcgggagttcgagaccagcttgaccaacatggagaaaccctgtctctactaaaaatgcaaaattagctgggcgtggtggcgggtgcatgtaatcacagctactggggaggctgaggcagaagaatcgcttgaacccggaaggcggaggttgcggcgagccaagatagtgccattgcactccagcctgggcaacaaaagcgagactgtctcaagaaaaaaaaagaaacataacattattatcattgctatctctggggaaaaggacaagaagctggaaaaagacactttaattttgctttaagccctttagtactgtggaaattttttttttttaataattattattttttttttgagacagagtcttgctctgtcgcccaggctggagtgtaatggcgcgatctcggctcactgcaaccttcgcctcccaagtttaagcggttctcctgcctcagcctcccgagtagctgggatcacaggagcccaccaccatgcccagctaatttttgtatttttagtagagacagggtttcaccatgttggccaggctagtcttgaactcctgacctcaggtgatccatctgcctcggcctcccaaagtgctgggattacaggcatgagctactgtgcagggcctgtggaattttttttttttcaaatgaattcacacttaagctacttaatagaaaaaaatgtgaacctttatcatttagagctactaaacacttcattaaacaatatcacttaatctttgctaaacacgaactagaaaaactaggcacaaatagaaactgtatagaccagatatacattagaatgggtctgctttagcagttaatggtttaatcattaaccaggtcagggtatttttctctaaggcactttatgtgttgctgactcttctacaatctaagtggctcaatgtaaaccattccccttgtgctaaacatgcgtgtttatacttaaagtcgatttcactgaggaaattagggtagggtcagtttgtaaggttttgccctaaaccttaaaaagaacacaaaatccttcaggtcttaagcaagattgatgcccaggccctatgaaggacacattgaatcttctgtatattttttaacaagctccacaggtaatttggatgtggctggcattgcctcgtgcacacctaaagtaaccatgcttagaaaacgctgtgttatccaaaagaaacacagcacagagaattctatgaacaaactattgcagtactctaagattttaaaataagtaactttctcaaacactgatatggggtttagagttaacactgcgggtaagcaaacccaccaggctctctcagttgacacagctcttctggctccttcgaggaagtgaggaccagtatgtggaagagcctttggggctggtgtttctcaagctacagcttcaggcaatctcagggacagaacctggactgtgcatctgacagccgcctttctacctcccacctccaccccattcttatgtccaagtagtttgaaactattgagctagatcagtatatcccgaacaccaaattgttaagagtggatggagccccagtgatctttcccactccccagaccagtgaatcaggaaatctctactggaggttctgcagtaccccaggttctttatctaaacaggaaagttaggaaacaccaatttaggtcaaactcattttaagataaggaaatcaaggcccaagaagtttaagtgatttcaccaaggacttatagctgattaatgatagctgggagctgtgaaacctggtgagctaattcttccctcttagaccaatactgcttgttatattatgtgtaatcatgagagccccagtatctgtgcagtttctgattcaccaggaagaggccccaagtgattaataaagcctgaacccaggggcatgtcagaacgcaccactggtttaaaggatgactgacatggtaaagtgtccaacgtcaacctgccctcggaattctttcactttcagtatcagtaggagaaatatacaattgtacatttcatagaaaagtaaacccagccccacacagttaacaaccaggtgaagcgggaacacaggacaattcaaagttttcggatcacaccatttcttggtcaaatattagtaccttcagcaaaagacctctaattaccacacacttttggttatggcaacagcctgctccttacttttgggagagaggagtactccacacccatggcctgaaaccaggatctccaaacccatcaaagagaaacatggatgggaaaccaaaccccccaagcttggaaagcatccagcaagctttaattcagggagagttcaatcgagatataattgcctctaattggccctcccacacgatctcacaacatacagctataatcagttccacaaagaatatgttatatttcttttctcccttgaaaagccagaatcctctcttgttaggtacttaccatcactgttttgatttttgtaaatataccgagacattaaaaaaggaagaatgaatgggtaaaagcaaagaagtagatggatttcttttttaaaataagcactgatccctatgaccttaatgataacccagtgcgattcaaatctgtaatggagactgatgtcgactcaggaaacctttctagtccagggcacatgtgatccaaaaaacacattcatctggtcggacattttccatactctgatttttatctttcttggcatgctcaactctcctttaataaagtcacaaccctttgttgccatggaacccaatcagacacggagcctgttactatgacttccctgcagatataaaaaaagacccagtgaccaaaagaccagctctttcttaaaaaaaaaaaaaaaattacaaggcaaagaggctccaaaaaaacctcaacacttctgtatttactgaagtttaatcttttatgtaggctcacctgaactcttcagccaaagctagctcatgtttcagctggaactttccaaagaaaatgattttacaaataaatacctaggcaaagaaggtaaaaaatattcttgggatatcttacttttcttcttcttctaggcaagctttctgaaatttgagtagctgtttagcaaacatgtgtcaatcagcagctgccaaattgcaatattcatttccatcaatacttaatgttgccaagagctcattatttctctgaaaagaaaagatattctaaacaatacaatcaatcctgtgttctggacctggactaaatctgcaggaaaaaaaaaaaaaatctgagactaagcagagtggactgagcagagctacttaagggaagagaattaacatttgttgagtgcctaccatgagctgggcacttttacgtcatcacgtcaggaccctgtaactgaggcaatgccacctctgtttggcagatgagggaccaaggctcagaaagcttaagtacttaagcagcttgttcaagctaccaggctagaatgctgcctggctcccaaagccagagctattccttcattcaaccagcacttatttctgctctcacaggtgttgtacattttgttatgcttcttattcttcaggagcgaattcacagcctgtaaagcttggctgtaaagagagcacggtgtccatctttaccggcacaggggccagtctggctacacccacgtacaactaccaccacgtctatacaacaccagctaccccttgggggaatcccgaataaatgccctggctacttgcctaaggaaacacgtgtgggctaggcacccattacacccttccagaggttgggccacggcccagagccttccaaccctggacctcatggtggggaggaccaggaagctctgggtggccttttcatgtgcagtaccatcggcaaagtaaaagtcaagccatgcaaaccacaacagtttctccaacctggttttggacaaccagcttcaagaaatgactagtaagaaggaatgtggcaagccacaaaagttataatttatattattaattataccagcctctcagctaaagaaaatttacctatttcatgtacaaagattataacaactgctttcattaaaagaaatttttaaaatcacccaaaactgcaatacgataccacttcatacttactaggatggctgtaattaaaagacagataataataagcactggtgaggatgtggagaaatcagaaccctcatacactggtagtgggaatataaactggtgcaaccactttggaaaacactctggcagttcctccaaaggttaaacagaattaccatatgacccagcaacactccttctaggtatgtacccaagagaaataaaaacatatacccccacaaaaacttacacagaagtgttcatagcaacattattcttcatagccaaaaagtgaaaacaacccaaatgtccaccaaatgtcacatatccatacaatgaaatattattcagccatggccaggcatggtggctcatgcctgtaatcccagcactttgggaggctgaggcaggtggatcgtctgagctcaggagtttgagaccaccctgggaaacatggtgaaaacccgtctccactaaaaaacgaaaaaattagccaggcgtggtggcgtacgcctgtagtcccagctactcaggaggctgaggcacgagaatcacttgagtctgggaggcagaggttgcagtgagccgagatcacaccactgcactccagcttgggctacagtgagattctgtctcaaaattaaaaaaaaatatattgttcagccataaaaagaaataaagtactgattcatgctacaacatgcgtgaaccttttaagagagggggaaatgaagaataactgctaagggtatctttctgagctgatgaaaatgttcgaaaatgggccaggtgcggtggctcatgcctgtaatcccagcactttgggaggccgaggcgggtggatcacttgaggtcaggagttcgagaccagcctggtcaacatggtgaaaccttgtctctactaaaaatacaaaaaattagctgggtgtggtgacacacccctccctccttgcctactggggaggctgaggcaggagaatcgcttgaatccgggaggccaaggttgcagtgagccgagattgcaccattgcattccagcctgggcaacaagagcgaaactccatctcaaaaaaaaaaaaaaaaattttttttttacagaggtttgattacctctgtaaagactgtatttccaaataaggtaatgttgtgaggtagtggtggttaggacttcaacatatcttttggtgggggacacaggtcaaacgataacactgactttaatagtaaatgggctgggcgtagtggctcattcctgtaattccagcactttgggaggctgaggtaggcagatcacctgaacctgaggtcaggagttctagaccagtctggccaacacggtgaaaccctatctctactaaaaatacaaaaattagccaggcgtggtggtgcacgcttgtagtcccaaatactcaggaggctgaggcaggagaacggcttgaatctgggagatggaggttgcagtgagcagaaatcgtgccactgcactccagtctgggcaacagagcaagactccatctcaaaaaaaaaaaaaaaaaagtaaatgatatggcagttccagaagggcaaatagtctcaccgtgaacgaaggtgtcaccacacacaatttttctaacagaaaagttacgcaagggttgaggctttccatcatccaggaggcaacagaagcattccaaattccacagaaaacctgccctgcagcagtcactactgtactgacacatggggagcgatctagagcaccagtaacttcagttaacattcatttaaattattacctttgtattttgtacgcatttgtttgagattttcataataaaatgttgaggtaaaaatttcctcagaatgttgataaaatctgctgtattagtctgttctcacactgctataaagatactacccgagattgggtaatttataaaggaaagaggtttaattgactcacagttccgcatggctggggaggcctcaggaaacttacaaacatggcggaaggggaagcaggcacgtcttacatggaggcaggcaagagagaacgcatgtgtgaacgcagaaaaaactaccatttataaaaccatcagatcttgtgagaattcattcactatcacgagaacagcatgggggaaatcgcccccataatccaatcacttccctccctcgacatgtggggattacaatttgagatgagatttggttggggacacagacaaaccgtatcatctgctaacaaaatctttattcttaaagaacacctaagtaaaaacaccaattagcatcttcaaacaaacatttttcacaagccaaaagtagagagaagataaattttgaaacacagaaacaagagtacatgtcttccctgattagacttatttaaattaatgtagccaaggccttacaaatcctttgatgtattaaacactgaaccctggggaaaaaaagtcctgctttctgttgaaatagtgaactcaaatattataccaatatcaatgcatgaaattcttaatgcattatttctttcctttcatgcttccttccatttctctacccatttattctgcaatctctgcccacctctgggtagagagggacaagtgagtcacaagttacaaggatgccacggctcatgcagacttgggcacaggttgggtagaagagcacccaagccaggtatgaactgagaaagggactcagggacgaccttgtatttacgttatcttacataagccttccacatccttatagggaaacaattacacttaatttgtttttgttgttgttgttattgtttgtttgtttgtttgttttgacagggtcttcttgttctgtcgcctaagctggagtgcagtggtgtgatcttggctgactgcaacctccacctcctggattcaaacaattctcctggctcagcctcctgagtagctgggactaaaggtgtgcactaccacaccaggctaatttttgtatttttagtagagatgggggtttcaccatgttggccaggctggtctcgaactcctgacctcaagtgatctgcccacctcccaagatgctgggattacaggtgtgagccaccacacccagccacacttatggaaactgaagctcaaatgggttaagcaaactggctaagatgatttcatacagcttgtaagagccaggattttaaaaccaggcctgttgcccccaaagccctggcaccatgctgcttcctcacttcaccatgcacagctgtcagcacactaggggagggctttaccacagcctgcatttagaagacctgaccgcttctcatcacctccactatcaacattctagtccaagccactctcatcactcctacaggtctacctgggccagcccatgcccacctacaatttcttttcaatccaacagcccgggagatccttgcaaggcctctactggctcaggaactggcctccccaccacctctcagaccccatgtcccaggactcaactccctgctcacactgccccagccacacagcctccttgctgtgcctcaaacacaacaggcacactgctttatcaaggagtccatgcatgctgttttcctgccctggaatgttcctcccttagatggctgcacagcttacttcccaggtcttttctcaatgtttcccctgacaagagctttctttgagtgtcctgtttaaaacttcttccctctacctccaccttgggcctccccagccctcttgtctatttctcagcattgcacttatccacatttaacatactatatattttatgtataggtctggcttgtctgccttgccctaccagaatacatattccacaagggtagggatttttgttttgttccctgagatgcctagcacatagtaggtgctcaatacacatttactgaatgaatgtactgaattgggctgaaagcccaatcattttaagtacaatccacatctgtattgctcatgaatggactctggcctgacgtaccacatagcccgctcctgacttggtggaaggttgggcaatgaagagacaattatccaacccaaagagctaaaaggagcccgttcttaaattcagtgccatgaaaggtgcccgagtgactccttttccataccacatgttgtggagacataggtaccactaacctcaatgctactcaacctcaaggtgtggtcctgggtgaaggggactccttgggccaggacattaggggaggcaaagagcagcctacctttttgtcttctctgcccaaagtgctcatcaataaaaaacccgcctggaggcttgggggcatctctgttttccctggtgaagctccacctatccacaaaagggctcttttcttacactgaccttctcatactccccatctatgaaacctcaccagagctaccaatgacaggcacacgggttcaattctccaagaggtctcaggcagcaaagggtgaactctgaacctgcctacagaatgactggcaggagtgagctattctaagcatcgcagtgtctgctggatggtgaggaaacaagcgcaacaaggctgcacaaggtcaaacagcaaaaacagtgcaacagcgagatggaccctttccaaaggggagcctgtgctgcagaaggtacaatgtctgccagctctaaactcatcctcatgctaagtcccttgtgggttagactggtggtggagaaatggggatgacaaataatgggaaagccataagcgcgtgacttttgtaaaattctagggcacttaaagggtgccgttctgctctgaaattctacgaagggactaaaatcactgcaagattgcttccaaacagcaaataaaacctcactgagagatggcactataatttcttgagtttgcgtcattctgttttctgtagttagaaaaaaggtgatggatttgggttacaaaggcagtgttccactataaaaacctgctggttgccatgacaattaacattcctgttcctccctcttctgcagcatccttcttccatctgagtcaaatcaaagaacctagctatgacgctcatgatttagtatttcctcggcacaaggatataaatatatacacacatatacaaaatacttatcaaaggctaatcacaggtgaaccgaagccttgaaaattgataccatctgtcctctaccaacaatgtcctacaaacaacaagagacatccctgcaggagggtccaagcaggaagggagggtgggccaggaaggcttaacagccaacacccagtcctccagtctagagtctctcagggtggactctgggggagttcttccttgggaggatccatgagaagccaggaccccatggagaactgtccctgccactctgcatcattattatctgtctgtgggtctgtcctccccagcctgagctccttgagggcagtgcccacatctgactgatctcagggcctcgcacagtgctgggcacaccgtgaagcaccaagggtgatggagggcactctggggtaaagcagcctccccttacattttctactgagacctcacgatcgggcctaccctgcttctaattggccctgtcggagaagaaagccaggggagaattctagatcaaagctctgaggtatgagctcgggacacctacagcacagtgttgccatgagctcccatccctgggtcaaaagtcttgaccaccaacccttccccagacctggagcaaaattaagaataacttagaaaataatagcataaatgtgatttatcttcttttcaggacaaaggctgatcattcaaatttcgaataaggttcaaatggagaccctgctatttgactatcattatcactctgtttaaatttattttaaatagaagttatatatgcccatttaacatttaattgcaaaatatgcttgttttacaaaagatatgaagatacaggccaggcgtggtggctcatgcctgtaatcccaacactttgggaggctatggcaggcaaatcacttgaggtcaggagtccgagaccagcctggccaacatggcaaaaccccgtctgtacaaaaaatacaaaaattagccaggcatggtggcaggctcctgtagtcccagctacttgggaggctgagacatgaacccaggaggtggaggttgcagtgagccaagaacgtgtcgctgcactccagcctgggtgatagagagcaagactctgtcccaaaaaaaaaaaaaaagaagatacaaagatacagaaaaggcagaggaggaaaataaaacccccatcatcccatgacctgacctggaggtagctcgggcctacatttaggtttttatgaggccatccttgcagatgtctgggtggttctgtctactggtttaggggcacaggctctggaacgcagagctacctgggttcaggttctagccttttcacttagtgggatgatcctggacaagtcgcttaacccctgtttgagcctcagttcttctttcctaacaggaggatagttgtgtctctttcttggcactgcatgagagctgttttaacccaggtggagccttgtcatagtgctggcaatggcactcctacccatttatgctagcttcattaatattctacttgtatgtggcactttttaaacaaaaatggtactttctgcgtatatcttgtaaacgttttgtgtttttgttttgttttgttttgtttttgaggcaaagtctcgctctgtcgcccaggctggagtgcagtggcaccaaactggcccgctgcaatctccacctcccgggttcaagcgattctcgtgccttggcttcccaagttgctgggattacaggcacccgccatcacacccagctaatttttgtatttttagtagagacagggtttcaccatactggccaggctggtctcaaactcctgacctcaagtgatctgcccacctcccagagtgctgggatcccttccaaagtgctgggattacatgcgtgagccacggtgcccggcataaatgttttcaatcaacataaaagcataaccacttgacatgtcaaaaaatatatttttataacattgatggttttacttctgaaacaagagctcactttagaccagttcttcctcatctttttaaacggttttctgccacaactgagaatcattccaaagaaagctatggaacctctccctagaaatatgcacgtatgcacacacacacatcaaatccacaaagcctaggggatatgggctgatttgtgtactcttaaaaattcatactgaaatcctaacccccactacctcacaatgtaaccgtatttcaagatagggactttaaagaggtaattaggctcaaatgagatcattagggtgggccctaatgccatttgactgatgaccttataagaagagaaaatctggacacagacacgtagagggaaaatgatgtgaagacaggagaaagacggccacctacaagcccaggagggaggcctggaacagctctttccctcctggttctcagaagaaactagctctgccaacaccttgatctcagacttccagcctccagaactgcatgaaaataaatgtattgtttaagctacccagtctgggatactttgtcaaagcagccctagcaaattatcacattaggttaagacaacactggccctaatctcatgtaatatatatagcagtgtttaatgtataaccttttctattctgaagtaacaaaacaacatttaaaaagtaacaggattacaaactaacctactttctaactgtggaaactgacgctccaaacttttcataatgctgcagtagtaacatgaaaaaacaggtaagttcagaaaaacagatgaggtgtgggatttcagccttcttcatctctgttcatagatgcattactcttaaaagtatattgacactactcacgaataaaaaggaatgaactcctgttacatgcaacaacatgcaattgcaaaagcattatgctaaatgaaagaagccacactcaaaaaggctgcgtatcacatgattccatttatactgcattatgaaaaagcaaaactgtaaggacagaaatgagatcagtaactgtcaggtgctaagcagagagaaggctgactataaagaggcgaaagagaactttccggggtgatagaaatattctacatcttaattgaatgtgggttataagactgtatgtgttcttcagaattcataggactgtgcacttaaagcaggaaattttactgtatgtaaatttatctcaataaatattgacacatttgctttattaggcattaacaagaatagagatgtaaaattattgactaggtacaaaaactgcctaatagcaaattcagaataactttatatttgctttcaggtaaaattaaagtacacaaactacatacaaataccattcaacacctacatagacaatctatcagcatcataaaaattttctcttacagatattaaaatgtggccttaaaaaatcactactgtaagtacagcagtgattacagtacttgagaaagctctttaagaatggatgtcaaagttgaagaagttcttttttctttgccctagcaatgtcacttcctggtatctccccttaagaaactctcccacgagtacagagactgtcccagaatcaacctacctgtttgccattagaagaatggctgtaaatacactctggttttattcatgtagcaaaataacatacagcagtaaaatatgaaaatgaagtaggataaattataaaaataccacattagaaaactgtaattacaaggctgggcatggtgttccaacactttgggaagccgaggcaggcagatcacttgaggtcaggagttgaagaccagcctggccaacagggtgaaacgccatctctactaaaaatgcaaaattcgctgggcatggtggtgcgcacctgcagtcctcgttacttgggaggctgaggcaggagaatcacttgaacctgaaaggtggaagacgcagtgggccgagattgcaccattgcactgcagcctgggtgacagagtgagactgtctcaaaaaagaaaagaaagaaaagaaaagaaaagaaaaattgtatttacaagagatgccatgtatgcagaattgtaacccaagaatacatatatttaattaaatacatgtaatacaataaattgtttatggattcatccagtgtgtgaaaacacgcaaaggaatgatacacagcttcaggttatggaggcctctgaggaagcaggaagagagaaaggcatctagatagctgtttatgggaccatttatttcttaaaaacaagtgacagaaatttgatgtaaacatggcaaaatgtcaacattcattaaatctaggaggcagatatatgggtatcatagttttaaaatttttttccatgtttgaagcacttaataattcaatttgtctgcttactatttaatcacagagccacttggttaatgattacggttttctccaggcaccaaacatttgcccctctttgtgaaacagttgctgtttctgatgggccatttcattaccttataattttggaatctgatgtcactgcatttacttctacattaacttcaaccttaaattaacaaccacagcaatcataaacttaggaaaattaaaatccactgagaagttaataagcttgctgccctagaaaaatatctaggctcattttaggctgttgtgtaaataaactaagaagcaattattttaaagaattattcactaacagttcgctgaatgagttactaacaagtaactgtgatttctgaaatatccaaagtatcaggaaacattaacataatctttgtattcagatttggtattctttgtttttcaatagtacatatatattattctttttgttttttattttttttttttttgagacagagtctcgctctgttgcccaggctggagtacaatggtgtgacctcagctcactgcaacctccgcctcccgggttcaaacgattttccctaactcagcatctcaagtagctgagattacaggtgcccgccatcaccagctaatgttttgtatttttagtagagatgaggtttcaccgtgttggccaggctggtctcgaactcctgacctcaggcaatccgcccggctgggcctcccaaagtgctgggattacaggcatgaaccaccgtgcctggcccagtatatgtattattcttatttatctatctgttaccattctaattaccccaaacatgcaaaaaattatttaagaaatgagggttgggaaggatcaacatttaatttaaagaaagccacaagaatgcaagactatttcatccatttcctatttggccaaaaaaacaaaagtttaaaaaaaaaaagtctgttggaatggtaggctcactttgcaaaactgtccttaaacagcaacaagtctcaagacctctcattttaagtctttctttaaaaataagagcttcatttgagccctgagtacttcaaaaactttcttggtattagatcattttaaacagccagagtgcgagtcaaacttctcaatagttgaatttaatgtgctcccacctacccaaacaataaaagcatttctaggtggtagaaacagatgctgattttgcataagtaagtgtccctactgctccccaggtagggcataaatgagccacctgaatgaaagagactcactttaattttggtgcccacatgcctaacagacaccaattctgtgaatgcctctaaattgcccagcacatgaggtaagctttggctggctttatgcaacacatagtacttgataatttgcttaagtcaggaggcttctacaagcatggtgcctttcccaaatgaaagcacatgtaaatagcatattcattccactcttaatatgctcttgaatcaggttataaaatgttaagtgttagtttctgggcacagcccagttttaacctccttctgtgtcagatgcagagatacaaggcaggtggaccgttcaataattaacacaagcgcatctagtgatatttaggaaggcacaggagtaacatacaagtaagaattaagccaaataaggaaacagatcgttacctacaaatcagaaatcttgttatattcgccatcctaacataagtgacaaaccaacttaaatttcccagtacagatcccagcacaaggatattaaatatgtttattaaataggaggaatgtgcaggcttgaaagcagtctggggctaacaaagcagaagcagtagtcctgtgacctgcagaacacaaagttaggctgggttcctgctcttccatctcccgagctgcgagctgcgatggtgtgtcacaaattacttaaggtggcaacagtggtttgggaagcaacaatacacattctatgtaccataacagtgtttgcaaactgtagaagggcaggattttataacattaagtcgaatttgatgagaggtaacacttagttcaaaagagaattaaaagcaaaattttaaaacacacacgcacaaaactttgctatcttttcctctcagccttttggtctttccttactgtaaataatactggagttatgcctgtttttgtgtgtgtatgtgggtttttttttttttttttttttttgagacggagtctggctctgttgcccaggctggatggagtgcagtggcacgatcttggctcactgcaacctccgcctcccaggttcgagcaattctgtctcagccttccgagtagctgggattacaggtgcccgccaccatgcccagctaatttttttgtatttttagtagagacagggtttcaccatgttggtcaggctggtctggaactcctgacctcaagtgatccacctgcctcggcctcccaaagtgctgggattacatgcataagccactgagcctggcctcaaaatgttcatttcaaatccctgaggggagaggttgggaagggaagaggaagaggactatcaatccagaataagtgtggcagaattacaaccttctgtgttcgacagatttaaaactcatggaaaaagtagacatttataaaaacaaaacttgatacatatgaacagcggtatatttttaaagacaggtaacaatgcaaaaaattgccctgggataactgtatagacatctgaaaaggaattgaataattctaactcattcaaagattcaaatatacaaaaataaaaatcataaaatatattaggagaacatgggcatgtgggcttttaaaaaatctcaaagtacaaaggccattctaagaatgatacaaacctataaaccagaaaatgtgtagatttcttcatggcaaaatatggttagtatttattcagcgcttgctatccactagctctatgctcagcacacaccaaacatataattcagggcaacaggcagaattctaagatgattcccacgatggtaccctcccacaagcaagacttttgaacatgatggaatttcactcctatggctacattatgttatatggaaaaataaaggaattttgcagacataattaaggcccctaatcagttgattttaattaatcaaaagggagagtgcctaggtgggcctaaactaatcaggtgaactccttaaaagaggatctagaagtaaaagacaaaatgcaacaaagatgctgttcattggccctgaagaaacaaactgtcgtgctatggaacatgccctgtggcagaaaacagtgaacagcctctggcggctgagggcctcaggtctacagttgcaagaaacctaatcttgtaaatatccagtgagcttgggaaaggatcccaagcttaagaagagattgcagtcctggttgacaccttgatttcaggctgatgacacacttggcagatgatgcagttaagctgcagctggactccaggcctatggaaactctgagataattaaatgggtgttgttttttgaagttgctcagtttatggtactttgttacacaacagttaaaaaaaaaatagagtcaggaatgacaagctgggaaaaatgtacttgcaaagcaattaatttaattagtagaaaaccaatacaaatctatgtaaaagaccaacagccaatagataaatggcaagaacatacatataaacagctcataaacacagacaaatgtctttttagtctatgaaaatatgatctattgtactatagttacataaaatgcaatcattgggagaagctgggtgaggggtacatgggacatctctgtactattttgtgcaaatttctgtagagctgtaattatttcaaaataaaaattttaaaaatatgaccaacctcatccataccaggaaagatatacattgaaatgggctaggagttttcacctatcagattggcaaggatcaaaacagttgaaaacatgctgtgtccgaagcgatgtgggtaaaggcatgttcacacattaatgatagttacacaaagtttaccagtgttgttcagtgctgcatccttagctcccagtgttcaacacagagtaggtgcagtgttcagcgtggtaatatcataatttaaaatgcacatgccctttggctgagtaattagatgcttgtgaatttagcctgctaacatattcctcacatgtgcaaaaataagtaatgaccaaagactggaagcaatatacctgtcctttaataagaaaatggttaaataaatgatggtatagccatacatggggatcctgtgcagcaattaaaacaaggcaaattaatctgaattgatatggatcaagagtagaataagctttccagcttctcaagtcccacagtacaatttcacaacatacacacattcactcattcagtcaatatttacaaagctccaactatgtccaatgctccatgcctagaaaaaagaacacaactatctccatgagagaggatggggcaggtacccacaggcacagagggaggcatgggagtccacaaagaaaggagaccggagttcaaggaccaagagtgggtgaaaagcaaaggtcagatgagagactctgggtgtctaagaagctgggcttctgtcctattgaagaatttgaagcaaaacattgacaagacactacgcaaaatatacactcaatgtaaaaataaaagagtgatctagctggagaaggtcataatctggggaccatctctgatgtcactagaggtgtcttaaggtatctcaacttgagcacttaagctgagtcacgtgggacatgctctttcccccatgcctgaatatgtgctcatattaaaaacatgaggacagcatgaggtcctcttgcaccatgccatcttatggggtggattcaaaggagacatttgccacctcttcctcctctggagaaatatctataagcacccctctcaagcatcttcacatgcatccctcgaccatatcctttcacccattctgcattcaacatgtaggatggaatggaagcagcacactcttccttgtatttcttccatcttccttcctgtctcccgtgctttctagtggggctttcaggcactttgcctgatgccaatacatagagtctgaacagctcttactgaatgggcttcatattgtcagataaattaaatctatgccaaccagtgattcagctgcaaatagaggccacctgttccaattagtgagattaaaatagtaccctgctgactatctgaagccaagttcaggctttctggatgatcacaacatcttgacaaagacagagaaaagggacttttggccccaacacagaattgaacacactggagtaaatatatttaggtgctgaagcacagctttcactaaaggcattctttatttttggacaagtgcttatactgaaatttctgtggaaggctgcagctcaagacaccatttaatttccttccattacaacaagcctacatacacatcttaattaggttcaactttactttagaaaaacatgtaactcaaatttcttctccacccactatctgtccttgcctgaaattcccaaagaattcatattttctggatgttccactcttcggcctatcgtcatccattacctcagtttctcccaggtcatggtcgtcagaagactaaagaggaaataatacagagagaagcaagctcagctcatttccaagctccttcaagtatttccacctagatgagactgcctttgacttatcagattgggcttctgttcatcccagtaacaatcatttatattgaattaaatcaattgatgaggccgagtatggtggctcactcctataatcccagcactttgggagggtgaggcaggtggatcacttgaggccaggagtttgagaccatctcagccaaaatggcgaaaccccatctctaccaaaaatacaaaaaaattagctggcatggtggtgggcacctgtagttccagctactggggaggctgaggcagaattgcttgaacctgggaggcggaggctgcagtgagccaagactgcaccactacactccagcctgggcaacagaacgagactctatctcataaataaataagtaaataaataaattgatgagtacctcatttggtatacaaggatttaagatagattacaggaaacacatatatgtaaacacacacacacacacacacacacacacacacacacattgaaaccaggccagaaaaaaatataaattagaaaaggaagccaaaatcaagaggtaagaaaaaaaaaaaaaaaagaagaagaaaagaaaaagaagcaggctataaaaatctcactcggttctgctgaaatttggatctgggttcctgttggccaaaataaaaaaggaaaacactcactaactcaaattttcacaacccatgagtgggaaaaatgtttctaagcatcttctagaccatgggtctaaagataaatatttcatgaaggaacgaaaggagatgatacattaagaccagggttttcctagatgattctgaattattttaggtgacataagacaaaagcattaaataacatagaatcacagtgagcgagttatttccttttcaatcctcaatccaattcagttgattcagtccaggaaaagtctttggtgctaaaaactttctaacattgctccaacacttgctaactagttttgttgagacagggtctcgccatcacccaggttggagtgcactgatgcaatcaaggctcactgcagcctcacccctcccacctcacccctcccagggctcaggtgatcctcccacctcagcctcctgagtagctgagagcatatgtatgcatcaccaagtccagctaatttttgtatcttttgtagagatggggtttggccatgttgctcaggctggtctcaaactcctgggcttaagcaatccacccaccttggcctcccacagtgctgggaatacaggcgtgagccaccacacccagtgctaatctacttcttaatctgctgctgggaggcctcaaactcagaagatatatagctagaataatgacactgatactttgaaaataaatgtaagttttaaggagataactgatttagaaatatcaagcaaataacagtgcaggtggtatgaggctgtgtgtcgtagatgtgggaatgactgaactttgggaaactgcggtagaccacgaatgactcaaactcagaacaacaaatgttgtaatgggtttcccaacaccgcttctaatggctgctcacaaagccgctaagtgaaagagctgacgttcaagtttcactccagagtccatttcctgatgcttcactctgttgctcaaatccagaggtaagcttaagagagggatgttgggggcaacgaggaaaagacagatgatcgacatttaagaagtaaaccattggggccaggtgcagtggctcatgcctgtaatcccagcactttgggaggccaaggcaggcagatcacctgaggtcaggagtttgagaccagcctggtcaacatggtgaaaccctgtctctactaaaaatacaaaaattatctggacatgatggtatgtgcctgtaatcccagctactcaggaggctgaggcaggagaattgcttgaacctgggaggcagaggttgcagtcagccaagatggcaccactgcactccagcctgggtgacagacccagaccctgtctcaaaaaaaaaaagaaaagaaaagaaataaaccactggatgcctgggtagggtgggggattgagggagcagctcaggcatctggtttgctgactggctgtatgggaaaagtataatattaaccaggaatagaagggcggttcaaagaatgaatctgatatacagactttgaggtgcctgtggaacaagaggtaggtggaagtgtctcataggatacagtaaaagccacattttactccccggctgggctctcaaattggcgtgtaaggcagaagtcacacgggctttttctagggggacgcttcactgggtattgcaccagacatgctgtctctccatgggccatcggactcaagtcctgtctttcccctagtgttggagcagataattgtttctttggtcaaggactaggtgaagttttaggcttgggtttaagggttgtgttatattgtatgcaaattttatatattgaaaacactcggtgctagaagagacccttaaggcgagactcacagaacggagagctttggagaccagggcagacttgggttgaattctaagtcaaacgcacagatgatgagctccatggcttatgcatctggcatacttttttccccaatatcccaccccaacaagtggaaggtcaggacatggatgaactcttcattttgcaaaactttatactgaaaaaatgaagacactaagaggaaccacaaaaaatatatatatatttatatatatattagcaacaatacagtgcaaagtagtttgatacatgaattgtcacccctcttttccccagtgccccccaaaaacctgtaaataaattcagaagaagaatggcctaacatcgtgtcattcaaattcacttttttaacctagaaaagtcacaaaaacttaaatttgttcatacctactgaaaataattttaaattctcattccacccctataacttagcaattaatttggtatttaaaaattatgtaaagcaatcctttttaaagacagaagatggtataatggttagtcccaatcagtctgtattaattacataattttactggttacagtctggctggtgtcattttctgcttctgcaaatggaatggtctggagttaataatgtctaaattcccttccagttctaccatggtaaaaccttgagtctaactttccaaccctctgccttcgtacctttaattcagtcaagccagggttccacagggagttctggtgtggacaccgggctatgttttctagttgctttaaactgccctttgtaatgtttttagttggcacagtctcctcgaatgcctttaagacctgaggaagatacaggtttacaatcagccatttaaaatgtggcttcctcaggggaccggcactaaatgggatgcatttcaggaagcaatccttgaaaagatctggtctctggagagaactcaaagtgttggaaatcacacccacggtctctgctcaattgcagctcctgcaatggccagacagctacaccactgttacatactgttattattcttcctctcccatctgaacattaaccgagcatttagcaggtgctggcactcaacagtgctttacacgtactacaccgtttaattctcacaacagtcctccaagggaagtactgtgacaacccttgtaaaaacctaactttggtaccatgcggcagggtacactatagaaagtcaaccgggccgggcgcagtgcctcatgcctgtaatcccagcactttgggaggccgaggcaggcggatcacgaggtcaggagatcgagaccatcctggccaacatagtgaaaccccgtctctactaaaatacaaaaaaatcagctgggagtggtggcgtgcacctgtagtcccagctactcgggaggctgagacaggggaatcacttgaacctgagcagcggaggttgcagtgagccgagattgcaccactgcactccagcctggtgaaagagcaagactctgtctaaaaaaaaaagaaagtcaaccgaggcacataactccaagactggcactcttaaccactccagtgcactcccccaaagtgtgatgttctgcaggggacacaagaaggcatggtttaatattacaagagccttcacagaaagatcaccaggtaggtgactgatgacatggctcaaaagaaggtgtgaacccacaggccagtcatgaggatctactgaggagacacgtttgcaggcatgtcttgaactccatgttcacaaggaagcaccaccttcaccttgctattcaacagtccatcctcaggagaccaaacatcaggcaaaaacacggttctttaatgatcttaaatcatgagcttatttgacagcctttaagacttcaaactactagcaaaattctcatatcctaggcattaaagttcatgaactatcattctgtatcattcattcacatgtttactgggaatatatgactacgtgcaaaagactggcaatgtgcatgtcataagaattagagcacacaattagggtaagtgcccagcagatgctgtacacatccttccccaggcacccaactagtttagaaagactgggctgctctccagtgttcgccacggaggcagacagggaagtggtaaagaatcaagctctggagttgagacatacacaggttcaaaccctagctctaccatagtttcctaatagccacaagatcttagagaaactaataatctgtctgggcctcagcctccccatctgtaaaatggaaaagtgggatattgtggaagaccaaggagatcatgtatttgaagtgcttcatgttgcctggtgtacagtaagcactcagtacacattaactattattgtgactgcattcttcctttcacctatgttctttttacctccttacagaggaataatccacaaatatactatggttcctttcaggcagcacccctcccaagtcgacggaagcagttggcctatgcacaaatcatatatcctgatgttctctttcgaaggaatgaaaagtcctcattctgattcacagtacagtgattcatggttctcttcctcttctcttgtcaccctcctcccctccactgaaaacatgaaaacacaattaagaaaccacagggctgaaagctgcagactcttctaagtcaagctgcgggcattttccaagtaggactaggttgatttctgaccttagcagcagtcctggagatgccggcagagggtctgaagcaaaatacaccctgagatccaacttggtagcagctgtcttggtgatctctacagcggatgtgacaggcgggtgagctggtggtggccggcagttccttctcctctaaaggaaaagcctgcaacaaagtacagctcgaaaaacacacaccgcatcactttgctcatcctaaatgtaagaaaaacctggcttgagacactcaccattattcattctctttaagaggctctttagaacaaaacaaatcaccggtgaaaacgatatctgtgtactactcaacttaccacttcaccgggtcagtgtcctccaggacagaggtcagtttccactccccctatttcctgcccagggagtaagcatgtgatcatcaacttactacatcactgcccaaccagttccactgtgagaagggctacagcatcctcttcttcactgcctttggtcattactcatcatgtaattgtagatggatttccaaaccacagaacacttgaagatatactacaggtggcactcacgcttgacacaagttttacttcagatgttagagatttctgcatgtattatcatcatgttctcctgtacaagacaggggtattgtccggaaccacaagaataaatgagatacacccaccagatattaagtttccacagagaccagactgtttcatttaccattgtattcctgatgcctagatcagcagccagcacacagaaggtgctcagtaagtattttttgaataaacgaagcatcttgctctcaaagtgccaatgtctatagtttataaatacatgtaagcattaaacatataaacagtcaatgtcatgagaaacatgacgcaaggaggcacaaaatgctagcaatgctagaaaagtctatacttttcacaaaattagcagcctttccgtttctaagctcacaaatccctctttcatatagtacaggtcccctattcaaaatgcttggaactagaagtgtttcagatttcagattttggaatttgttttgtttagttttgtttcggagatggagtctccctctgttgcccaggctggagtgcaatggcacaatcctggctcactgcaacctctgcctcccaggttcaagcgattctcctgcctcagcctccctagtagctgggattacaggcacctgccaccatgccgagctaatttttttgtatttttagtagagaccggattttaccatgttggccaagctggtctcaaactcctgaactcaagtgatctacccacctggcttcccaaagtgttagaattacaggcatgagccaccatgcccggcctaggaatctttgtattatacttactggttgagcattccaaatagaaatatctgaaatcagaaatgctcctgtaagcatttcctttgagcgtcatgttgacgctcaaaaagttttggattttggcttttggattgagatgctcggcctatagtaaaagtggttaacatctattgatttcttattgtgcacccggcatggagttaaacattttatagacattactgaatttattcctcaaaacacccctattatgtagaagtaggaactaaggcttagagtgattacaggatccaagattacactggtagcaaacagcactggtacaagatctgtattctggggactatcctaatgcaaatggttctgtagggaaaataatatggtccttgcatgcaggatggaacagaagttggtgaaggtcataagtgactaaggtgggggatgattgggagatatggaagaaaccaattccagagaaatgtcagagaaaggtgcggtggtattgctaataggttagagagatgggggagggcaggcactcaagatgactagcagttctgattagtagtggcaccaacaaaatagaaaaaaattattaacctgacatatagacaaatacagctttttcacccagtgagagaacataaatttaaaaaaatttttttaaatagctaatatttgaaagcacacaccttttttttttttttttttttttttgagaggaagtctcactcttgtcccccaggctggagtgcaatggcacgatctcagctctctgcaatctccgcctcccgggttcaagagattctcctgcctcagccttccgagtagctgggattacaggcacctgccaccatgcctggttaatttttgtatttttagtagagacagggtttcaacatgttggccaggttggtcttgaactcctgacctcaggtgatccacctgcctcggcctcccaaagtcctgggattacaggcgtgagccaccgtgcctggcttttttttttttttttaaaaaacaaatactttcttatttaagacacacaatcactcccagaagagtggagtattacctcttttacagatgggaaactggaggctcagaaaggctatttaggaccttgccccagtggtcacccagttaagaagctcgaagagccagaatacaacccacgtaggtccagagccccagctgtccaccactatactcaagtggctggagagggcattttagaacacttaaaatgaaaaccaactaaaagaaaacctaattcacacatcattaataaaagccagttactgtatagaaagcagacggcctgtattcttaaaaagatgataggctttaactatctagggcatgaaaaaaaagtaggagtctaattatggatgctctttcttctaaagtagagagatatgtgcatcaagttaacaagcaccatttctgagttttacaaagatgaagttttaaaatgtgaatgatcctgacttgtcagcttagcaacaatcacagaattcattacttacattttcactaaggggggaggggttatctaggtcagtccacctagatgtaaaaatagatttctgcaatgttgaaagagtacactgcctcattattattccagtctcaaaggctgaaataagcccagcaagacagaccatgtagtttccctgttatctcaacaggtattgattttgaatttaaaaaatgaccattcagtaactaagaacttcatctcatggagtctttgcccacttctaggcagaaactccatatccctgaaagattagtcgactcttcccatgaccccctagttctcattggcatttttaggggagctaattcaccaaatgagttcataaaagggttctttttaaatcctatactagtttcctcccaaggagatggtgacatcaagaaattagcactcgatgtcttcctctcgcatcacatacgttctgggtgtcaggaaaacatatctttacagctgcatccaagtgagttccacaatacaggagctacgatcatttaaatggatgaatactttctgcacagtaaaattgttgctttcccttcattacaacagacttattgtagcctcaggacagacttgaaattacatcaaccctgcttgagaaaagttattattatgagtttacaaaaatttcactagttctacctattcctcgctgtctcaacaataaaaaacctaaaagcagatagctgagaagtttcaactgggacctcaagaagtccagcatcactgtagtagaatttgtgattacggtctgctgaagttctagcccttctctgatttcctctcttcactagatctgactggcccaatgtgctaatttacgataatccgcacatataatgtctaactcagttttaatacacagcttatttaaaaatcgggtatctccatgctaacaatacaaggcagcaggtacaataacattgtcagtagaattgttttatttatttatttatttatttatttatttatttaaagacagagtctcgctctgtgcccaggctgacgcgatctcggttcactgcaacctccgcctcccgggttcaagtgattctccgcctcaccctcccgagtagctgggattacaggcgcccaccaccacgcccggctaatttttgtatttttagtagagacagggtttcaccatctcggccaggctggtcttgaactcctgacctggtgatccacctatctcggcctctcaaagtggtgggattacaggcatgagccaccgcccccggcccgtcagcagaattttaaagaaaatcaagaaatcacataaggttttgaccttttaatagaaaagactggcgtagacaggcaacagtggcagatgcggcagaaacactctgcagttaccttacacaattgctttaccacattccacctaagcagttgaggcacaaactttatcaccaccattttacaggttatgaagagtgagttttgtaaagttgcatgagttttgccaaaccacttaaatgagttgacaatgagccatccatcccgctaagattactaatcttgtttacacaaagaagatcacagttgtgacaagaaaaaacaagctttcacatttcaagtctgcaatattaactttacagaatcctctcaattacaaatgcattcgaagatgatctccttttcttcatagttctgttaactagcattacagctatccaagaagaaatgtctacctgtgggtaagcacatttcttcaatgtttattccaaatggagtttctggttattttcacagcaaactgttacgaaacttatacacaaagtgcaaaaacaagagaattgtaagattgagatgagtgcatgaggtattattccaccaaatatattcaatctgtaaaaactcaaatcatccttccaaaatgattaacagatgctaaaggaaaaagggaaagcgggcaaataaaccagagactcattgcttcacttctggggcaatcgattactacttcaaattatgagtgaagaccaaaatcctgcacaaagggccgcgacacaaccccgtcactattgctactatttccatccagttggtctctcgatcttggaagtggcaggccagaatctgagcccggctctccctccgtgaactttacacagaggctgacacccaaatccccagttctcggacaagcgagtaagtagttggcggagcaaagaacaactccaggtgcctcctgccagaacagatgccagcgtggaggaggtgctttgttaaatggcacttcaatcagccctggggagaacgggttacagagcctcacatccagcctcgacgattcaacagcccgggagggcaaaggtattcaccggggagggcgaaggcttcctctcccaggacagacccgcgcttgggctgcggcctccgtctttattttgaagccctacagggctcgtctctgcagcaggctcagaatgagctattttcgcccacagccaaaatcagcaacagcaaattacactgcaaacaatggcgagggcgcctgctcggctcggctcgaaactccggagaggcagcgcaaagattctgacttttcacttgggcagagcccgtccgccgcctccccgcgctccggctgcgcaccgcgctcgggttccggccacacgccccgaggacagggagacagggcggccgccgggacgttcggcggggagggcaccgtcacacccagggcgagaccccggagacctggagacgcggggccgcgggtggccgggtggcgggattccctcgcggagcggcgggcgctccctggcggggaggacagcagagcgcgggccgtcggggaaccgggcgtcccgcatagcgcgcggggacctgggcgccgtgaggggcaggcggacctgggatcccagaaccgcagcctgggctccgacgcccccgacgcccacccttttagctcggaggatcggggaggcacggacctccggcggcagcggagggcggcggcgaaacgccgggggcgcgtgggttagcactgagccgccgccccagcccgcctcgcccccgggcccgcgcgcacccgccgccccccagcccgctgcgctcacccggctcttgcagcggtggtgccggccggggtacgagtaggtccggtccacggtgagcgccgtgtcgctgcccggcatctccgcgctccggccgcgaactttcccgtcttctggggctgccgcgccgcgagccaccggctgtgctcgggatcaccctgggagccgcgggcgagggggcggcgcggctgctgcagctgttgcctctggtgccaacacccgcgcggccgccctgcgccgccgccgccgcggggtgggggaggcggggcaggaggcgagagtctcctcccccttcccttctccccgcctctcccgcgccccgcagccgcctggaccccccacccacccccgacccgggaggcaatgtcttcgcctccctccctggctgaaagttgattccatcccctcccacacagccctctttctccccaaaagataagcgacatccacactacactatctgttgacttattttatatataaaaggtgactgttactgcaagaagttgacacttgccttaaatgcctctttttatgttattctccattcaacaggcacttactgggcagctgccatgtaccagacgctggactagagaccagagatttaaagtaaaaaaatgaaataaaataaaaactccccccgaccatgattgccctgagcatagagcatacttccacttaaactaagatcctactgtgttgtgtattttaattttgcatatctggctcacctttatgtttctttcttttttttttttttttgagactgagtctcgctctgtcacccaggctggagtgcagtggcgcaatctcggctcactgcaagctccgcctcccgggttcacgccattctcctgcctcagcctcccaagtagctgggactacaggcgcctgccaccacacccagctaaatttttttgtatttttagtagagacgggatttcaccatgttagccaggatggtctcgatctcccgacctcgtgatccacctgccctagcctcccaaagtgctgggattacaggcgtgagccactgtgcccagcttacctttatgttttaagctacttggaagtcaggatatcttttcattttagtattccccattcccagtcatcagtccctgcccacaaggaatttggagtttagaagaggaaggaccattggtgaacaatttaaatatcagtaaccccaaacaaaattcaaaacacctgttctggctctgtagggtgtacagtgggagactgggctgaaatatttaaagtgcagctgttccagagaggacctggagcccagtgtgaccagtccagggggagggaaggatttccctcatagggttcaaaggggacggtagagcaggctgaagaaaactttggagcccctaaaatcagaggtacatttgggaaaacctcaagtcatcagttttggggagtgtcctcaggaacaggaagacatgatggaaaagaaggcagagaccatgcagaatcttcgttcaagggtaagaagttcagccttattctgtgggaactgggtagctgttggaaattcttgaacagggaaatgatagcatgggaatggaagtttaaggagaaggtatatctgacatcagggtgaagcagcgattgaagatgggcaaaacacactggcttcttagaaggccactgtaaagacagaatagcctaattatccttcagaaggagactaagtaaataaatgatggtacatcatccaatagaatattaggtaactggaatagaaatgaggcagccctctatgaatagctttggaagcaaatctaacatacatggttcagtggaaaaaaagcaatgtgcaggataatatatatggcattccaccatttatgtaaaaacaatatatgttatgtgcttctacatgcacgacatatatctgggaggataaataagaaactagggaaacagacaagaaattgatgccaagagaggggaaccaggtagctagaaggcagagatggagagagatctaattttcactgtgtatacttttgaaacttgaatgtttatactgtgggcatatattaactattcagaaagtaaaattttttaaaaaatgttttttagagatagggtatctgttgcccaggctggggtgcagtggcacaatcatagctcactgcagcctcaaattcttggtctcaagggatcctcccacttcagtttcccaagtagctagaactacaggtgtgtgccaccatttctggctaattttaaaaatatatttttttgtagagaaagggttaaaactaacttaagaagaaattgaaagtcccatgtagtccttaagccattcaaaaaattaaatcaacacttttaaaaatacccatctaccactaccccaacacacaactatactagacccagagagtttttcaggtaagttctttgaaagaagagaaataccaaacgctggggtgtgtgtgtgtgtgtgtgtgtgtgtgtgtgtgtgttggagggagattttagctagggtggctagagaagtcctccatgataaggtgaccttgagcagagacttgggaaatgaggaagccagaagtatagacattgaaaatttccagcagacaaacagaaagtcaagggccctgaacatttcgggagtgttcaaggaagagcaaggaggccagtgttcactggaaagagatgaggtcagagacatttcagagggccagatcatatatggactttcattctattttaagaactttaattttaggcagggcgtggtggctcacgcctgtaatcccagcacttcaggaggctgaggtgggccgatcacctgaggtcagcagttcaagatcagcctgaccaacatggagaaaatctgtttctaccaaaaatacaaaattagccggacatggtggcgcatgcctgtaatcccagctactcaggagtctgagacaggagaatcgcttgaactcaggaggcagaggttgtagtgagccaagatcatgccattgcactccagcctgggcaacaaaagcaaaactctgactcaaagaaaaaaaaaaaagaaaagaaagaactttaattttggggaatatgggaagatttggaaatttttgagcaaaggagtggcatgatctaccttttcacttggatgaaaataaaattgatctctacctcacagcataaacaaaaaccaataccagataaaggaaaaataaagaaaaaaaattagctggacatggtggcttgcacctgtaatcccagctgttcaggaggctgaagcaagaggttcacttgaggccaggaattcagcctgggcaacagagcaagacctgtctctaaaaaaattaaaaattaaaaaaaaaaaacagattaaagacttaaagtggaaaaaacacaacttaaaattgtcagaagaaaatgaaagaatatcattattatcatctcaagtaaaaaaaaaaacaagacacaaaaagcataaaccacaaaggtttgacattaaaaaaattaaacttctgcttatgaaaataaacaataaagtaaaaaaataagccacagaccaaactccagctaaaaaaaaaaatcaatatggacaaatttcacaaacaatactgagaaacaaaaaaagcaagccacaaaaaattacttgcagtaagattcatgtaggctgtgtggtagctcatgtctataatcccagcactttaggaggctgaggtgggaggatcacttgagcccaggagttcgagaccagcctgggcaatatagtgagaccttgtctccacaaaaaaaaaaaaaaaaagattcatgtaaagtttttgtttggttggtttttttgtttgtttgtttttggttttgagacagagtctcactctgtcgcccaggctggagtgcagtggcacgatcacagctcactacaacctctggctcccaagttaaagtgattctcatgcctcggcctcctgagtatctggattgcaggtgtgcaccaccatgcccggctaatttttgtgtttttagtagacatggggtttcaccatgttggccaggctggtcttgaactccttgcctcaagttcaagtgatccacccgcctcaccctcccaaagtgctggattgcaggcgtgagccaccacgcccagccttcctgtaaagtttaagaaaagcaagaggataataaacacaaatttcaggacagtatctctggtggggagatgaagaaggcttcaatagaaaaggggtacacaattataaatatataatgctctttaacaaatgactgttggtacactggatgtacattcattcatacatacacacaatagtgaagaataatttaaaattttaaaggtaacagagtctcaaaggaacagatatggtgatatccttaattctggaattcaaatcaccagttaggggtaccttctcaaataaataaacataatagcactttacgtgtgaataaactcagagaggccctgacaaaccagggttgggctttgcttgggggtaccaacaggcatctactttccatttctattactgtcttgatgtttcttagaattccatcctggaatgctgaccctcaatgagaaggataaattaaaactttattaggctcatttaaatgtcaattaacaaaggatgttcttttttagatcatttaaatttatttcataagctagttgcccaaaagctgctctgctgggcactcatacaaaattattttttaaaaatatacaaattaaatagcagaagagcaagctccccagaacagaaagaaaacaagcagtgctgatcaccatctgggtctccttttgggaggcagaacccaaggggaaaatagaccacatcccctcctttggacgcaatgccaatgcctagggttttgtcagccctggagagagagagagagggagagcgcaggtgcaaattcctcctgtcaatgtaagaattctgtgcttttgatacctccaagagcctctctctgcagaaagtatggaaaatatcgcactgttaaaataacaaatgcagtcagaacaataagaaatacaaaggttcatacctaaggtgtgaaataagaatttacttgcaaactataaggaaggagcacaacaagacagcagatgctaaaagcaccaaagaagagaccaggtcatttgagctgtaatagtttaaagtttggagtgaaaggcctatggaaagaggtaggactacacttgacttttgtagtgcgtgtttgttgtttcagcctgcccaggatcccaccccttattctgaagacagtacctaggttttctattgggacctaccctactcctacttttaatccaaatggcttagataaggtggaccattcccatccttggatctagagagtggcatgtcatccagccttggccagtcagagtcactgtggcttgtgcagggatgggcacatgagctaatcagagcagatgagagtcatccccagacttttgtcagaactgctgggaaagcctatgcccttccagtgggcattgctaagctggtacaatgcaagcctgatgctgtagtggacatccttccaccatataaagacagcctccctgggaaagcagagccatgaaacggagaaagacttcttactaaatccttagagcactagatccagcattttccatctgctatcgctgcatgacaaaccaccttaaaatgctttggcttggccaggtgcagtggctcacgcctgtaatcccagcactttgtgaggcagaggtgagtggatcacctgaggtcaggagttcgagaccagcctgaccaacatggtgaaaccccatctctactaaaaatacaaaaattagctgggagtggtaatgggcacctgtaatcccagctactcaggaggctgaggcaggagaattgcttgaacccgggaggcggaggttgcagtgagccaagatcacgccactgtactctagcctggatgacagagcgagactccatctcaaaaaaaaaaaaaaaaaaggtgttggcttacaacaataactacctctcattagctcatgattctgcaatctgggcaggcctccaagggaggtgaggtggcttttctctgttccatgtggcactgggggggggggggtagggtgtccaagatggcttcattcatatgagtgacattattatatatatatatacattggttttcacccatggttcctggcttataattaccaatgcccctgtaatagtctcttgtcatgattttggggcactttagatcccagaagccagcctcagaagccttatcctacccttgttccagctgctcttttctctcctgaaggaaggaatcttcccccgcctttctgtcatgcagctggccatgaagaaattctctgacctaccttgtctgactgtaggacataaggttcattttagaaggggtcctgctccataccctggaggaaagaatgctgcacagagaagccaagaagaatctgaacagacaggccttgctgggtctcgccactcagtctcttagtactagatcatatacccttttgtccagtcacatttctacatggttgtcaatcatgcccacccagtgacgtctccataaaaggccgaagagtacagggttcagggggcttctggatagctggacatctatggagggtggtgtactcagggaagacacagaagccctgcgctccttcccctacctcgtcccatgcatctcttcatctgtatcctttctgatatcctttatactaaaccggtaaatgtaaaatataaggttccctgagttctgtgtgctgctctagcaaattaatcaaacccaaagagggggtcatgggaaccccaacatgaagccggttggcccgaagttctgaaggcctgggcttgtgactggcatttgaagggcagtcttggggactctgccttcaaactgtggggtctgacgctatctccaggtagaggtggaggacacccagctggtgtccagaactgattgcttgcttggtgtgtggggaaacccctctcccatatttggtcacagaagtcttctgtgtttattgtttttgtagtgtgagaacagaggaaaaacatagtttgagttgatttttctacaaacaacgtgtcagcacctataagacttagggtggctggaatggtgggggctggccgggcctctgtctttatttttatatgtttatagttttttaaaaaactttttatcttactctgtcacctgggctggagtgtgatggcatgaccatagctcacggcagcctcaaacacccagattcaagctatcctgccacctcattctcctgagtagctgggactacaggtgcatcagcacgcctgtctattttttgtagcgacagggtcttgctgtgtgcctaggctgatcttaactcctggcctctcccacctcagcctcccaaagctgggattataggcatgagccactgtagccggcctgtttatacttttttaaatacttttttttatagtctctcatctctccatcagggtagttggatttttttacatggtggctgccttctaacacagcaaaaacaaaagctgccaaatctcctaaggcctagcctagaactggcagattatcacttccatcacattctactggtcaaggcaagtcaaaagtccagctcagactccaggggaggagaaacggggtctacctgttgagggaaggagtgatgtgcacatagatgggagaaattgctgactgccattttggcagccaatccaccacaccagccttgcctagaccaccttttcagtgatatgaagcaatggattcctctttttgctcaagcccgttagagatggggtttctgactcctgcaacccaaagaatcctgtctgatgcaacattcaatgcagggtatgggcagaaagaagacaaggaaaagggcagcatttcaagagaaggcaagaactttgaacagcacaaataaagggagaatcaacagaggattctagtgggggcaccaaggactctagagttttctcaggccactagcttgagtcttctgtggtcagtccacaccagattacctgtgaactgctcaactatttacagtctggactaattatttcaatacaaaggttataatacattatattctttaaatatttcatgtgataatttctatgcttcccccctacacacactagagtataggttacctgaaggaaaggactgtactttccaggtacatgtaggtattctggacagttcttaacatagtattcaataaatgtttgctgagtgaatgagatcaacattattaaatgtctacttatttcctaggcattggggttttaaaaaatgactccgacataagcaaaaactagtgtctgttcctaaggggttggaatgggtaataggaaaggatgaaaattcactgaatgatggatgttaccaattttcagctactaagtagttaatgacatttgtgaattctcccgtcatttattgagcacctttggtgtgacagcctctgctcttggtgctgagaatatagaaatgagtaagacatccagaagggacagcccatctagacagtgaggcagacacctccaaaaacgttgctgtagatgccaggatagttatgtgcttggcatggtagtaggacaaaggaaggaggtggtctcctcatgcagctcacttccttagatgtttcagtcctatggtcatcacagcagggagaaggagagacaaggaaagccagatgttgaaaacaaaagtacaagcctcttgtaaaggaaaggaaaatgtatttcttttcatattccagtttgatttaatagtgcagggaagtgttccctttgggggaaagagtcataagacaaaaagtacaacaagcttccctctgcaaggatataagaacagagcaaaaggaagaataaatcaggtttttaaaatgtattcttctagcttgaggtgaacacatgctgatcagctctacatatctatattacagatagatagatagaaatgcttatgttgcggatcagcagctttctggcctgatgcaaacatggatctctaattctaactacctggtttatagccaactaaaaatgaccacactcttaacatctacatttaatttctaacataccatgttctatgtgactgcaaataaacaatcactgctacttatttagtattagcaattatctggcacagaagcccgaaacttccacttggcaagattttgattaaaaacaggaaagtagacagactcaattgaaactctgcaggctagggaacttgcctttgaatattcctttttttagcaaatgcaacaattccatgctattgatttctcaagagcaatgagaaaattctccaggctgccttcaagtgtcctgggagatggtcttcaacatgtgccttgcctgcagacttgaggctacataaagaagtacaaaaatgtattttacttcatcaaaagtaaacgcttttgcttctcaaaaaactctgataagaggataaaaagacaagatacagatgggaagaaaatatttacaaaaccaaacatataacaagtgatgagtacctagaatgtataaagaattctcaaaactctatagtaaaaaataaacaatccttggcccggcgcagtggctcatatgtgcaatcctagcactttgggaggccaaggtggcagatcacttgagatcaggagttcaaaatcagcctggcccatatggtgaagccccgtctctactaaaaatacaaaaaaaattagtggggcgtggtggcgggtgcctgtaatctcagctgcttgcgaggcctaggcaggagaatcacttgaacccgggaggcggagattgcagtgagccgagatggcggcactgtactccagcctgggagacagagcaagactccatctcaaataacaataaaaataaaaataaatccaatttaaaaatgagcaaaacataggaacagacatttcactgaagagaatatactaatggcaaataaacacatgaaaagatgttaaatgtcattagctattagggaaatgcaaattaaaaccacaatgagatgttactgctcacttatcagaatggctacaataaaaacgagttataacacatattgctggcaaggatgtggagaaactacataaatcatacattgctggtaggaatgtaaaatggttcagcctctctggaaagcagtttgacagttttttataaaactaaaacatgcaaatctcccatctgacccagcaactgcactctcaggcatttatcccagaaagaaaacatgttcaaacagaaacctatacacaaatattcatagcagctttattcgtaattgccaaaacctggtagcagcaccatgtccttcaacatgtgaatggttaaacaactgtggtacatccataccatggaatatgactcaacaataaaaaggaacaaactatttgatatgcatcctttttttttttgagatgaagtctcgctctttctcccaggctggggtgcagtggcacaatctcagctcactgcaacctccgcctcccaattctcctgcctcagcttcccaaatagctgggattgcaggtgcctgccatcacacccagctaattgttgtatttttagtagagacagggtttcaccatgttggccaggctagtctcaaactcctgacctcaagtgatctgcccacctcggcctcccaaagtgctgggattacaggcatgagccaccgcacccggccccacttacatagcattcttgaaatgataaaactatagaaaaggagaagagatgagtgggtaccaggctctaggaacgggagggggtagttgcaggagggaggtgggtgtgtttataaaaaggcagcaccaaggatcctgtggggatggaactgttctgtatcttgagagtggtggtggatagaattgcacaggactaaatacacacatgcacacacgcaaacaagtactggggaaatctgaatgagattgatggattgcaccaatgttaatgtgatatttgtactgaagtttgacaagatactaccatgggagacacagatactaccactgggggacaggtaaagtgtacagagttcctcagaagtattccttacaagtgcatgtgaatctacaacaatctcaaaattaaaagtttacttaaaaatgtgttttaaggccaggcatggtggcgcacgcctgtaatcccaccactttgggaagccaagatgggcagatcagttgaggccaggagttcgagaacagcctggccaacatggcaaaactttgtctctactaaaaagacaaaaactagccaggcgtggtggtgggtgcctgtaatcccagctactcaggagtctgaggaaggagacctgcttgaacccacgaggtggaggtagcagtgagctgagatcgtgccactgcacaccagtctaggtgacagagactctgcatcaaaaaaaaaaattaaattaaatttagatgcaactgtagtcattttcacagaaaaaactgggttttgggaggaggggaacaacacaagcaggagtgaactttttctctgaagaagttgttcacagaatattctaccaggttatggccctttgctgcaccagaggagttgaccagctgtggaaactgagggcaaacaaagactgtaggtggtgctcattaatatgaccacacatgtcagtacctggccacagtgcatgctgtgtctcaaccacacaagttcagggccaacggcaatgtccattatccttggcccatcagtgtggagcaaagcacctggcacaaagcagtgattctacaaggtttttatggaataaataatggataattaagtcctgatttggttggaagaacatattaacgttcatagatttggttcaggttcaaaacaattcattatatgagttgtttagtaaaaggttacatagcaagtttgagtagagaattttgcaaattcctttgagaggtggaggcgggcggatcacttgaggtcaggagtttgagatcagcccagccaacatggtgaaaccctgtctctacaaaaacacaaaaattagccaggcatggtggcacacacctgtagtcccagcactttggagggctgtggcatgtggattacatggggccaggagtttgagaccagcctggccaacatggcaaaaccctgtatctacaaaaaatataaaaattagctgagtgtagtgatgcacacctgtaatcccagctatttgggtagctcaggcatgagaattgcttgaaccctggaggcagaggttgcagtgggccgagatcatgccactgcactccagcctgggcgacagagcgagactctatctcaaaaaaaaaaaaaagaaaaggaaattttgcaaattcatgtgctttgctttgctccatgttttatgattcctatattggtttgagtctttactttatatcatgcacacacagattataatataagtggtttgctatttctaacctcttgactctaccacttggaaagagtttcactctctgattatcgtgtatgactactggctatttgctactgcagttttccagaagtctacaacagggttagaaaacaaacatagataaaaatgccttactttttactaggcacgaaatgttccattcagttaaacctgtaactggacttgtgatgcttgggttcctacttcacacaaccacagagaaagcagttctctggggatctctagctgactccattctatgcacggctagcccaggagaattgtctttcattaagcacatactgaatctgaaggatgagctagctacactccaggaacatatcgtccgtgaattcactttgcattttatcaactcactttgcaggataaggaaagtgggaaatgaaactgccagaaaaatctgatgtgatgttgtttttaaacagtccaagtcacagtcctttcaaaagaggatgctgcttgctgaagccttccttgtccactccagtccacactgttatctctctcccttctctgaattctgacagtatctgttgcttaaatcactcacataaacattcaattgtaaatgatcttgtgctgttacagggaggcggtatggtgtactggaggcagactgcttggattcacatcttggcgctgctccttacgagctctaaagccttggttctcacattcataagctaaggataacaatagtacccacctcatactgttgttgaggattaaatgatgtaatatatgtaaagcacttataaataagagctcgataaatgtctgcacaaacaaaacaaaacctaaagtctgtcttcacgtggtatctctttctccttaccagtaagacttcagtaaggatgtatgctgttatcctggaaagtgtcctagtaaggtggaggatgcattttgatgccgtatgtcatcatcacaaattttgtgaataggattaggatgaaagtaggagcctgtggacaagctctggaccccggccatccctccctctctgcctctgcttgtgctgttcctaccactgcagagtctgcaaacttgcacaagtgacaagggcacacttcctccttttacactaacctccagctcctttcattcccaaggccgtagctcccatgtagaatacacagagtctttttgctggtacactttgaccaaaatattctacttctaggaagctatgctaaagaaataataggctgggtgtggtggctcacgcctgtaatcccagcactttgggaggccgaggcaggtggatcacgaggtcaggagttcaagaccagcctggccaagatggtataaccccgtctctactaaaaatacagaaaattagccaggcctggtggcacgcacctataacccagctactctggaggctgaggcagagaattgcttaatacctggaggggcggaggttgcagtgagccgagattgtgccactgctgtccagcctggcaaacagggcaagactctgtctcaaaaaaaagaaaagaaataatacaggaaaatacagaaaaacttttacacacaaacatcacacattttgtcattctgaaaaaattaaaacaattcaaaggattatttattatgaaaaatcatggactgattatataaattatgatatattcataaaaaatgcagtgcagctattgacaattatacttaggaagaatatgtaatcatatgaagaaatgtttctgtaatgatattataaaaattataacaggccgggcatggtggctcacgcctgtaatcccagcactttgggagactgcggtgggcggatcacaagctcaggagatcgagaccatcccagctaacatggtgaaaccccatctctactaaaaatacaaaaaaattagtcgggcatggtggcaggcacctgtagtcccagctacttgggaggctgaggcaggagaatggcgtgaacctgggaggcggagcttgcagtgagaggagattgcaccactgcactctagcctgggtgacagagcgagactctgtctcaaaaaaaaaaaaaaaaattataataaaaaatcagtataactctacaagactgacaaaaatagaaaagtattatgatacttagtgctggtaatgatctggagtagcaggaaccctcatgcccagccactccattcctcagtatatatctatcccggaggccacacatcaaccaggacacacgtacaagaacattcacagtggtaacagtccctatctagaaacaacccaattgtcattccacaacagaatggataaagaaattgttgtacagttatttcacaattaaggtcagtcatttgttgccaaaaatcaaatgttccatgtgaaaatgctaacagggagcctgttatcttaactcattttgcaaagtagggtttttctgttatgtgtatcaaacctaatactgactgctacagagcctaacaaaatgccccatgcaaagtatcacaaatgtcgatatcttctgtcccaccccacccccggaaaatattcagggcaaaatggtcaacagaagtccaaaatattttgctactgaagagtaagagaaacatctttctccatttcttctgtgtcttcctatagcatctctataggactttgcacagagccagtaaattgcaatagttatttattttgcctacgtcttctgcaccagacactgtcaatacatcaactgagttactgccaaactcttgcccccccatctctatgatggaaggtgctatgattttcccaatatccggagtagcaaccaggacatctgaatagatcaagtgatttgaccaaaggtactcagctaataaatggcaaaattattgtccaaattccaggtctaagcttatttactaggtgcatatccttggatgagctctttaatctttataagcctcagtttcctcaattgtagaatggaatttgcaattgtagaattgcaattgtagaatggaattgcagatggaattctaaaaattatacccattaaacgataactatctcttgactaaaagtcaaggctggcactgctgagaatatgaacagggaagaatctcagtgcatctgcagagtacactgttgcaggttccctctcaaaacatttaacttaaatgagcctgacttgtcctcattccctgtccagcctttccctgcttctccataacagtttaacacacatccactattactaatattcccatgaagatgatttctacattctaagcctcttgtttcctgttcttcccatgaagaaagaaaacgaagcttttgaaattcaaaattatatcatcatgactttaccctttatctgaaggctccttgtaaatcttttccatcatttctaagcacttctagattttcagttttgcatgtcaagtttcacaaaattagaagtcaattctcctatcacgttggaagtgaaggttcaatttcctgcgagtatttagaagtcctcactgtcctagctgacagttttgaaaggtattctatagttctgttatttctcactgcttcttcctacatcagctgtggctgatgcactcccagttaatatttctgacattctattgattttcttccattagaaggaatatctttcacaaaaggagaagaatgctatacaaggcacaagatttaaagtatgtaatataataccatggagtgtaggatacccagcaggcaagtacacccactaacatgcatgtacacacacatacaaaggaattagtagaagttatcaggggccaggtacagtggctcacacctgtaatcctagctctctgggaggccaaggcaggcggatcacttcggccaacgcaggcggatcacttcagcccaggagttcaagaccagcctgggcaacatggcaaaaccccatctctccagaaaaatacaaaaagttagccggacatggtggctcgcgcctgtagtcccagctactcgggaggctggggtgggaggatggcttgggccctggaggtcaaagctgcagtgagctgagatggcgccactacactccagcctaggtgacagaacaagaccctgtctcaaaaaaaaaaaaaaaaaaaaaaaaagttatcaggaaatcaagaatataacatgtaggtttttcagaacattagcaggatttggtcatttggagtttacaacaacaacaagcttccttttcaattgctaaaaggaactgaggtaacggaaaaaacaaatacaagatccaagaagatgctgaccaatttatagagctctattttgaatttctgcttcaatgaaagagacagaaaatccataaatttcattgctgcttcttgacactcacgattgcaaaaccattctctggataaagctctactgagatggggcttttcccattgtccattgtttacctctaatccttttacaaagggaatcgtactttccacaatccaaaaatgtcagaatgttttacatataaccaattagaagacagatgattagaatatggattattcataaaaccccagcccaggacctatttaaactactatgctttaaatattttccctcatttagatatcaagatgaagtgtacaataaatgattgtctgaatctgcatactgaatacagtagatgctggtcacatgagcgcaccgaggactcgaaatgtacctattgtgactgaggaactgagttttaaatcttacttaattttaattaatttacaccttaaagacagtacaaacaaaagaaggtaaaatatctcataaatattctatactgactacatgtcaatatgaatcacagagcccatgtttaattatcaaaatgtcaaaacacagagactgacaagtattcttcacatctcattatataaaatgagccaaacatgagctaaacatacaaatactagtactatacatggctctgggagggatcccaagggatctctcaggtttaaattaatcctccttccctggtagcatcttatgtatagctttagcatcatacttaccacagtctaatttatgtgaagtaaattgtacgtacgtctaccacgcctccctttagtagactgtaatctttttaaaatagaggacttacttgctcattctaaaaatccatcagtccccagcatggttgttatattggaaatccttccataaatgtttgaggatttaaatacagtgtgtactaatattttttaaacattcgtttttctataaaagcaagcctaaaactaatattaaggtcatactcatggaggaaaagatgcagtatcaaacaaatgtcagttttccctaaaagtcaatcaataaatgaaacacaatccagtaaaaaaggatttttccaaaaacttgacaagcttattttaaaatttgatggaagaggccaggcacagtggctcacgcctataatcccagcactttgggaggccaaggcaggtggatcgcttgaggccaggagttggagaccagcctggccaacatggtgaaaccctgtctctaccaaaaatacaaaaaagttaactgggtgtggtggcacgcgcctgtagtcccagctacttttcagtgagccgagatcatgccactgcactctagcctgggcgacagagcaagaccctgcctcattaaaaaaaaaaaaaaaaaaaaaaaaatcagcgtaagaggggccaggcgtggtggctcatgcctgtaatctcagcccgttgggaggccaagattattggattgcttgagaccaagagttacagaccatcctcggcaacatggctaaatccatctctacgaaaaaaaaaaaaaaaagctgggcatgtgggcatggtggcactgcacgcctgtagtcccagctacttggggaggctgaggtgggaggatcgcttgagcccaggaggtggaggttgcagtgagccaagatcgggccactgcactccagcctgggtgacagaccgagaccttgtctcaaaaataataagcaaacaaaatgaaaaataaaattcaatggatgaaaaaatacaacttgggggaaaaatatggggagtaggggcagacagagtgagctctccctaccaggtagccagacattttattggcaatagttcaggtgattaggaattggcacagagacccaggaagagagagctcagaaacaggctcatgcacatatgaaagcacaatctaggatggaggtggcatcagaaatcaatgtggaaaggaaataattggtagttcatattgaaaagagtgaaactgcagtagatccctgaataccaaaccaaaatttaaaatgcaggtgcaattgtttcatctcagaacattcttggtttttttgctgttgctgtttttgcttgttttgctttttttgagacggagcctcactctgttgcccaggctggagggcagtagagcaatctctgctcattgcaacctccacctccggggttcaagcgattctcctgcctcagcctcctgagtagctgggattacaggtgcccaccaccatgcccggctaatttttgtattacaggtgcacactgccacccccagctaatttttgtattttttgtagagacgggggtttcaccatgttgcccaagctggtctaaaactcccgatctcaactgatctgcccgcctcagcctcccaaagtgctgggattacaggcgtgagtcactgtgcccagcccacattttctattattgataattcattgggaattctagatggactgtataatacataaattatacattgatatccattgttcctacttgatcaataaataggaataaattaagaacaataaaaggaacaaatgatttttaagaaactatcttgaagaggcctacaccacagggtacaaaaacacatttttttccttctttaaagtactgaatcaagcaaaagtcccttatggctttataaaggtcacacttttagaatggagctggaggccatcaaatatacagagggactccatgactgtgcaaagtacttctaaagacttctttgaagctaactctataaagctgaaaccaaaatccagccaaacaatgactgctctggtgctgttaacagcacctctccactcatctccatctgggctgttaaccgagcgcagcttggctttatcttaattcacccggatcgaagcgggttaattctcagcgtaaccccatgcatcagacattcctagcattcaacatcagcatgaacacagctctctgaatgccacatagtttccttacacttccgtatgcctgaacctgtggtccaaatttttccctgacttcaaaggaggtcaaaatcccaaaactgggctttgatggggaaaaaatgttccaaagacgtcatacacctagaacatgtttcacacacgtgctagatcatctctccagagagtttatttcctgcttgaaagtggtttcacctgtttttctaggtctccttcttggattctcctgtttgatgctgcggcgatctcataacagaaatgtgatattgctataactatttgtattactttgctcaggctgccatagcaaaataccacagactcgggggcttaaacaacagaagtttattttctcacagttccagaggctagaagtctaagaccaaggtgccagcagggttggtttctctgaggcctctccctttggtttgcagacagctgccttcttgctgtgtcctcacatggtcatccctggtgtctctcagtgtgtccaggtttccacttcttcggttttttttgttttgttttgttttgttttgttttttgagaaggagtctcactctgtgacccaggctggagtgcagtggcacaaccttggctcactgcaacctccgcctcccgggttcaagcgattctcgtgcctcagcctcctgagtagctcggattacaggctcatgccaccacgcccggctaatttttgtatttttagtagagatgggttttcaccatgttgcccaggctggtctggaactcttaacctcaggtgatccgcccaggtggattacagaggcgtgagccaccatgcctggctggtttcctcctcttacagggacatcagatagatcagaacccagcctaatggcgttgctctaacttcattacctctttaagggtcctatctccaaatgcagtcacattctgaagtactagggtctagggcttcaacataccaatgttacaggggcacagttcagtccctgacaccactcatgcgatgatgaacttggcaaatgtatggaagcagctgtgcctggagataagggggaatagcagctggggaatgagagagtagggatcttgaaacctacaaagaaactccacattcctgggaaaataaagccctgatttcctttgttgaaatctgctcattttgattaggtactttcttaaacccctactttaattttgcatagagatagagctacataaaaatttccatccaaagagataactaaagaggtaatgacccatagaatgtctttaacagctcttcctagtatgcagtcttcttttcttaagaacagctacaattctcaatatgccatttctctgcataaagtatatgtgcacagcctgtgatatatgaatagaaagggagagtgtggggagaggaacagaggagatgagggaacaaaggaaggcagtgaatggagatttttaaagaaagaagttcagtgtgaaaaatacacacaaactcctgagaggtaggaatgtactgcaaagatgcttctctgaatgagaagccagggcaggcccaaccaagtgaatttctggtatgaaaagaggtaccaggaaggaaaaagaagtataaagtttttaataagaccaagtgattcagttttgaaatgagatataatctaacttaaaggacttgggagacaagtgagaacgtggagttatcagtggagacagtaccatagcagctgggggcagaaagttctgcctttgtctgtgggttttgcaggtcaaataaacagtatccccaaagattcaaacctgaggcttgcaaaggactctccagttccagattctggtgttaaaagtctgtatcatgcctaaataaatatatttaaagagctgtggccaaagatgtggttttataattacatattgatttatattggatttcttggttggctgcagagtttggaatctttccagcattactttcttgccaatttctaggtagcttatagcaatttcaaagtacctccaattatacattttcaacagatgggattattaaatgcttagtgcaaacaatgatccatagatgtgttaccacccaccagtagacaaagccgagcttctctctgctccactctcattccaataaatatttacatccttccatttactcatttcaagactgtaggatatggaatttcattgctcttttaaggtgagtgcaagaaattgttaatggtttctggattttccaattaacttgctctcagaagaatttatctttagtataaataacagaatggttcatggtctgtagatattttcatctacacatccaagtatggtatcaatttttaagtaggaaactttttttttttaagcatttatacttttaaagcctagactgtagaacttttcagaacaaggtgtgtggttcagccttctttttcagatgaggaaacttgaggcacagatatgtaaaatggcttgctacttggtagcagagctgaaggaataggcagtagaagagggagaagagactctgcagttcgtgtgggcacctgctgggtggccaggttctcatctttgtggcttcacaaacacacaccttgcagccagcatccttgtcacaaactcaggctagcaaggctgagacggagacaggttaggacagtggcccgctgtcattcacagtaagtgatttaaacccaagtctgtctgataccccagaccaacccttttccatttccctacactgttccctaaacagaaccaagttatattattgagtttaaaactgatatttataatggcattagataaagttagattcaatagcttctccaaaccctaggtttattttctagtattcaatctctgaattgttattggtttctgttttggcagcataactgacatttacttaagaaaatatgaattaatacatatttaggtgtaaatcaagtgaaagcctagctgtttgaccttaattaatcattaatggaaaaaattccctcatcctttgagcctttctattttgaatgcaattatttaaatgaaaatgtagggcagtcctctttaccatgtcttacccgaataggaaattcacggagtgtatctcatacgtccatccccagtgttcacggtgagagacatgaaaaggtacaagaatcagtcagctagtaagtgattcaaactcaagaccacctgacacccgaaaccaagcctttttattatctaacgtttcccaggtaaaggaagaaatacatacaaggatgtatagaatgcacctttaagacattatcaagcatattcagatgtaaaagcttcttagaaccttgtgcactggtattcaatttctgtgaagctattcgttagaaatagttttacttagcagagagaaaaaaattatagttattttatatagttaggtaattaattactcacccacagctaaactcgctgccaaacacaggtggaccacagggctatgaggcctaatgcttcacacctattaacccaaaatgcagtggacacaaagggcatccttaacccccatatggtaattctgaactgcacgagcaattaagtaagagtgtgacctattaccactgacataaaaacagctcaaaggccatgtactatttactattcataggagtcccgtggcatacattggttttcaaaagacagcaggtgacattcatcagcagactttctgtgtccctctgctcacacttacagcacaattttagagtctcaggttaaggctgtttttccttaacaatactcaattttcttctgaatcactgagaaaatctaagtctaccgtggggtcatcctcagtagactggaaatggggaagagaatgtgagcttcttttgtttttatatcctcctgtccataattaggcaatatttttaaaagagaaaaacaaaaacgttccaagcacaataaccttgatgccgttctgtaatccagagtggcatactggcaaactgggttattatttttttttaatttcagataaccttctctcaattgtcaagggtatattcagcaaatcaaatcgacttccctcagcatcataaatcccatttgtatcctagtagaaacacacatttcctgagaaagggagctgggtcttaaaaaaggaagttgaagtttttaagctggagataaggcatttcaaaagggaagaaacttttggcaggactcgagtgcatcctgcactaatggaaattggaaacccatccttcatttcatgaacattactatacaaaatgtaaaacatattggtaccacagcaaccaactctgcataatgtacttgcagcttcaaatggcaaccctgggggagataaaagttgattttttttttttgctatcatgaaatgttggaatttcttaattccacagatattagcaagtgtatatttcatgccaggaaatgttcttggctccaaggatatagcagtgaacacaattaggttgctggcttcatggagttatatttggaggtgggaaattttaaaaattactgtataatatagcagattagaatatatagggatggtataatatatattatggtatattagtatatatatttatcattattacatgtgtcacatatagaaacatagtatataataccatattatgcaatataacaaaatatgtcaggtagatatagatcatatcagatgctagtaaattttagaaagcagagaaaaggggatagatgagtgttgcatttctgaataatatgttttgggaagttctcatggataggctgggacacctaactagagaactgaaggaagtgagggggtgatacatgtagaatatctagaaaaagaccattctaggcaaaaggaccagcaagtgcaaaagctccaaggaaggggagcacttgatccatttgaggaacaacagcaagaaaaccagcatgggtggagcagagtgagccgagcaggagagcggggagggtggagatgaggtcagagaagcagcctggggttagaagaacagcagcgcagatcctgtggcattttctggcagagtaaggactttttatgggggggccagggtggaagccgggaggctgatcaggaggctattgaaacagttcaacgtttctctgcatctgtcccagaccgttcccttcccatcttgctttctctcccagaccactgctggcttttttttttttttttttttttttagatggagtcccactctgttgcccaggttggagtgcagtggagcaatctcgcctcactgcaacttctgcctcccaggttcaagcgactgattctcctgcctcagcctcccaagtagctgggactacaggcgcatgccacgacacctaatttttgtttttttgttttttgttttttttgagatggagtttcgctcttgtagcccaggctggattgcaatggcacgatctcggctcactgcaacctccgcctcccgggttcaagcgattctcctgcctcagcctcccgagtaactgggattacaggcttgcgccaccatgcccagctaatttttgtatttttagtagggacggggtttcaccatgttggccaggctagcctcgaactcctgacctcaggcgatccacccgcctcagcctcccaaagtgtaatttttgtattttcaatagagacaaggtttcactatgttggccagactggtcttgaactcctgacctcggacgatccgcccacctcagcctcccaaagtgctgggattacaggcgtgagccacctgcccggccatggagcctcttgctcctatgtctcttctgacctccagccttactcacccatccatccagttcatctacacatggatggctcagtatgttcaagtgtgcccgccttcctccatgcccctctggctcctctaggatcccacctttcagcaaatggcaccaccacttagttgcttaagacttctcttgggagtgtccctcctttaacacctcacatccagggactcacatccagagtcctgttgccgcagacgcatttcatttcctttcatgataacacagaggagtagaaggggccaaaggcataggaggaaaacaagaaaatacagtgtcaccggaaccaggggaagtgtgttgataaaagcagtggttagcatgtacttctcactgtagcagacactatgctcaccacttcccacaaactatgtcatttagacctcgctacaatctgaggaggaaggtgctacgcccattttgcaaataatttagagaagtaaatttcccaaggtcacagtgtgtactaaatcccctaagagaaataaattgagtctgaaaaactcaagtccactgaactgagtcatgtggagaccaccggtgaccttaacaaaaacctggccagtgtccagccggaagaagagtgagaaacaagagggagatgagaaaataaggacaggaagttagccaactctctccagggttggcctgcaaagcagacaaggaggaagataaggctatagttgaagggagggcagaggggctgggcacggtggctcacgcctgtaatcccaacactttgggaggctgaggtgggtggataacttgaggccaggagttccagaccagcctggcccacatggcgaaagcttgtctcaaaaataaaaactaaaaaagagagtgctgggggagtgtctagggaaggttttattttaggtgacaacaaagtaatttaaatttctaaaactcaacccctttgcagagtgtgggttagcatgtctatgtgagcaatcagcacagagaaggtatttgttttctctgcttcctgctccaaggaaattcagattttgcttatgagtttggtttaaaaaatcattggctatgcataaaatttgcgtcccatatcctagaagatgggaaaagctatagaacagaaggtgtataactgggtcaacaaaataaacaaaaagaggatctactctggttttcttgggaagctgaaaaatcagtgctttagaaaaaaccagtcaagccagactattctgtcacaatgtggtggagaaaccccaacactgaacccaaaagcagatgacctagtgggctgctctttccggccagccactgtctagctttgtcatcttgtataagtcactcaattcagggtcagcatcctctgtggatcaaggagctaatatttattatgccacacttggttctgggcagaatcaaacaactgaatcagccagaagattgacagaggatgcatgatttcaaacaactgaaatcagccagtaaaaacgctttatacaaatgcaaggtattcccaatatctatcataattgaaggtaagcattaaaagatacttatgggctaggtacaatggctcacacctgtaatcccagcactttgggaggccgaggcagatcgcctgagcccaggagttcgataccagcctgggcaacatggtgaaaccccatctctacaaaatatacaaaaactagccaggcatggtggtgtgcacctgtagtcccagctgctcgggagactggggtggggggatcacctgagcctgggaggttgaggctgcagtgagccgtgatggcacccctacactccagcctgggcaacaggggagactctgtctcaaaaaaagaaagaagatattgtacacagtctggaagcaagctgtttggatacatgtacattcaccaactgattcaagatttttaaaaaattcagtgatagcttaacaatgccagatatataacaacaaacacctgcatatttacttttcattacagctggtgctgttgaagctgatttccagtgaatcaggttaagccaggcctaaacttgtggccatgactggtctgtgaaaatgctcaaagtgtgacatactttcagtttgctctggatctcacagcataccaattcagtacacaggtcctgccacagaggtgtttctggcctgtgatttaataagcaaagaaaaaccagtacagccagtctaattattagagcagccaagctttcagactctcttaaatacttccaacatcaggcctccctcaggcagggcaagattacacatgactccagcccggtaccaattccctaactgtccatttcctatggagacatggatatggccttctctaattagagggacaaagacagaagagaaccattattaggactttactttttatcccgttttagttctaaaacattcaagtcctgcccttcactgatcactattacaaatattaaaatgggggtaggagtggtggattaagtgccacagagaccgaatgcatcaattgtttcacttatggaacattctgggctctgagaacctcggagtaggagtgaatcaatcgtacatccaagcagataacagctcaaatcaccagctcagcacaattcttctgggcaccctcttctctatctgcaaaaagagactggctttccttcctcctcttgccctccctcctgcccccaccccacccccgccgcgccctaggcctggagtctagggctgcccaatgacaggaacacccaaatcagcactgtcttctgggctgcgttggcttctgtggttgtagctaggaatggccagcagggcgggggttgggtggggtgggatgggggccgtgggggtggctgcacaaggaatcatacacctttggtaatacacttaccgtttacaaaaagttgagagtccacataaccaggaatgtgtaattcatgcagcttcctaaaactgccagggaattattcttgcctccaagtcagccctggctaggatcgtaagtattataaatgcaaaaagaataaaaaaaagacagtgcaattcttatttagtgggtattcagctctcaaacctgagggatggactaggagattaacatgatgctcaccagcctctgagaccttccacaaacgccctctgaccagtctttcccacctaccctcctgcactcccgcaccctctgccctgcagtcattctgcctcactcaccgcgccctgcacgtgccttgcctctccctttgtgcttttgcaggttatggttccgctgctgcatagaataatccctcctctctcacagaaattcctcccatctgggcccagatcaaatgctcctcctcaaagaagacttctctgattgctaggagcagtatctccttcttcttgccacaaataatattttgtttacagcaataataagagctacttattgaacacatactatgggatgggaatcctatgaagcacttgatacattttatttcatttaatcctactactattcctagttataggtgagaaagccatgattgagaaaggttaagtactatctctaaaagggcagtggcgacactggacttggtcaggcagttggacaccagagctcccacactctactacacgttgccttatactgtaatgatttgtgcaagggtcccatctgctctgtgaatttctgaggtcatatatcttcagatatcccattatatgaactcatggcttggcctaagtggtcactggaattggagcaaaagtgcacttagagacaggttgctatggctgattcttccaggtatgctattttatctttaacccagctctgacctttaggatgggtcaagagcagcaactaaaatggcctcacaaagtcaaggatccaagacccaggaagcaggagaaatctgacccctggaatgctctggaagcactgaggggccccacaggatatgggcaccattgtgtcctaatttggataacaggtacctgagacatacaagcctgtctctgtgcatatcagctagatctcttagaatggtgagtcccggagccaggggcagggtagctttcttttccagtatataataaatgcacacttgttgcagtcaatgtttcttcagactcggttttcagtctcccagagaataataaattcttgttgagaggataagacagcatggctcaaaggttaaaagcaaatgggctcaatgttaaacagaatcagtctgaatgagtccaactttgccccagtatttgtgatctaggacacgatacttaatgtctgtacttcagtgtcctcgtctgataatagagataatatcaccacccattcattcataaggtgactaggaggacagagtgagataatgcatgtaaagtgctcactatactccactcaaaaacggttagctcttattatttaacaattgctcttttcactaatgctaattattgttgttggttagtcaatttatagctaatgagagtacattttccatctgaaaaattctttactaaaattcactggttagtgttactcttttctgctctacagagctagcagtgaatatagagatcaacaattctgaacataaagaatgagaagatatgccaggcatggtggctcacacctataatcccagcactttgggaggctgaggtgggcggattgcctgaggtcaggagttcaagaccagcctgaccaacatggtgaaaccctaagtctctactaaacccttagtctctactaaaaatacaaaaatcagctgcgcatggtggcaggcacctgtaatcccagctacttgggaggctgagacaggagaatcacttgaacccaggaggcagaggttgcagtgagccgagatgccgagattgtgccactgtactccagcctgggcaacaagagcgaaaatccatctcaaaaaaaaaaaaaagaaagaaagaatgagaagatatatagtgatatggtttggctgtgtccccacccaaatctcctcttaaattcctatgtgctgtgggagggacctgtgggagataactgaatcatgggggcaggtctttcccatgctgtgcttgtgatagtaaatctcacgagatttgatgattattacaagggggagttttcctgcacaagctctttcttcctgctgccctctctgtaagatgtgacttgctcctccctgtcttccgccatgattgtgaggcctccccagccatgtggaactataagtccaattaaacctctttgttttgtaaattgcccagtctcgggtatgtctttatcagcagcatgaaaacagactaatatatatagcctgggcaacatggtgagactctgtctctacaaaatataaatagccaggtgtggtggtgcatgtctgtggtcccagctacttgagaggctgaagtgggaggatcgcttgaaccctggatgtcaaggctgcagtgagccatgtctgcaccactgcactccaacctgggtgacagagtaagaccatgtctcaaaaaaaaaaaaaaaaagatataaacattagaggtaccacctaacaattaaagctgttcaaaatatggtggcctctgagaaaaatgagctgccccctttccctacccagcagaaactgcctcctatggccattacatttggttcaatttaagaccctgatatggtggggatttgtgtccctgcccaaatctcatgtcatccccagtgttggaagaggggcctggtgggaggtgataggatcatgggggcagtttcttgtgaatggtttagcaccatcttcctggtgctgttctcatgagagagagtgagttattactagagctggttgtttacaagtgtggagcactgccccctctctcaatcctgctcctaccatgtacgatgcctgctcctgctttgcctttcgccaggaatgaatgctccctgagacctccccaaaagcagatgtcgctatgcttcctgtacagcctgcagaactgtgagccaactaaacctcttgtcttgataaattacccagtttcaggtatttctttatagcagtgcaagaatgaattaatacagaacccaatggtcttacttcttctaatatcctattttgccccagccacttatggtgatgattctcaaactttggtggacgtaagagtcacttagtgtgtttaacaaatacagattcttgtgtctatttgggattatgatttaattttatttactttttagagacagggtcttactctgctgctcagactggtgtgccaaggcctgatcatagctgactgcaacttgaactcctgggctcaaacgaccctccagccttccctcttaagtagctgggaccaccggtgtaagcccaactgggattatgatttaataaagaacatcccaggtggtttctgataccagtggtcctgtgaaccaattctcaaaaacagggtcagtaactgacaacttagaaatatttttccgtgtaggctgggcgccgtggctcacacctgtaatcccaagcactttgggaggtcaaggcaggaagaacgcttgaggccaggagttcaagaccagcctggccaacatggtgaaatctcgtctctactaaaaatacaaaaattagctggctgtggtagcatgtgcctgcagtcctagctactcaggaggctaaggcttaagaatcgcttgaacccgggaggcagaggtcacagtgagccgaggtcgtgccactgcactccagcctgggtgacaaagtgagactccatctcacagaaaaaagaaagaaagaaagaaagagaaaaaagaaatatttatccgtgtaaatttatttcctgtaacagaaaaagatggaaaaacttttaattctccaaatctgggtctgcattttttgaaaataatgttccctgaagcctaatccttggattcgataataatgagtttgtctattagttatcacttattctggtgagtaatttctaaagtctcgttttacttccttttttttttttttttgaggcagagtcttgctttgtcgcccaggctggagtgcagtggtgtgatctcggctcactgcacactccaccttctgggttcacaccattctcctgcctcagccttgagtggctgggactacaggcgcccaccaccacgcccggctaaatttttgtatttttagtagagacggggtttcaccgtgttagccaggatggtctcgatctcctgacctcctgatctgcccaccttggcctcccaaagtgctgggattacaggcgtgagccactgcacccggctagtctcattttacttctcattgctgatgaagcaccagttactttattgtttcttcccaaggctgtgtactggtaataattttctttaagagaggccagaatcttgacatggtcctgattctggggccaggaagcctcagttttgctttattacaagctctgaggcttcttttcaaatggctacagtcaggctgacattggcaatgatgaatatgatgcagaaacagctgcagtctctgaagcagaaggtgctcacaaacctgctttctaaaattcactaatatctgatatgacacacatccatccctcaagggtctagaatacaggatgtcaggagagaatgaggttgtaaatatagaatctgctccagcactggccagtctgaacatttctttcccttggctccagcatagcattaaagaccaataaaaccacagactctaaaggcagagacttcctgagtttcaaatccccagctccaatacttactactgtgtgaacctgagcaagttacttaacttctgtgtgcctcaagttttaagtttttcatctataaagtgctgtagggggaaaaatatattttcttctatccatcttaggtgtcttggctagtgctcctgtaataaaagccaaattaataagagagaagcacacaaatttatttaatatgttttacatgacacagcagccttcataaagagaggaaaccatagagaagcaattaaacctgagtgtttttcatagtaggttgatgaagaggatggtggtggagaaatatgatagggcaaagggtgcaaggtgagtgcagtgacctggaggaacttagcaaggcctgtttggattcttctctgtgtcccatcgtcttcagagataaggatgctccttccctttgaatatagggaaagcaactctcacatgagtgtttcatgaccctcttcaagggaagctcagaaaatctgtcctagattttatgatgtgcttcagaagggaagggtagaggaaaggtcagagagaccttcctgtgtctgcattttctcatattccttcagattaaaatatgcagtatgccaaactgccatatattggggtagtgtgttctgaaccccatcaatgggatgttacaagaatagaattggcacatagtgctatgtgagcatttattagtataggatggtcatatggcccaagctatccatgacacttcattccggtacttttgctgaatgagatgcttctgctggagttgataaatcggtaaatatttaagctgagaactgccaggggccacctgtggagaaagccttcctgagagtgaagctactgcagaggaacgagggctgagaggtggagacagtgtaggatttaatgcgaatgcttaagacctgggtccagtcatgcctggatatctagtgtggacttttcagtgacacgggctgtgaactttcttttctcacttgagttggcttgggttggtttctattgtcagaggcatttgaaccagagcgactccatcttgaataggggctgggtaaaatgaggctgagacctgctgggctgcattcccaggaggttaggaattctaagtcacaggatgagataggaggtcggcacaatttacaggtcacacagacccggctgataagaggttgtggtaaagaagccggccaaaattcaccaaaaccaagaaggccatgaaagtgacctctggttgtcctcactgttcattatacactaattataatgcatcagcatgctaaagacactcctaccagtgccatgagtttacagatgccatggaatgttagcaagttactctatatggcctaaatggggaggaaccctcagttcctgaaactgctcacccctttcctggaaaattcatgaataatccaccccttgtttagcatataatcaaaaaataactatacatatactcagtggaacagcccatgccactgctctgcctatggagtagccattcttttattccttttctttctgataaacttggtttcactccatggacttaccccaaattctttcttgcacaaggtccaagaatcctctcttgggggtctggattgggacccctttccagtaacattatcaccttccaacaaaagaattctgacctagctttattgagatataattcgcataccatccagttcacctatttaaaatgtacaatgcagtggtttttaccacattcacagagctgtgcaaccatcaccacaattgttggattgttgatctaaagatcctcagagatggctcagtaggcctgggatgtggaatgtggacaggcatgtgtgattctgcttccaaagtcaccacgattttgttttgtttcgtttttgagacagggtctcattctgttttccaagctagagtgcagtggctcactgcagcctcgacctcctgggctcaggtgatcctcctacctcagcctcctgaaaaactgggactacaagcacacaccaccacgccatttttttttttttttttttttttttggtagagatgggattttgccatgttgcccaggttggtctcaaactcctgagctcaggggatcctcccatcttggccgcccaaactgctgcgattacaggcatgagccactgtgcctggtttcacaattttgaaactaccttttttttctttgaaactgagtatcgctctgtcgcccaggctggagtgcaatggcgcgatcttggctcactgcaacctctgcctcccaggttcaagtggttttcctgcctcagcctcccgagtagttgggattacaggcgcacaccaccatgcctggctaatttttgtatttttagtagaaacagggtttcaccatattggccaggctggccttgaactcctgacctcgtgatccacctgccttggccttccaaagtgctgggattacagccatgagccaccacaactaattttaaagttagaattatcaactttttgatttggaagtaatgaaagttcagcagagtataatggaaaaggaaataaaataagagttagcactcctgctttctttaaagagacattagaaaatccctacagtccctttatactctcaataactcgaccaggcacagtggctcacagcattaatcccagcactttgggaggccaaggcaggtggatcacaaggtagggcgttctagaccagcctgaccaacatggtgaaaccccgtgtctactaaaaatacaaattagccgggggtggtgtcgcatgcctgtaatcccagctactcgggaggctgaagcaggagaatcgcttgaacctgggaggcagaggttgcggtgagctgagatcgcgccattgcactccagcctgggcaacaagagcaaaactctgcctcaaacaaacaaacaaaacagaacaaaaaacctctatagttttcatcaacttatctaatatttcagatgacaaaactgagggccagtgagggtaactaaaccgccaataaaactgaaggccagtgaggttaagtaaattgccagagctcacagaggtactcacttttagacacattcaagaattcagttcagttttctatgttgttagtttcaagtagttcttactttttctgcaggatttcatactcaagactcaggtcagtctcttgaaatgcctggagattaagagggtctttgtagtactaatcaaacattcattcaattctgttttgactcattcaagaaatacactgtgattatgatattccctatatttatgttaaattcattgcatctgtctctttagataaaatagtgttctacttacaacctagagaaaaatcaatatacttgccctaaagcaggatgtaataggaaatttcaaaaatattctatggtatttactgggttaggtaaataataaattggcaagtttccacaaacatttacgaaatagtcttagtttgtaggaccaggaggtttaattaccatgtagtgctgctggggataaggaaggatgatggttaggagagtaactgcactctttgtctaataaaaataaagagatttgataaccaaactggaaatatagaataatttgacttctaatagcccttgaagcttcagataacttctcaaaaacatgaaaaacaaccctttagctattgctaattacaaatctgtgtatctgggcacataaggactctctataccggctttggaaatttttagaaacacatttcctggaagaacctgagaggttggatctggccaaaaaaatataatacagtctgtggcaggatgcattgtacttaaccatattcaaggacagaaaggcatttgctttatctgggatatcctgtgaaaacacattaagaacacccagggaaacatcgtcagcagggatattatttgtggtcatcgttgtttttaacgtgtgttttttccttagtaaatcctagacaaagtaatttgaaccttgtaaaagagtactgcaggccaacctgggcaacatagcaagattacgtctctaaatacaaaataaataaataaattacaagcaagaggcggtagaatttttaaactgagttcattggtgaggatcttggatggagttcaagggaaaacagtgaaaaggagatgaaacactgtccctaatcccaccgtcttgatagaactactctgagaactttggtgccttttttgtgttacttttcttctaagtattccttgtatatacttgtaactgggaagtgacaaagttctaagagatcctggcaagaactgccacccccaactcatcaccacaacactatccttcccttccccactcccttccaacacacatacattctcagccttcaaaaccaacaagatcaatcccatcatgatttgtttttaaaactttttttagagtcagagtcttggtatgttgcccaggctggtttcaaactcctgggctcaaacgatcctcctcctctagcctcccagttgctgggattacaggcattttaaattcacgaccagaaactaggactgccaattggcaatcctaccacattccctggtcgatttactctgccgcgctgctagatggttaattcatactcctctttcctcaaacttccgacacctctcctcctcctccatcttcactcttggctcatgatcttgttttctacttctctgaaaagtaattgaagcaatcaggagagaatttccacacattccctctaccacatctattcccacctgctcctgtgcccatatatactctgcctccctcctgctgccatggatgaactgtctgtgaccctgaggccaacccctttcctcatctttcgcagtccgagcccccttccctacttaggagccctgcaccagcaattctgccctctttcctgcattgtcatatttctctctccatgcatcacttccaatagcatacaaacacgctggtattcccctacccttaaatatccctctcttgaccccgttaacctctgtcaaaactaagtcaaatctggtcattcctgtttgaaaccccctaatggctctcgtctcacttagagaaaagtcaaaatcctacaagaccctatatagtcagagcccatctacttactactccaccacctgtgttccctgttcctagaacacacaccgggcctcctccttgctcaaggccttcgtatctgctgtttcctgaaaggctctctgagtatctgaatgttcattccctcacttcacatcttcactcaaatgccatcttttcagagaggctttctttggcctccctacacaaaataaccaccacactccctcatattacccatctctcttccctgctttatttttcttcttagcacttcacgctttctaacctaccataccaaccttacttgttaggtttattgactgttccccccatttgaatataagccccatgacagcaaaaaaaaatttttgtctgttgtgtttgctgccaaacatattctctagctagcactgcagtgcctggtacataggaggtgctcaataaaagacacagacataatgtaggtcatcttaaagtttgcacagtcatgctcatttatgattcttctgcagcctctgcttagagttctctgaatcaaacccatggacctcgtcttaccatggtctactgtgtacatgtctttttgtctttcaaataaaatctgactgtagaacgagaaaagcgaaggacctggagtgccttcagcaatgcactgagtctctttcctcgctttcattttggtttctactaagtttggtatggagagaggaagcatttgtgtctatcttggagagagagcagagaagatcttgcagggggtttcagcatgagtatttggcaacagaaaggatgattcagagcttgaacgtgaaactcatacagaggcttaggggaaaaaaaataggagctagaaagagaagggagaatcagtcctatcgcctgagaatatggttctctggatcagaaagacactgtggcccaaagcagattccaaagatgaaaggagaagcggcattccacaccaggaataaatgttttagccttggttaaaagtaaacataaaagcaaatcaccacaggattaagatttcaaaacaataaggaggcagtgagctctagagtcagaaagacctcgctctaagtccagcttccaccacctcggagcgctgggacgcagttctcagggttgcagaggatttcaatgcaagcctggagcactgtctggcaaacggtggggcctcaagggatgttagttccttcccccgctacagcctccactgcatccccacagccccgcaccacgtaagacacatagcagatgctcaagaaatactagtttgatgaacggatgggtaacacaagaggaatcagttcccaaatcaagctgcttctgccctcacaccagacttcatagaattcacttgcttttttatcactttcctgcatccccttgccctctgcctcacccactcccaaaaccatcttcacgtttgttgtttgtgttcccactccacaatggagccggcgtcagctacgtcaatcctcgagctgccaaacgttcatttccatttaaaaacatcgtgttttagcagagaaacgtggactagggaggcacggtgcagacaccagcctccatctattactccaggctgacagattttttttagcagagtcttgtttttctcctctgaaggaaagcttgtttccatagaaggatttcccctctttgtgttcttgcttcattcacagttttagtgtttacttttgctttttatctttgcataatccttgctgttttaagaatctgaggagactctggactatagtccctcaccctcccctgtaaatatctctggttcatgccaatagtggctgacacatttccccagttttccttcacatctttgtcgtgtgaaaaaatgctggtaaatcatgtggacaagcctcagatgacttggtatttgttcatgggacatttttcaaatccttctgccaagattttgtgcaataatcagtttgttttaatgcagttcatggagagagggttccagttctgcactggctgtgcaaccaccaacctttctgtaagtccaccaagggtctggaggcggagggcctcaatgcttggaaggccaggaggcccactgctcagggaacaggtgtgctcatggaagtaagtggctggcctccaggactagctcataagcaatggggaaactagggttgggaactgtttggtggagcagcaaaaaaagtgatgccatcggggcaaccccagcgtgagtgagggcaggggactcttcttgtcttgttcacaatgtccccagcacctacctgtgtgcacagctcaggactggtattctgtaaatatttgtggaatgaataaatgaacaaatgaggtagaaagacagggtaccacgagaatcctcttgaataaaatggagagttttgaaagggattaaattgctattgtcatgtttaattttactggaaaatatttgtaattctactgaaacaccaggttggtgtggtctagagaaaaaaaatactagacaccattttttttccatataagacaaaccaaagcaaggaacttcattttttaaaatttattatttttttttattttaaatgttttttttctgggtacatagtaggtgtatatatttatggggtacatgagatgctttgatacaggcatgcaatgtgaaataaacacatcatggagaatggagcatccatcccctcaagcatttatcctttaagttacaaacaatccaatcacattctttaagttattttaaaaatatacaattaaattattatcgactatagtcaccctattgtgctatcaaatagtaggtctcattccttctatttttttttgtatccattaacaatcccaacctccccgccaaccctcactacccttcccagcctctggtaaccatcctgttactctctatgtctatgagttcaattgatttgatttttcgatcccacaaaataggggactttaggcaaaaaaataattgatgcctagtatgtgccaaatatggtgtaaataggaggtgagaaaccaagataacttgtgtatataatgctatacacctggagttattatgcaaacatacagagttacaataattgagcacttgctgcatgccagacactatgtaattcttctactaccactaagatgttgtaccattattatttccatgttacagatttagaaactgaagctctgagacattaaaaaaaaaaacaaaaaacccagctcaatacaaggtaaccttgaaaataatatgacactcgaattttccagtgaaaaaattaccctcttccagagatttttggctaacctgaattaaaaagcttttagaaatgacagcacaaaatctcatacacattgttcaaaataagaaacctaccaaggtcactgacttaatttttcctttggtcaaaagaagaagagacagaaataagtttctgaatttatttctcagagaacagctgtgcccactgatcaaacttaatgtaatctttgggagttacagttaccaatttgaataatgttaccccatgacaattaattagcatgtaatgttatttccattggagacattattaaattttagaaagtctagatgtctccaagtgggcttcttagagataactctgaaaggatatttaatggtaacgaaacacagggtaggattttactgtgggaatgttttcaggcttccattttatccagcagctttcctctgaatggctttactgtttatcactcagtgtcatgcgctcgctctctctctctctgtgtgtgtgtatatataatatatattatatatattatatatatttatatatatatatatatatttttgatactgagtcttgctctgttgcccaggctggagtgcagtggtgcgatcttggctcactgcagcctcctcctcctgagctcaagtgatcctcctgcctcagtctcccaagtagctgggactacagacgcatgccaccacgcccagctaatttttgtatttttggtagagacagggtttcgccatgttgcccaggctagtcttgaactcctgagcttgggtcatccacccacctcggcctcccaaagtgctgagattacaggcgtgagccactgcagtccctatatttacatcaacagcctctcttagaggcctggagtttctctatgatatggtttggctgtgtccccacccaaatctcatttttaattatagttcccgtaattcccacatgttgttagagggacctggtgggagatcactgaatcataggggtggtttcccccatactgttctcatggtagtgagtaagtctcacgagatctgatggtttgataagaggaaacccctttggctttgttctcattctctctcatctgctgcgatgtaagatgtgcatttcacctcccaccgtgattgtggggcctccccagccacatggaactgtgagtccattaaacctctttttctttataaattacccagtctcgggtatgtctttatcagcagcatgaaaacggacgaatacaaccagcaatgctaaaaaggaaaaatacactttcaagaccacaggcaagattttatttgctgggtctgaatcagatacacagaccccagacaaatctaaggctaagtgaaagaatacgagaagaaacagattttcaggaaggaatgtgagacctatagcatttttcttccagggatgaaatcatgtgataatcggacatctactatccatcaatttcattcaataaacatatttcaaatgtctttatcatgattagagccagccacttttaagccaactaaccattttctgaagtctttgtcctgtctactttgtttcctccatagaaacacacatgaaagcaaacacagccccttcctccactacatttgttaagtagccgcatattatttcagaatttattaccaattctctaaattgaacattgggttatttccaaatgctcaatattacaaaggacattgaaatgaacatcctatgaagaaacttctacacacgatcttaatgatttccaaagaatagttatgtcaaaagtgtgcatgtgcctaaggttttcaatacacattgccaaactctccagaaagatcacgttatagttaaggcaaacttttcactacgtttcctggtattatcattgccacatttgccaagatttggctgtaacactcaataaatttttttcaaaaccatttttattatagtgtataagaagcaaagtaggtaaagtacacaagctaaagtatacagtctgatgaatttttacataggtatgcctctgtaacatcacttgtatcaaaatacagaatatttccaacacccagaatgtttcattatgactctttcaaatcaatacttcccagccccaccctggcataagggataatctttttttttttttttaacttccttccataaccactaacaagttttacctcttcctgaacttcgtaaaagtactcttttagtgtctggcttatttcacccaacatgatatctttgaaattcatccatgttcctgcatgtttcattagtttatattttaattagttcattatttatattgctatgaagtatttccctgtataggaagcaccacattttattgtatccattcccctcttgatatccacttggattattaattagtttggggctgttaggaataaggccgatatggacactattgtgcatgtcttttagaagacacatgtacatatttctcttggttgtatacctagtagtggaactgctattcttggggtgggtatacatttagctttagtggaaattgctggtttttcaaaacggctgaaccaacttaaattcccaccacaaataatgtgtgagagtttcaggtatttcacatagttaccaacatactgcttaaaccttaaggtacttggtagatatatgacatgacagtccttacgtgttcaatttttacatcagtaatttattctagagtttacctgtagtatacagattacaataatgagggaggaagtttagtcagttgatttaagtggatgatcctaggtagagagggtcccaattatcctggtcagcatgtctgagaccgtccaaaacaagggtgccccactccggggccatggactggcacccgtgcatggcctgttaggaactgggctgcatagcaggaggtgagtggcaggtgaccgaacaagcgagcgagcaagtggagcttcatctgtatttacagctgctccccatcactcacattaccacctgagctccgcctcccatcagaccagaggcagcattagattctcataggagcatgaaacctatatgaactgtgcatgcgagggatctaggttgggcgctccttacaagaatgtaatgcctgaggatctgtcactgtctcccgtgccccccgagatgggactgtctagttgcagggaaacaaactcagggctcccactgaatctacattatgttgagttgtataattatttcattatatattacaatgtaataataataatagaaataaaatgcacaataaatgtaatgcactttaatcatccccaaactatcccttcccctcaacccgcccactgtctgaaaaattatcttccataaaaccagtccctggtgccaaaaaggtgggggactgctgatctaaagtgcaaaaatgtcaaagaaaaatccatatgacctttcaagtcaagttattcacctccaagatgaacctctaagatgtgacagtctataatatgccacagagtcaacaatctaaagaaagatacaggcacctgtatctcaaatctaagagggcctatgttactctgcacattaagacttctcatctccatgagaagtctcaaaaattgttaaaaagtctattaaaaatcataataaggcctataaaacctttagactttacctagttgaggccttacatgtccctgagaaggatgtattaccgtgttcattttataaataagtgaactgaggttttttaagagatatagctactgagataatgaatcagtctcaaaggctatgtagaagaaccaatttcaattcgttgtcctccaactaatccattgccggactttttccaaatgcacacttacaaaaagtaatttgtaaccgtctacctggaagatctagccatctgttagacacctggagccaagaatgtctgaatctgcacgaatgccaagaagtgtgcaaaactgaacttgcgatctgccccaccatttcctgggcatgcccagggtggcagcggtgctggtaccttccacctgcccctcaagatccaccccatcttctctgggagtccagtgtacatggctgcatccatggacaaggcttcctgctgggctcgcccctgaggagcagcagcagggggaaggagggagaagagggaggctggggtgttcatttcccctgttgccttctctatggctcactgtgggctggctccatcctctaactgaagggcacagcttgggtcaggaagccccctccacagagcctcttcacccccaggtttgggtaagtactcccttccctcctcaggtctagggctggtgttagcccttctgtgactaacctgaaggagctctgcaatgatctgcattttctctctacctttgtaagaagttacttcattaatgctcttcaggttatctgatttgggtgtatcatctgtttcctgtttggactctaggtgatactgtagtcttgtcaaagcccagaactgaagccttcataataaatgaaaagaagggctccattggaaatatcataagtgatacatctagtcttaggaggcctggaggaggaaaaaggaatcaatgagcttttccttactgactcataaaccacccaagaagagttggtggtctcctcaacactgttgctacatagcaaggggagggtgggaagaggaagaaggagggaaagggccacatagtgagcacttattatgtgccaggtgcagtacaggattttcacacacatcatgtgatcacgtgctgtgtaatcttgtttcgaccgtaacctctctttgtcccagtttttcatctgtaaaatgagaataatagtaggatctattttgtggtgttgagacaattaaatgagataatacctgtaaagtggctaacacatcatacatgttcaataaatattatctattaataatgatgatgaggataatagtaatgattttaaaagcctcataatcatcttctaaagtagatattattttgcccattttaaaaaggaaattaaggctccaccagtgatgtcacaaagaagaggcagaagggaaattaatctggatcctgacataaaatcttagaaatttcaccatcatcacatcaccctgcccctcagttgcctcccatgtgccacaattcacaatctatataagggatggcatatatgtgacccatgtgctgtcatgctcttctcccagatgagtgatggacaagggtcctcttttgagctgactctcagaatgcctcctaacatactccctgtcttagtcctttttctgctgcaataacagaatatcacagactgggtaatttataaaggtcagaagtttatttggctcatggttctagaggctggaaagtccaagactatggcaacactaactggccagggtcgtcacctagaagaaggtatcatgtggcaaggaagcaggcacacaggaaacagaaaaaggaggccaaacgtatccttttaacaggaacacattcctacaatagcagcattaacccactcatgagggtagatgcctcacggcctaataagctcttaaaggcctcacctcttaatactgttacagtggcaattaagttcccaacagataaacttttgggggacacattcaaaccacagcactacctaagcacccactaataatcactcccagttgacctgtgaggtaaagctaatttatccttgaagaaaaacattaatgcagatgaacaggacaaagtcagattcaacaaagactgtgtgctccatagatcaaaattttgttttgttcacaccagtatccctagggcccagaacaatgcttgatatgtagaaagcactcagtaaatacttgctgaataagtgaatgaataaaaggtattatataaagacccatgccttcagagaatttacagagaatgaagacagacaaaaggaagaccataaacagacctaatgcaaactagcctaagataggcaccataaaagcatagtcagttgtgggtaaaataagaagagagggaagtctgaattagtctgggtaacagcatttaaaaaagaatatggtgttgctttcaagttatcttaatctaagctcaccctcttctcaggcagatactctaataggcctgctttaacaagcagatgaaaataatttataattagtaacactatttaccttaaactgtttacaacttaagttcataaatctctttggagagaacaaatgggactttcaacccaattctgggtgggtcagtgtgaataaatgagatcttgaattattcgaacaagagccctaaggtgctatcacttgtccttttctcactgaaacctaacaggggcccacacagagactttctcctcttcctttgctctaacatggaaatattttttttttttttaattttaagagccataggccaggcgctatgactcatatctataatcccaagactttgtgaggcagaggcaggaggataacttgagcccaggagttcaagaccagcttgggcaacacaggcaaacatcatatctattaaagaaaaaaattttaaaaattagccagatctggtggtgcatgcctgtaagtcccagctacttgggaggctaaggtgggaggatcacttgaaaccaggagtttgaggctgaagtgagctacaatcatgccactgcactccagcctggaaaaaagtaataattgttctaaaaagttccaaaaatacaaaaatttaaacagtagagagtgaaagcaagcaaacaacttctccccaacccaaatgacaacaggcgtcagcagactatggcctgtggccaaagccagtctgcacctatttttataccgcctgtgagcttaggattgtttttatacttttaaatgactgaagacaggaataatattttgtgacatgtgaaaattatatgaaattcaatgttcaatgtccatgaaattttggtggcacatggccacgtccatccctttatatataaaatctgtggctactttcaagccagagctgcagagttgagtagcacccccgatctaaaagaatagattctttggccttgctaaaaaacacttctctttccaactcaccatctcttttttttctttttgagacagagtctcgctctgttgcctagactggagtgcagtggcatgatctcagctcactgcaacctctgcctcccaggttcaagcaattctcctgcctcagcctcccaagtacctgggattacaggcctgcaccaccacactcggctaacttttttacatttttagtggagacggggtttcatcatgttgtccagtctggtctcgaacttctgacctcaggtgatccgcacgtcttggccttgcaaagtgctgggattacaggtgtgagccactgtgcccagccctaactcaccatctcttattcatccatctatacatcaaacaagttgtgtaatataacacctcccgtttgtcaaccggtttttttttcatttaactatttactgtggctatcatactccaatcaggctgctataaaaaaatgccatggattctacacgactgaaatttatttctcacagttctagaggctgggaagttcaagatcaaggcattggcagactcagtgtctggtaggacctgcttcctcatagatggagccttcttgttgcttcctcatgtggtggaaggggcaaacaagctccctcagcctaatcccactcatgaggactctaccctcttgacctaatcacctcccaaaggtcccacctcctaataccattgcactggggattaagtttcaacataatgactgggagtggaggcacacaaacattcagactagagcagtggccatcattcttcaggttttcacagaacaatcaactttctaatatgtatgtcaatatcacccatatccctatcaagtttcttacaggcatttcatgaccagccatgcattcaaaagcatctcttccctacctcacttatcttgctggggaaacagcacagagagtacagactgcaaagggctcataagaaatgggagctataaccctgtgacttccctttgcagtaaacacatgaccctggtaatcagtcactctccaacttggctggtccggtgtggtagaacacaccctgggtgactgtgcagtttggttgggaaaatatttgccaagcaaatgtcttgggtaagtggggagtcccaaccaaaaatgtgagatgttagtcttctgctcatttagctaatgtgaagaactagctttagactgtatagttttcatacctaattcctagcaactcacagattcatagataaactgattttacattggcttacttcctacaattattttgatggcactttgttgatattctactaacaaatgtgttttttcctagaaagtttcaatttagtcagtaaatatgtactactgtaggtggtctttggtatttggtttagtgaggatagagaaaaaaacatctttagcatgcgaaaattattcctggaataattttcaggaatggcttaattaagagttaagtttttgctagaagaaactttctatgatagcactaatattaaagaaagcaaaacattttttgatctcacatatgattctaacgtatattagttaaccaaattggctggtgttccagttactgctatataatatgccatcccaaaaattggtggcctaagacaatactagtcatttatttttctcatgaaatctgcaattagggcagtgctcagcgggaacagctcatctctgctctatggggcattaactggggtcattcaattgaggcaggggatccacttccaagatggctctctcatatggttggcaagttgctgctggctgtaggatggcagctaagctgggctgtcagccagtgtccacatttcctttccatgtgggcctctctatgggcttcttgcagcttggcaactggattctaagagtcagtgttcaaagaaaccaaggcagatgctacaaatcttcttacagtctacctcataagtcaagcaatgtcatctccaccgcattctaccagttaagcaaattgttaagaccagcccaaagtcaagcaggggataataagatcccacatctcagtgaaaggagttgcaaataattcatggccaccttgaatctaccacagcacataaaagaaacaatataaatgaatctctgaaactcatggtttggatatcgaagtggcaaagagaagccaagagtagaattagagtctctcatggttggaccaactctcttgacaagaaggaagacacagtggtcaagagcacaggccaaggccaggagctatggctcactcacacctgtaatcctggcactctgcgaggctgagacaggtggatcacctgaggtcaggagtttgagaccagactggccaacatgtgaagccccatctctactaaaaatacaaaaattggccaggcatggtggtgcacacctgtaatcccagccactcaggaggctgaggcagcagaatcactcggacctgggaggcggaggttgcagtgagctgagatcacgccattgcactccagcctgggtgacagagcgagactctctctccccgccaaaaaaaaaaaaagagcacaggccacccaagtgtgactcctatgttctgtcatgtaccagctgaatgaccatagacaaactgtcctttccatgtccccatatcttcatctacaaaatggggaaaataatgatgtccactgcagggtttatccagagaaatcaagattctgctttttaattaactttaaaatttttttaacctggtatataacatgctcacagaaaactgcaaaataagtgctctgtgaatttttactaactgaacagacttagctgaccaccacccagaccaagacgtggaacacaggaaggactgggaaacaacagggagcgggaacaatagggagtggggaaggggagtaggaaacaacagagggtgctggagacttcaggaaacaggagaccacagattcttggctcttgccagtaataaaggtgggatgtgtagattaagcaaaacatggcagaggccagacttagtccacatacccctgtttggaaccttgaaaataggaggtgttagcagcttgaagaagtggggagggtttggaatagtgttaagggatgggaagatggaggtgcgtgaagaacaagaagggaatgtcagcataagagaggctgacatcataggtatagctcagtatggcagggataatgggcgtggggttaactaggctcaaggttctagaaggaatcttggtgtgaagttgtcctaatacaggaagaagcctaccaggtgctgagaaacgctcagagacaaacctcttgccacaaagccaagtgatcacccttcctagctgtcacctatttaatcactaaaacatcacaaggagctccactcccatatgcaactgtgctcagtctttctccccctctccttttgctcattcccacacatagtaagacgtttgttttctctcccttgctcactttgtcttgcttttgtgtatactgcccctctgcgtagagttcctaaaatttctctctcttatgaaacatctcacagcgcacatactgttggaagatttgggcacttcaaatcctttttggaaagaggcagatacaaaatgaggaacacgaaaagtgaagtcctgttcacaactctggctctgaaatccaaggtatctggtagacctcttgaaataatcccgagccctcctcaccttggctacggcaggcagtttaagaagtatgtaactaacctgcacaatgtgcacatgtaccctaaaacttagagtataataaaaaaaaaaaaattaaaaaaaaaaaaaaaagaagtggctaatgagatactcaagagtggtgggaggaggggaaatccggaatcattagcaactaactgggtgactggcagatctggagatgacggcccatggcatgcagctggcaagggtaacatcaagaagaagactaatttatttagaaatatttaaatcaaactcccatctgaacattagaatatgcctgcaccttactagatgagacagcacacaataagcatttcagtttagtgcttggcaaagagcaggtgcctctaaacgttttccccttactcaccccttttcctttcttctcctactctatcaggctgtatatggttacatgaagccttatttacttagggaccctgctggctacagtcagctcttcttctcaagctgtgcccctggcctgatctgaactacatggccacactagttttcaattgactttggaagaaagatttttgaatcatttcattcatgtgttaaaggtgaagtctctagttcacagatcttgagtgtctttggaaatatgttctgccttttatcatccctgccttttatcatactaccttggaggcagtgtgatggtgcagctggttagttcatgtgtgtgaacacttttttatgttcagtgcatgttctattgaaagatacaggtactttacatatatttggaaagaggcaagatgtaaattaatgaaatcaaagtgaagaaaatcccatttgccactgaaatcccatttttcaccctgtatttgtaagtatagtgttgtttttttttttatgaagcactgttttgggtattttaactactgtagcataaaataaaactaaggaacaataactatttgctggcttctctataacacagctctagattcttcacactgtgaatgaaaattcttactcaataatttaggatgaactacaatttttatttaagaaattcaggattattttggagaggaagcatatgggtggtgatgggaacatgttttaggctctacaaaaatgatagtaatttatgagaggaccgtttacatcactcagaatttagcactgagagtccacattttggtttagaattaaaacatttttattttcatttacagtttaaaagcatttaaaatttagcatatgttcttttagaagtgtacatgcacacatacattttgtataaactggactatatgaatgcattttgaaatatgttttttcaaaaatttaatgcaagcctttctattatgattgctacatctacaacactgaagccaaccagtgtctgtcttgttggatgttatcctcagtgctttactattttaaacaatgcttagatggtcattctttacatatatctttatatgcctatcccattgtttccttaggataatctctagaagtggactgactgaaacgaaggataaatacattttaaagtctggaatatatatttcaagctgccctccccctatattatgttgatctataatcctgccagagtactcttcttcatactcttgccagcattggttcctgcatttctttgctatcttcacaagtttaattatacatcttttgttatttgcaaagtttaattttgttcacacatgtattgccacctgaatttctttttcggtgaagtgcctgttcatgacctatgcaggcgtgaggtcttgcctgtggtttgatcctacactgataaatttcacatatttcatatattgttaatgcacagcagacatcgcaggcctctgatgaatggctgtgtgtatttttgaggcagttctggctgtaaaatataaatagggtagaaaaaggaatgactcaaagctcttacttcttgtctgaagtaaacaaaacatgcgctccagtatatttgggtcaacacaaccagcatttctagctaaagaaaaagggctggctctggctgctgagtcacttaaatcatgtttcacttggcaacatgactctaagtccttctgcaaataaagaggggctgatagctactccaagctccaagcaatgcattaatgacaaaaagataaatttacccacacagaaacatagaaacaagagcaggagtccagctatttatacaagttcaatcactactttatttttaatccagttcctctttctttttaaattagaatttaaatgccaaatgctgtgaggctagaggtcattttaaaccaaacatctgaaatccaaaagccctttctggccatttttattactttaactgttaaacggtacatcgcattcatggatatatccctagtaccacgagttcattatttcctattgcaagccagactgcctcctatattctgtcatttctgtccactcgcatagctaacttccgaggtaatcaggccaaagactttcacaaaaatctttattcctccttctcccttgccctccttacctaatcaattgccaaatcctagagatttttaatattttcttaatataaagcttttactgtagaacagttttagatttatagcaaagttgcaaaattcacctattctcctaacctaggtccctgtaatgtgaacatcttacatggccacagtaaatttgtcacaaccaaggaaccgacactgatacatgactattaactgagctccacactttgttcagatgtcaccagtttttccctaatgtcctttttctctcccaaggtcccatgtccaggataccacacgatgtttaatcacgtctccttagtctcctttgatctgtgaccgtggttcagtcttgccttgtttttatggccttggcagttttgaggaatagtgatcaggtatattgtagactgtccctaggtctacctggtcattttctcatgcttcaactgctgtcaatggcttttctggaggatgaccgcagggctggggtgccattttcatcaaatcctatcaaggatgcatgctatcaacgtggctctcggctgcttcactcgcaacacttctaacaccaactgtgggggtttttcctcacactaattctccagttttctggacagcagccaggtatcctgtaattcaattcaattcagttctgacactaactacccagagttaacacagagccccacaagactgccccatttcagacaccaattgcaagtcctgagccctccacacttctgactggctataaatctggggtcaggggagtcctaaaactccctcctcagggctcacagaactaaggagaatactttcctactcttacttgtttgttataaaggatacacataaacagctcaaggaagaggcacacggggtgaggtccagaaggggcagagtacagaagcttccatccctgtggggttgggatgtgccccattcctggtacatggatgcattcatcaatctggaaccctcagaaccctgtcctttaggttttttaatggagcttccataacagaggtatgattgattacatcattgaccactggtgattaactcaatctcgaccccttcacccctccctgaaggaagggtgactgcattagtctgttctcgtgctgctaataaagacatacctgacactgggtaatctatacaagaaagagttgtaattgactcacagtttcatatggctggggaggcctcacaatcacagcagaagaacaagggacatcttacatgggagcaggcaagagagagcttgtgcaggggaattcccctttataaaaccatcagatctcatgagagtcattcactgtcatgagaacagcacgggaaagacctgcccccatgattcaattacctcccactgggtccctcctacaacacacgggaattgtgggagctgtaattcaagatgagatttggatggggacacagccaaaccatatcagtggccctgaaagttccactctttaattacatggctggttcctttggcaaccagctccatcctggagctatctaggggcccaccaaaagtcactgcattagcagaaactcaggtaaggctgaaggggcttgttatgaataatagaaaatgctcctatcatgcatgccactcaggaaattccaagggttatagaagttctgtgtcaggaaccagggacaaagaccaaatatttcttactctatcgtgacttagcactgatgatgttgaccatgaccacctgactcaggtagtgtctgccgggtttctccactgtaaagttcctgtttaccctcttttcatactcatttttcagatggggaaactgaggttagaagttaaatgattatgtcaaaactaaaaagtaataaaaccaaaattggaaggcaaggcttctcactccttgttctgagtttcttccactctaccaggagttggcaaacgacaatggtccaggggccaaatctatcccagcacctgtttttcataagggctgtagttttaagctgttgggaaaaaaaatcaaatggacaatatttcatgacatgtaaaacttacattaaattcaaatttcagtgtccataagtttattggaacacggctatgcttgcctgtttacatattgcctatagctgctttcatgatacattggccaacttgagtagttacggcagagacttatggtccacaaaggttaaaatatttcagcttaaaaatgtaaaatatctggccctttacagaaagtgtttgccaacactgcactataccatgatgctaagctgcctctttattttttatctatctatttatttatttatttatttatatacttttgtcagggatagagaaaaccagcagctcttaatctcttaagatgggttcattgtgcaatatacgaagtgtaaaacaaaatcctctaaaacatttctttaggggctcagacttgaggtttgctcagctttcccactcttagtgatgatatcacataagcgcagtggagagcttgagtgtgggagagaagaagagatgcagagacagggacacagagcagggagaggcagagacacatacattactctggacattagaattggagagaagaagagtgactcccccaattaacagatcatagataaaatttgtgcaatgagtctaaaacaccccaaaaaccaaaaaacaaaacgtaccggggaggctgtgacaggccaggatcttttaaatgcaaaaatctgagatcttcctccaacatgtacagcaaagacattcttagaaacgttgcctacatgtttccaagtctcagctgctccaacagcatgctcaagagactgcctctccactctctccctcactcaaacatgacccccatcattcctatctgcagacgacaaggctggctactcgcccaactccaaaactgttctctgtttatttctaactctaggaaacgacagagatgtctcaagagaactgtattctggggtgttacgttccgatttttattgtatgtataatacagaaagctacttttcgtttttgtctcagtatcttttgtgaatagtcacttttctaagttcatatcgaatacctatgaaatttcttaggaggcccctcctttagaaaaatattttgcaaggcagataaaaagctggcaccattcaagaatcaggaaagtgggataatccttggagaggaaaatgcaactgtcacaaaaagacaaagggcgaagtgaaggccgtgtgaggataacttcatgaaagcagataatagaaaaaagaactgatgttagaaagttcaaggttaaggacattgctgaagctgtgtcatcattctgacctcaggaactctgcatttaatactttatactttcaaaaatgtgtttcaccatcacagcaatccagtgaggttaggaattagcttcacttttcaagtcaagtccaggcattaaatggctcatttaagttacctccatgagatcagggctcagctggatcatcactgtatacccagagccaaccattatgccttggaacacagcaggtgctcaataaagacttgctgggaaaatgtcattaggccgattgacaaatccccaaatcttctatctcctagtatttacatcactaatggataaagacgaccccctgctacaataaatacccctctcctttctattctaccatcaaggtgcaatttgttgatcaatgacttcccagcttaggcatcctctaagtgcagctctgacactcagtgagtcaatcgcagacacagagagcaaggagagggcctcaaaatcccatttcttacaggagaggatgggttatattaatcttaaaacacaaatgtggacaccacagtatttctagaggatcagtatttatggaggagacgttaccttttaataattaagtcctaaggtggcttttcaaacttacggatgggactggcttacttaacagtttagcaataagaaaataaagcacaagatgagaattctgcacaactcgccttctggtagaagccatatctgtgaagcagaacgagtataaggattctaaaaaaagcagaagaaaatccagctgtctttctgtgatcatctcataagaacagcaactctcaatcacagtctacttagtacaatcgattcattaacacctatttacataataacaccagggtttgaggctacaattttctgtacagaggcatgattttaaagcaagtatcttcacaatgccacacaatgatcctcaaggcatgaagatatctagcagacaatgccatgggcttctggagtcccctttaaaattttatttttccttttcagtcccaggaatgaatagggacttcctggaaatgccatctaaccttgtattttagagacattgttggggataacaaggcatgaaattgctttccaaaagaaatcatttttctgtttcaataaatggtgctggatattgggggagtccattcaatagccgatttgaataagggagagcaaagaaactctttagatgctgttcaagttattcctggattgagatattggtactgagagatgatgagaaaagaatttatttaaaaagaaaatgtgaagagcagttggtcatgagagagagagtgactgtgttattctcaagaaaacagtagactgtccccagtttttgccaccaggccacccagctatgatgggataactagatatataaagcccagtgtctgccaagggcaaattggttcctcaggtaaagcacaaataagtcactagcttgacagtagaatcagcagcaggttgttttggttttttgttttttgtcttctattttttgttttgttttgttttttcagtaagacaacaaagagctcacagtccccaaaagaaaaagttactttcttgccaacattggtcaaaagtatgattcttttagaaaaattcaatgaaggtttcctctcccaaccccatcaaggcaggaaatggaattgtatttcttaaatgaatgaatgttttcataatatttatgtttttggatatatatgatcattaaaatgtgacttctatttgcatgtgaagtggagacaaattagaattgattgcatgtggagattttgtttgtttcgtatccttttgtatatgctatgaaatcttaaaatcattagaccaggaggagcctggaggggccattggatccaccttacgtctctctgcttccaagtgtgggccttggactagcagcatcaacatcttccgagaccctgttagaaatgcagtggaccccatctcagacctaataaattagaatctgctttactacaagattgccaggtgatttgtatgcacttccatctcccatcttcttcagctgtaactttcctggtctcagacaaactcatctagcctacagatgggttagtggtcaaggaggtagtgtccaagaatcagaatcactttggccgttggtaggatgggtgctgactggccatgcctagggtcgcatgctcagccctggatgaaggaaggtccctagaaccatggggacttagattgaggaagaaaatcaaggcgctactatcagaagaacagggaatggatgacaggcaagcaaaccaaaagaccttcccagaagtgatcaattacttgggatgagtatctgaccaaagtcagatcaacgaagaacaattgcatgactttggctgtatctacagagaaggggaggctcttagattgaggttataaagttcatagaacgtaaacctagagctgccacgtggagaaagcctgcctgtgaacaaggcaaaccccaaggaaacagggctgggaaatggagagagaccaggtccctgtaagcttagttgtgtccctgaatgtatggccactaactccagggggcagccttcacactgtttgctaatgcaatgtgactgtgcccctgaagctgtgccatgacatgccagccctccctagatccagctacacctgaagcacattttctctctggacttttgttatctgtgcccatcaacttctccatctttttttttttttttaattttgatttaagtcggtttgaggcagattttctgtgacttgcaactgaaacactgctgacacccatgcggtgagttttaaaaatattcatgctcatcccagaccaaaactttttctcctgcaaaagacagactctgatatggccaaggtggagatggggagaagggaaacgggttggaggatgcattcttatgcactgccaggaagaagtcaatgaagaaatcctctacaggagagcaatatgattatctctatatttaaatattttaaatatttaaaggtatatgccatttggcctagtggttctatttctgcaaactgataatatagattaactagcatatgcgccaaaatatttatgttcaagggtaacatttaatttgttgggacagcagaagattgtacaaccaaaatgcccagcaataaaaggctagtaaatgatggaccatctaaacaatgtttaaaaaacattcctgtagttattaaaaagcaaatatgggaggtctacatgtgctaacccggaacaatccctaagataagtaaaaacaagtaaggtggccgggtgccgtggttcatgcctataatccctgcactttgggaggccaaggagggtggattacctgaagccaggagttcgagaccagcctggccaacatgatgaaaccctgtctctactgaaaatacaaaaaattagccgggcatggtggtgggtgcctgtaatcccagctactcgggaggctgaggcaggagaattgcttgaacccaggaggcggaggttgcagtgagtcgagattgcgccactgcactccagcctgggcaacaagagtgaaactccatcccaaaaacaaaaacaaaacaaaaagaaacaagcaaggtatggaattatgtatatgttaccatttgtgtgaatgcaaaagataaataggtctatatgtatatatatacacacacatacattaaatgcatgtacatggatatatctctaggaatagacagaaagttaatagggattgtttctgggaaggggacaggattgggagagagacctactttatgtcttttaaatattgaaaatactatatgcatccactatatatttaatgccttggcagatttggaatgtttccctcctttttctttctttttttgagacggagtctcactctgttgctcaggctggagtgtcgcggcacgatctcggctcactgcaacctctgcctcccgggttcaagcgattctcctgccttagccttctgagtagctgggattacaggcgtgtgccaccacacccggctaatttttgtatttttagtagagacagggtttcaccatgttggtcaggctggtctcgaactcctgacctcgtgatccaccccccccccacccacccccacccccagcctcccaaaatattgggattacaggtgtgagccaccgcacctggccccctcctctttcttttattaatacaactactggtctaaagaaactgagaatgcatgtcccaagcaagaagtctggagactgagaaatcagcggccccctcttgtctaattaggccaagagctgagcatatcatactcacaaatgaaaaatcactgaaagaacttcattaattggctagggtagagctgcagtgggagtggaaattatttttcccaggagcagcagggcagaaagattcagctatggaaacatctgtcctactgttaggtgctgcagggcatgttgcagaaattcccaggacccatcaatcaaagcaaccctactggtaaatactttctctcctgtgatgtgaatcctcagtggcctctggcctgccctactggccatttagaattaccaagccctcctttggaacaacactgttttctgaagctcttcccttattcttttatcccttctaatacatgcgcagctggaaacatttaaagcttcaagcatagtttaaatgaaaagtgtaagtaaggccgtgtgttgattcttaagctccaactctcctgattacgagggttagacagtctctgccatgactctgtgtgatctgcagtggccacggtgtactcactgacactgaaacagcaaacactggaacacatcagggtgacctgagacactcagagccaagtccaccacacagtgacagctgctgtttgggaagctcatgattggcattcgagttggctatcattttacgggtttaaaatgtgcaacccaagcatgacgatgttattgtttccatcaagctgtaattaacctacgaattaaccactgctacattgattcaattcaaggctatcttagaaagagtttgatcccaacttttgggattagaaactcgttctccgcttttttcccaacaaagctcctcctcctctccaaattatatattttaccagttagaagagttattacttggtagccttctgaaatgatacatgcaggatgggtggggcagtgggaagtgtgtggagaaggtggcccatgtttcttaccagaggaccacaattgattttgatgctatccctaatgaacactcaaagtttgcaatatttatcttcctaggcctcagccttctcatctgccaactttcttggggaatgagatagatgatctcagaggttcctgtactgcaccatcagcacttgaaacgaaagcacccaaaaaggtgaggtggcatctaaaaaatcccaaagtttggttgttttgaatattactgtggatttgagtgtatgtgttttgatctttcacagtgcttttcttaggaaaatgcttagtaaatacttgtggagctgagcaacctttatctctagtccagctgcctataagactgtgtgtgttcagtttaaacattaaaggacagttcaagtatgaaaatttgcagaccatcccatttaaatatattcaacatggactagtgtctattattctttatagcaagctaagaggaatgtgtagttctttttcagttggggagattttaaaaattacacagaaagtcctagtttaaactagaactagtttaaccttgagcctctcaagtttgggcagattgtgaagccagccaaagagggctacgaatcatgccatggtgtctagggaaatagctttgcctttgcttcactgcaagctttccggttccctcctttattccacagaacatgatgcggtcacaacaggtgccagatgccccatctgtccagagattgctttaagcacatcagtctgggcagctgcgaacagaatctgacctcattcactttatatgtagtcagttagcatgtggtcgggttagactacatcatggacaagagccctaacaaaaaaacatcctgagcagtctgtgaccaggtctgagtcattgttttacttccagcaacaatgtcaatgcttaggatatagtaggtactcactcaatcaaggttagctgaatgaatgaagtatgacagctttcatcagtgttatgacaacatggctgggagaaaagatgatctacgactatgagtttgaattgagggttacagagcctagcttgtagcaccacatagtttttagttttagacgtcattcccaattgaaaggtttatactaagaacaggcatacacagcaagaagctagcaatatattgagattttcatagctttaagtagagcatatgtacataaatatgcacatatgcacattgggaaacctatactttcactcactaaagcaaacttcatgataaataactaaaagacataaaattgatttaacaaaaatagcccaggggatttcttttcatcacaactgaacactgcaagtaacagaataagattcattcctaaatgactctagactcactagactcactacaagtgaaatttcatcccccaaaataccaacacacagcaaaaatttgatcagttttaagtctagaaagaaattagtttggaccccatgctgcaatatcacactgtatctgttgaaagcccttcaacatgtttcacagcttgaaacatcaaccgattccagagatattgatggctaacaataattaaacatctttttttttaactggaagctactaataaaatatatcaataaggctgggcacggtggctcacgcctgtaatcccagcactttgggaggctgaggcgggcagattacttgaggtcaggatttcgagaccagcctggtcaatacggtgaaaccccgtttctaccaaaaatacaaaatttagcagggcatggtggcacgcactgtaatcccagctactcgggaggctgaggcaggagaatttcttgaagctgggaagtggaggttgcagtgagccaagatcatgccattgcactccagcctggatgacagagtgagactccgtctcaaaaaacaaaaacaaaaacaaaaacaaatcaatgagccaatagattccttagtaattccataatgagcacacattgtggagttggactgagtttaaatccagattatactgtgctctcttcggcagcacatacactaaacaaaacaaaaagcagattacatcactttttagctgtgtgattttgaataatcaatttaacttctctgtgcttcccatctataaaagggggagaataaaagcatgtacttcataaggtcatggtaagtatcaaatgagataattgacataaaaacttttaggaaggaagttagcacatggcaattaatcagtaaatggtttttatcattattacatctatccgcaaaacatgtccatttaacaaatgctcgccattctaatcataaccccatccttcctaaatgctcaacctcagtgtttccaccagcacaataccaacaggaaaaccaatttgtcttgcatccctgttcccaagtgcctgatactgtgcctggcccagagttgagtaagtcctcacttaataccagccataggttcttgaaactttgactttcagtgaaacagctgaattggtatgatgagaccaattttaagagttaaattcctacatatttctggtcagaaaaacatcaacaaacttctaagtaaagaaccaaaacacttctatattaaacactgaaatcaatgtgagctaaatatacacttaagaaagattaatgaaaacaagtaagataattagttacccagttattccagttcagggttttatgtggctggaacctgtcccggcagctcagctcagggtgcgaggcaagaacacaccctggacaggacacatcccatagcagggggcactcacacccacacccacactcacactcactcagactgggcctatgtagacatgccaattcacccaatgtgcacatctttgggatgtgggaggaaaccagattatccggagaaaacccacgcagacatggggagaacgtacagcctccacacagacagtggccctggccaggaatcgatttgtttcatcatcaatgcaataacaaaacaatgttgaacaaaatgacgttattcaaggacccactatagttgctccaaaaatattgggtaagatagtgaaatgatgatagcaatattttaaagcacttaaaaatacatcacaaaaagtatgatattcactgtgttccttaagggttaagggagaaagagaaggaattctaagcttagattgcttttcttttcccacggggatggaagggaaatgaacaacagcagatactgaaaggtgcgctggaattaaattgtgtcaattccccagcataataaaaacagaaagtccattctggagccaaggctgatcacctattcatccactctattttttttttttttaaaaaccactctctcacacaaattctctctcttaccaatatacatgactcactaagaattcacattacatgaaatcacaaaaaagcaataggaattcaataaggcattttctaactctcacaaaagtttggcccccagacagtcggcaacagagagtgctgaatttccaacggatttaccactgctgtctgacagcaagatcctgtgaaagaggttggggctgacgctttgatgctttgtatggggaggggatcctgcgctgggaaagggtcttaatcagaccagtgtgagctgcccacggcttgtaattaaggctcttcctggccaaagcccacagagatgccaggcttcaagtacaggtattcagcacaaaaagccaaaattatcccccggagtgcagaggttacacggttacaaaagccgaggattttttttttttgtcctctttagagaaataaaatcatgaactgctccgatataaaattaaatggcaaaatgtccatgatatagcaagctccctttcccaaaataaagttgtagacaatatgtattagtgagtccatttaattaagcaaagccaaaaaccaaaccctctccactatcccctttctctctgtaatgcatacattgaaagcttcctgaaaatagatatcaaagtgttaaaactgattaccactggaaagtgagggggagtctttaaattttatataatctttcatcacaggaaaagtaaacagattagtttaatgaaccctgatgtacccattactcggtttcagcaatgattaattcatgactagttctgtttcatctatacccttcactcacttcctttcttctgtattgttttggagcaaatcccaaatactattcacccttaaatatttcagtatgtattgttaaaaacaaggaaatttaaaaaaaaaaacataaaaataataccatcattatacctaaaatatatcaatgataacaatttaatacttcaaatatccagtgtttaaacttccaattgtcccaaaaatgttttttaagtaaaaagaaaaacttgatacaaattaatttaatgaagtttaattgagcaaagaacaattcatgaatccggtagcactctgaaccagaggaggttcagaaagctctgctccataactgggcagggagtatttatagaaagaaaacagacatgaggcacagaaacagctggataggtggcagctcagaatttgccttatttggacatggtctgatcagttaacagcctgtaactggctaacacctaacacccagctccttgttacaaaatacactcctaaattaggctttcaagtttatttacattctaagttaggttagcttgttaagtagggactcatggtatggaggcagtctcaggccaaatttagtttaacatttgttttgttttacagttgtttgaatcaagattcaaataaggaccatatataatgattggttaatatgtcctttaagtctttcaatctataggttctccttctatcttactgggttttttaaaaaataattacatttagaattttatgtatctattaatttgaaattgatcactaataggttttctgttttgttttgtttttgagatggagtctcgctccgtggcgtgatctcagctcgctgcaacctctgcctcccaggttcaagcgattctcctgcctcagcctcccaattagctgggactacaggcatgcaccaccacacccagctaatttttgtatttttagtagagatggggtttcaccatgttggccaggatggtctcaatctcttgaccttgtgattggcccgcctcagcctcccaaaatgctgggattacaggtgtgagccaccgtacctggctctgttttttgttttttgtttttttaatgaggaaggaaagaaaaattaaatagctgagagtacagcactgagttccttcattgatgaaaaaataaaaaagcaacccatggtaagagatacagcagtcattacaggatattcctctgtctcccaaaaggcaactggacaagagtccatcaatatataaaacttgcttaagaggtaactttatgaagctagtgaactatcagtagcacagtgagaccaatggcagtgtaaaatgtcatcagaaatgtcatcacaaatccatctgagggaacagacaaatcagcttaactgtcggtgtgtcttggttctgccctagttaagaatggaaatgggggttattaggaagacagaagggagaaatcatattggggaagcaacggataaatgttcactgtcatcactgtttatatttgttgtgctgtgatgctcttgttaaatatgggaggtggtttcagtgctgaaattaacttccaattggtagaagttggggagagaaggtttccaattgtcaaagtacaggatgatgccttacacttggtacgtactacacacatttgttgaaaggaacataaaatagcttaaatttttaaggcagatagccaatgatgcttcccaaactacaagaccaagaaaagtaaatttacggactctccatgtcaccccacctgcattgaaaaagagtccgtatttacatacatgcttgaatctcttagttggttatgcaaacaagcagcattcattgatcaaatatttgtcatcgtgtctttccttgtaatggaaatcaaagaatcatatcattaaaaaagtcaaattcatagaagtagaaagtagaatggtggttaccagaggctgggggtggggacggggagagggatggggaaaggaaagacgctgaacaaaaggtacaaagtttcagaccatgcacaatggctcacacctgaaatcccagcactttgggaggctaagatgggaggattacttgaggccaggcgtttgagaccagcctgggcaacatagcgagatccagtctctataaaaaaaacattttaaaaaattagccaggcatagtggcatgcacctgtagtcttagttactcaggaaggggaagtgggaagatggctggagcccaggagttcaaggctgcagtgagatatgattgtaccactgcattccagcctaggcaacagagtgagactttgtcccaacattttttttttttttttagttagactacagaaataagctttagtgatctattgcacagaattttgactataattaataataacataatacgtatttcaaacttgctaaaatagattttagggccgggtgcagtggctcacactcgtaatcccaggaccttgagcagccaaggtgggagggtaacttcaggcctggagttggaaaccagcctgggcaagatggtgagacctccatctctacaaaataatacaaaaataagctgggcatggtggtgtgcgcctgtagtcccagctacttaggaggcttagtgtgaggatctcttgagcccaggagttcaaggctgcagtgagctatgatcatgccactacattccagcctggatgacagagcaagacactgtctctcttttatttatttatttttaaagtagattttaaatgttcttaccacaaaaagaagataagtatgtcaggtgatggctatgttaattagcttgatctaattgttacacaacttaaacatatatcaaaacatttcatcataccctttacatatatacaattatcgtcaattaaaaagcttttaaaataattttaataattctagtttctttctcttttttggcatatccctttaaaaaataaaatccagctgggcgcggtagctcatgcctgtaatcccagcactttgggaggccaaggcgggcagatcaggaggtcaggagatctagaccatcctggctaacacggtgaaaccctgtctctactaaaaatacaaaaaatcagccgggcgtggtggcgggcgcctgtagtcccagctactcaggaggctgacgacggagaatgtcgtgaacctaggaggcagagcttgcagtgagccgagatggcgccactgcactccagcctgggcgacagagcaagactcgatctcaaaaataaataaataaaatcctacaacatattacacatttaaatcaaataagagttgagttgggcctgttagaataagactggaggacttgaaaccctcccactaatctagtcctacttaccacataatactagtaactcctacaatatcagcttgaatatctctagtgacagggagtttactacctcacaggacataatcttattctagtttcagttcctgatactaaagcaatttcctactattgaccaaaagtctgatttcctgtaatgtctactcagtggaccaaaaccctcttctacaagtgaatatttcaagtatcttaagacagctgtcatcccgctcagctctgcagtctgcagctcaccacccccagttcttcaactgttactcaccagacatggtcactgctccttatcatcctgctcccctttcactgggtatgttttgggagttttaaatatgcccttgacccaggggagtatgctaaccgctcagtgtctgtcgaatttatttctcaactggcttttatcaacgcacacattttctgtctttgtcagtcaaccctgtttctaattttcagccctaagcctgagagaatgcccatcaaaactcatctcttgacttcttgctgtacttcctgaacttggattatcttctcctcttcgtataccgtaggctccccagactcatcattcatagcaaatgccctgcgctccagcagacaatgtgatgcctttcttgatgctgctacttttcccagctcaatccaaaggcccagaaaaaagttctcctcttgtctgtattcttcctaaaacagaatacaacaccccagatgtgcctcggtcacctcagagttcagtgtgactgttctttcctctctccatagagtgcttctcttcaagtagatgggtcatattagtgaatgtgtctgggggggttttagcagctgcccctccctgttcgctcatctcaagctcacagctggccatcagtctccactggccacagctactcctagctgtctccaatgaggtggcccccctgcagatttagttgggccctgaaccaatgacaaccaggattgataatagagtaagacaatggctgtcaatgctagctgcacagttaaaatcatctggaaagctttaaaaactatgaatggctgagtccaaccacagagattcagggtcaattgttctgagtatcctttaaaaaaatcagaattttaaaaaatgctcccaaagtgattttaatacacaggattcagagtcacttctgcaaccggaaatgcctcctaacaggtaaatatgttctagaattcatctgtgtctgtaaaatagagcccaaagtgcctggtagaacttctattccacaattcaaggagctgtcctaaccatctaataaaccatatttaattttcccaacaattccccattgaatcaaggcaaaaacccagcctcagaaatgtccagtaaccagtgcaaggcacactggaaggaaggggtgaatacagagtactctggcaggctccaaaggtagtgtccttaaccctgatacacattccccaatgtagcccattccttggccttgctggagtgctcaccctttcttcccagagtcctgggactcgggctttcctcagtttccaggggggattagagttcaactttgaacctctacctagttcctaccagcccttctctgttgctcctgatatgttcatcattttgaaggaactctgtcgacatagcctggatgcttcaaaatccagtcactaggtcagtcagtcccttgggtgcaattccttctagccactgacccagcactctgtgaggccaaagtggatctctttattcctttcccttctcccccgatcatgccctccccactcaatctatccttttcttccagattctgcccatagtcagtcctggtttactcccagttgtttgcatgctatgtggcaaggcccagccaattacagcaccaattaaatccctctgatttcttctttccaaatgaagtgccataaagctgcttctatttcatcgtgtacatttatgatcactctttgaaacctaaatgtatgacttcacaatttttgcttttttatttagctttattagtttgtgcctattatgtcagcacttccatagaatctgaaattgtcatttatcataatgaggtatctttctgagatgtttatatcagctgcattttctgttttttcttttgagacagggtctcactctgtcgcccaggctggagtgcagtggcacaatcacggctcactgcagcaactcgtttgacttcctgggctcaggtgatcctcccactttagcctcctaggtagctaggactacaggcacatgccacaatgctaggttaatatttttgtatttttagtagagacagcatttcaccatgttgcccaggctggtctcgaattcctgggctcaagtgatccacccaccttagtctcccaaagtgctgggattacagatgtgagccatcacgcccagcccagctgcaaattttttgataaagtcttctttgtttttatccaagttactaataacatggctctttattacaggcattactttagtttggtctaaaaccaacagaatcaacattttctggcaaaaatcatccacttgactgtctccaaataagtatacaatcttattttcaatattttaatgaggagttttgtgactgctttgctgaaactgagattcactatctagatattgttccctgagcctggttaccataatgagtgttgttagcgaacccttatgggttcctggtgatctctttattcttctccaattgctgacaaatatttgaggatctattataaacttgtcagggtttacatgaaatgtcaaagaccatttgtgaaaaagtggaacaacaccctgcattttcctattttttaggatcgctcctattctctataacctttccaaatttactaatagggccaggcgtggtggctcatgcctgtaactccagcactctttaaggcagaggtgggaggctggcgtgaggccaggagtttgagacccgcctgagcaacatggcgaggcctcgtctttaaaataaaataaaattaaaaaaaaaaaaaaaaagagtactaacagttgctttgaggtcagttcctttacatgtgggatgtaatcagctgggttttcttcacatctttccacctatccagtgtttcagtgtccttttaattcatttgtctttttaattgaaaactttgctgagataattaaagatttgcatggagttgtaaaacataatacagtgatcccttgtacattgtactgtttccctcaactgtttttgcaaaactatagtataatattgcaaccataaaattgacatttgatataattccccccatcttactcagatttcctgtttcacctggatttttgtatgtgaacctctatacaattttatcactcatgtataattgcgaatccagttaagatattcaacggttctaactctgcaaagattccctgtgttgcctattcatgactcttttaaacactgcttgctttactctctttggtttttagatcaatttccatgaaggaaaaaggagatgcaaaataagagttgagaggctgtgccttcactgcgctacttgttaacattatcactttctattccttttcagcatggtttcttaatctgcataagaatttctttttaaatattattgttattttttcctagaattttaaaaatgctttcatgtccttaggttttctttatctgatgtccattttcataatttctttgaaatgtagcttggtaagtgggtagagtggtttgcctgtttttctactttgtagtagaatgaaataaataacagcacccatttgggacacaaattaattgacattgtttcctacatagtttccaattataaatatgtatgaaataccttttatttgggtattaaactataatgagcatttgtagctatttaatgcactaaaatatcgtttctgggccaggcatggtggctcacacctgtaatcccagcacttcgggagtccaaggcaggaggatcccctgaggccaggagttcaaggttacagtgaggctactattgcaccactgcactccggcctgggcaacagggtgaggccccgtctctactatatataaaatttccctcagtaatctctttgaggaataagatcatattttatacctcttttgtatctacagtggccgctgtgcttgccttttcaacatatatgccccaaatgattagttttaagccaaagattggcccttgctttataaagtggcagacagtacatattttaggcttcgtgggccaaacagtctctgtcacattactcaactctgccactgcaatgcaaaagacaatatgtaaatgagtgggcgtgggatatgccgataaaactttatttataaaaacaggcagctaactgtagtttgcctacccctgatctaagccaacagtggcaacttcctcagccagtgactggtttacaaatgcacatatgatccaatctggtgaaagggatgtgagaaaagtctgatgggggcttctgggagagacgatttcacatgtaagacacacaaggaagagacaacccttttttcccccttggatgttaccaaatctgaatgtgatagccaggattgctagagccatcttgttcctgatctaaagatgaggccatcaaacataagggggttaggccacgagaatcacagaggagagcagcagcttggcatactgggcctggagacagccccacttcttagggaagacaataaacttccttattgcttaagccaatgcgttggcccaaaagcatcctaattactgtagcaccccctctggcgttcagcaaagtacttcacagagaatagatgttcagcaaacaacagtttgctggtctggctaacaatctgaaccatgaatttatgcaaatcagaattccttccgctgtaaataaactagttcctcttataatcctctttttttcttaaaaaaaaaaaggattaaaaaatagaaaaacaccaatgagaggaataatatagtaaacctatattatttaagatgaatagaaaagtgataagttttcatgttttctgaaaataaatgtgttttaacttatttatccgttccctgcagttttcctcctcttactttaagcctctctctccgtggttggcccttggaaggcctgccatatgcaaatgtgtgtatactcatcagtcttattaggcgtagttccaactggccaccccacatgaacacaattaaaagttaaacatcaattaaaattcacagactccatttagctttctcaaaaagcactaaataacggtacacatttgggacacaaattaatctacattgtttccttcatcagtctttagttatcaaacatcctaagcctcattttagactctgttaattgctcattcagcccacactgagtaagcaatgaaaaacgagcccgagacaaaagaacaaaagaatgagatgccacagtggatcaagtttagtcagccaggtggttcgtcaatgatggtggcactggagaaatcctgtgtgaggacaaacactgtccaagtgaggggcatgtgggtgatctctcttacgagacctccactgatacatgcatctgcttattcatggacgtcgatatctaataggcatgtcaagtttcaacagggcccaaacggaatgcataattttccctctaaatttattccttttccctcttcctccatttcaataaatggcactcagttgcataggcccaaattcagcatcacccctgatttcccattttctgtatccccacgaccaagccatcagcaattcctatcggctctgtgtccaaaatctgttcatccctcttcattccgctgccaaccccttaatccaggcctctgtcatgtgtcccctgtggtgactgcctccgcttcctgactggcctccctctgcccctcctgcctctcaacaacctactctgctaaaaactaaataccatcccattgctcccctccaaatgtgtctccactgcattttagaattagacacctgtttactttcctattgctgtaacaaatgatctcaattcagcagcttagaccaacgtacatttattctcttgacagttccgcagctcagaagtcgaaaatcagagtgttggcagggctgttttccttctggaggcttcggaggataatccaaattctcacctgctacaggctgcctgcactccttggctcatggcctcttcctcactttctctgactctgatcctcctgccccgctcttataagaacctttgtcatcatattgggtccacccagatgatctccccacatcaagatcctccacttactcacagctgcagcgtcccttttactatgtaagctaatatagtcacacagcactggctctggaatgagacacagacatttagcggggcctcattcagcctaccacaaaactaaaacacaacacacaaaaaaaccagttccttcctgtgaccacccggacctatgtgcccagccttgcacatctctctcagcttgtcctctactgctctctcctcactgctacaccagccttcttctgtctgttcctttgatgtttcagctcgcccttaccttagggtctttacccttgttgttctctccatctgaagtgttctccctccagaagtccacatagtggttcattcacgagagcccaaatgtcctttcctcacttactgtccttcgagatcatctcgtctattctcccagaccataagcaaactctgagggaaaagtccccatctgtcttactcatgctccacccagcacagtgactgacacacttaccaacttaacagttgttgaaagaatgaactatctaatttcaaaatgttagtgatctctggctgggtgcagtggctcatgcctataatctcagcactttgggaggcggagaagggcagatcacctgaggtcaggagtttgagaccagcctggccaacatggtgaaactctgtctctacaaaaaatacaaaaattagccaggcatggtggccggcacctgtaatcccagctactcaggaggctgaggcaggagaattgctggaacctgggaggcagaggttgtagtgagccgagatggcgccactgcactccagcctgggcgacagagagagactccgtcttaaaaaataaataaataaataaataaaattataacccattttggttttataatccatatatttatgtaagtactttttaaatacatcgacattttgaccctagatcagctcacaggataagactaaacaagatgaaatgtaataaaactgactttgaagtattacttgagaccaggagtttgagaccagcctgggcaacatggtgagaccttatccctacaaaaaaataataataataacagccaagtgtgatggcttgtgtctgcagtcctagctatatgggaggctgaggtgggaggattgcttgagcccaggaattcgaggttgcagtgagctatgatcatgccactgcactccagccagggcaacagagtgagacgttttaaaaaaaaaaaaaagacgataaagcctacaaaatattggagaggtggaaatgcagtgaggcgatggtgctgagaaaaatatgaataacaattactatataaagaagacttagaaggattaattatagttaactcaaaactccgtgtgacttgtcagcatggtgtggctaccaaaaacatgaccttctgtgcactggagattcctaagcaaaaagaggaaaaccgattcttggacacactaagatgttttaaaattaaagctaagtttcaactaatccttaattgttacagtcctgtgtcatttttgtatgagggccatcatcactaagatctgtcattattgtaacaggagtagtgatgctgtaaaaaggaacaggacacaactggaggctgcggaaatggtagggagcatgccaacatctctcctgcgaagggcaagcggagatactcacatccccagattaacatggtattaagtgctcaattcaagccaagatagactctaaggtccaaaggcaaatgaggtatccaagaaaggaagcagaggtcccacggggtgaggggtgggaacaggaagcaccactatattgcaccgtgtcaggtccgccatagtggaggtgtggagggccccaccttgtgaacgatttatgttttatcctagaatgcaaagtaggttccctcttgactgacaaagtacaatgctcttcctctgctggtaccactgatagcattcataatatgcttttacgaataatgcaatctggagacatctgaaggatacagcttttggtcaataaatccaactctaaaagcccttttaaagctttgcccaaccacctcggccttctttaatagaattacttctgtttttccacagaatgatttctcctctgattaagaatcacttcaaactatagaagagatgcatatgacagatctgtgtatcttcaggactttcgtgatgctaaatggcaaacacatgtgggtcagagttgaatttcttaggacaatagtgaaaagctgagtgccatctcctcctccccatgtcatccctcttcaggatatgctgaaaaactattttaaaatatcatttcaaaggtgtcaagttatgagctagctgagctagatgttcatgtgtctcagttttgtgtgtgtgtgtgtgtgtgtgtgtgtgtgtgtgtgtgagggtctcaagaaaggatctctttctgcagaaaaatacacgtgtgtacacatccctacaaattaatggtgctcttggacttctagtgcatggccaggaattccaagttaagaaacttatgtcttattccattttgtgttgtgtattagtctgttctcacgctgctcgtaaaggcatacctgagatggggtaatttacaaaagaaaaaaaatggactcacagttccacatggctggggaggcctcacaatcacagcagaaagtaaaggaggagcaaagtcacatcttacacggcagcaggcaagagggtgtgtgcaggggcaatgccctttatttttattttttattatttattattattattattttttgagatgcagtctagctctgtcgcccaggctggagtgcagtggcacaatcttggctcactgcaacctccacctcccgggttcaagcaattctcctgcctcagcctcccaagtagctaggattacaggcactcaccaccacgcccagctaatttttgtatttttagtagagacgaggtttcattgtgttggccaggctggtttcgaactcctgacctcatgatctacccacctcggcctcccaaagtgctgggattacaagcttgagccactgcgcccggccagaaatgccctttataaaaccatcagatctcgtggagacttactcactagcatgagaacagcatgagaaaaacttccccccatgattcacttacctccaaccacgtccctcccatgacatgtggggattatgggagctaaaattcaagatgagatttgggtggggacacagccaaaccatatcatgctgccataaaggaatacgccaggctgggtaatttataaggaaaagaagtttatttgcctcatgattctgcaggctgtatgagaaacatggcaccagcacctgcttctggtgagggcttcatgctgcttctacccatggtggaaggtaaagggaggccagtgtgtggaaagatcacgcgatgaaagaggatgcaagagaaagcagggaagggccagactctttttaacaatcagctttcaggagaaccaataatgtaagcactcccacccatccccaggaagagcattaatctattcacaaaggatccacccccatgacccaaatgcctcccattaggtccctcctccaacactgggtatcaaatttcaacatgagattcgcaggagacaaacacgcacacttatagtatcttactacagtgggtaagtatacctagagagactattttaaagacactctaaaatggcttatgaacacccaagaggcttatttttccagcttctaggtttgtcattgttcagacctaccacaggcacatctgactacctgtggagcccaccctagatggagcatgcactggcctgcagatgattgggtttttttcagtataaaatttataaacagattttgtttttgtttttgttttgttttttgagacaaggtctcactctgtcactcaagctggaatgcagtggcacggttttggctcagtgcagccttgacctcccaagctcaagtcatcctcccacctcagtctcctaagtagctggaactacagatgcgcgccaccatgctggctaatttttgtgtttttttctatagatggggttttgccatgttgcccaggctgatctcaaactcctgggctcaagcaagcctccctcctcagcctcccaaagtgctgggattacaggcgtgagccaccaccacttccagctattaacaggtttttaaattataactagcttgtctttggagaaagaatgcaagtatttgagaacaaattaataaactggcattgtaatgttgtgtgcatgtgtatgtttgtacatgtgtgagtgcctgtgaccgctgtgtatgttgtatgtacgagtttacgtgcgtcttcccttaagagatgaatcatccatcctccctgggtctgccatttcctggtttaccagacagatgattcactcaggtaggagccaacctatgggtccccaagcagcctatcccctaggagctcagctaacctcctcccatccacaaccaccccatcttcagggacgctatcatattggagacacctgcccacactgaagcctttgcagcagctttgaaaagttccaatcccttcttatcgcaaaggactaatctgcttcttatcgctaagcttcctcaactacatcccactgtgcggcctaaaggggattaccagctgtcaagtcgcttttatctttccacctacccaacagcagacaggagagctcaaaatgggacagaaataataactaagagtaaaggaattcccaaaggggcgaatctgtgtctctgaggcaatgaaagcatcctacacaaaatgtaaaacatgagtcttgggttttcctaaattctcctgtctttttttggctgaaagcatgagaccgataaataagtgtctgccaactgctcgctctgaccagcaaagaaaatcaactggggaaagaaagtcaaatcaggaaagggagttgagcacgggcttgcatatggggaagcacgcacacacgcacatacacacacgcgcacatgtatggacgctcacacgtgcagggagaaaggaaaggaaaagccaccacccttcctgaattttctgagacagacctataactgttccagacaacacaggaactcttcgaagttcagctaaggaaagagaatgtttccacttcacaggatcatcagacactggctctgtttctaggtatatgtgtacacagaggttcacagataatactgctgtcctgtggcagcaaatgtcacgctgctgaccagcacttgagtttattttcccagttctgatatcttttccagtcatcctggagaccaagagcttgatggtccgagtcaaacaaaagatctttttattgcgcaaggtcaagtggcccaaatcaagccaaataacttttgacaatgtgcatttgtttaaaattttcaatggcttcccacttccctaaggataaattctcagttctctaactgtgagaagggtgggccacatactttgatggtccaaatcgggacatttttgagagtgaaagagagtgctattaataatagtgctggggctgggctcggtggctcacacctgtaatcccagaactttgggaggctgaggcgggcagattgcttgagcccaggactttgggaccagcctggccaacatggcaaaacccgtctctactaaaaatacaaaaattagccaagtgtggtggcacactcctgtaatcccagctactcaggaggctgacatgggaagatcacttgagcctgagaggctgacgctgcagtgagctgtgaggatgccactatactccagcctgagcaacagagtctcagaaaataataatagtgctagacaactgccacacgcaagagctgtcttcactgacagaccaaacaatgggcaccctaccctgaggtctctggctctggcttgtgatcaacccacttatctcaccgtcctctgctcactctcttctctagccacactggcttctctccgctttttgaaaggggctagctttctccagcctccgggaccttggcatgccctttcctttccctgctccatgggtttgcagcttcctcacctggctcactcctgctcatcccttcttcaggtctcagcctagatgtcacttgggcagggaggtgtcctctgccccccaggacaaggctagctccctcttatgggctcccacagcatccagaacaccccccatcacatctgtgatgacttaatgcttgctcctgcccccacagatgctcagtgttccaccacaatgaataagccaccgagccagctttcctcgctgccaaatccctggtccccagtgcagtgctgacccaaggaggtgctgggttcaagtcccaccacaggcatccccactccaatgcttgaacgccactgcccttccccacactgctgtgattgtgggcggccctgagtgttcccttggactgaggctgcctttgacctagtctgtcacactggactgacatcaacccacttagtgctgtgcgttcctccaaggcagagactgtaattcactcaccgaggcacgtgctgatgaagatactggtgaaggaaacacaacatcacgacccctcatccgaaacctagggcttagatgtgttttagaatttagaatttttcacttgaaaatgataataatatgtaatattgcccatggggctggggcagcaccctgtaatctgccacactgatatttctgcagcaaaatgggtgaatcttcacactaaacagcgaaataaagcctcaaaattatctcacatcctttcaggtcaggctctgcaagtcatttagttcagatcaggtgagaatttctgcccaagtatgaagaaactttggttttcaatagcttttaaattttagaattatgggcagggcatggtggctcacatctgtaatcccagcactttgggaggccaaggtggtcaggtcatttgaggtcgggagttcgagaccagcctggccaacatggtgaaaccctgcctttacaaaaaaatacaaaaatcagccaggtgtggtggcacatagctgtgtcccagctactcaggaggctgaagcggatcatttgagcctgggaggttgaggctgcaatgagccaagatcatgctactgcattccagcctgggcaacagagaccctgactcaaaaaaaaaaattttttttttttctagaattgtggaaaaggactgtggacttgtaacagctgacatttcattaacacttatatgctaggcactgcttgaggtttacatacatattatatctcatttaatcctcaaaacagtcctacaaagtaagtattatgcctttgtttatttttcagataaagaaaccaaggcatagatactataatgaacactcagagagtaagcagcagagcacaacactggacgcatgatccacagcaggtgctcaatgacttctgaataaatgacaggacgctgcgagtgtgcacgtgttaggcacagtgaggcaggctcgaagcagttacacaggtagactgctgagatggccttgccagttcctatggaactgtctgcctcaactgcgtcttccaggcatagcttcaagcccagcttgatgtttacaaacacgacatgaccatacagcctaccctcctggacgcagatgactgcagcaggggcaggctcctgacccatgtttgggcgatcatagcgataccctaagacttaggaactggaaccacaaagtcattttctttcttggtccctggactctaaaacataaacatgtttcagagaaaaacagggaacaaacacatagcatctatatgtttgtacctatatttaggttaaaacctaaacacccaaataaagcctgacatattctaacaagtagcttacgttgtctaatttttccacttaaataaaacattggctagcacacaggaactactaggccagttaggactgcttctgctgctgaaatggaactgatcattaagagtcatttggtaattaaattattcaacccatgtttactgtgtacctactatgagccaggaactctgcgaagcagatggtaaacaagacagatgtggttcacgtcctctcagatcatacagttgtagtggaaagtaacactacagtgtgagtgttattatccatgggaaataagaggaacagagagaattcagagcagtaggtttaaacaaattagtcattgaaactgaagtggaacaaaaattacactgtttatgagttgtttgatcccaacaaattcttataaaattgaatgattatgaagaattattgatataaaataaatgctaaatgtataaataaagtcttacataaataatactaaaactataaagtcttcatatgcatattgagtcattctaacaatcatatatcaagtatggaccatccagtctcaccatgattaaacagaatattagtaagatttgcatatgcattatgaatgtctgattaaaccacttgacagtgaaaaactaagtggttttcagaaaacactcaatccaaccaataccttttgccagtttaacgccagggctagcctaattaaaactacattctgcaggaagcactttgcaaaaatattagaatatatttgaagttcgcaagctaaaagggcaacactaaaaggatttcagcaatagtaaacaggacgagtagctatggtgatagaaacacatttgatgtaatatatgacaggtgctattaactgtgagtgcattaaccttccttccctcctttcttcctcattagcataaccccaattgtgttcaggttactaagatgccctgctaaatatactctttcctggcctctcttgaaatcacagatgccttgtatcatagttctggtgaataaaacctaaataaaaatctgttttgagtttctttttttttttttttttgtgacggagtctcactctgtcaccaggctggagtgcactggcgccatctcggctcactgcaacctctgcctcccgggctcaagcggttcttctgcctcagcctcccaaagatctggggctacaggcatgtgccatcacacacagctagtttttgtatttttagtagagatggggtttcaccatgttggccaggatggtctcgatctcttgacctcgtgatccgcccgccttggccacccaaagtgctgggattacaggcgtaaggcactgcacccagccaagtttcttaataaaaggaggcagagttggtgagagaaatcctttccctacccttcttctcttccatgcagacatgagctgcagccaccatgctgtcaccatgaggacaaaagccaacataccatgtagctctgatgaagccctgaaccccgcctacctctagattttgtgtcatatgagaaaaaaatggccctgtttgtctaaaccactattctttgatttttctgttatttacaaccaaacattcctaataaggtagtgcaagacagaaggctgtacttaaaatgtttgaaccttgggcaaccgtagctatagagactgagaattctgtgtgcaatgagagactcggcatagataccaggaagtagcccatccgtggtgaaacagtgtaaaatattgatcattgtgggacactgaatcagaactgtggtagaagctggtgcttgtttactcaacgtacactatccatattcttcctcatcaacagaatcctgtatttgttcccatggtgggcactcacatgtcctttcctagccccagggcaagtcccatttcaggcatttaggcaaagcctagtagaagacaggaagggcagtgctctgccaactgtgtagacgtgatgctccctccagctcccactttacgttcaggagattttgatatggaatacagatctaacgtgtgactaactctagggtatgtttaatgacattgtcggccccttcaggacttttttggtttggtgtagaagtaggtgtacaagtacctggtatatctgatacagggttattactattcttgaactcaagtacagttttttttttttaattttttgagttaagtgctctcattttgttttgcagcataatattccttttcttagctttcctatgactttacttagcaacctttgccaaaagaagtacaatatacgatagactactttgaagacacatacattggacacctaaaatcaacaagagcagagaggtatggcataatctttttcatttgttatgtgttgttcctcgagtcaaactaatcttcttaatggcagaagctaaagcaaaatcatcctcaagttaacttttaggaaattatattgtaatattacagatatctgataccttcatattttaagtacattttaaataataataattattattattaacaataatagtgcagtggtacaatctcagctcactgcaacctctgcctcccaggctcaaaagatcctccctcctcagcctcccgagtagctggaactataggtgcatgctacagtgcccggctaattttttatagtttttatagagatgaggtcttgctatgttgcccaggctggtcttgaaatcctgggctcagtcaatccacccgccttggcctcccaaagtgggattacaggcatgatctaccacacccagcctgtttaagtacttttgctaactggataatttttaaaaatcattatttaagactttggcaacctcaaattttcatgctgtggtacaaaactacactttttgctcactttcatctttgaataccttatgaaagtttgctgctaaacagagcaaagcactggtgattggtccatagaagagtatctcaccaggcagccagcatggatgaaaaattatggtaacttacactgaagtaataatgattacctgctgcattaggtacaaggtttacaggacaaagtaatattttaatttaatagcagtggttacttatatgatatcttgagtaaatttaataaataggaatccattatatccaaattaccatttcaacatgtaagtattagaaaaattactaatgagatagtttccatttctttgaaggctttcaaagccttcagaattcagtgtgtgttttatacttataaaacatcttatttcaagagctaaatttttactagacatacttgagatacattagatttcataaaacttatatttataagagtagtttcacatacctaaattgtttgaaacatatttaaaagtttccgcagctcaaccatcaataaatcatttttctcttacatttgcatctactttgacaattctttatcttagcaaaagcatatcaacttgaaaactatctctgtccaagtgtatttaaatagcattttaatttaaaattattaacatcaaattcaaatttgagttgaaaagcaactccctaaatttatcaatataaagaagtgtttctttttttttttttttgagatggagtctcactctgtcacccaggctggagtgcagtggcgctatctcggctcactgcaaccgccacctcccgggttcacgctattcccccgcctcagcctcccgaatagctgggatttcaggcgcccaccaacgtggcccactactttttgtatttttagtagagacggggtttcaccgtgttagacaggatggtctcaaactcttgacctcgtgatccacccacctcagcctcccaaagtgctgggattataggcatgagccaccgcgcccggccctttttttaacttttattttaggttcaggggtacatgtgcaggtttgttatataggtatatagtgtgtcacgggggtttggtgtatagattatttcatcacccaggtaataagcatagtacctgacaggtagttttccaaccctctctctcttcccacccgccaccctcaagtagacccggcatcttctgttcccttctttgtgtccacatgtactcagtgtttagctcctacttgtgagtgagaatatgcagtgtttggttttctgttcctgtgttagtttgcttagaataatggcctccagccccatccatgttgctgcaaaggacatgatctcattctttgttacggccgtgtagtattccatggtgtatatgcacattttctttatccagtctaccattgcttggcatttaggctgattccatgtctttgctacagcagctttttaaacagataccatagtgataagtatattgcccctgaatataatgatctcttattttccctttataatttgagaagtggtctatacatttttactcttatattaaggcttcatttgtaagtaataaagcctaattttttaaaaaagaaaagaaagcatgaaaaggaatcttaagagagcagagcacattcagaaactgctaatgggccacaaaggctgtagagaaagcaagagatgaagacgggcaggtgggcaatggagatttttgtatatcgcacatcaaagtgtgactttcatcccagtagcaatgaggagccactgaaggattttaaacaagggactgacataaccagattctttatataggaagattaaatgggctgcactatgggaaagcaaattgcaaggtggcacaggagtctagtacaagacagtaaggcctgaattaaggccacagcagtggatggatttcagaggtgtttaggaggtaatggggaaagggtctggtgacagactggatttctcaggtaaagaatgagaagcagtgaaagtgactcccagatgtgacagggggtggctggtgatgctgtccacagaggcagggaatgcaggaggctcaggtgaatgggagtgtcaggaaggggtgagagacacaaggcacattcagtttttggcacttgggacatctcatggagatgatcaccagataacagaatctatgggtcaggcactctgatctaagcagtaactataatttgaatgcaaatagcaattgaagtcatgggacttcatgagatcatctaaagaaaatgaaaaaacgggtagatgcataagtgaaactatagaaaatactaataccagggatgaattaaggcgcagcatccacagagaaaaaactggagccaggcatggtgacacatgcccatggttcccgctacttgggaggctgaggcaggaggatctcttcagtccaagagctcaaggctacagtgatcacacctgtgaataaccactgcactccagcctgggcagcacagccagaccctgcttctaaaaagaaaagaaaagaggggagagagaaaagaaaagaaaaggaaggaaggaaggaaggacagaaggaaggaagaaaagaaagaaagaaagaaaaaaagaaagaaagagagagaaagagagaaagaaaggagagagagaaagagagaaaagaaaggagagagagagagaaagaaagaaaagaaagagagagaaagaaagaaaaaaaagaaaagagaaaaacagagacagagagagagaaaatgaagaaatggccagagaggcaggaagaaaaccacaggggaggtggagtggggagcagggtgggaaggccagggaagagggctataagggctgagtagtctgcagtgctcaatgctacagaactcagctcacgctgacttaagggattctcttccccaaggcacatgggctttgccccccaccgtgtgtacatgtgatcctgcttccctagccacagttaattggtcaaggggtgatcaatgacccaagtagcatcgaaaccttccctgggctgagctcttgaaaggtaaaagtgggccagacctggaatttgtggaatgtcacctgcttctgccacgtggattggaagcagacagagaaaggggaaagatgagcagggacagccaggaacaatcttggtccagggaagacaccctgtattctgataaatgactcttttatgctgcagctggttcctgttggtttttcttacttggaactataaaagtcccaaaattcatccaacaagagagacagaaatataaagagctggattacctgacagaatgaaacatgtgctgaatggggacctaagagggggctgtgggagctcaggagcaggggagagtcattccagctgggcggagggaatgcctccagaagggaggcagcacttcagctggcactttaaggatgagggggtttttaatggggaaagaaaggaaagggtggattctagccaaaggaagagcaccagcaaaggcagagatgagagtaaatggagcattagggaaatggaggcagcggctgtgcctctgacagtttcctggtctggttaactccaatatgcctttcaggaccctaggaagccttcctgccctcccacagaatctggccaccccatcacagcctctcccacactgtatcaaaatgccccgttgactggtctgcatcccacaccagacctgaggcactgcatctattgatctttgtatgtcctgtgcctgacccaaggcagggctcaatacagacttgatcatctcaaacatctccattcaaccagtgcattcagaggagggaaagccataggagactgagggtttggcatcctattctaaggaccaggagtggcaggaaggatgctattcggggttagcttgtgaagacttgcaggtatgggaacattaagacgactaacatttttttttttttttttttttgagacggagtcccgctcttcagcccaggccggattgcagtggcgcaatctcggctcactgcaagctccgcctcccaggttcacgccattctcctgcctcagcctcccgagtagctgggactacaggtgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagccgacgactaacattttttaaaaattatagtaaaatatacaccacaatttaaaccattttttaaaagggatgggtctccctatgttgccttgaactcccaggcataagcgattctcttgccctagcctccagagtagctgggactataggtgcacgccaccacatccagcttatgtgaacctttttctttttctttttctttttttttttttttgagacggagtctcactctattgcccaggctggcgtgcaacagtgcgatttcggctcactcaacctctgctgcccgggttcaagcgattctcctgccccgagtagctaggattacaggcgcctgccaccgcgcccagctcatttttgtatttttagtagagatggggtttcaccatcttagccaggctggtcttgaactcgtgacctcgtgatccacccacctcggcctctcaaagtgttgggattacaggcgtgagcctccgcgcccagcccatgtgcaccatttttaagtgtacagttcagtggtattacactgatacacagccatcatcccaaactgaaattctgtacccattaaacaacaacttgaaacaacaactctctagcccatctcctcaggccctgcaatcaccagtctactttttgtctctgtgaattttattcctctcaggtaccttatataagtgatatcacacagtatctgccctttcaaaaacaatttacatttaaatgtgttttcaactgtaaacatttaccaagtattgtcacttcctcccctgtgaggcaggcagggcagaaactattggtctgggtttggaggcccagggagctgaggttcaggaaggttcagagatctgtccaagcctgtggcacataagatacccggcctatctgacacccacacactcctcagaggctggtacagaatctgaatgaatctggataggcggagggccatgaccacaactctcagcccacaccaggtaaccttcctgtacccacaggcatggtttgaacacgtcactgcagattggcaatcagaacaggaaataatcaatgcagtagggtgaagctaaaggaaaaggattcaacctaaggacattcagccagaggccaggatgtatctatctacagttgggtgcagagatggctagaaagaagaccttagtttttaattactctttatctatggccatgactaaatgtttggctaatcagggagacgactcagggaggtcaaagtcattgccagcatgaattattaatctgcacacttgtttggagtccactggaataggcagcatagtcaagtcacagtggaaggtgctacatgattaatcttcttcctgcctgaggcccccagctcttgagtgggcattcttcatactgaacatcaggggaaagatcttgttttccacactcaggtcaaaaggtttgctcactttttttttcctgcataataatggttgatactaatgacctatttgcaaactgccaagagacagtagggtttcttcacgtttgtttgttttctggaatcagaaatggttcaaactgtgcattaccttctaaatcaatgtactgcagaaagctcttagtgaacctgaagaaaacgagtgatatgcattttgttctcatcaatacttactaaaataatttattaggtgtttaaattgttagatgagacagagttatcagactggaataaaacttagttttcctctgctatcctgcttaggagaaaagaggggctcaaatgaggattgggctagctatagaaataaagctatcctttctttgcactaagtgtaacgtgaatacattttctgccctgttacaggattaataattactgagtgcctactacatactgggtcctttcatacatatcctcatttcatcatcaaaataaccccatgtaggaaacactattattttcccatttttagattaggaaacttaggcatagacaggttaaggttgagcagcattcccaaggttccacaggtagcaagtgtctgaatccttacaggaacttacagactaaaagagcacagaacccataaaaaggagacacttacaatgcagtgtactaaatgcaaggacagaaatgagtgcacggagttggggacataaagagaggctaaatttcacctgggaaagctttctggagaagattatgtacatgacttattttttgaaaggtattattaatatacaacaaaatgcacagatgttaagtattcagtttcataagtttcaacaactgcatatgtttgtgtagccaccatcaaaaacaaggtttaaaacacttccatcacccccagaaagttccagcatatccctttcctatcaatccctcccccttctccgatttctgaattctttcattacagattagttttgtgtgttcttggacttcataaaaacagaatcttctgatgtacacttttgtcccggcttcttttgctcagttgagtcttaaacaacgaacaaccctttagctgagcaaagggccggtgtaaagcagatgcagggaggtgagaggtggcctggagccggggtattgggcgggaggtaatgggggtgggaaggaagacaaggggagggactgaggaccccgagttttaatctaagagggcttggattttattccatgggcaaaggggagctaatgaaggcttaaagcagctacagatgcaccattttgcacttataatatctcaaactcagtagtcttaggacaaggttattagtgatccccatttttttggagtcattttatttttattattattaaacaacaacattgtcatgttttcttgaatattgacaatttgaaatttaacttgttcatgaaaataaatctggaaaaacctcaaagaggctaatttccggccacaatttaaaaaaacaaacagagccccaattgaactttagctttaaattcattttaactttatccccaagactcccagttttgtcctcctagatgcaccgagactacacaacatccttcgttaatggtggaaaataaacagcttcacaggaaacaagacttcatcacacaaaaatttatagacttgttcatgatccccacttttaagtaaaatttcctagctggtaagtcaggattcaaacccagactgactccaaatatcctgctttttccacccagagaaagctttgaaaataaggagagaaaagccaacataagctatgaattgctgcctgagaaaggcaatgaggagactgcagaggatgaaaagttactcagtgcatatggcaatggagctgaacggggctgacccgcagggagggcagaaggcaggaatcctggcaaatccagggtgagcaggagccaggcagttcctggcactcctgcttctcttctttaaggcgctgctaatgactccactggacatgagcatgatggcgttggctcactcaggtggaacaaacttaaagagataacttattttcctggattctcttagcaagcaacttcaaacctgtttgtatgccgcccttatactgcattaagccaactctccactgaccaagtatactctacgaccttgcagatgtgttaaaaagaacctccaggattactaaaaactatatcaaattcatatttactaaagatttttaaaccgatttacctttttatccttcccactgcatttcttcacagcattccttctacaatgaaccaaacgaaggtaacagagtcagtttctagaaaacatcctcagaattacgccttctcttactccatactcaaaatctgctccaaaatgtgataaaaagtaatagtgaggaaaaggagggctaataatatgtttcaattaaaaacttaaacaattggatttgtctgtgtcacaggatttaatgacattctggagatgaattgaacatcatgaggcccaagagctcaagagaaaggcagtctggtaatataatatgcagaaaaaagagctgaagaaagtctgggacatgcaaaaacctgttacgctttcctaacctcatttaaccataatacctattttccaggaaaaaatattagcaccctacaccttcagatatgctttaggaaaggttgcaattgttttcttgtgcctggaaagcttccctgccttgtctttctgcactcctcttctgagttaccacctttttctttttcctatctttgcttggaatgacttctttatggagaccttcctagaaacatatccctcccaagaccccaccccaaaggccagattcataccccttctatgtacccaagcctgctgatcacagcaggaacccctctgtgttataactgcttgtttactcctcagccttctgagcctatgtgaactttttcaagtcaaggacaatgtcttgtccaccattatattcctagtaactaaaacagtgtctgacaataaatgttcaataaccaattgacaagtgactgactgattgagcagccaatgaactgtcaacctaaataacagacaaagagggagactctttcaaagaaaataatacttatttgggagttgcactgcaatgggaatgtgcatggatatattcagggaggtcaaaggaagacaagggcttttaaaggaaaaatgaagaagattccataatttttttgagacaattatctttggctacaaggatcattaacaaaggtgacatcagtccagggttagacaggggtttgctgggcagatgttctcacagaagtattttttgtatatgtcaagttgcaagggcctttgtgcaaggttgtgtttttgcagagtcttttgtgacagttctcatgcatgagaacccttcattcatggccttctctggctccatcttttagaattttgacataaatgactccattttgattctgacagctttcacagccaatataccttaaatgtcaatagtttgaatgggagaagacatttatcatctgtcagggaacgccaagcacaacacagaaggaagaggaggaagtttggacatggctggttaggaggacttaaaaggccatgctcaatttggaatgggtcccaaagtaaagaaatcgtatttgaaaaaaaaaaaaagtatagcaggaatccctttactgggaactgagacacctggggcctggccaagctctgcctctcactggatatgggacttgggacaagttccttgtcacttgattctcaattatgtgtgaaatatagaggtaagcaaaataaaaattttaaatgtctttttgtatgtcttgaggtaacatttaataaaaccatctttcattgttttttaaaataaaagtgacatgtgctcatgctatgggttgaatgtgtccctcagaagttccttttgccatttattggcaacttaatccctctgccctggtgaatggattaatggcagctctgacttcaagaatgaattaatgttgctatcgagagagtgggtttgttactgtgagtgaatgtgttatcagtgtgggctctctctggctcccttgctcttgccctctgccatgtcatgacacagcaggaaggcccttaccagatgccagtgccatgctcttggacttcccagactgcaaagcggtgagctaaatatacttcattatttctttataaattacccagtctgtggtattctgttatagcaacgagaaacaaagacagctcactctatagaattttttttaaataaaggataaataatcctataatctcactcagaatcccatcacccagagcttcagggcttttaaggtggttgatagggagttagagagtcattttaactctgcattatataaaacattgaaaatataaaacaagaaaatgaataaccaggaataaaattttggaggatttccttctagttttatttatttctttattttttttattttttttgagacggagtctcgctctgtcccccaggctgcagtgcagtggcgcgatcttggctcactgcaagctccgcctcctgggttcatgccattctcctgcctcagcctcccgagtagctgggactacaggtgcctgccaccatgccccactaattttctttgtatttttattagagacggggtttcactgtgttagccaggatggtctcagtctcctgactttgtgatctgcccgcctcagcctcccaaagtgctgggattacaggcgtgagccaccgtgcccggccatttccttctagtttttaaaaatttacgtgattacccattttactttatacacttcaatgggatcacaaactacattcttcacttaacattggagggcagaccctgtgggtcagctgacccaacgctcatttccaaccctcatctcccttgcctgcctatactctacagttgtgaaaagctatatactcactttattaacatcctttgcaaccagctgtggccaggtgacatggttttagctgataagatacgaagatgtgtcagctagggagcactcgaaacagttttgcttttctgagtaaaggtagagaagccgtagttgccaacccccactccctccctactttggcagcaaactggacgcccatagctgcagcaggcctctggtgaccaccgggtgtcaagcattagaaagttaatgggaatagcagagatgttggtgctgatgttgctgaaccaactgagccaaccccagaagctgcctacgttggtcttcctgttatgtgagaaaaataaatccctatttgtatcagcccaatggaaataatttttactagctgtagccaaatgtattcctgacataaaatgtaacgtaaacagctttccaggccattaactttacaatatcattttaaatggctacagagtactctatcaaagcgatgtaccacaattcatttaaccagttttctattgttcaacttttagatcactttccatttaactattatgtacactggtcgaagatttttgtagacaaatctttgcaattttcatgattgttttcttagaataaactcctagagatggaatttcttgatgaaggggcacgtatattttttaaggccaataccagcttgtactcttctcgttctctccctcgtacaaggaatgccattttaaaaaaattaacaatcagatgagccaaaaccaatacctcattactacataatttctaagtttccttttataactaaacatctctgatgcaacttgtgaaacatagtagaagatttggatgtgggttttaacgggctttcggctgacttcagattcatttccaaagcaaagaaagcactgcttggcagtgtgttacaactctaatttgtacaaatcttcccattattgtgagcctgctctcatttcagccgtatagggcccctcaaccaaaagtcaatatagaacatctgcgggggctgggaggggagctacaaatgactggaaaatggaacccagagagatgggagatttctgggaagaaacaaattttaaaatgaataaggagagaagggagtaaagaaaaggaagaaagccaccagaatcagggtccacacactcaactttcaggcactcgcattctggttttccgccttgccaaggttgcttcctggctctgcggttctgtttggaaagttgtccccttaggcacagcagctacgtctttctcatcctttgtgagtcaccccaaatagtgcctcttcagaggagtttcctccaatcacctgacctaaagtggctctcacgtcttccctgaccttcgtatcatcctatgtgattttcttcatagcactgaaatggtcttgctcaatgacaagcatccatgttgattgtcaagttcccccagcagaatgtaccctcaacctgagcagaaacctcactctgtatcctcagcatctagaacagtgctcggtccgtactgaatgcacagactgacaatttcctaacctctaaccagacacacactcagagatgatcatggaaagcaaaggatgaactaactgctccggggccttgggaagtctgcagctcctgaaaccacacttcagagagcagtagagagtccagtgtccctaggcagctgccacttctccttccctgactcatcaactcccactccactgaagtggagggtccaggggagggagggcccagcatctagggctggccatctccaaagggatgagaggggttactgtcacatggggctcttcacacttatttctggtattttgctcttatcagtatttcaaatattttaattttttcttatgaagattttcaaacaaacaaggtaaagggaatggtacaatgaactaatgtatccatcacccttcttatttcatctcttctcttacactgtgtatgtgtactggagcattttaaagcaaaaatcagacacattaacaaaatgtttaactgttcctgtgtgctgagactgccttcagagccctggaattgcacagtacacatgctaagagcaccaaggggtcaaggtttcttgctgatgctcaatctaatggcagcttgctgctttcttctcgttgacatgcacaaaaaggtagatttccaactaactgcttaagaaaacattcggagcaaacaaagcctttgatccctgtggaaagcttagaagatgccaggcaattctgcaaaagcactagacgctaagcagtaataaaccaggtcaaacggacatgtctgcctgacacccagttgttttggttgtctcttctccagttacttaatttccctgcttactgccttctagatcccggaaggtgccatgttcaccaactggtactgccttttccttcttctcacgtgaacaaaatgaaagtattaattagaggtgtctctgagaacaagtgagggagcaagtgtttttatgtagccatggagggatgggtcttgggagagtcagagcggctgggctctctgaaagatgacccagtcagtaatggacacgcagacacaactgatccctgctggctcaagcatggtgcctggaacagggcaagcctgaaatgaactaaggaattaatgaatcaaatgagtgaatcggaattgaagaggctgggggatcagcagaactctggatcctgatctcccaggcaacgcactgtaaacaatgagcaactaaaacaaaacttacaaaataagacattaaaatacattttaaaatctatcaccttaacagaagagttactttccttcttccgtgtaagtctctgtcatttgaggattagtttttatgcagctgcaatcttgatacacgggcagttttataaacactcttcctcacttaacacagcaaacacgacctgtgttgttagtcttcctcagaattattttaaatggctgcatgtttgcaggtgtgccaacacagcctagcttaagttacttgtctgcactattcctttcctttccttttttttttttttttttaagacagtcttgctctgtcgcccaggctggagtgcagtggtacgatcttggctcaccacaacctctacctcccaggttcaagcgattctcctgcctcagcctccctagtagctgggattacaggtacctgccaccaagcctggctaatttttgtatttttagtagagacggagtttcaccatgttgaccaggctggtctcgaactcctgacctcatgtgatccatccacctcagcctcccaaagtgctgggattacaggcatgagccaccgcacccggccttcctttcctttttctttgcacattcatctccttttttttaggggttaaaagaaactttcccctggcctcatctcccactccctcttgctgcgaggcacccgaaccatgagcgctccctccctcgaggcatcagcacatgctgttccttctacatgcaacactctctcaaagtccattcgtttgcctaacctattcctacccacatttcagggatcggattgtcaccccaggaagcctgccctgaccttcgtagatgctttaacatcctgtacttcaagggtgatggtgctcatcgtggtctgtaattgcttgtcttaggatctgtttgtcccaccagattgtgagcaggacctatttttttggagccttattagctaggtgatcatggtgagcctcagtttcctcacctgtaaaagaggatagtcatgcactctttcccacccaccaaaaaggatgctaaggagatcacaccaggcagtactgtgaagattttctgtgcagcataaagaaaatgatttcaaattctatatctgccacctaatcctaaggaacgaaaggcagtcacatcatcttaaccctttgaggctcacagtcaaatgatagctaacatttatgaatatttatggacactgtactagacagtttatatgcacttctcattttatcctcattacaaatgaatgggacagaatctagtattatcctcactttccagaggctcagaagactaaatagatttcccaagtctacactgtttcagaatatgctgctgagcacccagtgcaagcctcttcccataaaaaaaatgcccatacatacatccacacaaaatagtgcatacaatttccaagttcatgaggcccctgaagccaaacttcttttgatccctattctaggccttgcatgcagtaaagtgaattctccagagaagctcaaagatttatacaccccacagggctgggaggttatgggaataaactgtgtcagcaaaaattctggagaaaaccttgtagcctaggaatgagttgtaaatcttgaggtctcactagacacagtttccttggcaacttaagtcactgggctgactgaagactcttggcccaagtaagagccacatggcatgaatcctgtattctgataagccaggtgctgggagaagctggtagtactgccaaactacagccaccaccaccgacagccagatacttactggtataggcagttgctgaagatactcactgcttgatgtacttcatataccggagaaacaacagctaaatggaacatacgaggcctaaaggagccaacgtgggagcaggaattggaattgatcaaaccatctggcctgagactgtgctaatctcagaatggctttggatgcagtgaggcatcactgtgggtgtgaaaggtgtgtctcacactgagcagagtgagagccaacacttgggtcagagggaatggcgcaacaccaccctctgcagaggattccgtgggattgtgccatgagccaaataagcaatgaaaacgtgaaaagcaaaccggtgagccaggctgcatttttcattgtggcactgtgtgggcaaagccttggagaccacctgggaatgggataagatgagccaaaatggtttccatggcgaatgctcccaaaatcaagaaacaaaggcttggggagagtgtggtgtccagaaaagctgcctgctgagcagtgcaagctgtgacggtcctcacacggaagatgatggaagccagcaactctccagatcccttagaagaggagaaacgggatgcagctgaagagactggttggggtgagggtaagggagagcagagagaactccccacccctgagaactgtcaagcttggaactaagctaccaaggggacacacacaggaatggtgccacagcagcccctaaatgtcggggaggcaggcattttggtggaaacaaagtttattttgctttttaaacaaaagaggtgataagggtcctctctcaaacatatttttttgatggtccacaagttaaactaccgccagtgcaaaacaggagaaaattatgggtccacaatcctttatctgcaattctgaaatccaaaacgttctgaaaacagaaatttttttcctaagtgtgtgcaaatcatttggaagcaaaatctgacctgaaatgacatgaagttatcataatctttacttatccccatctaatatgaatatgtcttactgaagacacattaacatgtctcattgcaaagtgctaaccccaagtcccactggaggcgttagataaggtgtaataagcaaagaatttcctccaaaacttggggtaggcaaaattgtggacacacatctccttttctacaggtcagtaaaaacaaaagaaatgtttgaccacctggaacagaatgaatgtaataaaaaaaggaacctaccagatctctttagcctccaggtcggaggatggctttggggcaatcgatgatataggtgtcctcatggggtccatgaaccagactacccttctgtttctaattctaaattataatttacatattgtgtttagttctattagactctagctttgcacccatataaatccaaagcaactccagatttttcattcatgcagtgaaatctgggagactctctactgggatgaaaatgaaaatatttaataggtaatactgtcattggctctcctgctccccctccaggagaatatgaactggtaaacttgatctctttcatttctagagatctatgattttagagggggagaataaaacaaagttaaatgaagatgatgtgttttcttggagatctgaatagtgttttcttgatgaacaagagaaaggactccagatttcccatcaaatgatccacttttcctgttccataatagaaggcccatttggcaggttaaaggataagaaaggaagatttaaaagggagtacacaatggaatactactcagccataaaaaagaatgaattaatggcatttccagcaacctggatgggactggaaactatgattctaagtgaaataattcaggaatggaaaaccaaatattggatgttctcactcataagtgggagctaagctatgaggatgcaaaggcataataaagacaaaatggactttgtggactcaggaggaaagggtgggaagggggtgagggataaaagactacaaatggggtgcagtatatactgcttgggtgatgggtgcaccagcatctcattaatcaccactaaaaaaccacctgttccccaataacctatggaaatacaaaattttaaaaataaaataaaagggagtacagatggcttttagccaaaaagacctggattcaaagccagacactaccacttaatagctgtgtaaccttggaaagtttacttcactgtggctgaatatcatctgcaacctagagaaaaacaatattttcttcatagggtttttacgaggattaaatggcatgtaaaacatacctaatacatggtaggcactcaatatatggtagctattattatggctgttgctagattcgggagttgaacagtgcctggcttcacttcttatttcaccagattgcctggctcagcaaatgcaggggatattgacttcatgagcacagaaacagtggataataaacacacatagcaacaaatcacatcggtaaaccaatctacctcagctaataactgctttccaggctcctgcatttgctttgttagaggaactaaatagttcctaatggctatggaacgaaatcatttagaagagggtgaatttcatcagctttagagtttctgttgagggcagtgtaggagactgtgcaaagccacctctttttaaagaaagctaagcaaaaataatccataaatcatgtgagtacctattacaggtgcttatgtaacttaccatgttttctaaggagaggcttatttcccattcattgaggtgacatttactgagcatgtccaatgtaccagctaccatattaagtgctagaacacaaaaataaaaagacataggccgagcacagtggctcacacctgtaatcccactttgggaggccaaggtggaaggatggcttgcgcccaggaatttgagaccagcctgggcaacagagcaagatcccatctctacaaaaaaattatttttaatttagcttaatttttaaatgcatagtggtgcatacctgtagtcctggctgcacaggaggctgagacaggaggatcactggagccccaaagttggaggctgcagtgaaccgtgactgcaccattgcactccagcctgggttacagtgagaccctgtctcttaagaaataaaataaaaatagaaaatcaaaaagacatgagcccttctctccaggaacccaggcctgtgggcgagtatgtatgtgttttttatggtccatgctggaagtggtaatgagagaggggtgcacaggatgatacagggtgactatccaaaatagacacttccctaatgtaagatagttccacgacgctggaattatatacagtgaacacgtgttacttttaaaactaggaacaaaaaaatgtaaaaggagaaacaaagaactcaaagtccagtggtggaaacagattatataacaaatattcaaatagtgggatgagtaccaaaattcaaggacatcagagtgttttggggggagtattcttcctttagaagaaaggaagggcattccatactgcctgggggtaaagatgacaaggcaggtttccttaagaaggtgacactcaagctgagaccttgagactgaatgatttgccggtaggagtgtgtaagtacagtttctctagagggcaatccagcaatatttattagtatttaaaatgtgcatactccttgaaccagatgttcctcttctggtatttcagctgacaggaatgccagaaaacatatcaaaagatctctgtaaaaaagatgtttatcacgtcaatgtaataataaaacactggaaataacttaaatgtgcatcaataggacattgtttaaataagctatggtgtagccatatgctagaacaatagagtcatgaaaaaaataaaatttatatatagcatattaagttttaaaaggtaagttacagaataatgtatccttgtttttgtagaaataattttacatattttttacacataaaaacgtttgcatataaacagaaaaagcctgagaagataaacaacaaaccattaacacttaaggcatatcagacctggtggggtaggggtggggagaagcaatttcattttcttatttactctgtattcacattttttacaatgaggatatcttccttttatatttaaaaaataatattttttggctgggcgcggtggctcatgcctgtaatcccagcactttgggagaccgaggtgggtggatcacaaggtcaggagttcgagaccagcctggccaacatggtgaaaccccgtctctactaaaaatacaaaaaaattagccgggcgtggtggcgggcgcctgtaatcccaggtacttgggagactgaggcaggagaatcatttgaacgcaggaggcggaggttgcagtgagctgagatcacgccactgcactccagcctgggcgacagggcaagactccatctcaaataataataataataacctttttttaaaaaaaaaagtatactaattggaaagttatgggtacaaaacgactgaggttttagagaaggcatctgctcaaaacagcttagcaccgctggaatacaagagccacatgagttcaggagacaggactgaaggaagactttgaagaagaaacaaatgtggggtgtttcaactaggagagaaggtgtttcaacttgaagtgaagggagtaagagctgtggggcagtgtgagcaaacagtaaaagtacaagaactgaaggatggtgttcaaagatacgggacactgcagagaaaggggcttcaggaattctcaagggtgggaagcaggtgtctcattccacaggactcatctgaggagaagggcattcttttaaaggagagcatctgcgaaaaaccaagttttcactaaatatctgctctacatttcttagtttggccagagagaaagtcagagcaagagagaacttttttttttttcctgagcagaacaccagggaatacaatgaatattttattgaaaaataagctagattaaatcattaaagtatccatttactcagaaattgttccattacaaataccactggcacagtggaaaagggccctttctttttctttttcttttaaatttttttatttccatgggttttgggggaacaggtggtatttggttacatgagtaagttctttagtggtgatttgtgagattttggtgcacccatgatccgagcagtatacactgaacccaatttgtagtcttttatcactcacccccttcctaccctttcccctgagtccccaaagtccactgtgtcattcttatgcctctgtatcttcatagcttagtttccatttatgagtgagaacatacgctgtttggttttccattcctgagttacttcacttagaataatggtctccaatcccatccaggttgctgtgaatgccattcattcatcccttttatggctgagtagtatttcatatatatatatatgaattatatatatataaatatatatgaattatatatatatgaattatatatatacatatatatgaattatatatataaatatatatatgaattatatatataaatatatatatgaattatatatataaatatatatatgaattatatataaatatatatatgaattatatataaatatatatatgaattatatatataaatatatatatgaattatatatatataaatatatatatataatggaattcacaatggaattgcgaattgtgctgccacaaacgtgtgtgcacatatctttttcgtataatgactttggaaaaggtccctttcatccaaggcgagttttagaccaaactgtgttgtcctctacaccccagttcctcctttctgggttttctttcctcttggtggatctcacttcatcccctttctggagctcaatcctcctctcagaaagatctaatgtaaaacatgtacacttctgtgtgagtttataatcattcttccctttcttccttcctttcttttcattttttttttttttttttttttttgagacagagtcttgctctgtcgcccaggctggagtgcagtggcacgatcttggctcactgcagcctccacctcccgggttcaagcaattctcctgcctcagcctcccaagtagctgggactacaggcacgtgccgtcatgcccgactaatttttgtatttttagtagagacggggtttcaccatgttggccaggatggtcttgatctcctgacctcatgatctgcccaccttggcctcccaaagtggtgggattacaggcatgagccaccgcacccagctccttccctttcaatgtattttaattctaggccctatctctaaataaaaaaatccttcatttagagagcccatctttttaaaaggagttttgagcatcaggtgacaggtggaaaaagaaggagagagaagattcttggaggccacgcagcagaaggtcacctacatttggaagctggtcctcttttcacatgactaaaccagcagtcctcaacctttttggcaccagggacatagatgaggggaggggaatggtttcaggatgaaattgttctctatcattattagatatcatatcattattagattattaggcattaattagattctcataaggagtgtgtagcccagatccctcacatgcacagttcacaatagggtcctcgcttctatgagattccaatgccactgctgatgtgacaggaggcacaactcaggcggtaacacttgctcgcccaccgttcacctcctgctgtgtggcctggttcctaacaggccacagatcggtaccggttcatagcgtgggggttggagacccctggcctaaacaatgtaggaaagcccctctcagaactatcttgacccaggatccataggatgaattctaaaatgtggaaggagtgggaggaggagaaaatattattctcttgtaccacttccttaaaacacatgagcaaatgaactgaaaacatggcaattttctcattaatcgattctcgacaagaaactagataattctgctgaaaaaaatatccctctggtggttaaattatctcttcggctgtctacatccaccaaattaactcaagaactgtaacctctatttcatattgtgttgtgttaatattactgtggcaggtttgaatgcagaggacctgagcacctcaccattcatcccttctgaaaggagggtctaaaaccaatgcccttctggtcactgaggcgggagaccagaaatggcacagttcaaacactgccccactttaagctgcagcttcagttaggaaatgttatgatttcaactgctttaagttgactttacatttcccaatctaaaaataaataattttaaggcacttggcaatggatcgagagatgtatagaaggttaattttcctacactacaaatatttgaaataacaatacaaagataaatagactgcaaactttttttaaagtctaacctcacttgtgagagtaacatgagttatcgttttttttacctatcaaatgggcaaaaaagtttgaaattctttccagtgtgggagagtatctaagaaagcagatgctggtaggagtatagattgcaacattctttcaaagtaatttgaaatcttatttaaaacatttgtctaacatgcagaccctatgattcagcaattctgcttctaggaatgcgtcctaataaacatggacacaaagaaatatgtacaagacaatctttctagtgatgcctataataataaaagctactaaaaccacaaatgtccattcataatgagctgtgagtaaattatgttataaaatggaatagtatgcagtcattaaaactgataacacagttattttgatttagaaatatatttatgttattaaagaaaaaggtaggttatgaaactatatattatatagcatgtgatgtcacttttgttaatacatacacaatgaccataaattaaaatgtgttaagcaatttatacacacctacacacacatataaatcgaaaaagtgtctctaattctctttaaaatactccagcacaaacagtatggtatataggtgtatgagtcttaatttatactctaggggcagttgcttagcatttgaaagactttaacaaaaaattggtatttccaaaaaaattggctattataaggcttcggctgcctttatctttaataaacatcagacggtttgttaataagcatagtggatattagaaattattttggatgaaaataggtgttcaaaatacagttatgcactgcttaactacgtttcagtcaatggactgtgtagaaacaatggtggctccttaagattataatggagctgacaaattcccatcctcctctagtgactcacagccgtcataatgctgcagcgtaatacattactcatgtgtttgtggtgttgctggtggaaaccaacctactactcttccatttgtgtaaagtgtagcacatacagctatgtacagtacataatacctgataataaaacaactatgttaccagtgtatgtatttactatgctatactttttattgttattttagagtgtactccttctacttatgaaaaaaagaggttaactgtaaaacagcttcaggcaggtccttcaggagatattccagaagaaggcattgttatcataggaaatgacagcttcaaatgtgttattgcccctgaagacctcccagtgggacaagacgtggaggtggaagacagtgaaactgatgatcctgaccccgtgtaggccaaggctaatgtgtgtgttcgtgtcttagtttataacaaaaaattgaaacagtaaaaatataaataatagaaaaaagcttacagaataaggatataaagaaactattttttgtatagctatccaatatatttgtgtcctaagtgttattatgaacgtgtcaaaagtttcttaaaatttatttttaaagttacagtaagttaaggtttattattaaagaaaaaattttaaatgaatatagtgtagtcttagtatacagcgtttaaagtttacacttgtgtgagtggtcacattcacttaccactcactgattcacccagggcaacttccagtcctataaactcccttcatggtaaatgccctatacaggtgtgccatttttaatcttttataacccactgtgtttttactgtaccttttctgtttagatatgtgtaaatacacaaataccaccatgttacaactgcctattcagtatggtaacactttgtattggtttttagcctaggagcaacaggctacagcatatagtgtaggtgtgtagtaggctatgccatctaggtttgtataagtacactatgatgtttacacaatgacaaaattgactaacgatacatttctcagaccatatccctgttgttaagcaatgcacgacagtgcagtaagggctcacttcatgtcatcaacaggaaactgcaactttcagtgaaacaacatatagtgaaactgattttgccacaggctaattgagatcaacaagagctaagttcttatggcatatttctgatcacaaaaaaaatcacaaaacttctaaataaaaaccaaaacatttataatattaaacactgaaatacatgtgagctatacatacatttaagtaaggttaataaacacaaggaagataattatttgcccagttattcctgtttcagggtcaagggtagctggagcctgtcccggcagctgaggctgcaacattgggacccatcctggacaggatacatcccctagcagggtgcactcagacccacacccccaccacacacacccctgccacacacacacacacacacacgctctctctctctcactcaggctgggaccacatgccagttaaccaaacatgtacatctctgcgatgtaggaggaaattgggagacctggagaaaacccatgcagatgtgggaggatgtgcaaactccacacagacaggggccccagccaggaacagactttctcatcaaggtgatcatgaaatgacaccgattgaaatgacatcatttgaggacttgctgtatatggatcagctggaaatgctgtacaggccactccgccttcttatgaccagggtgtgagaattcagcaacgccagcagcctccatccctccagtcttacgttatggaggattctgtggcctgcgtgactctaagtaaagttagctcaatgctatggctacaacactgctgctgcacaggccacaggagagcctttcatgcaaggtgtttgtctaagcggctgaaagctgggagcttgggcctctccagcgcagtttacagcacaggctgtgtgcctgcttggtcatgcatgtttgtccccgtagcaggattggtttgagaactgctcttgctttctcctttcacccttacagaggttgtggagtagagatctgtcatcactggaggctcctggtatcaaccatacataacctattagctgtgaaccactaaactggcttaggtcagtttaccacaaaggctgtgtatgcctgaacttcagcagtgattatctacagatggtgggattatacaattccaacccccaccccccaactccctttgtgcttatctgttttctaattcttcctataatatgtatgtatttgtacaaggtgggtgggtcacttgaggtcaggagttcaaaaccagtctggccaacatggtggaaccctgtatctactaaaaatacaaaaaaaattagcggggtgtggtggcaggtccctgtaatcccagctacttgggagcctaaggcaggagaatctcttgaacccgggaggtggaggttgcagtgagatgagatcccaccactgtacaccagcctgggcaacagagcaagactctgttgagagagagagagacagagagagagagagagagagagagacggagagagagagagagagagagagagagagagagagagagagagaggtattatttaaataataaataaataacaagagacttaagtaaactgcacagacagcactgtcaccacctactggcaaaaacagagaaagaccattgtaggtgaacgctgactgcttaacagcagagaaggcggcttgcagttagacttttcagtttccagttgtttttaacttcgaagtataacatctggattttagggaggggagaagatcactcctcttgaagcatgttaccttgaaagagttctgattttcaaaagcaaaatatagttctgctgaccatggtttaagtctgagagaaaatcatagtccctgctatgtatcagttagatacagtaagtatctaactatgatgccaccgcaggcagcagcttcaaatgagaagccaaaggctgatcatgggttataacaagtataagtcattttaaaggtctcgttctttggatgcttctaattaggcagttgccaaaactgatgcaatcagtaaggccataatctctctggtcttatgatttctgctaaatttctaatggggacctaagagtccaaccgcagtttgggttctataagcaaagcaaactcggcacagacacaaacagcgagaaaggcagcagttacgacaatgttgcaacaggctaacttctttccaggctgatgcctggggcacaggagcctccctgtgtccagcagcacttgaagtgtggatccctccacagatgacctgcctgtctctcctctgccaacccctgttctcctccttgcccaacctctgacaccacctatctcagaaaatggggaggctgctgccccccaaatgctcatcctgccatctaggagccactgccctcagacccctcccatccctattctgtctccaatggaagaaactactacagaaacaccctccccctagtaccctctactcccccaaccatctcgttctcctatgacatcccttatacagtgctcaccatatctagaaattattttcacaatctttttttttataaatatgatacttgcaatccctatttgaaataaagggaaaacaacacacaaatgctttttactttagggtagtatgcatgacacatctgcatttgcactggggaccaacacacacacacacacacacacacacacacacacacgcacacacacaagagtgggaccaactgctctcatattattcacacaggaggcaaacaagattttactggcaacttttttttttttttttccagacggagtctcattctattgccaggctggagtgcagtggcacaatcttggctcactgcaatctccgcctcccaggttcaagagattctcgtgcctcaacctcccaagtagctgggattacaggcacacatcaccatgcctggctaatttttgtatttttagtagagacggggtttcaccatgttggccaggctgctcttgaactcccgacctccagtgatccacccacctcaacctcccaaagtgctgggcttacaggcatgagccaccatgcccagccagatttgggggcaatttttaaaaatcatcatctatttggggaaaagatactttaatctcaaaaaagaacatgctatcagaatgacaatgaaccaacttagctttgggagaaactcacttcattgcatttactttgtcatggtcctgcactagtttggggatggactcaggagtgcatcttggactctagtgaccttctaggtagttccaaaacttcaaacacttcaaaaaccaaaatttcagtaattcaagaaccactaatatatcataactgtactactatttccttaatatttctcttaaatatactcacatttttacttatatagttttgttttaaaaggagactttgtgtcacttccataaaagaaaaatcaatatcatgtgtcacaaataaaaggtaacctatgaataatgcaatagaaacaaaacatgttattgaagtccagttagacagtgttgctggctgaggcctgatctcactgtgtagaccagggaggctggcaagtggtcagcagtgattaaagaccatcatcaaaccatgcttttctctttaataacatcagagggattgaaagtaaattgaaaataaaagtactttcactcaaggtgatacaatattatccagtgctagactcaggtcacatctaaagtcatctccagtggttcatatcccactcttagagtaacaagaatcatgatactttggtgcatgaatattgctaattcatccagccatttgacacatttattgagcatctactacactccgagcactgtacacaacagaagaaggaatgaataaaacaggcatggtatttcttgcaaaccttccagtggtgaaacatacattaaacaaatggttacacaaattatatttgtgtatatttgtgttgttttacatacatgtaagcatactgtgtgcatatatctgatatacatattatatatatgtgtgtgtctatatgcatcaatttggtaagtggttttgtttgttttgagatggaatcttgctctgttgcccaggctggagtgcagtgacacaatcttggctcactgcaacctccgcttcccaggtccaagtgattctcctgcctcagcctcctgagtagctggtactatggttgtgtgccaccacgcccagctaattctttgtatttctagtagagatggggtttcaccatgttggccaggctggtctcgaacacctgacctcaagcaatctgcctgcatcagcctcccaaaatgctgggattataggtgtgagccaccatgcccagcccaatttggtaagtgttgtaaaggaaaaatacgagacgttatggcatggtttcacagtaagaccgtctttaggtaaggggccagtaaagacatatagataggaggatgtaacaattaaactgaagcctaaaggtaaacaaactttagcatgttgaaagggtgggtaacctccacacagaggtaatgatgtagaaaaggtttggttcctttggggaactggaagaaagatatgtgctgagagggcagcaagcaagaggagggtggaatcagtgggcagggggtgggacaggggtggcgggggggaagcagtctcctaacctttgcctaaagggaccagaaactttctagttctctgtggaaagatcttccatctttgtatatcaccctataaatgtttcctaaagaaaaatctgtctgttgttttcacacactaataaatcagttcaacacttttgcatcatgtgcagaggaagtttaattcctcctccatgtgacagcctccaagtatctggagatggccaagtgttattccagaactttcccttccaggatgaacaccgtcaaagttcccatgctccctgttgtctgtgtccctcttaaaaggaagggtggctgggagcagtggctcccacctgtaatcctagcactttgggaggccgaggcgggtggatcacctgaggtcaggagttcatgactagtctggccaacatggtgaaaccccatctctactaaaaatataaaattagctgggcgtggtggtgggcacctataatcccagccacttgggaggctggggcaggagaattgcttgaacccgggagagaggttgcagccagctgagattgtgctattgcactccagcccgggcaacaagagcgaaactcctctcaaacaaacaaacaaaaacaaaaaaaagaggaaggcagattttccaatgtccatttgtgttatgggacttgaatttccttctctgcatattctttgtttctaactgcctttctggaaaacacccaataagttatggtcaggcctgaattccttgagaactaggaaattctcaaatgcatgccatcaaaaatatttatttcttctttcatgtctctttcctgcaccttggaaggcaaattccattcgtagaggggagggagggggcgctaaggaactttttcaaataatggaatgatggcgaacattcatctatgctaaactcaaagacatgcccaaagtttgtgatagaaaatttaaatacaatatttactatttgaactgatgttccatttgtgggtacaggaatgctacattcagggaaggtgagaataatgcaaaatccccactcttgactgctgtggctacagacccagattcccctgaagtgagggcagggtactggggtggtgctgtgtaagcagggcactctgccaggctcggatcacacatctcctctttgaaactggtgtggaaaaagacacatgagagcttcatgaataatacagcagccctgacacgctgaatgcacatttcagccaaatatatgcacatttcaaccaaataagttggtctctccacatccccaccctttcctctctcctccctcccttcagtgctctttcaccactttcgccagatttctaggttttcttgctgcctcctgttgcaaagtgaattgtcccagggaaggagggctagcttccggattccccccgttgcacctaaagccttctcctcctctgccggccttccagctccctgactgcagcattgcccattaggcttcatcagaggaggctgtgtgtggcccaagggcagcaggtgaaattcaaagcagacaagttgcttctccgcatcagtgctgatatgttagaggcaggcagccaaagaaaatgaatataataaagaaagtctggtttaagagcatctgttgcttttcttggaaaattctaccctttacgcattagcctgcccataagagctctacctctgcacataatcggaagaaataatattcaaaaaaagttttcaaatacgggtgtaataacaatgcaaacagcattaaaactcagcagagtgtagtgccggacgcaaggttctctctcatggggagtgccccttatgtaaagcagcaggaaactgtgctggccataaaattaccaactcctgagggaagagaccacatctgcttatctttacgttccttcaatggttgatgcaacgtaccgattagttgttcaacaaaatatgttgcatgaatttgattcttaagaagaataacatatacaggcactgaaaatagttatcttctgggtggtagagcgaaggtgatttttatttctgtctttgccttttccacatgttcctgattttctccagtgaacatgaatatatttagtgagaaagttatcagtaagaaggagatttttagaattggaagggaccagagaaattagtccaattctcttattccttacatgtggaaactgaagctcagagaagctaaatgacatgtccaaagccatgtagcttgttaaggagaaggctgaaagaaaactgaggccattcatgtttctcggcctactgcctttcttcccctatacatatcctttgcctttcctgaaagacagtttaggtgagactctaatctaatgttttgaaaaggcttggacccaatttaaaagcaaactgtgctatccagtgagcttattccccacagaagacactatcttagaaaatgcaaagcataatttaaaagtcattaagtaaaacatcctctgctgctgtgacagcaaaacgttcggccactccttcatgacagatggccccatgcattgacacacacctcaaaatagcctctgcaaggaagcttaacatccgagaaaggcggaatagtgaatgtcacagaaaagggagagtttgcttgtgggtttgcatctccagaagtaagaagacttaagagatatttactgtgggctcatcttccaccaaacttttattgatgtgtgaacttgaaacttcttatcataaaaatttctaacatacaaaagagagaatgttaaaatggattccatgtaaccagagtacagctttattaatcattaacttagggtcatccccccagccactgcctccctccccatgggtaattttgaagtcaatcctgaacattataacattttattcatgagtagtttaacatgtacctctaaaagataaggacctttgtttaacataaacattcaaatgtcataatgcctaaaaaattgataataaatccttgatacagccaaataacccgtttgtgctccacttttcctgattacctcacaaaaatgtttaaggctggtttaatttgtcaggcactgtgtattatctcagttaatcctgacaataacactatatgggggctgtaggtagcctgggggagcaagacacatgatcaggttagagatgtaggtgggagcctcactcccccaggctctagacacacttgacttattttctttctccttcaaaagccaagcaggtgcctacttcagggcattttcatgtttatttttcttcctggtctttccatagctgtgaactcctcagagatcacccctgactgcccagtcactctctattaaaataccctggctatgttcctcaaaacatttggtactatctacaattctcttgtttgtttatctgcttgtgtttctttccaacagaagagacgctccatgacaatcggctcctcatctgtggagctgaggcttctgtacctacagccctcagcacagcctctggcaatggtaagtgctccatggttgtgtgatgcgtggattaacatatgcctgcaaacacaacaggtatttgttgaatgaaataatgcacacacgcacacatgagaaaaagaacagccttgtttctgctgagctccactcttgggctctcaggcacttggccgaggcctttagccaaactgcacttttattactttctattgtcaacggctttttataactacaaaggcagtatgtgttcactgtagaaaatttgggaatccacaacaaacacaaatttgaagattcaaagagcctagaaatagccactgttgacattgtttttatgcacatattatgcaaaattggagtcatgggattcttattgatttgtgatctactcttttcatttaacaatgtggcattaatatttcataggtcacttaactctcttctaaaatgcgttgtttcaaggctgcattgcattccattgtacggccagacaaggttgtcaataacaccacattacgggacatttcacttgtttccttttcttcttggctaccataaaaaataacaataaacattcttgcgtgcttatgcacatttccattattagtttctccagatagattcccataagtggacttgcttgacaaattgaaatacaaattagagcatttgtaagtattgctaaattgatctctagaacaactgcatcaattaatactcccagcatcagtgtttaaagatgttcatctccttttccctttaccaacaatggatgctaatattttttaaaaatctataacactataatctatctttttaattagatcacagatttcttgcgagccctttcttttacttctgtattactcccgatatatagcaggcactccttgtgtatggatagatgaactgcatgaattttgtcaaggattaccaggaaaaacattgagcaacatgaacaagttgtctttttcctgtttcaagagctctcctgcccagtttacatgcgcacctgagcacagtccttcttccctgctaaaccttgctgaacgtccttttgcctttggtttgggaatgttgggcgcacatcccaccagatccagctctccctcccatttagcttcagcagaagaggtggcagaattactaattttagctgacatgatgtttactgctgcaagtatcactaattaatgatgtaaccgcagaataacaagtcccagatttcccttagcaaagcaaaactgagagtaaaccccacactggaccactccacagcatccgagcctaccaactggaaagagacaatcaccaggggctcaatctgacccagaatttgtgctaggagaaatttaaccccataatgccatgttaaagagctgcctgctacccactcaccccatgtgcagatcccagcttgtcagccctcagggagccctcagggaataggaccaggtcttgtttgttggtacagccctgtgcccagcattgcttgacatatggtaaatacctattaaacatctggtgaatacacagacaccaaagagagggaacagacgatgaaaagattcatggaagcctgggcagggagagggcagggtgaggagtattctctgatgttcttcattgtcatccacatggagtagagcaaatggacactcagggaagaaacagctggggccacagctgggcagctatatagcttgtaaattctgggatctggatttggtcttaagtcagaaacaacttcattccctttgcctgttctatgctgccttccaactctagagaaaaatgtctaataccctccatctgagaatttgtgttcaataaatgtttattacaattttaaaattaaaatgtcttgaataatcaacttatattccagctattgtgaagacgttctcacagcaacattttccctgaaatggcccttatatgctaaagtgggccctatatggtaaaaaaaaaatatatatatatggaagtgagaactattgtctgcctacacaaattgacagtaaaatcatagattttctgggctggaaagacagagaacaaaatgaacaatagactctccaatgcatttttgttttttaatgcacatcttctttggctggagataagagttaaccattttagtaacactgaatgccaataacagcttatgtgcaaatacagcagaaggagctatataattcatttattcatttatttggtgttagacactacggaaacaaaaacagtatgttcctccccattctcatgaagcttactgtcaaccagggagatccacaagcactctatcacaacagctaacagaggcctgtgcccactgggttacagaagtgctttaccaggcttctcaaggaggtgagaaaagaaggaattcagaaaaactgagatgaaacaagacttatgctaattgaaaatatattaataatactaacagttatccatttattgagtggcctactatgaacgcagtactaataacaattcattgattacagcattttgggaggtcaaggcaggcagatcacctgaggtcaggagtttgagaccagcctggccaacatggggaaaccatatctctactaaaaacacaaaaattagacaggcacggtggtacgcgccagtagtcccagctactcaggaggctgaggcgggaggatcacttgaacccgggaggcagagcgtgcagtgagctgagattccgtcactgcactccagcctgggtgacagagcaagaccctgtctcaaaaacaacaacaacaacaactacaaaaaaaaaaaaaaaaaaaactcattgagggggaatctattatctccattttacagaggaagaaactgaggctttgagagtttagtttacccagctcataaggtcctaaacaagagaagaacaatctggattagagttaaaaactagcatataacagtcattgtcccaaatgtcacttgaaaaataggtgcacatcttctattgagtatctattgctacataacaaattatcccaaaaacttagtagtctaaaacaacaaatatcctttatctcaaagtttctgtgggtcaagaattcagagacagcttaggtgggttgttctggttcaggatcactcagatttgcagttcagatgccaatcagggctgtgttcatctgaaggcttgactggggctgcacaatctacttccaagataccccactcacatagctgttggcagaaagcctcagtttccttgccatgtgggcctctccatagggttgagtgtgaagccgtatggcaggtggcttccccaagagctagtaatctaagagagggcaaaatagaagccacaatgccttttacaatctagtctccaaagtctagcaatatcactcctttaactttctattaattagaaatgagtcttcaagtacagcccatgttaaggggaagagaattaggctccatctttcaaatggtggagaatttgtggtcatgtgctaaaaccatcactctagctcagactggaaactagaattgagtagggggatcctatctggagaaaaaggtttgtgtttcaaaaagtagtgggtagtaaataaactagctcttgagtgttgaaaaaataagatggtatccacaaaccaggcaaaggaggttgctcatctaccaagtgcataagtggaatttttttttttttttttagacagggtctcactctgttacccaggctggagtgcagtggtacgttcccagctcactgtggcttcgggctcctgagctccagtgatcttcctgcctcagccttctaagtagctaggactacaagtgtgtgccaccacaccagctaagttttttttttttataagatggggtctcactatgttgccctggctgttgtcaaacttctggcctcaagtgctcctcctgcctcagcctcccaaagttcaaagttctgcattacaggtgtgagctaccacacctagccatggtgtaatacttttaggaaaagaggttggcggcttggtaaaattcatagttttaggaagagaaacatgaagtttaaaaatactttttggttattaactctttttattgttttccctgcctttgagcaaaaattcctttgaaaatgtcaatttacttattagatatgccttaagaaaggggtttgggctacaaagacaggtgggaattagaatctctggtggaccagaggaagtggggatggttgcagggatcaaagggagggagcacagaggggagaaaaggaagagcagggtctcctaggtaagctgtttccaccagaaattctccttcagggctctccttggcatgtcccagacttctgaacattctgtgctctgttcaaaaaaggaaggctcttccttttcagagcctagataaattagataaaatgaacttcctagcatagaaagctgaatgtcaaaaaaatcaattcacatgaccttaccaatgcaaaatacaaaccatgaaatggtcttaacatatcgaaggcagcatttgcactgtggagaaaaagatagacagcaaagcccagagccagcccagcatcgccactgaacggaaagcgctgcggtggggcctgggctgaaacccaagcgccatctataaccagctgcgacaccttgggaaaattcatctttctcaggtgtggtttcctttttgtaaagataggggtactagtaatttcttacaaggttgtgagggtttaatgagaaacgtaagagctcaacgaatgtcaactatcattaatgcatgatagggactaagacatgaagttagccattaggagtaaaattaaagaacatgtgttcattttctgcatctcaatgtatggttttatcttgaacactgttcagaaagcaaatggtaaatcactgcaccttctctccctccttcaacttccctaacttcccatcccttcgctctccagggaaaggggagggacctcatcactcagatcagacatggagaaacacagagagctgctgtttcccgaatcccagcagcatttcagaggcggtaagtcccgggaaggagccatggcagcggcttcccatggctcctgaattccgtctttctgaaaccacgtgtgtgtgtgtgtgtgtgtgtgtgtgtgtgcatagcaatagccctattcaacagcagcttttccaaatcccagaaattaggcacaggggagccactgggggactccttggaattctagggaaagggaccccaggagaggtgtaaaggttggtaaggaccctctctggagcaaagggtgggaaaatcatccccacatggcttttatctcctaatcaagcctcacgtctcaaaccacagagcaacacaagctcatgaccagcaaggctgaggttgtttccagcagcacagttcttgggcctttaagaacaggaaaaccaatatgcattagaaggtacataagaaggtacctgaaacacactgatgaaagaataattgtcaattcccatattacatggccaaatgccagtagattagatgactgctgtggtccctcatacccattttccagcagggagctattgcccaagcttggtcagaaccctgcagtcagaaacaggttaaaattccctttccagatctggtcctgtagcatcccatcagggaaatactccctgatgctcctgaataccttgccagccaaacaggtacctttaggcccacacagccttacccatttaataactgaagcacttttctaaaagctgccaagcccagttttattaagggtccaaatataaaaccttcatcaactattcatgcctctcaggggcttaactgggacctttcagagaacagtgtgagagactcggtacttagtcacaaaccctgcctaggaaatcaatttattctggattcttggaggaagaatagagcatgttgctatttacttttaataacaaaaccccttggcgtctcaagcccatctcttagtcaaagagaattgttattcatcattacagggtaaggtctgaccttaaaagcctgcctccactggacacattcctagatatatacatgtcggggaacctcagatggaccctccgtggagtcaggagagacaccatcacgcacccatcaggcttctgtcactgattcaaggccatcaacttctggcccttgtcaagcagctggaattgtttttaagttctcgctgtgcaatactttcctcagcctcaataaccaacgccaccactcagtgagccttattctatgccaggcactgctctaagtccttttgggtatcatcgcttttgtttttcaccactaccctgaggggcaggttctataacacccccatgttttacaaatgcagaaactgagatacagggggatggataaggaagctgcccaaggtcccacagctaattaagtaggagagctgggatccaaacccacagtctggccccagaggctgtatacttgctgctgtgttattcaaacctgtttgctgtatgggtttcagggttttttcgtgccatttaaggatgaagcccctctctcctttggcatcttagcaaaacactggtttggcattagatggtagccatctaatacttgctcagtggccatgccttagctgtttctacactgtaaagaactgccacttcatgattcttttttttttttacttaatgttgactctttcagctttcttaccctaaatggtattctagtgatgatcaaagcttcatttcccttaagaagcagaataaaatagtagaacatggattttgaagacaaagagaagcccttctactacttcaagatgagttaccttgggcaagagaattaacatctctgagccttagcctccttgctcatgatatgcaggtggccatatttaccttttaatattattatgagaaagaaaagatataaagtatataaatgacctgttacatgcaataaagagtaactccctgaggttctttcctgttctaaaagtctgtaactacctttactgcttgggtgattacatatccccaaggaagaaaagatttgggtttactggcttgtttccatcaaaagcatgtctctcgggtgtagaaaatcaacagttactgacatctaccagttctgtagtctcatgctaaattcaggggacatacattccagggagcaatcagatgcacatgcggggggaagctaacaaataattccacaagcaaatgaccaagcaggaaaccagcactgagcaggaaactaacagaaggagaagatccttccgccggcccctgtgtgaggtcagataagagaaattttcaggaaagagcagattggggcaggcagagaagatgaggggggaaaaatccaggaatggcagagtagaaaggagggaagaaggaagagagagagaggatagaaaggaagagagcgaaagaaagagagagagcagcacacgcaagcactaagatctggaatgtaaagatggaagatcacaagatgtacccagtcaacagtaagacagctagctgggcaggaagtcaggattaaataatcaattgatggtgtacatattgttgcattttgctttaccacttaccaagtgctctacatgtgtaatcctacttaatccttacaaaggccacgctaagcctatactatccctatttttcagttgaggaaacactcagagagactcagattcacgatttccacaaccgattctcaaaataattctgagatgagtaggcaagcattatttccatttcaaaaaaaaggtcaattaaggctcagagaacccaatgatccatctcagtgcttctcaatgctaaaggtgcagcatccttttttttttttttttttttttgagatactgtcttgctgtgtcgcccaggctggagtgcaggggcatgatctcagctcactgcaaactccacctcctgggcaagcaattctcctgtctcagcctcctgagtagctgggattacaggcacccaccaccacacccagctaatttttgtatttttagtagagacagggtttcaccgtgttggccaggctagtcttaaactcctaacttcaagtgatccacactgggattataggcgtcagtcgccacgcccacccagcaccctcgttttataattaatatttataatgccatcattattatcttcaaataaaacaaaactcaaaaataatataataaccataattgtgacaaccaaaattgtcccccacaaatatccaagcacccaccaggggataagacgcttcaggctaaaaactattcaaagacaaaggtaggaccagtcctcaaccttaggtctcctttcaaagaagggctcttgaaaaggtggggtgtggccacagggtggaggacacagaccagcagagccatgacagagaaggctggacatcagcaaggtcaggccttcagcctctttccctctaacgctggccaccagtattgagaaaatgatggcatttacatcacaaccactcaccacctcagctctttaatctctgaaactcatcttgccgaaatggaaattaagcactgtcttctaaaccctttcacggtacatattccatatgccagttctgatgcaaaaaacacagggacttgagaagaatcacttacgctcttcacagctaactcaaattaactcatagtacaaaacaaaacatccggaaacaagacttttgttttaaaagtctgtgcaaggccttggattcgatttatcttcctcttggtctaaccacttgacaggactgatggctttgatcaacctgccaagaaaaaccaaaaagacatccagagctcacattccaggggcgcctgtgggagattcagggctgacaaattgtatgcacagattctcaggaagaaaagccaaacatcttcattcttgaggtttaatttatgtgatttaatgccatgttagcacgcttgtaaacctatgtcatgatcaatcaagcaggaggcaagacgtccttctctcagttggctgtgccacattgttttagcagacattagataataaaacaaagctactggctgggtgcggtggctcacgcctgtaatcctgtcactttgggaggccgaggctggtggatcgtgaggtcaggagttcgagaccagcctgaccaacatggtgaaaccctgtctctactaaaaatacaaaaattagctgggcatggtagcacacgcctgtaatcccagctactcaggaggctgaggcaggagaatcacttcaacctgggaggcagaggttgtggtgagccaagatcacaccactgcactcaagcctgagtgacacagcaagactccatctcaaagaaaaaaaaaaaaaactgccatgaagaaactgctggctcacatcctaaagttccacctaagtggaattatacattcaatgaatgactacaaagcacctacatagcgccaggcgctacgagaagtttaacgacgtccctggtcctccctcccaggaccccacaacctggtgaagaaaatgtgccaggtacgcaggcacaaggccctgagtgagcggcccaaaaggcagtgaaagcaaaaagtcaaaaataaatccaatcagcctgggcacagtggctcacgcctgtaatcccagcattttgggaagctgagacaggcaggtcacttgcagtcaggagttcgagaccagcctggccaacatggtgaaaccctgtctctattaaaaaatatatatatacgaaaattcaccgggcacagtggtgggtgcctgtaatcccagctacttggaagggtgaagcaggagaatctcttgaatctgggagatggaggttgcagtgagccgagattacaccactgcactccagcctgggcgacagggtgagactccatctcaaaaatatatatattttttaaaaatccaattaatgtttggctatgtggtaaccaaagccaggaatagggggcatacataaaatccacagaaaccacagatttaaattaatttaaggtaaacccttttcagaatattaacaggtagatctctctcaattagcctttaaccacaccttccaacaagactaagattgacttactaggcagaaggaaagggactgttggtttatccaaggtcagctgagcagcagagaccaaacaccaactgaggaagaagagccatgtgcaaaaaggagataactttagatggaaattctagacatacagtgacatggaagcatattaccttgcctacaaagcaaaagagagaaagattcctatgccaagggaaagacagacccaaaatagctttaaggtttgttaaagtcctctgatgcagagttcaattgcactaattctgtcctcatttttgaaagaagacatgccacatttttaggaaatgaataaatattgccaaaatttattttatttcttataaacttgggaaacgtttttccctaagttttttccctgtatttgcaatgacaaactccctaatttcttctccaaaaagactatggcatcctatttcatggagggtaaaaaaggctattttgatgatatgacatccacaaggtgagcaggtggaatgtgcaataatgccgctaaagtttttcctttttaaacagatttattaagatgtaattcacataccatcaagggcatccatttaagtatacaattcaatggtttatatacatttagtatattgcaaccattactataattttggaacattttcatcatcctctaacaaaactttatatttattagcagtcactcccattttctcctaccacctgtccccttctcctaccctaaggaaatactaatctactttctgtctttatagatttgcctctgctcaacattttatataaacagaaccatacaatatgtggtcctttgtgactggcttcttccacttagcatgtttttgagggtcatccatgttatagaacataccagcacttcattctatttgttgctgaataatatttcattatagggatataccatattttgcttaaccatttatcagctgaaaaaaattgggattgtttccactgttttggctaatatgaatagtgttgctataaagatttgtatacaagttttgtgtcgatatgttttcatttgttttgagtataatatgcccaggagtggaactgctgagtcatacagtaaatttatgtttagttgattttttttagagacaggatcttgctatgttgcccaggctggcattgaactcctgggctcaagagttcctcccgtctcagcttccaagtagctgggatgacaggtgcacaccacagtgtccagctatgtttagcattttgaggaagtgttaaactgttttccaaagtggctgcacgattttaccttcccactaacagtgtatgagggtttcaatttctccacatcctcaccaacacttgttattgtccatttttttattacagccatcctcatgggtatcaagtggtatcctggtgtcattttgatttgaatgtccataaggactaatgaatgacattgagcatcttttcatgagcttaccagcctttgtatatcttctttggagaaatgtctattcagatcctttgcccatttttaaattgagctgtctttattgttgaattgtaagagctctttatatattctagatacaagtcacttatcagatatatgatttgcaaatatttcctcccaatgtatgagttgtcttttcactttcttgatgatgtcttctgaaacacaagttttttattttgaaaatgtgaaaggttttgaaagtacttagtacatatcttacaggggaggtgaaattaagataggggcatatttgtacacccatgttcatagcagcattattcacaattgccaaaagaggaagcaacccaagtgttcatcaacagatgaatggatgaacaaatgtgatacgtatatataatagaatattattcagccttaaaaaaggagattctgacacatcctacaatgtggatgaaccttgaggacactatgctaagtgaaataagccaatgacaaaaagacaaatatcatacaattccacttatatgagatccctagggtagtcaaattcatatagacagaaagtagaatgatggttgtacaaaaattagaaggggtaaatggaaagttattgtttaatgggtacagactttctgtttgggaagaaaaaagagatgaaaagatgaaaggagattgacagcagtgatggttgcacaacgtgattgtaataaatgccactgaactgtacactggaacagttaaaataataagtaataaacagatgaggggccgggcgcggtggctcatgcctgtaatcccagcgctttgggaggctgaggcaggaggattacctaaggttaggggttcaagaccagcctggccaacatggtgaaaccccatctctactaaaaacacaaaaaattagccggctgtggtggcaggtgcctgtaatcccagttacttaggaggctaagacaggagaattgcttgaacccaagaggtggagggtgcagtgagccgagattgtgccactgcactccagcctgggtgacagagcaagactccatctcaaaaaaaaagtaaataaataaaaataaacagatgagggcagtagctagttcccagtcctcgggttttagcttatcatttgctcttccctgctaacttctatgccaataagtaaaataagccaaaagcacaaaaagtaaacggttcaactaatccaaaaacaagcagcatacaaagttcaatgaaacagcaaaatgtgaaaataaattccttctgctgactcccatatttgtagaaggtccatactatgtgaagaacaatgctgaaggtggagattcagaaacgcttgagataaggactctgtgccctaaaggaattttcagaccaggaatatattttcagtcccgtgaatggcactcagcctaattcgacctgcatgctttttgaatgggaatcttgtaaagactggattgaagaacactgcaatcagagttagactacatctagggaagctcttgtttcttcttcttccctcctctgacatagcagtatatctttcaactctatgaaaatttaaagctcttactcatctgttaaatataaaaggaggatgattatgcaatttggaatccagatagtcatttttctgaatgagttcatgcatatgcttatttacaactatttcattttttcctgaatgcacgtaaaagatcactgcagcttaacagtatgcaaatctattcctactgtgaaatcataacagcagcaccagcctgctgagaactaagaggaaatgccacatatgaccaaagactaaattacctaccaaatcaagcctttgaaaagcacagacacatttactatggaacaagaatatgcaacaataagaaaaagttctagcagagggattagttagaataatacatgccgaaaagtgctttaagaagcagaaacatcttttggacagacagaagttcattcaataacttaaacaatatttattaagcacctattatatgccaggtaccatgctaggatctaggaggttaaaaataaaaaagaagacttagtccttcccaaccctctcccagaacctcagtgtctaccatggggaaaaataagcaacaaattcaataagatgtgataaatgctgtgatagataatgtacaagatgctatgaaagcaatagcattataggatagcatggagggatcaaggaaagtttgctgaaggagaggagacctagggtgtgtggaagtagatgggcgggccaggcacagtgactcacacctataatcacagcactttgggaggccgagatgagagaagcacttgaggccaggagttcaagaccagcctgagcaacatagcgagatttcatctccaccaaaaaataataaaatcagtggggtgtggtgacacttgcctgtactcctagctacttggggcggtgaggcaggagtatcgtctgtgcccaggagttcgaggttacagtgtgctatgactgaaccactgcactccagcctggactacagggcaagaccttatctctaaaaaagtaaaatgaaataaaaaataaagtagctgggcaaaaaaggtagagagggtcagtgttctgtggagaaagactagtatatgcaagaagatggctcccctacaaaagtaagactttgggttccggagtcaggaagatccaggatagagtcccactctaccacgtgttaagtaaccttcacaagctaatttttttccagctcaatgttctaatctgtaaaatggagatggcaattttacctcctcattgtggattaaatgaaataaatacataagtagagttccatacacacagcaattatcatgaagataatattttttaaaatagggggagtatagcaagaaaataattgagagagttacaaaaagaattgcatttgatccttgcattttcctttgactttggtctcaagtttcagcctaaccgtgaaatattcatgtccaataaatgataatgtcttaaccacttcaactgttgatatagtctcttttatatgagcacatgtatatcagttaggattagattcagttgagtaacacagactcaaactaatgatttaaacaaaataaaaatgcatttttcttatatgtgaaagtccagaggtaggcagcacagtgacaggtatgcaagctctggtccctgaaatcttcacagaaccaaaagccttccagctcaccattccaacatctttagagtttggcccttcttgtcatgatccaatatggtggctatagctctagtcatcacaaccatgttccaggcagcagggtggaagaaggtataaataagagagggcaaaaggcacacaccacttttttaaaacaggattccaaaagctaccaaacaattcttctacttgtaatagtagaatgtattctattggccagaactagtcacctggcctcctctggttgcaaaggaagctgggaaatatagtcctttttttcaaagtgtatgattttctaagcacatgtggaaccatcacataactaaaataatgaacatatccatcacctccaaaagaggaaatataatctttattctgaatggccatgtgcccaactaaaacttgtgagttctaagaaaaagagaatagatgttgggataagagtcactgtcacaacaattgatgtgctagaaactcaaagtacagaaagtagggttttttgttttgttttgttttgagacggagtctcactctgttgcccaggctggaatgcagtggcgtcatctcggctcactgcaagatccgcctcccgggttcacaccattctcctgcctcagcctcctgagtagctgggactacaggcgcccgccaccacgcccggctaagtttttgtatttttagtagagatggggtttcaccatgttagacaggatggtcccaatctcctgacctcatgatccgcccgcctcggcctcccaaagtgctgggattacaggcgtgagccaccgtgcccggcccagaaagcaggtatttttaaaggaaggcattactaagtgcccactatgagaaatctgaagagctctagatacaaagattgacacgaatatcaggaaacctggtacacagaggtgagccacaaaggagataaaaagagctgttgataaaatgcatgaaggtaacaaagaaggggctataggaagaggatgtgaaagaaagttaattgctgcttttagaaagtaatacagtgaccaagtaggcacattctttgattccacaaacccaattcttgcattttcttcaacaggaaaacaaacttatgcacaaatatgtttgctgatgaccattcaatgagaagagaaaataaatatttaactggacaacaggatagacttactatacaaaacactgtagtatattatacagtcattaaaaatgaaaaccatgtacaagcaaaaactttgccctatggagtgaacagaaagtttttactgattattattagatatacattaaatgtatacaaatgaggacatgaagttaagtcatacgcactcatcagacctcaatgcacacatcactctctcagagcaaccttctaaggccttggaatagctcaggtgttgtaagtgctgatagcaccgttacctttcttggggccacgcaagaccgtgtgtaactgcagtttttatctgaacttctccctttggactttaagctcctcgagggcggggacctgcaatgggcacctgtgtttttttccctgaccagcatcctcctttttcagtaacataaccttgataccttggctccaatgatggaccataccccaagcctgaccaatcagcccattccatgctctggttgctccatgccacaagcctcctgagtgctaggtccttgttcatctttgtctttccagggcctagcacagaacaagttttacataaatgtctgatgtccatgaatagatgaatcgatggatgctcttctaccaacccaggtacggaacagaatttgactaaatagatgtgtgggttgatgcttttaaggaaaaatgtagtgtttaatggaaaaatgtattcaaaagcaacaatttattttgctcaagggtcatttagacccgggctccagacctagccccactctttgctagattgtgcctctgcgtaagtcacacaagttctctaggcctgtttattcattggcaatgaaaattacaatatctaccttacatgactgtgtgcaggttacctacacatggaaacaaatgtggtatgtacatacagtggaagggtttagcatagaacctaatacatgacacctgctcaatgtcagtggtgctgttattattatacctgggaatagctacaggcaaatatagagagacagtgggtggggatcttctctttgacatttgtgtgtttagtattccccttgaccaaatgaagttatatttaacttctcctttctcactttccttggaaatttcactgggctgtggctctctgtgtcttagaggacaattatttatcttccaaagtgatgcctggcttattttatttacctgtggtagattggacaatttaggatccatctagtgaccacccccggtccccgcaacaatcactactcaggaagcttgtcaccggtagggcggtgaccacactagggcggctgactatgctaggacagtgcagaggagggatttattttttccttttgcagatagatggatagcaattccaaagccaggctggttaccagaaaaaccaagggagcttaaagccaaaacaacaaataaaaaccacatccctgggcctcaccacctgagaatctaatccagtcagtgtaggatggggcttagtggtctgtatttttaaaaagctccctgggtgattctaaagctcccccaggcttgggtactagagaaataaaatcagttttttcccaatgtatgggttaatatatggtcactcccagaccaagcatagagctttcactttttaacactgacctgctacataggggctccaatcctcagcccagtgcaaaactagatgagctttatatgacgtcacaaggattttttaaaaatataaataattctctcttctgttgtcttggagaatatttattcaatcaatagatagcacaacgttagttaaaatgacatatcatgtatgactttaaccagaactataattggctacaaagctgactgttttgcatttacctgctttcccttctctgtatcacctgatgcaccagtaagcagtgcagagatgatgaagcaaaggagtaactttaacaggtaaagaaacaacaagggaaagaagtaagcaaactgaatgatcaaaattgaatcaccagctccagaataacaaagacttaaaactgcaatctttcagaaaagctttgtctcttttgagaaattggcatgctctctcttttccaaaagtatgagttatgtaccttatcatgttttcctttttgccacagctaccaggaagttccaggtaaaatcagtcaaaagctctaatttaacactcttggatagtagtttggcattttcttcttttccatggtccttttctctccttttttttttttttttttttttttttttgagaaggagtctcactctgttgcccaggctggagtgcagtggcatgatgtcagctcgctgcaacctctgtctcccaggttcaagcaattctcctgcctcagcctgagtagctgggattagaggcatgagccaccataacagctaatttttgtatttttagtagagatggggtttcaccatgttggccaggttgttctccaactcctgacctcaagtgattcacccacctcagcctcccaaagtgctgagattacaggtatgagccactgcatctggccctgattttcaatttctaggtccactttattaatattattattcattggttgagaagtcactccaaatttgttttaggaaggagcaggctaagtcaaatcaaccaactccctggaagcttttttatattccatcaacatagcataccgcctagctcctcccaagcaagctcatcagaactatctactgcttaaagctcttaggacatgtacttttttcctaggtttaatttggtattcaaaggccacagcaaaaattatattcattacagaacagacactgcttggtggccatgccagctgacacaacaccaccatctcctctggcagacattttaccttaaagcacaaacactgtgtttcatcctgatatagggcctgtggctagaaagtgattgttatcattttctattcatgtgttctcaacagaaaaaaaaaaggacattcccttataattctctatcacagacaacttcaaaccatcttatgtccctttaaatcactgaactagctgctttcataaagactattgattttcatcctgcataaattattttacaagatagataacaaagggaaaagtaccaggagattcaataattctctctggttttatttaagggaagatatattctcttccctctacaaaaacacattgcttttcctgtcctccccgtgcctttcatgctgtgaaaatcagataagatacaaacattccaaaccctgcaaaacactagatggttctcatgaaaaccaattattattttaacgcatagggaggatttctgacacatcttttggtggcacattcatttattaatttctttcagtaaatatttatcaagcacctactatgtgccaggaactatgcaaggcatagaccctgcccgcccctttcctatacaatgtcattttggggagcacaaagggttttgttcatagctgctttcctgctagcatgctgcagtatggctgtgccagttcctcaattgtttaaatattcttgtacctcaagtcccctcagcatcccctaccgactgatctcttttccagcatgccagaccttctgcttggatttatgtctgatccagctgggaccccagggcatgctccagcactgtggccttcagcccttccacgggatagtgctgctgggtaccagctgataggtatctttaacagatcctcctcatttcaggactggcctatggacctaacactgcactcccattcacctacctcgcccatttcctcccatgttctcacaccaactcctcccctggcctagacacaacaagctctgcaggagaccaaagactttctctctttatgtctcaagaggatcagggtctccgtttctccattttactatcattgaacaagaccagttggagcttttgccttcctcccacccaaggtgatgttcacagtgtccactttgtcagcggtagcaagcaagtgaagggtgtctttcctcttactattttggcaaatgtagaatcatcacagggactctgtttaaaacgaaaatgtgcaatgaagaaaaagcaactgtgggtgactaggcaatccacaccagggtttgaaaatgatttaaaccagtaactagaactttgcatgggcagaattccaaacaggagaactgcagggcgagagtgacaggtgccaaatctgagcaatagttcctgcaatgattatgcaaagcactggccattcatgctttgatggtaatgcactcatttctccaacttccagcacactaaatgcaagtgtggcttaatgacggcaactggattgaaaggtaattgggagctgaaaatagagactttgcctcattatcataattctctaccagaaatgtttgttatgtcaaaaagcacttttccctgggcaccagtttaaaggaatatccattaaagattttaagggtgtaagcattaacagtgtttttaagccatgaatgctaagcttatacaaaatagatatgagggaccttggataactgaatgtatttcaggcaaataagatgtgagagcagtaagttcaagccatgagtctattctgctcacctgacttccctctaatattttttccactcccctcatttcctttccatctccaatgccccttccctatctcaggtacccccaccataccttgtataacctcttgtaagaggcaagttgtgttgaagaagagaaagaaacaaaagccttcaacatttcttctcttctgccacttccgcacctctgaccagcccatggtgataccttggggatgacagtgatgatggtggtaatcatgacagcaactactataacgaatctactttgttccagacatgttaaaaatatactcccttgttgaacaatgagaacacatggacacagggagggaaacatcacacactggggcatgtcagggagtcagggacaagggaagggagagcattaggacaaatacctaatatatgcaaggcttaaaacctagatgacgggttgataggtgcagcaaaccaccatggcacatgtatacctatgtaacaaacctgcacattctgcacaagtattctggaacttaaagtaaaatttaaaaaaataaatgttatatatatgtatatatatacatgtgtatatatctcattgcatatatatacatgtgtacacacatatacacatgtacacacatatacatatgtacatgtgtatatatacatacgtacatgtgtatatacacatatgtacgtgtgtatatgtacacatgtacgcgtgtatatatacatatgtacgcgtgtatatatacatatgtacgcgtgtatatatacatacgtacacatgtatatacacatacgtacacatgtatatacacatatgtacgcgtgtacacacacatatgtacacatgtgtgtgcacgtgtgtacgtaaacgtgtgtacgtacacatgtgtgtatatatacacacacacattctcccttattttcacaagaagtcaataaggaataaatacttttaaaaccatttttgttgttgttgtaaataacataaaatatggctaacagcagcttccataaataggggtccatttccttgcataacaagaaatctgaatgtagacagtaccaggggtgctttggggagactcaatgatggtaggacacaaggttggcacctctgtgattctcttagtcttccccctcatagtcatgaaatggctgcagcagtaccaagcatcgcatcttagcacggctgcgtgcaaagcagagtgcaggaagcagcacaggcagaggttctcctcctctacttccctcggatgtaggaaacaaattttctcccagaagccccccaccgccaccaatttccccttacatctcttgaaccagaagacactcacctgtctgcccctagaaccaggggcaaggcccacctttcccgagtttgggtgacctctgcctggttttgctaacaaggaaagaaagagtcatggctttgtggcaaatgacagctgccgcagtagtattctctgtaatctacagtgaggtgacgcaacaagccaaagctttattccactgaggggcctccctgcctgctgcagccctcggctgagatccagttccctccatctagaaggcttcctcctttttttttttttgttagtgcttattttttcttaagctaaccatactaagtctgtcgcctgaactgaagaagtattcaaatttcacccaggaccgttcagttctgccccctcccactcatttataagaactaagtccaaatcagtcaggtcaagagcaccccgaggtgcagacagaaacattttgtgcagaaaacagccgttccctaaccaacttgcaacagggctggaaactgctctcaccagggtcaccaggggagctgccatcctgttaaccgagctccaggaactcactggcaactgagacatggggcaggtagagcctgacaaaaatgtcatcctcaaaaacaggaaggggcgaaacccttttgtagaactctgaaaatgtcaagcgcctgcttgcacctccgtcagggttagattgaatttcacatttcactgcggtagggccctggaggcactgcggcagcgggagcaggcggtgaaggttggaatcccaaggctgacactgccggtgtggaattcctattccctctgtgcttcatcatccttcactgtaaaacagacataacaatggaatctatctcaccgcatatcttttgagaattaaaagacataatatatgttaagggattagaaaaatctttgctcaatgaacatcagtgtgttagcaatactggtagcaacaataccagcaatagaaacaaaaccaaatggtctccctgtaatggccaggatttattttaatgacttaaaggtactagcaaatcagtctcactgtcacctcagtccagagcttgaaagtctagctaccttctccctaaactcactcaacaatgagcaatcaccccaaaacaacaaacaagcataaaaagtagaacatctgataccatgcagtatcttgttttagtttcattttattcttggtatatcttgtgtgaaatattccaagaaatcaagagaatgtacataacgtgtatccacattttaaataaaataacaaaatacctatgtacccatcccacagtttaagaaatagaatgatgacgctgtgcatccttccatgattccaggcgccccaaccttaatatgcaggtaaccaacaatctgaatcttcaattaatcattccttttcttttcttcttttttttttttttttgagtcagggtctggctctaccgcacaggctagagtgcagtggcaccatctcagctcactgcaacctccgcctcctgggttcaagcgattctcccgccccagcccaccaagtagctgggactacaggcatgcgccaccacacctggctaattttggtattttttatagagacagggtttcaccatgttgcctaggctggtctcgacctcaagtgatccacccacctcggcctctcaaagtgctaggattataggtatgagccactgtgcccggcctcctttgcttttctttatactctcctcgtcacatatatatgtatccctaagcaataaaccatctaattttgctatattaaattttatgtccataaaaatatagagcaggtattcttctgtaacttgctttttcattcagcatttgtttagttttatccatgtttacacacataattatacttcattcattttcattgttatgtaatagtattcgatttaggaatataccactatttatttacccattctcccattaatggatatttgccttgtttctagtctaagacttctcacccgaggatgggcttacacagatcctatttagggtaaccatataacttactgtcctaattgagacacttgtgggaaggaaagagaatgctgttaataatgacacaaggacaacaggcataaacaactacactgtatggtcaccttgtacacactgaacatgtctcagggcttcttaattactcccctaaagtgcggactgagacatttaagcccaactcttcataactgatggtgaattcacatcttaaatgctgctagcttctccattcagatgagaaccctgaaggaaagcccaaacaattaattactccttctatcccaggaagaaaaaaacaaattctttaagacataagacggaaaaaatgcatgacttccctgcctcagccatctctgactttcacagttgatcatcactgtgtgaagaaaattctagctccaatgataactgcagcaaagagaaagtgtaaaaggcctcaaaatctgagtccttctcctgagttaagacggggctaaaggcctcgcacccactgcctcctttcatctttaccacaaccctgtgtggcaggtgtgggaaatgaagctcagagctgcagcaatgtgttccaggtcacagtgcacataagtgacagagcctcagtcactttgtctaagtagggagccgtatactttgtgatgcaaaggagtaaaagggggtgatttaacaagtgccaggaaaacagttgtaaactagtcttccccaggcacacccggacatgggacaccctagttctaactttaccatatgcacttattttccaagagcagatataaatgatttgggggactgatgagatgtgggacccaaatctctagtgttgacactcgtcttgtgtggcgatacactgtcctcgcagaggtcacagggtgtgcaaagtccctcccctcttcctcctcagcagacttgcaatgcctggtgacttcccagtggcatccttccatccaccacagcaggctggagaggatcatgactcgcttccctgaaattcacaattaaactggagaggcactcttcctcccaaagcagctcctgctggtggctgccagcagcagtgttatgtcgctctcactggagcaatcttctttcacgaggctgcgcacacattctccaacgtgggggatttgtaaccctgtccttcagcagggcccctgaaatccccagcctcgcacctttctgcatgtgtgtgtggcctctcacacacacacaaacacacacaatagttttttaaaagaaatatttcagccagccacagtggctcatgtttgtaattccagcactttaggaggccaaaggagaaggactgcttgagcccaggaatttgagaccagcctgggcaacatagtgagaccctgcctttacaaaaaaaaatgtttgttttttttttaattagccaggcatgatggcatgcgcctgtaatcccagctacttgggggcctgaggtgggaggaaaagaaatatttcagatatggaaaaatagagaattatataacagcatcccctgggcctgagcacatacatatcttttgctatacaaaaatgttctggccaggtgcggtagctcacacctataatcccagcactttgggagactgaggtgggaggatcacttcaacccaggaggttgagactgcagtgagctgtgattgtgccactacgctccaacctgggtgacagagtaagacctagtctcaaaaaaaaagaaagaaagaaagaaaaaaagttctgttcccaaccacaacattcacagtggccccaaaggagaaacaacacaaatgtccatcaacaaacagcaaaatggtacattgtggtacaatcacacacataaagtatcatacaataggaatgctgtccagtaagaaaaatccacaaattgctgctacacacaataaggtaatctcacagtcaatatattaagggcaagaagcaaaaacaacaaagaatatgtgcgctataatttcatatatataagtttcaaaaacaggcaaaaatgacctataatgctagaaatgaagactattacttttgtgattgaggtaaaggatattgattaggagaagcctagagagtttgcttctaggatgttgataatattccaatttttaatctggatgttaggtacagaggtggcagctgtggtaattcctcaagtaatatgcttaaagatgtggacacctttctgtatgtatgttacacttaaagaaaaaaggtttaatttaaaataaatccagaatgaaagcctcttttagtcaactattatgttatttatacccaaataattatcttcactatcaagccatctgtgtgacctttggaaaatcacttaatgatctgtgtctatttcttttttggcgggggatggagtctccatctgtcacccaggctgaagtgccgtggcatgatctcagctcactgcaacctccgcctcctgggttcaagtgattctcttgcctcagcctcccaagtagctgggattacaggcacatgccaccacgctcggctaatttttgtatttttagtagagacgaggtttcgccatgttggccccaggctggtctcaaactcctgaattccagcaatccacccacatcggcctcccaaagtgttgggattacaggcgtgagccaccgcgcctggccttttctttatctgtaatggcgtatgatgtatagtggtgatgtgagaagtacttgatataaatatgaaacatgcttagcaagcacttggcacacaattaagcacccaaaaatgttagccatttgaattagtggtattctatccacacctcccctccttgtatttgggacttatctccacttatatccttctggactgggcaaaggcatattgaaacgaacaggtttgcctatgtgtgttttggggtaggaagtggaatgggtaaatcccttctggaagacaatctggccatatataccaagagcccagaaaatgtttgtacccagtaattccatttaggaatctaccctaaggagataagacaagtaaaagagatttatgtgctgcaatgctgttacttatgttatttatgtaccattgcatgttatttataaaagtgaaaaactagaaacatttattatatcaggaaatagtcaataaaataatggtgatgagcacttttaatgacatgaaaagttgaatatgaaagagatctaactataccaatttttaaaataataaatacatataaagaagattagaggaaactaaaccaaaatttcagctaattatctctgggtggtaggattataggaatttaagttttcttccttatactcttctgtatttttcaatattcttctctgagtatatattacccttaataatgacagatataaatgttaaagaatttctatcctcttcccctaaggcctttgtctctgtggtcaaggtgacagctggctgcaatccatcacatttaggaaggatgctatacaatgaaatgtgtctgaaggaaagtgactgacaggttggcaaagtgcttcaaagataaaccccatgaggaatggctgaaggaacagggatgtgtactttgaggaagacttgttaacaggacagctgtcttggaacacctgtcatgtggaagagggattacacttgctctaccagcctccagatgtcggaaccctgacaataaatcaaagttacaaggagaaaacaaggggagggtgaagagtatagctcaagaagcatccaagctgcatgatcacaatataaactccaggtttccttcctgtccaatagtaagcagctcccctggaggtgtccagtgaattttctcgttagcatttgggcaaccacatggctccatcctgaggctgtgctctaccagcctcccagatcacagccttctctgtggacaaacccatgagttaggatctctgtattcataagcaaacaccagcctggggatatgcaggttaatccctaacccttgtccttcagcaagctcttcaaaatttacataaattggtctacttttctccattttttccacttgaccatcttagtctaagtcgtaatcacctctcttccctgtacaactacaatgtcttcctaattggtttctctcttctattcttgctacctccactcccaatctattcactacctagaagctaaagtaatagttttcctagggtaaagaaaaaaatcattgacagactataagactcaaagtggagactacatctccagccttcactggatgccacaccccttgcttggtgtactccggtgaaggtccccaccttttagggcccacattcatgctcaacctttccacctcaggacacttgcacatgctgaaacactctccatcaccttcagaaccccaaacctcagatgtcattccctagttttaatcctataatgggatcccaaattgggaaggagactttgtgtggcttatcagactttgtgtgacctagccacagccgaccagtctgcacctactatctctagtctcttaactaggctcagtatgaatgagcctcagcctcactgaggaatgagggagatgttggtgcatttgaggaactcagaggcatgtaccaacatccccctcattcctcaatctttaggcatcctgcttcctacgcctggaaaaatcttgtggctaattcttgatcaccttcagggctcagcatgaaatgtcacttcctcaggaggtcttaccttacctccagatactgggtgggtgtctctggtgtgtgcttacagcaactctaattattccatcagagcatttttttttttttactattcaactgtaactgtatttcctgctatttggtaaactatatgaaggcaggaatcacatctatattgctcagaactgttgagcaaatgactttattctttaaatatgactttccccccatgaatgagcatattaaagtcaaaaagaacccaggaaaaccatagatctcaacaggaagcattccaataagtggtatttcttcctggaataatgaagcaaatctagacttccgactcaatttcccatgtcctaagggaaggttcatgtgttgtcatttttattttcactagctggcatagtaattattctttaccagcattcgaatgcccgggggcaatcttcagtaggcacacaaaaggatcgataagtactaaagagactaaaaagataaataatattgaattcataaaatggcaggataaaagaaaagtaaattaggaaaacactggaggatataagactaataagcaaaaaataaatcacccacagtctgcttcccccaaaagcataagcagctgttgttaatttgataaaactgcttcatgtgaaagaccttcagaatcctaaaaccagagccctggtctggaccttggtgtggattcagggtagaaatacaacaaacagaagccaggagacagtgccctgtgtccccttccctgctctaccttttgtcagctgggagactttggacaagttacaagtcttctctgaatttcagtttctttacctaagaaggctacataaattcatgtggtagaaaactgctagttctctacgcattctcattcccttctcctttctcggtaacggaacccgatttttagctgggcacactaatgtcccattaaaacataacatttctcagccaacctctacaactaggaagccaatgagatgtaagtagacctgttgggtgggtctactggaaagttctgaaagaagagactggccattcatcttcccacttcctggcacagaaatgtgactgatggctgagacctttcaaactgtaaaaacaagagcagcaccagaaaggccaagaagaagaaagctggaagaaactgggacccaaatgacctaatgaaaataccacaacacattctggactatctacttctaaattcctttatgttagagagaaatacactgctcatctagtttcatactggatggcttcgtagaaagatttccctttatatttggccccagttggcctatttgggtacattggtcctgcctctctcctcgggagcaagacgttccattctgtcctccttagcgtgccagccccatggatatttagaaacactgggaagtggtctgagaaaacctgagtttccatgggatctcgggcaagtcgcttaagtgctctaagccttgttgttcatccataaaatgaaggttacttcctttatttccccagaaatattgtttagaggaaagagcataggtttctgagttacatatgaattcaaattacttaatggctatatgatcttaagcaagctacttaacctttctgaatttcagttttctcatctttaaaatatcttacttcacagattattatctaaggattggatgagatatcaaacacgaaacacttagcctaaagacttttatttgcaagcccaataccttaccataaaatagtagttactgtcatctgttttcattttgcagtgttgtatgtaatggtaacaacagctaacaatcactgagcactcatcgtgtgtcaggcactgttcaagcactttccatgtattaagtcatttagttctcacaacaatgaggtaagtactcttattatccccattctatagatgaggaaacagagacgcaatatgttaactgccttgccaagtcacacagctaaagagggaagccagacagtctgaccccagagcccctgctcctatatttccagcgtacaccatattgcttgctgtctgggggtagtgtcatgtctccccaaacaacatgctagcgtcctcagggcagaatctgcatcatatatgcctcggtgtcctccctggtggctaacagggaatcttacccaccacaggcctccaagcaccagagagaactgaatggcaggtaagtaataactgagccacttcctaaaatacctgtatcacagatgaccttgaagaagaccatttgtccaatgaaccaaggtatgcctgaagtgaaacacagagaatccctttcacagggggtggaatatccctccacccgaagtgcacctcttgggtcctcagaatcagattccctaaaggcttaaaggactctgggaacaattctggccaatgttttacatgcttccagagtctgaactgagtttaaggcctctgtcattcattcaaattaaaaatgcctgccagacagaatgaaatgtgtcagagtttgccggcctatagagagtcaccatttcctcctaggtgctgacggacaacagctttcgaaaatagatctatttatgttgtcatgatcaagaacactgattgagtatgtcactatgcaaactgagtgtgtcactatgctcgggatgcagctgataggacacaaacctcattagcacagacttcattaatttggaatatgtgatcattcttagtaatgaattttattttttgttatccataaagaaaacaatatgcaaaataaatgaagaaacaagaccaattcatctcttctaccaatattcattgtaaatctagcaccagggtggtagtcatagatgttattttgtgtaattctcattaaaagagaaccctttagtgcagaaggtaatgtacccattttaaaacaagttagaagtctggaaaattaaattacggtacatccatacaatgaaatgctatgcaactataataaaaccaatggagtacatcagctggtgctaacatattaacaagaacaaatgctgaatgaaaaaaagcaagaggtggaaccctctttaaagtatctcatttgtattaaaaaacaatgagaatagattataatgatgtatacatacataaatggatatacagtgaaattctcaggaagggcagtcaagaaaaatggatggtctaggatggaaaagaaactcatttttcactgtacttgtgtaacatggagttctttaccattttcatgttactgtttatattaaacctaacaaaaagaggttagcattaattattatttattggcccatgcctagtgcaatgtctggcatataactggaattccagtgttaattgcatgaatgtaaagaaatgataccactaattaccatctaagcacatttatcttttctattcatacatcaggtcccaccctaacattaaatgcaaaaactctctggagtaaattcaagttcctgtatgtgcttaaagaaatacacttgcaacaattttgaaagatactctgtaattcatccttcccctttatgttccccactctctcctttctcaagctctgctctccacacaggcgaacacacacacacgcacacaggcatgcagagtcaggtaaacagttcactgacccaaaaaaaaggactggaattcagaaatgttttaccgctattgctagaggtttggtatgatcaataatttttttaaccacatgctgatttgagaaagtctataaccacacactaccacttcactggcactaccaattaattttccaagtatattttgaaaagagttggtgcagattcattggaaacaatctgcattattcctaatagtaaccacaaacatgttctaaatagtcagagcaacccttaagcatcttggaggtctatgaacacttacctgccagatatcaaattcgcaggtatacctgacacgtgcagctgctccctcccgctgctatctccctacgcgagtgacagcaagccagggaattggaaactgacagttttgttttctcagtgctgacaaaggggaacaaatttcatattttccctgagtgtgcagtgtgttgttttaaattttgtcagagtttttcccctagtagcagcaaccaggagaaaaagaaaaagacatctggtaacttctttagagtatgtcttaacagatctgttggtgtgactccactcatctgtttcataaataaaacgcaggcaatgccatcaattaaaaatctttctaaagacggttttaacaagagcaatatcctggaaactacggtcccaatatcctaataatcacaagagccaccatatatggaacacgcttgtgtactggcactgtggggagcactttataagcaagcggcagcttaattctcacaattctattgggtgccatcattatccccattttgcagatgaagaaactgaggctcattgagatgaattggccagcacaaagtcatacagctagtgagtgaaagcgctgggattcaaaccaggttttgaagaactccaagcattctggagctctgtgttccatctatgttcaatgagtttatctgacaaaaaaaaaacagtaagaattagaggaacaaggaaggagccattctctctctgctccagaattgatagtctatgactttcggcacacaggccagctgtggcagacaaaacagtaagtctggcatcaggaatcccagaattgccgtcctgactctaccatgaacaaacctgcttgtctcacttaacaagcaagccttgttctccacagctccgagatgaggcagctggattacaatctccctcagcttaaaaactgcatctacaaagccaggcacagtggctcatgcctatactcccagcactttgggaggccgagaagagtggatcatttgaggtcaggagttcaagaccagcctggccagcatggtgaaaccacatctctactaaaaatataaaaattagccagacgtggtggtgtgtgcctgtaatcccagctatttgggaggctgaggcaggagaatcacttgaatccgggaggcagaggttgcagtgagctgagatcgtcccattgcgctccagcctgggcgacagggtggaactccatcttaaaaaaaaaaaaaaaaaaaaaaaaaaggtcaggcgccatggctcatgcctgtaatcccagcactctgggaggccgaggtgggtagatcacaaagtcaggagattgagaccaccatggctaacacggtgaaacctggtctctactaaaaaaatacaaaaaactagccgggtgtggtggcaggcgcctgtagtcccagctactcaggaggctgaggcaggagaatggcgtgaacccgggaggcggagcttgcagtgagctgagatcacgacactgcactccagcctgggcgacagagcaagactccatctcaaaacaaaacaaaacaaaaaacaaaaaaaacccgcatctacaaggataggtgtatagaaacattttgctgggatagtaaagcaggacaaaatggaatataagccacatggtgtacaattgagcatataatgtccactttgcagagaaaaaccctgacagatggcattaatcagcagtcagcttccaatgaaattgcaccaatgacctccagtgcccactgctaaatccagtggtcaatttgtggtcatctcaatgggctgatcaacagaaatccacagaattaacattctctcctcttgaaatctctctaattgacttccaagacactaatctctactatattttcctcttccttcctggatgcgccttccaagtctccttcgcaactttgtcctcatcttcccaactcttggagtgctccagaattgagtcccagtcttccttgtctacagtaactctcttggtgctctcatccaatttcacagatttaaatgcaatccacacactgatggctcccaaatgtgtaatctctaccccagaaccagacttttacatccagttaccaacttaacacctctgctcagatggctaatgggcatatcatgcccccaaatgagctcctgtatctccccaactccaccctcagagtcgtttcaataaacgggccctcagcccttcacggtgctctttgcagtcccagcttgtctgcagccaccccagccagctccagcttatgcacttactattcccatgacttggtgacttcaccaggtatccatgaggctccctctctcacctttctctggtaattattcaaacatcaccttttcagtgaggcctttccctgatcattccattttaaattgtaacccatccctcaaagcaccttctttcccttccccttgctttatttttctccataaaaatttcatcgcctgatatattttatattagattcatgtacttctttattgtctataatccccaactagaatgcacgctctaggaagaggaaagagtttgtctgtcttgttcactgatacatctctaacacttagaacaatgcctggaacatagcaggaattctttggggggaaatgatgtaatctacaagcatccatgcatagcctgagtacaccagagcatgcacagtagccatttctctctgaataggaaaatgatgaaatatctgtctcagacactagtttcttttcctcttgtctaaaaactgaggtcatttttggatgtaagaagtatatattgtagtgccccatttagaaatcacagcccccaaagaactaagataaaatataataatatcataaaaataactttaaaaaataaattagaatcagtgtgttgttttcatgtgtacattaatttttaacatatataatatatgatatgtagagaaagagacataaatattttttccataaaattggggaactagccatgccaggatttctgtggtaatcttgaaactgtctttatgtatcaacagccaataatgttatttgtttatctatagctagttgtgtgtctcatttttctttttctttttttttcatatttgaaatcttgtatttcacctaccactaccctgtaatggcaaaggatggtcactgagttagtgggtcaaagctcagacattagcatcaaagagactgggcctaattcacagatcccatctatgagaactctgaaaacattcttgacccctgatttcctcacagattcaccatccagcaacatttctgtgaggatcagtgagataatccgcataaaacccttagcacagtgcttggcacacagaaagtattcagtatacattaactattattaatcttcagaccttatctgacatctttggctctcaaaattcaaaggtcttattgatctcaaatgcaactcctgccagctgcaattaaatacagtcatgtgttgcttaacagtggggcttaatggcagggctacatgccgagaaatttgtcattaggtgatttcatcaccgtgtgaacattctaaagtgtacttacacaaacctagatggtatagcctactacatacctaggctacatggtatagcctattgctcctaggctacaaacctggacagcatgtttctgttctgaacgctgtagccagctgtaacacaacggtaagtacgtgtgcatcgaaacatgtctaaacatagaaaaggtaatgtattgccctgcaacattacgatggctatgatgtcagtaggcgataggaattttcagttccattatcttatgggatgaccatccattattggccaaattgtcactatgtggtgaatgactgtattcccttcttcagtttatacctaatgaaaatgcacccattttcagtaaacacgaacaaatcaaatcaccttaaatgtcctaacaatacatgtgaatgtaggttttaaagacaaaactattgagggttaagaactggctgataagtaaatgaaccaagtgttcgcatctgaaatgacatagaaggaggtaaagaccatgaagaaaagaggaaagaaaaatgctatctagaaaaggggtgaaacgaaaaacgaatcagaagatataggttccgtgcttaccaacgcattcttttaaaacagtgacaaaaataataaataacgcctacgtaggtagcatagataagagtgcccagcattgttccaagggcattatgtgtattattagcccattttgtcttcacagtgtcctctcagtgggtacattattatccctgttatggggcacagagataacatgtccagcagctgctgagtggcacagtcaggattggaaccaggcagggcaggtccagagcccaagctcataaccaccacgggacatacatcctcatgtatattccctgatttcagagagagaggtgtgtgttgttattctttgggaaattgcccctttccctgaccctatgtggctctagaaggcttgactcttccccttaccctatgtaagccacaagttatgggggcaaaggtaacccaatatgaccagacagggtccattctctgaaatttttttctactgcagctggaaagaaactgtccttatcttcccttggactgagagctgtaaggctatgatcccaaagcagctaggacccttttgccccactgcatggaggtacaaggaagtgcttaaagcatgggcctttccatgaacagggaccaaaatgagagatggacagacagaaagagggaaggggtaagctgtttaagtctctggatccaggtatccctgaggtctgctgtacctcctcctttctaaattccatttacctgagtcaactactttctaccttgttatttaagatattagtttctgttgcttatagcagaagaatcccaaggaacacatttaactagacatttaatacctccaggatgagctggagaaaacaacctgcctgctagacaatgaagtaggtttatagctaaaggaacatatgttcctagactgaacatgcatcttctgagcacccatcctctgtccaggaccgtgctagacacaggggaatcatgagaaataagacactgtcctcgttcttgaggagctcacagtctaatgtaagaggacacacatgaaaacaaataatcacaagacagtgagctaggtggttaatagagttcccgcctcggggtctttgtattttctgtttccttgctggaaacactatactctcagacccataactgtccaaggctggtatatcagtttgctagggctgtcataacaaagcactacaaaccaagcaccttaagcatcagaaatttattgtttcacagttattaaggctagaaatccaagatcaaggtgttggcaaggttgacttcttctgagggctggaagagagaatatgtcccacctttctctcctagcttctcgtggatatcttggcctgtagatctctgccttcatcttcgcatgccattctccccatgtgttatctgtatccaaatttctcctttttctgaggacaccagtcatactggattagagacccactctattccagtatgacctcatcataactaattatatatgcaaggaccctaatcctaaatcaagtcatattctgaggtactgcggactagagctttaacatattaatttttatgggacacaattcaatccataacagctagctttgtcttgccattcaagtctcagtccaagtattacctccacagaaaggccttccctgaccacccaattgaaagaagctcttccccagccaccagtcactctacctcattgccctacttgactttctccatgcacttaccactaccagaaatcatctcacttgtttgcctttggtctgcctctctacacaagaacataaacctcatgaaagcaaggactttgtcttgcccacttgtctccagagctgagagcagtgcctgtgacacatggtggtgctcaatcaatgtcagctgaataaatacatacataagttaaatgaaaatcacttggccattcataaatgtaatgccagggagtgccacagctatgaataaaagtcaagcagggtaagagggtagagaaaggtgtgctgttctgagtatggcagccggggtaggcttctgaggagctgacacagaagcagcaagagcggtttcagtgagagtgaggctgatggtctgactggggtaggaccgaggcatgaacaggaggcaaggaagtggagacagcaaggagacatgccataaagggaagctgagagtgggggcatctgcatttactacccagcacctagaccttgacagctggcaaagactttgccatgcctggggaaatagttttcacttattcccgaagtttttacaacagccctgaagccctcccttctctgtcccctgaacattttgttcttgttttggcactgtacttctagaatttctgtggaactgcaagctttcccttttacatggctctttcctcctccaaggaactccttgagggcagggaccccaagaggttcccaatagatatggaaggaagggaacttctggctgttgcttctccctgtgggtgcccctttctactacaaaaaaacaaacaaacaagttttatccctttacaaacaagactttgagatctgtgtggtgaaaattataaaacattgatgaaagaaattgaagatgacacaaacagaaaagtattctgtgttcatggatcagaagaatcaatattgtcaaaatgtccatatgcccaaagtgatatgtagattcaatgcaatccctatcaaaattacagtggcatttttcacagaaacagaaaacacaatcccaaaatttgtttggagccataaaagacccccaaatagctaacacgatcttaagcaggaagaatgaagctggtggcatcacgctcactgattaaaaattatactacaaagctatagtaacaagacagtatagtagtggcataaaaacagacacataggccaatggagcagaatagagagcccagaaataaacccacacatgtacggtcaaataatgaccatgtggacaaaggtgccaagaacacacaatggggaaagaatagtctcttcaataagtggtgccgaaaaaactgtatatccatgtaccaaaaaagtgaaattgaaactttatcttatgccatacacaaaaatcaattcaaaatcgatgaaagacttaaacttaagacttaaaactgtaaaacttctagaagaaaacatagggggacagctccattacattcgtcttggcaatgattttctttttttctttgatacgataccaaaagcacaggaaacaaaagtaaaaacaaacaagggagactgtcccaaactgaaaagattctgcacagcaaaaacacagcaaaacgaaaaggcaaccaaaggaatgggataaaatatttgaaaaccatatatatatgaggtattaatatctaaaatatataacgaactcatatacctcaacagcaaaaaataatagtaataatatcccaacttaaaaatgggcaaaggggctaggcgcaggggctcatgcctgtaatcctagcactttgagaggctgagacagtaggatcccttgagatcaggagtttgtgaccagcctgggcaacacagtaagaccttgtctctagaaaaaacatttttaaaattagccgggaatgatgctgtgcacctatagtccgagctgctcgggtggcaagaagattgcttgagcctcagaagtcaagactgcagtgagttatgattgtgtcactgccctccagcctgggcgacagagcaagaccttgtctctaagaaaaaaaatgggcaaaagactgatatttttccaaagatgacatacaaatgaccaaaaagtatacaaaaaggtgctcaacatcgctaatcatcaggaaatgcaaatcaaaacaataagatatcatctcacacctgttaggatgactatgatcaaaaagtcaaaagttaacaagtgtatggcaaggaggaaattaacaatccttatgcattgataatgagaatataaattggtacaaccattatggaaaacagtatggagtttcctgaaaaaaaataaaaatagaattaccatatcatccagaaatcctccttctgggtatatctccaaagaaaataaaatcatgttctcaaaaaagtatctggatttcacgttcagtgcagcatcattgacaatagttaagatatggaaacaatctaagtgtctagcaacagatttatggatagagaaaatgtgctatatatacactgtggaatattattcagatttaaaaaaagaagatgaaatcctgccatatgtgacaacatggatgaacctggaggacactgtgctaagtgaaataagccagacacaaacagacaaatactgcatgatctcacatagatgtagaatctaagaaagctgaactcagaaacagaaaatagaatggtggttgccaggggctggtcactggtcaaggatataaactttcagttataagatgaataagtcctggggacctaataacaacatagtgatggtagtgtataacaatttacacttgaaatttgctaagacagtagatagatcttaagcattctcaccacacacatatgaaaaaatggaactgtgtgaggtgatgaatatgttaattagctagattatggtaactgttttacaatgtgtgtgtgtgtgcatatctcaaaacatcatgttgtatacctttaatatacatatttgtcaattacacttcagtaaagctagagacaaaataaacaaaaaataaaaatcaggctttcaggagtgatgtcatgcaaactaacagagcaaggagctccaggagctatctctctactgaaacaaccattgacctggaaggagtgactagaatcaactatttaggaacggtggaacctaactagacacttacaacaaccaggggagggcttgatgaagggagggactgctgatctttcctaagacagcaacataagtgaaccagctaccattcccatcacagctttgaagatagcagcccatgttctaggaatggctgactcataccagagtaggtagtggggactttctcttccaaaaattgatgttgtacatttttgttggtctagcagtgtctgaggggttgacgcagacacccactttggttttggccctcttggtggcagcaacttcccctggcagcatccatatgaaaattttaagtaacaactcctacccacttttccctttttggaaccagtaatttaaagaaatatttttcaggtcactgactgaccacagagataacagaacagaaacttcagtgaccacacaaaacaagaaacacgtatttgcaaaaagagtttggaaaagtcacaaattaacagcactagcccttaatggaaaaaagtcagcaagtcctgagaagtgggaaaatggcatttctagagttataatattatagtactcagaatttccaattttcaataaaaatttgcaaagcatacaaagaaatgggaaaatatagtcattaacaagaaaaaaagaaatttgtcagaaatattaacaagcaaacccagacaatagaattactatcaagagtgttacatcaattatattaaatatggtcaatgagctaaaggaaactatagacaaagaactaaaaggaagtcaggaaaacaatgtgtgaacaaaatgaggatctcagtaaagagatagaaataattttaaaaccctagaaattctataacttaaaagtacaaaaactaccatgaaacttactagaaaggttcaagagcagatgtgaaaaagcagaaaacaggatcagcaaacttgaatataagacaaccaaaattatccaatttaagaaacagaaagaaaaaaatatgaagaaaagtaaacagagtctaaggaacctgtgagacatcatcaagtagaccaacatatgcattgtggtgacccagaaggagaaggagagaaagaagcagaaagaactttgaggaaataaatgccaaaaacatctccaaatctgatgaaagaaattaatatacagatgcaaaaagctcgatgaactccaagcaggataaactcaaagagatccacatagaaaggcatataattaaagtgtgaaaacccaaagcaaatgagaaaaatttgaaagcagcaagagacaagtgactcttcgtgtacagaggaaacttaatgaagattaacagctgatttattatgagaaactatggaggccagaagacagtgggatgacattcaaagtcctcaaagaaaaaaaactttgaaccaagaattttatatctggcaattctatatccagtaattctatatccagcaagtctatatcccacaaaactatcattcaagaataaaggagaaattatgacatttctatataattagaaggtaaaggaaatcattaccagtagacctgccatacatgaaatgataaaggtagtcctctgggctagaatgaaagaacactagacaataactcaaagccataaaaaggaataaataaattggcacagttaactaaataggtaaatataaaagccaatattattgtacttttgctttgtaactatgctttttttccccaaagtgatttaaaaggaaaatgcataaaacaataaatctgtgttaatgagcacaaactatataaggatataatctgtggcaataacaatataaaggaggaaggatggagatctataggagcagagtgtatactattgaaactgaggcaacattaatcaaactaggttgctctaagttttctttcagtttgaaatgctaattttaaaataaagtgtacaagacatacagtatcatgatggaacaactagaaaaacaaggcaaaaaactggaatcaccttaagtcataccagctttatcttggttgagctgaaaatttttttagtgactagatctttttcagaagtgccggaataaagaggggagcatgtcagacagctggaacagtatgggaaaagaagaatggcagaaaagatttttctttcttttccctcaaagagataggctcttttttgtgtaagatttctccaagtactttgtatatcaaaggcattagagtataatagttaagaaacagactctgggctagcctaaccaggtttgaatttggttctatcacttactaggtatgtgatgttggtccatctctcaacacttacttattttatttgtaaaatggaaataataatagtacctacttcatgggttattaaaatgttaatgcctgtaaaacactgaaaatcgctccaggtatataggtaaagcctaataaatactggcttttactataatcatacaatcatctagataccctaagtggcaccaatgaggacctaccaaagtctatggctgtagcaataaaaaaatttaaaaactacttactcaatttcagaatctaatcaattaacccatttcttaccagatgtagacaatttccacttaacatctatctaggccaagtataacatctgaaatattttggtgctttaaaaaggaagtcttccatcagagtaataatgcagttagttctgaaagcttttttctaaaccagaattggaacatctgtgtctttctgtccttgctgttgacacaggatctaccacaggaccaactcccatgatgttatctggaaagccaaaatgtctagccatatgagatttattcatttatgtattcatttgtccaacaaatattgagtgtcttttatgtgccaagcactgggatatgggaatatacaaaacagataaaaatccaggggacagtagtgcagacttcacagggctgtggtgaaatttaactgagttaaggagatgaaaagtacttagaataacatctggcacatatgaaacattcaataaacatttttcaaaaacaaaacctcccaacattgcttttggccaattatttcatctagagagtatcgctaaactgtgaaatcacacaatccgttagacaaatgaatatttaatcattacagcacaccaaatagcaacttggatttcgggggcatggcactttcagattacagtaagggccgaggttggctgctagagttggcttctctaagaaagagctcagaaccctgcctactgacttaaaatgagtcttggtgcagaatttcccagagacattggctcctatcccctccctcccccctgctttcctttaaagttgattcaagcaaggaagcatgggctttatggccagggcctaatatgagtaaacacaggcctccagggccctggcccctgctcaccatgatcaataacctagtcctggccaggtgaggtgactcacgcctattattacagcactttgagaggctgaggcaagcagatcacttgaggtcaagagtttgagaccaacctggccaacatggtgaaaccctgtctctattaaaaatacaaaaattatccaggtgaggtggtgcacacctgtaatcccagctactcgggaggcagagacatgagaatcacttgaacccaggaggtgaaagttgcagtgagccgagatcacgtcactgcactccagcttgggcaacagagcgagactctgtctcaaaaagaaaacaaacaaacaaacaaacaagaataacccagtcctcagtgtcaaatgagttccatcacagccaagcacactgccagcctttctctttccctcacgagagaactctcctgcgctcagctttcctctcttcatttgcattacaaaaagcacacctgaccctgttgaaaagggcatttaaggagatcatcaaaggggcctgtggtgctcctttcacagcacatgatctctctccctgataagccctctccccagccttaagaaacccacattcgggagcaacattacgctaccagctgcagctgagggctctgggtgaaatcgagccagggctggggaacaactcaaaagtcatctgagaggtgtgacacctccctggcgtccagacccacggcaggcagcctacagactttttctctttgactttttaaagtaagatttatgaaaccacttttcctatcacggcataagaaatgataactgcttgaaggattatacctctttgccatttgatgacatctctgtaagtacagggaactatgggctctgtcatctttgcatccctaaaatcaaattcagaaactggcccccaaaaaggctgttgaataaatacataagtaaattccatttttatactatctactgatgtctaaaaattccaaattagaagttaaaaatcctatgatagatatctaaaggagaacaaagtaatccaaaattaattatatattacatgctacctaggattttatgaaactgagctcaatctcaaaattaaagaactgtactataggctgggagcagtggctcacgcctataaccccagcactttgggaggccaaggcaggcaaatcacttgaggccaggagttcaagaccagcctggccaacatagtgaaaacccatctctgctaaaaatacaaagattagccgggtgtggtggctggggcctggaaccccacctacttaggaggctgaggcacaagaattgcttgaacctgggaggcgggccatgagcctagatcgcaccactgcactccagcttggatcacagagcgagactgtctcaaaaaaaaaaaaaaaaaaaaaaaaaaaagaaagaacttactgtaaaatctgctttgctttgttactcactcttatgaatacagagccaatcactggttctagcctcactattatgctatattaagggaggagaccacccctcatattgtcttacacccaatttctgcctccaaataaagaagtaaaaactaaaaggcagaaatgaaatccacaggcagacagcccagcgctgagccctgggcctggtagttaaagatcgacccctaacctaagcggttatgtcatctatagattccagacattatatggaaaagcattgtgaaaatccctgtcctgttccgttctgattaccagtgcatgcagcccccagtcacgtactcccagcttgctcaatcgatcacgatcctctcacgcggacccccttagagttgtaagcccttaaaagggacaggaattgctcacttggggagctcagttgttggagacgtgagtcttgccgacgctcccagccgaataaagcccttccttaactcggtgtctgaggggttttgtctgcagctcgtcctgctacaatattactgtatatatgtaaaatatgctatattactatattttctcatttataaagtgggagtaaaaataacagctacctcattgcatttttgtgaggattaaattagttaacacatgtataatagttatgggacatagtgaccacttaagaaatgttagctagtattattgttgttgttaccaggcactgttctggctaacattctattagaccaagttaaatattagttcatttagttaatctgcccagaaaagtattaatagaagcaagttgcccatataacctgtccccttgacaacaaaatttgccttctgaaagccattaatggattctcaaggtacaagaattgcctatgaattgtttactttttagaatatgatttccccttgaggcagaatatatatttaacaggtcctaaatgtataccagaaagaactgaatcgccagcttcactaacaggtttctctaaaaagaaaatcagacagcaattttaccttctgttcaggccagatgatgttcctaatcctgcaaggtctggggtactttcatctgataagagcccatgagcttctgagagcttcaaatgactactacttaggttaaaaataagcaccgagaaacaaaaactgagaaacaaaagcagaagtatttctaaaattgctctcttcgcactgtctcgctgcgggtactttcctgtctctcagatcactgaccttcagtccagcaatttccagtgtcctgcaggctgctgatcccaagatgctcagccacacaaaggtgttgcggccaagtaaggttggggaacccatactatactcccttttgccacaatacctttttaaccagactccttttgtgatagtaggtagctagttagacctgagcagggcagaagagggctcccctgccccactccaggagtgtcaggcaaccactgaggtcaggcagttgttaactgtctctctaaaataataattgggccgggcacggtggctcacacctgtaatcccagcactttgggaggctgaggcaggcggatctcttgaggtctggagtttgagaccagcttggccaacacagtgaaaccccatctctaataaaaatacaaaaattggcagggcatggttgcgggcacctgtaatcccagcttccccgggagcctgaggcaggagaatcgcttgaacctgggaggcggaggttgcagtgagccgagatcgcaccactgcactccagcctaggctacagagcgagaatctaaataaaagaataaaataaaataaaataataattggtcacagccagcaccagagaaaggcagtctcccaatagatagaaacacctgaagctgggaatcagcagtttcctgataagatctcaggagttgggccagtgggctcaagcaaaaaagaggcaaaatggcaaagtttaactggtatatgaccttctaggaacattcaactggtaagagaagaatgcctcgagtgagcatgcgtacaactccagtaaacataccgtgcatgcatcactcctaagtgctggcagccactgcggatgcggagagcccacccaagggaagaatcaggagacaagggacacaagctcctggaaatatgacaacatataaaatcccaagtcaatggggaatccatgcacttgatctctccagtcacccccttggccctcttccaagttcacttcctttcattcctgctgtaaagcttttgaataaactttcattcctctaaaacttgccttggtctctgtgtcaaatattttcttctgaagagggaagaattgaggttgctgcagacctgtatggactcaccactgctaacacctttttcaaggaatatctactagaatctaggtgttggaaatgctgaaatagtctaaactaaccaattatttccaccttaaaatgactgtaggctcattcacctggcctggcaaagtcagcacttacttaaaagcagatgggagagaatgttgaccctatacatacccacagtccctgatcaacatacattttcatgaagaggtatatcttggatcaagtcaaaaagaaactatccccggatccatctgaggtgtgtcccatactcagggaacacaccaaaaaattcaggaatggctcacagggaagcatgatttcagaagatcgggagcataagaaaaaggaagatgatgacactataagagaaatcctatcaacaaaaggaatataattctcctcctgttttttttaagtcaaggagaagaatgctggtgcattacaatctaattggaacatgtccaaagtgatgggagaaatccactgacaccagattaaaggagtcctgagcagagaggaagctggatggtggcagggtcctcgaaaaactatctccaaagactccaatctctagagcattatcttagttctatgactggaaattttttccagaatcctcaatatctatctgtaatgtaaggctcctttttgctagcaccagaagcttacataaaattaggcacttggggaagcatcttgaccccctcatcaggccacccaaccataactgccccaatggccaacaggtggggattatgggaactataattcaagataagatttgggtggggacacagtcgaaccatatcaatggaggaatacatggatatacatgcagaaatctgggtggctttaattccttccatgaggtcttacaatcctaccatcactataaactagccaaaattaaaatatatctgggcagacaggagacccagatgggtaggaactaaatatacaaacatttctctcagtagagagaaaaaccaagaaaagggaagaaataagattcaaaatgatcccaagaggcacatcctggggaaaacccaacaagataaatatagtaagtcctcaaaagatgctagttactagtattatcattaatgttaaatagtaatattaactgtaaatccctgcatttatattgaagatagcaattacataagaaaagatattagagaactggcttagccaaaatccacaggagaaaataaaatttgcgttttggctaatcacaagcccaacacgtgtcagcactgcaatgtagctgataagtaactaacaccactgggcagccctcacccagagcaaaggagctaacaggctcacaaaactctcccagccaggccatatctgatgtgtaggtttgatttaggcacaaaagatatagacaatcggaattgcatctagcaagaagtgactatcacagctgtaagtctggaatccaaattaaacacaaaatagttgatagaacaggtggcaaccatggaagtgatggtttaaggtactcttcgatatttgaagagctgccaataaagaatggcactagttgttttgtgtcaccaacgggtgaaatttacaggggaggctaagttaggctccatacataaaatgattttccaatacttaaaattatccaagaattgatcccacgggcttgaaaagttttaagctttctttttgaaagtgcctgggagccagaagattatcaaccaacaagagcaatctaaggattcctctggtgggtgaagggatgcactctgaagtttcaaggcccctttcagcatcaagaatctgcaattctatggttctgactatagctgagcttcatcagattagtagacagagcccagtgctaccctctcctcccactcatttttgcatggtgaatggtaaatattcttggggcgaggcgcagtggctcacgcctgtaatcccagcactttgggaggccgaggcaggcgaatcacaaggtcaggagatcgaaaccatcctggccaacatggtgaaaccttgtctctaaaaaaaaatacaaaaattagctgggtgtggtggcatgtgcctgtaatcccagctacttgggaggctgaggcaggagaattgcttgaaccagggagtcggaggttgcagtgagctgagatcgcaccactgcactccagcctggcgacagagcaagactccatctcaaaataaataaataaataaattcttggtagactctggaaaaaatgatcaaataatacttgtgtctccaatattaactaatttgtgttaaatacccttttattctacttaaactcttgtatttcttatctgcaaaaggacctaaatgagaagataaaggtaaattaactctgaaaacctttaaagcaatgtaagggatatttttataattattgatgtttatcaataagtagagaagcactcaactaattttttaaaaaagaaaaatttgcatataaagcagtcatttttcttatctgacttcaattgtaaattgctgaggaaggtctaatttcaccttctatctcaagatttggtagccaaagttaccaaaggcctgcatagttaccaaaggcctgaacacacaattccaggaaggtgcccaacacagtgtattagcaagagaacttggaggctgggctttgccttctgtcctcaaacaggaataaatgtagatccagggagaatgaaagagtaaaaattgggacatctaaactaagaataaaccaaagagacaggaatatttgggtgctaagaggcaaaggccaaacacaaactataaaagaaaaaattgattaactggacttcagaattaaaagctctcttcaaaagtcaccattaagaaaattaattaattactctacatatttaccagtgaaagaaaaggaaaatgaaatgcaagccacagatgggtgaaaatatttataaatgatatctgataaggcacttatatccagaatatataaagaactctcacaactcaataataagacaaggaactcaatttaaaaataggccaggccgggtgtggtggctcacgcctgtaatccctgaactttgagaggccaaggcaggcagatcacctgaggtcaggagttcaagaccagcctgatcaacatagtgaaactccgtttctactaaaaatacacaaattagccaagcatggtagagcatgcctgtaatcccagctacttgggagtctggggcaggagaatcgcttgaacctaggaggcagaggttgcagtgagccaagactgtgccactgcactcccacctaggtgacagagcaagacttcaccttaaaaataaataaataaataaataaaaataaaaataggccaaaaattgaatggacatttcaccaaagaaaatatataaacagctgagtgggttccaagatggccgaataggaacagctccagtctacagctctcagcgtaagtgacccagaagacagatgatttctgcacttccatctgaggtaccgggttcatttcactggggcttgtcagacagtgggtgcagcccagggagtgttaggtgaagcagggcggggcatcgcttcacccgggaaacacaaagggtcggggaattccctttcctagccaagggaagccgtgacagatagcacctggaaaatcgggacactcccaccctaatactgcgcttttccaatggtcttagcaaacagcacaccaggagattttatcccacgcctggctcggagggtcccaagcccacggagccttgctcactgccagcacagcagtctaagatcgaactgcaaggtagcagcaaggctaggggaggggcatctgccattgcttaagcctgagtaggtaaacaaagcggcccagaaactcgaactgggtggagcccactgcagctcaaggaggcctgcctgccactgtagacaccacctctgggggcagggcatagctgaacaaaaagcagcagaaacttctgcagacttacacgtccctgtctgacagcattgaagagagtagtggttctcccagcacggagtttgagatgtgagaacggacagactgcctcctcaagtgggtccctgacctccaagtagcctaactgggagacaccttccagtagggggccgactgacacctcatacagccaggtgcccctctgagacaaagcttccagaggaaggaatatttgctgttctgtaatatttgctgttctgcagcctccgctggtgatacccaggcaaacagggttggagtggacctccagcaaactccaacagacctgcagctgagggtcctcactgttagaaagaaaactaacaaacagaaaggacatccacaccaaaaccccatctgtacgtcaccatcatcaaagaccaaaggtagataaaaccacaaagatggggagaaaccagagcagaaaagctgaaaattctaaaaatcagagcgcctcttctccaccaaaggaacgcagctcctcgccagcaatggaacaaagctggacggagaatgactttgacaagctgacagaagtaggcttcagacgattggtaataacaaacttctctgagctaaaggaggatgttcaaacccatcacaaagaaactaaaaactttgaaaaaagattagacgaatggctaactagaataaatgcgtagataaaagcttaaatgacctgatggagctgaaaaccatggcacaagaactatgtgatgcatgcacaagcttcagtagccgattcaatcaactggaagaaagggtattagtgactgaagatcaaatgaatgaaatgaagtgagaagagaagtttagagaaaaaagagtaaaaagaaacaaacaaagcctccaagaaatatgggactatgtgaaaagaccaaatctatgtctgattggtgtacctgaaagtgacagggagaatggaacccaagttggaaaatactcctcaggacattatccaggagaacttccccaacctagcaaggcaggccaacattcaaattcaggaaatacagagaacaccacagagatactcctcgagaagagcagctccaagacacataattgtcagattcaccaaagttgaaaatgaaggaaaaaatgttaagggcagccagagagaaatgtcaggttacccacaaagggaagcccatcagactaacagcagatctctcagcagaaactctacaagccagaagagagtgggggtcaatattcaacattcttaaagaaaagaattttcaacccaaaatttcatatccagccaaactaagcttcataagtgaaggagaaataaaatactttacagacaagcaaatgctgagagattttgtcaccaccaggcctgccctacaagagctcctgaagaaagcactaaacatggaaaggaacagccagtaccagacactgcaaaaacatgccaaattttaaagactatcgaggctaggaagaaactgcatcaagtaacgagcaaaataaccagctaacatcataatgacaggatcaaattcacacataacaatattaaccttaaatgtaaatgggctaaatgctccaattaaaagacacagacaggcaaactggataaagagtcaagacccatcagtgtgctgtattcaggaaacccatctcatgtgcagagacacatataggctcaaaataagggatggaggaagatctaccaagcaaatggaaaacaaaaaaaagcaggggctgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccctagagacctacaaagagacttagactcccacacaataataatgggagactttaacaccccactgtcaatgttagacagatccacgagacagaaagttaacaaggatatccaggacttgaactcagctctgcacaaagcggacctaatagacatctacagaactctccaccccaaatcaacagaatatacattcttcttagcaccacatcacacttattccaaaattgaccacatagttagaagtaaagcactcctcagcaaatgtaaaagcatagaaattataacaaactgtctctcagaccacagtgcaatcaaactacaactcaggattaagaaactcactcaaaaccactcaactacatggaaactggacaacctgctcctgaatgactactgggtacataacgaaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatctaaaatgggtaccctaacatcacaattaaaagaactagagaagcaagagcaaacatattcaaaagctagcagaaggcaagaaataactaagatcagagcagaactgaaggagatagagacacaaaaaacccttcaaaaaaaaatcaatgactccaggagctggtttttggaaaagatcaacaaaattgataaaccgctagcaagactaataaagaagaaaggagagaagaatcaaatagatgcaataaaaaatgataaaggggatctcaccaccgatcccacagaaatacaaactaccatcagagaatactataaacacctctatgcaaataaactagaaaatctagaagaaatggataaattcctgcacccacacaccctctcaagactaaaccaggaagaagttgaatctctgaatagaccaataacaggctctgaaattgaagcaataattaatagcctaccaaccaaaaaatgtccaggaccagacggattcacagccgaattctaccacaggtacaaagaggagctggtaccattccttctgaaactattctaatcaatagaaaaagagggaatcctccctaactcattttatgaggccagcatcatcctgacaccaaagcctggcagagacacaacaaaaaaagagaattttagaccaatatccctgatgaacatcgatgcaaaaatcctcaataaaatactggcaaacggaatccagcagcacatcaaaaagcttatccaccatgatcaagtgggcttcatccctgggatgcaaggctggttcaacatacgcaaatcaacaaatgtaatccatcatataaacagaaccaaagacaaaaaccacatgattatctcaatagatgcagaaaaggcctttgacaaaattcaacagcccttcatgctaaaaactctcaataaactaggtattgatgggacgtatctcaaaataacaagagctatttatgacaaacccacaggcaatatcatatggaatgggcaaaaactggaagtattccctttgaaaactgccacaacacagggatgccctttctcaccactcctattcaacatagtgttggaagttctggccacggcaatcaggcaggagaaagaaataaaggttattcaattaggaaaagaggaagtcaaattgtccctgtttgcagatgacatgattgtatatttagaaaactccatcgtctcaatccaaaatcttcttaagttgataagcaacttcagcaaagtctcaggacacaaaatcaatgtgcaaaaataagcattcctatacaccaataacagacagagagccaaatcatgagtgaactcccattcacaattgcttcaaagagaataaaatacctaggaatccaacttacaagggatgtgaaggacctcttcaaggagaactacaaaccactgctcaacaaaataaaagaggacacaaacaaatggaagaacattccatgctcatggacaggaagaatcaatattgtgaaaatggccatactgcccaaggtaatttatagattcaatgccatccccatcaagctaccaatgactttcttcacagaattggaaaaaaactactttaaagttcatatggaaccaaaaaagagcccacattgccaagacaatcctaagccaaaagaacaaagctggaggcatcacactactatactacttcaaactatactacaaggctacagtaaccaaaggctacagtaaccaaaacagcatgatactggtaccaaaacagagagatagaccaatggaacagaacggagtcctcagaaataataccacacatctacaaccatctgatctttgacaaacctgacaaaaacaagaaatggggaaaggattcccgtttaataaatggtgctgggaaaactggctagccatatgtagaaagctgaaactggatcccttccttacaccttatacaaaaattaatgcaagatggattaaagacttaaatgttagacctaaaaccataaaaaccctagaagaaaacctaggcattaccattcaggacataggcataggcaaggacttcatgactaaaacaccaaaagcaatggcaacaaaagacaaaattgacaaacgggatctaattaaactaaagaacttctgcacagcaaaagaaactaccatcagagtgaacaggcaacctacagaatgggagaaaatttgtacaacctacccatctgacaaagggctaatatccagaatctacaaataacttaaacaaatttacaagaaaaaaatcaaacaaccccaacaaaaagtgggcaaaggacaagaacagacacttctcaaaagaagacatttatgcagccaacagacacgtgaaaaaatgctcatcatcactggtcatcagagaaatgcaaatcaaaaccacaatgagataccagctcacaccagttagaatggcgaagtcattctaactgttcatatggaccaaaaaagtcaggaaacaacaggtgctggagaggatgtggagaaataggaacacttttacactgttggtgggactgtaaactagttcaaccactgtggaagacagtgtggcgattcctcaaggatctagaactagaaataccatttgacccagccatcgcattactgggtatatacgcaaaggattataaatcatgctgctataaatatgcaaaggattataaatcatgctgctataaagacacatgcacacatatgtttactgtggcactattcacaatagcaaagacctggaaccaacccaaatgtccatcaatgatagactggattaagaaaatgtggcacatatacaccatggaatactatgcagccataaaaaaggatgagttcatgccctttgtagtgacatggatgaagcttgaaaccatcattctgagcaaacaatcgcaaggacagaaaaccaaacaccgcatgttctcactcacaggtgggaactgaacaatgagaacacttggacacagggtggggaacatcacacaccagggcctgtcatggggtggcgggaggagggagggatagcattaagagatagacctaatgtaaatgatgagttaatgggtgcagcacaccaacatggcacctgtatacatatgtaacaaacctgcacattgtccacatgtaccctagaacttaaagtataataaaatatatatataaacagctaataagcacacgcaaaaatgctcaatatcattagtcattacagaaatgcaaattaaaaccacaatgagatactactacacacccaccagaatggctatagtcaaaacgacagacaatatcaagtgtagaatgggatgtggagcaactggaaccccctcataccccagagatgggaaggttaaatggtacagtcaccgtggaaggcactgtaacagcttttcaaaaggttaaatatacatctaccatatgtcccaggaattgcaattctaggtgtctacccaagagaaataaaaacatttgtctacacaaaaacttgcatacaaatgattatagcagcattattcataatagccaaaatgtagaaacaactcaaacgaacatcaactggtgaatgagttaacaagatgttgtatatccatataatgagatactcagcaacaaaaaggaactaccaatgtacattacaacagtgaaaagggtcaaaaacatgctaagggagaaaaagcccgtcacaaaaccctatattaaatcattccacttatatgaaatttctagcaaaagcaaatgtatgaagatagaaagtggattagtggttgcccaggactgggggtgggagaagagactaactgcaagtgggcacaaggccaccttgtgctgtaatgggcatgttctataaacatggattacggagatgattgcacaactctacaaattcactaaaaatcaatgtatttacaatggatggactttagatatgtaaattatacctcagtaaagttatgggctcagttcagagggcagatcttccagtcatattcatgatgagtcacaggcaatccaaagatagaaacaaaatggagagaaagaatacatttccttcttcttcaattttatttatcaaaagcactttcttcaggtatctcaaaatttaaagctataagccaggcacgatggtgcacacctgtagtcccagctactctggaggccaaggcaggaaaaacgcttgagcccaggagtttgagatcagcctgggaaacatagcaagactctatctctctttattatttttttaattaaagctaaaatacccagatctctttttttaattattattaatttctgagacagagtgttgctctgtcatccaggctggaatgcagtggcacaatctcagctcactgcaacctccgactcctgggttcaagcaattctcctgcctcagcctccgaagtagttgggattacaggcgcctgccaccatgcccagctaatttttgcatttttagtagagacagggtttcatcatgttggccaggctggtctcaaactcctgacctgaaacgatccactcaccttggcccaaagtgctgcaattacaggcatgagccaccatgcccggccccacatctgttaaaatatgattttgcaggcagtttgcctggaggttaagggttggaactgtggactcaatctgtgtgtaaaacccagcactcctacttactagctgactttagcatgttacttagactgagtttcagtttcttgttctgatacaaaaaattaatacatactacagagttgttttaaactagcacactatctattaacagcacatggtaaatactcaacaaatgccgatgttatttttttattatcaacacatcatcattaccatcactatgactgtagtttccttgggagacttgaaaacttgactgatatgtgtatgttcctaatgtacatttagtgcttcatcactgctatattcaatttaattgactgcccaaacataaccatgttcccttataaccctcattccttatcttagggaccttatactttgaaataaaatccctggatcatttcactaacagaacaaaagctgtgctattccctggctaaagcaagatattttccaattcaaccataggaaaaaaacatttttaaaaggtgcagtttttgtttgtttctaggataggagaactggacaaagaaaaaatgtcagcatctcctcagagaagcctggcaaacaggggaaataacactaaacaaagaaagccatgtgcagaggacctggcacaggaacacaattgccaggccttgcacccgagaatcaccaacacctgcagagtaaagcaacgggccacgtacagtgctgactgcttcctgggtgacagctgaaacccagccaagttcaaaaacccctcattgtgggtgtgtgtttttgctttgtaacatctatatgaaaagggaagggaaactgcatggggtaaactttctattttgtaagacaagcgtcttcttgttctctttttctttttctggtcagtgagtggaaggacagaaccctggaaaaatacctgtgcaccaagcaagacaaccccatcactgatgtcaggaaaagcagagcagtcacctctggcttgcccagcccacctcactcgcccaccagcacacactgcgactaaagaaccccactttagctgactggagcattcttccagccacacacctcaaagatcatctgggaagagataccacaacacggcagggggccgggtgcctgtgccagggagggacacatgctcttcactccccacacttgctggtgagccacagaagccctgtgacctcagcacactcaagggaaatatgtcatggggcttacccttcatgaggaccgctctaacttagcatccaagaaaacctcacagcccctgtggggacttctcctgggcaccacctagctcctgccttagtaaagtgtggagaaaaccaacttcctcacagaaatgtcttttagagccaaatgtaagtgtccctgaaatcaagtagacaatgatattcctatcattctgggcctgtccttgaaagttgtctctgttgttttctttccactagaaagtcatagaccctgagacccaaaaaggcccacagggatctagagaggtgaaataacttactaaaggccacagaggatggaagtggccaggccaagactaacacccagctttatccacaaaatctggaaaatgctatcaggctatcttcgacccagaaaagaagcgctcacaagaagaatatcaagggaggctagtccagactctgcagctagtgtcaaagttcaaatccagttctgtcccttactagggcacgtaacctgggcaatttccttaacttctgttttctcttccattaataagaggataataacagcatcaacattacagagcactccaagcatgaatgtatcaataccgagagtttctatatgactgatcatcctcctcctcctcatcatcatcctaaaacagacaggggaatgagagtaaagaagggatgataggaaaaaaaggtagaaagtgagtgtatggtcactaaataagtagagcataatttaacttcaaaaaattcaaagacatgtctagggtcatatccacaggggttagtgagaacataaaagcaaaacgtattataaaccattaggtacagtatggctccaactatgttaaatattcatacccacatgtatatacatacttccagaagaaagtgaaataaaatgcatgaaacattaattctctgggcactgggattaaggttgatctttattgtcttctttattacttttatttcccaaattttccacaacagacatatattgctttagaaatcaaaataaatgtgggttttaaaggctgtttttatttttttatttttatttttatttttttgagacagggtttcactgttacccaggctggaatgcagttgtgcgatcacagctcaccgcaatctccacctcccaggctcagaagcaatcctcctgctccagagcccccaccacccatagctggaaccacaagtgcatgccaccacacccagctaatttttgtatttttgaagagatgaggtttcatcatgttgcccaggcgggccttaaacccctggacccagagccatctgcctgcctccgtctcccgaagtgctcacaggcagagccgcagcgcccagcccaaggctgttttttaaaagaagaaacttgataccaggccaggcctcaaatggcaaaagggctattaggtagaatcccaagaggcaggggctgtgtttactcagacagccaagggggaagtgcctgtgtctgggaagagaacaagacttagggggaagggggaagcttaaccacgaagcttatgcctgagagcatcaggccagggaaggactctgtaaaataggaataaattccaaaagaaaataaaacagaagtgacgacatcagcagtccctagttaaaagaagaagaagaagaaagagaatcctggagcaagcctctgcgcagataattttttttccctggctggaacagaagatcagtcaccaaaactaaaaagcaaaagatccaagtggctgaaaaaaggaattatgggctcccactggggacaagacttgcctggaagcccatctgagggcttgctgccctatccttcacatctgagattatcccctgatcccagccaagaccagggatttcctgctttttggcatccagatgcgagaaatagatctgctgactctgagatcactgactgacactagccagggcccagagagaacgccgccgtggggtctaagatcgagttcacctggcatctttctcggcacgtatcttcctggcttgtcctcagtctccactcctctcagtttgagttcccacctcacctcttttgcagagattccttgtagctcatatgaaggagtggacagaagacacagaacagatagcagagagaagtactgggggcctcccagctcttgttcagggccccactttcctctgacaagcatgttaaggtttatccagattatccctccagttcccctatttcacagatgagggaaatgagacagaaaaagggggactgtatgtctgtgcccatcaaagtcagatgaaatgatacactgtcttaagaccatctgattcgggaccttgcctgaggtcacaaatctttgtagtgacagagccaggacaagcacataactatcctaatggctgctccttccttcagcactgtggctgcctacgagctggactgcagtctctactgctcactagaaaagttccagtcccccagcaggcacaggggctccagcagccgcggcgtgtccttgtcctccttcggggggctacagcggcatcctgtctgggtccaacggattgcttgcgggcaacgagaagctcaccatgcataacctcaacaactgcctggcctcctacctggacaaggtgcacgccctggaggcagccaacagcaagctggaggtgaagctccgtgactagtaccagaagcaggggcacaggccctcccacaactacagccactactacaggaccatcgaggacctgcgggacaagattcttggtgccaccattgagaacgccaggattgtcctgcagatcaacaatgctcaactggctgcagatgacttctgaaccaagtttggtttgagtgtttgggtgctggatgaggtgaccctggccaggactgatctggaggcacagatcaaaggcctgaaggaagagctggcctacctgaagaagaagcatgaggaggaaatcaatgccctgaggggccaagtgggagaccaggtccatgtgagggtggattcagctcggacctgccaagatcctgagtgacaggcaaagccaatatgagatcatggccaagcagaactggaaggatgctgaagcctggttcaccagctggactgaggaactgaaccaggaggtcactggccacatagagcagctccagataagcaggtctgaggtcactgacctgcagtgcaccctccagggtcttgagattgagctgcactcgcagctcagcgtgaaagctcccttagaaggcacactggcagaaacagaggcatgctttggagcccagctggtgcagatccaggcactgatcagcagtattgaagcccagctgggcgatgtgcgagctgatggtgagtggcagaatcaggagtaccagcggctcctggagcaggagatcgccacctatcgcagcctgcttgagggccaggaagatcattacaacaacctgtccacctccaaggtcctctgaggctgcaggctctggggcctctgctctcctcaaagcacgtctcctgggtaggaggatgggaaggaagagacccttacccctggttcttcccctgacctgccagcaaaattttatggctcaagggaagaaaaaaaaaaaaaaacaagagcaaagaaaagttccagtctaatccccaggctcctcttgggcaaatgtcaacacataaaatgatccagaaggccaagtcaaattacggtgtaatggacaggggtgcctcttcacattgcctaagggacaactataacagaaaacatctcagtcaaaaaggtgaccctgggccaggcgcggtggctcacgcttgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcatgaacccaggaggcggagcttgcagtgagccgagatcccgccactgcactccagcctgggcgacagagcgagactccgtctcaaaaaaaaaaaaaaaaaaggtgaccctgcaatgtggattgccaggacccacaatgagccagaggggttggcaccttttcaacacgggcctgcattcctgcaggtccagatcccagagtgtactgtatccaacgtgcctgtggctagcgtgtgtctacagactctggaaccacactccttggcttccaaccctggctccagcacatactctgtgacttttggccagtacattaacctttctgtgtctccatttctccttctggaaggtaagcattaagtatctcctatctttaaaagttcctaagaagtctacatcctaggccaccctatatgtgcacacccagcagccctttctgtcccctttgagcccaatctgagggaggacaggtccctctctcagcctcagaaagtgaatgatgatgggattcaaccttttctttggttttctccttctctttggccagtgacaagtcaaaggcaagaataactcggttctcactaaacagggaggtcagcagggaaactttcctttcccaataaaaagacataggtttggccaggtgcggtggttcacacctgtaatcccagcactttgggaggctgaggcaggcggatcacctgaggtcaggagttcaagaccagactggccaacgtggtgaaaccccgtctctactaaaaatacaaaaattagccgggcatggtggcacatgcttgtaatcccagctactcgggaggctgaggcagaagaatcgcttgaacctgggaggcagaggtttcagtgagccgagatcatgctactgcactctagcctgggcgacaagagcaaaactccatctcaaaaaaaaaaaaaaaaaaaaagacataggtttatgcaaagcgtattaggccattcgtgcactgctataaaggaatacctgacactgggtaatttataaagagaagagttttaactggctcactgttctgcaggctgtacatgcatggcaccagcatcctgagcacagcttccagggaggcctcagggagcttttactcatggcagaaggcaaaatgggaacaggcatgtcacatggcatggcgaatgaaggagcaagagtgagttggggcagaggtgccacaaacttaaacaaccagatctcctgagaactcactcactatcactcactatatcaaggacagcaccaagacatgagggatctgccccatgacccaaacacctcccaccaggccccacctccaacactggggattagatttcaacatgagatttgggcggggacaaatatccaaaccatatcacacaaaagaagccttttgacccttccactgcctttagtgctgctatagcagccatctgccgccatggggaaagagccaggaaggccaagaggatctcagccctgagcactaacactgtcctggtctctgtgcccaggccagcctccacttattccaaggatgactgtgaggaatgtggacccctgcttgtttacagtactgttggataactcttcttttgcttgtggccaaatgccatcctaataggtcaactgtataagtttattctcattaaaaaaaaataaaatttaaaatcatgttctccaaaaagttactgagtaaaagtgatgtcgcaatatcagtatgactcatggcattgatttttgttcgtttgttttttgtatttttctgagacagagtctcactctgtctcccaggctggagtcagtggcgcaatctcggctcactgcaacctcctcctcccgggttcaagcgattctcctacctcaacctcctgaatagctgggactacaggtgtgcgccaccatgtctggctaatttttttgtatttttagtagaaatggggtttcaccatattgaccaggctggtctcgaactcctgacctcgtgatccgcccgcctcggcctcccaaagtgctgggattacaggcatgagccaccatgcctggccggcattgttttatacacacacacagatacagaaatatagggatgtgtgtgtatatacattatatatacacacacacacacacacacactatatatgggtgtacatgtcacatatatttcctagctttttccactcaggcggccttgaagctgtgatgtccctacagcaacaagcacacttagtatctggatcttggtttctaaataccatcctccagatgacctccaagagaccagtgttccttgaagaaatggctggctcaagaactgcagcaaggaaaatacaagatgaacctggacatcttagaatgccagaaagcaaaggaggtgctttttttaaaaaggaaagggtgagaaaaggaaaaaagaagaaagatggggcatgtcaaatggacgtataagccaaactgaaggagttcccaatagccaaagctggaacaaattagagggaaaaaaggggggatagtagtataagatcatagaataaaacaaatatctgtgagcctatactgaaataaataagtgactaagtaaatatagcaaaagggacagatcttccttacaaaagaattccaattaataattatagaaagaattaggaaaatagaaaatcacctgtatttcactggagcagaaatgtttgccctaaaaaaaattatggccttcagtcttcctgggaatgatcagctgttgcactttcggtgacagcaggattatggacattaatacagaactttacagtttataaatttttttttaagaaagaaaagaagaaatcatgattaaacaccatagtaataactgctttaacaagatccactgatgaagataaaattaatgtgtgaaactttatggagaaacattatctgcacaaccttaaaatatctcctagctgaatactaatacaaatattaattactgtggtggttttaaaatatgtccacagactctttgatactcctccatgaggtggaacttaatccccccatgccctgagtatgggctggacttggtgattcctctctacttaatcaatgatggaaagggaaagacagtaaccttacagtagtgaaacctagcagacatgagacatcaccagtaccaagccatcttgacatcatgtactccttcaaaggacgcagtgagaacagcgtatcacctgaatcgtatttgtccccaaagtccataacctcagtctaatcctgagaagacactagacaaacccaaatggaagaacattctataaaatgcctgaacacgactcttcaaaagtgtcaaggtcatacgtctcaagccttttagtgttgttataaagcaacatctgcatgcttggctcatggttctgcaggctattcaagaagcatggtgccagcatctgcttctggtgagggcctcaggctgctcccactcatggcagaaggtgaaagggaactggtgtgtgcagagatcacatggtgagaggagaagcaagagagaggagaggggccgggcacggtggctcatgtttgtaatcccaacaatttgggaggccaaaaggggagaatctcttgagcccaggtgttcgagaccagcctggacaacatagtgaaacgccatctctacaaaaaatagaaaaattaactgggcaaggtgatgcgtgccttaagtcacagctactcggggagttgaggtgcgatgatctcttgagcccaggaggttgaggctgcagtgagccgtgatcacaccagtccacttcaaccggggtgaaagaacaagaccttatcacaaaaaaagagagagaaagagagtacaggtgctaggctctttttagcaaccagctctcatgggaactaacagagtgaaaactcactcattaccacaaggacagcaccaagctattcactggggatccacccccatgacccaaacacctcccattaggcacccacttcctacactggaaatcagatttcaacatgagattagcaagggtcaaacatccaaactatagcagccatataagacaagggaagatgaaagtatcatacatcggaggagactaaggagacatgacaactaaataaaatgtggattggatcctggaacagaaaataacattcgaggaaaaactgggaaaatgtgaataaagtatgtagttaacaactaaagttaacagtgttgtaccaaggtaaatgttttcattttgatgaacataccatgttgtttaagatactcatattaggctaggcgtggtggctcatgcctgtaatcccagcactttgggaggccgaggtgggtggatctcctgaggtcaggagttcgagaccagcctggccaacatgataaaaccctgtctctactaaaaatataaaaataagctgggtgtggtggcacgcgcctgtaatcccaggtactcaggaggctgaggtaggagaatcgcttgaacccgggaggtggaggttgcagtgagctgagatcgcgccactgcactctagcgtgggcgataaggtgagactctgtctcaaaaaaaaaaaaaaaaaagtgtgaaaactaaaccaaacaaagcaatgctccaagaagatgcagcacgtgtatcctaaggcttcaggttcccataaaatccctgaggttgcccagacacccccagtttgggatgcatcagagcctctctcactaatgaataccatagccatgatgaccatgcatccaggaggaacagcatgtatcctctattttcactggaggctgtaccccaagggtctttcctaattaccactgctgcgaggacctggatgaaaagtgataagcccccaagcatggcaaggctctagcctgttgcttctggctatggtcccatcactcagcactttgaagacccgcatagaatgagttattaacacacccaaagaacaaattctgaaagtgcatcaatattaattcatttacagagaggttttgctttctcctctctctttcttgattaaatgcttagtgcttcctcaagagatatgctgtcacgaaactctcaacaagtcatgaatgagaagaaaagataaaatcttccccatcaccttaaaggaaagcatttatttaaaagttctcatcaaccagacgcagtggttcatgcttataatcccagtgctttgggaggccaggagttctagaccagcctgggcaacatagcaagagcccgtctttaaaaataaataaataaaaaattagctaggtatggtggcatatgcctgtgctcccagctattcaggaggctgaggcaggaggggagcctggggtgggagaatccacttgagcccaggagttttgggctgcaatgaactatatgattttgagacaaagtgacattccgtctcaaaaaataaagttctcatcacctaaacgtatgccttttagttcatattttatttgtttaatctttgggtaagactcttgttgctgttttctttctttttaagatgaagtgatagattgcttgcaaaaatggccccaaatcctccatcccactcccttgtatccacaccctttactcagtgtgattatgtggcttctttcatcaagggagacagtttgtttaccaaaccttgaagctgggatggccatgtggattactttagccaacacaatgtggcagacagagttggtaatgtgccagttcctgaacgcaggcccacgaggctctgctctcttatgctccctctcagaaccctgcttcacagccatgagaacaagtcaaggctagctgctggagaacgagaacacatgtggtataaagatgagccagcccagccaagaagacaactgcccacatgggcccagcctacattgcttgcctgcagaaccatgggctaaatagttatgtcaccacattttaggatagtttgttatccagcaaaatctaactgatacaattgaagtgtgtgattttagtgctgttaattattctgatcttaaaagtattactaattggagaaagtcagaaaatacagaaaaggagaaaaccgcccataatttatcactagaataaaaccaacattctggtggtgtttttccccagtcttcagtatattagtgtgactgaatgaaaatgaaatccacttagttttaattccgtatctttctcctcccactgaaaacattcaatagagcttttcttatgccattagtgtctgaaaacgtaatttttaatggtttaaatattctatttatcatggatgtacaataatttaaacgtgtgcatatgtttctgtagtttctataattaaataatgaaattatttattcattattgtaagtattattgttcatttgagtacagaaagctatgttcaactctgtgcttatttctttaaaataagcttctagaactgaaattcttgattcaacgagtatagactgctagtcaaagccagtccccctacacacacacacacacacacacacacacatacacttctttgctggcagagacacattttgttccattgtttaccctgcgttctaccatgtgctcagagtgaggagcctctccccaacaaggaagagaaaggagaatcctgatagtctaagctactagctaaatctagcccaccacctgttttagtataggccatttaatgcaattctggccagtgagacatgagagaggtcttttgggagcttttggaaaaagcttttctttacaaatacccatgcaagaaggaatggttccttttctcaactctagagatgagtgtataaagatgcaatgcccggaactgatgcagccatcctgaccatgaggacttaagtctatgggaacaaactgatatactcaggatggcggagaaggaaaaggaaacactcatgtcctttgtgatgtttttgagctgctgaatttcctggaaacactccacctctggacagtgagatgataaacctaaacttctttctgtgtaaaccatttttaccaggttttctgttccttacagcctaaaggacagggactctttcaaggctttctccacacattaccaaactgagcgcatagagagattgtagcaatgaacattttctgcagaactacatgggcttaacataaaatttacaaaataacttggagaaaaataatacatgtaaaatattcaatgttctaatatccacaaacctgatatctcctttgttcaaaattttaaaaaatatctcctagtaaattccattatttacttagtccagcaatgtgctgtgagtttttctaaaggttttacgcttttttgctgttattataactagaagcattttctctattatatctaacagattgttgctggtatataataaagctattattcttcatgtataaatccacaactttactgagttgtcaataagtttaggagtgttaccatacatttgtttcttttttattgttatgtaattatgttgtttattttttaaaaactttttacttcctgctatcagctatatttcatatgtttcatgctttattgtactgacaagaaattccagaataataaatatcatcttagtttttttattttaaagggaatctctaatgtttcaccattgagtatgacattaaatactggtttaagagatatgtatgtgtgggtgcacagacatacaaaatttattttttggtttataatatacataaatcatgtaaaaaatcttatttttataagaattatattttttaaattaacgacaggtactgaattgtcaaatgtaatttaggaatctattgtgatcatcatatagtttatcttaactgaaactgaccaaagagtctagttacagacttcctttaaaaaattcatattcctaggataaaatgttacatatacatcctgaattactcttttatgagcatttctttttgaactttttcatgtgctttatccggtgttttattcatatgatttggatagttcttctactagagtgtgatagcactcatagaacaggggaattatctcatatctggaactcgaataagctcattagtaaaattggaagagcaacccacgaccccatggtaaaaggacaaaattcccaatagatgaagttaaacgatttatggaggaagggaaggcagtcctttgaaatgctagtattaccatggacatttctttttctcttttttcttttttttgagacggagtctcactctgttactcgggctggtgcagtggcatgatttcagctcactgcaacctccacctcctgagttcaagtgattctcctgcctcagcctcccaagtagctgggattacaggtgcccaccaccacgcctgactaatttttgtaattttagacagggtttcatcatgttggccaggctggtctcgatctcctgacctcaagtgagctgtccaccttggcctcccaaagtgctgggattacatgcgtgagccaccgcacccagccacagctgacatttctgacggctttgctagatacagtccttgcctggaggttcactttccctttgtagcacttcaccaactatgctgtactttcctgatgctgagagttggccatggctggtttgttttattttgttttcctactgtaccagaaatactgctccatgttttcagacagtgttatataggaggagaggaggagagagtttctccatttctgaacacaggaccactgcctgtccatttcccaccatccccatgtgtatcagttatccagttcacaataatgctgtgcaaaagtaatcagaggacctcactagcatacagcagtaagggctcatagctcaagtgtctggagtggtcagttaggtggctctgctgatcctggctgagattactggccctggagtaattaccaccctgcaatcagctggttctttgctgatttaggaagtctttggctgggaagtttagggtaattcagctctgctctgagaacatctgcaagacaatggtgtatgtgcaagagagcaagcaggatcatgcagtctcttaagacctgggcttggagctggcataccctccatcactactactgcatcctgttggccaaagccaatgtcaagaggccagcccaagccaggcgcggtggctcatgcctgtaatcccaggactttgggaggccgagatgggcagatcacctgaggtcaggagtgcgagaccagcctggccaacgtggcgaaaccccgtctctactaaaaatacaaaaattagccaggcatggtggcatgtgcctgtaattccagctactcaggaggctgggatagaagaattgtttgaacccgggaggtggaggttgcatcagtgagcctagatcacgccactgcactccagcctgggcaacagagcaagactgtctaaaataaataaataaacaaacaaacaaacaaataaataaagaggccagcccaggcttgaggggtgtctctttagtgaaaagaactgcaaaggcgtggatccagggagaggtggggaactggccgcccttgcaatctaccacaccgtatcccttctccgtcttcagctacttctacacatcagtgatcctgcatcttttcctctcacatcttctctccaccatagtgtttggccacaagttacccctcccctgcagaaaagacagtggctttcgttagcccagcactttagctgtctcagagacccaaaggagtagctgggccttccggtcagggtaaggaacaagaactgctaagtgagctgttcaaggctctctcaggtgggaagggctgggggaaagaacacagtctccacggctgggtatgactcagggaagaatggccgttggggagccatgttccacatctccaccttacagtgaatcaggaatacagaaaatcaaggttgaggctatacacagtaacactcactagtggcacagctttgtccacatcagcaagtctaagtgcaggctctgctgttgctaactgcctgacctcgggcaagccttctatctcttaggatatttaaaaaaccaatgggttggacgagtctcagtgagccttccagcaccaaccttccacacctatagattttattttgttaacaaaccaaactctcttcacacatattcattcttcatgtcaacttgtagtacgactatctgctcacaattttaaaaatcagaagaaacaccaacaacagcataaccttcaacccaacttctccagatgagtatcacaccacctcaggtgaacaaaggcgggctaagattattattctatcaaagcagcttcatgtaaagaaagagaatggaatgtgtacatttttcagggcagtgcacattcatctgtgattgaagaatgattcagatctgtttcaagcaataatttaatttttcacagtgaaaattatcatttccccaattttcagtttttttaattcaacttattttttgaataggtgatacatgtacatggctttaaattcacaagctacaaaataatataaagtttaaaagtaagttttcctgtcactcctgcccctatgcaattcagttgctctcctcagtgacaaccacagttaccacatgctcggtacatacaataagtgcaagtgcatgtgtatgcaggtgagcaagcatgtgtgcacacacacactattcttttttttttttttttttatagagtctcattctgttgtccaggctggagtgcagtggcatgatctcggctgcatactccgcctcccaggttcaaacaattctcctgcctctgcctcctgagtatctgggactgtaggcacgcaccaccatgcctggctaatttttgtattttttagtagagatggggtttcaccatgttggccaggctggtcttgaacgcctgacctcaagtgatccacccatctcagcctttcaaagtgctgggattaaaggcgtgagccactgtgcctggcctgttctttttagactataaatggtattatcctaaaaacattattttccatcttgcttttttccctcctaatattatatcgcagacattacttcataaagagtagcctcagacttttcaaagactgtatcatattctgttgtatagctattctatttaaccagtgcctgaaaactaatgaatatttacgatgtttttggtattttgctcttttaaacaatgttaccatgagtacctttgtacacagggcattttgcacaggtgcaagaatatctgtaggataaattcctacatagtcactctctgcacaaccatgtattcataacttagatacagccaaaccacttccagagacactagactggggttgcaaactatatcccacaggtcaaatctagtccacgagctaaggatatttttatgtttttaaagagttgttttaaaaaaaagaaaagaagaaaaaggagagggagaaggaagaacatgtgacagagaccttatgaggccttcaaatatttactatctggccctttcagaaaaactttcctgagccctacaccaatttacagccccatcagcaatgtataacagtgaatgtttttccactatttccattctaatctttgttcaaattaagatttaaggtaatgcttcaagttttgtttcagttgaagaaaataaggcactcataaaacacttacatcatggcactatgatctttccaggcaaaaatatggcttgttctaggacacaaacataaagcgacacttgaacttctcgcctcacattcacaggtggtgagaaaaggttagaacctccaactgttagaaccggaaggaactttaaaggttatctgatgtaagagttacagattctgtgtaccattaaaatttcaaaacaaatttaaaggattaaaacaatgttgtcaattttttatgttgccaataaagtcattaaaaaataaaaacagactgggcacggtgtctcacgcctgtaatcccagcactttgggagaccaagacgggcagattgtctgagctcaggagttcacgaccagcctgggcaacacggtgaaaccccgtctctactaaaacacaaaaaattagccgggcatggcggcatgcatctgtagtcccagctacttgggaggctgaggcaggagaattgcttgaacctgggaggcggaggttgcagtgagccaagagcacaccactgcactctagcctgggtgacagagcgagactctgtctcaaaacaaaaacaaaaacaaaaacaaaaacaaaatccaaccaccatctacttctttcaccatcacttcataaaggaatttaacattaaaagtagggcattcccaatattagaataaaggagagtccattacattaaatatacttaccttcacgaaaagccaaacacatcaccattttccttctgcctttgcttcacattgaggaaaactccatgtcaaacccatgtggaaaccaacttcactgtttcctaaacaatcaaaagaccctatacccaaatgaatgctcaagattcaattctgggctgggcacagtggctcatacctgtaatcccagcactctgagaggccgaggcgtgtggatcgcacgaggccaggagttcaagaccagccttgccaacatgatgaaactttgtctgtactaaaaatacaaaaattagctgggcttggtggtgcatgcctgtaatcccagccactcaggaggctgaggcaggagattcacttgacctgggaggcagaggttgcagtgaaccaagatcacgccactgcactccagcctgggcgacagagtaagacccagcctcaaaaaaaaaaaaaaaaaaaaaaaagaaaaagattcaattctgatgacaatgaatttatggcagacctagaactagaacccaggacctatgtctgccaatccccctaaattttcccctacaccacattctccacatgtcccaaaatcacaaaacaaatgaccagcataactggtcccacagcaccccagccagtctcttccttcctacatcactgctcttccctctcaagtgtgatcgcttatctctcagccaaaatgtgttttcagtcctcttcgctgggaggcaggggagcaaaacaacaacaaaactggacattttctctcttcttagtagctggagaatcctaaattcatgcagactcaaatggcaatcacccattcattctaaatgtgtttttcccccatcaatccttataaatagcctccacctcactctcctttgctgtgtaaggtggagagggactggggtccctggaaacacatgcatgagcttctatgggcacttaagcatcaacccaagggtcttccagatggttgacaagaggcatctcctacagcttcttccacaagaagaaccaaaatagcgagtagatagtcacacttcaaatagatcatctaagacagaccactggaattcaacagagaaatgacaggaaacatctaaagcagggaaggagacagaagcaaggcagcctactctgccagggtgggccggcatccaggacaggcttcccaatggagagaaagggtaagtgccacattcccaccacggactcctgcaatcttagccacaagagagcccctccactctggggggcccagagactaacctaaggcactgcctggagactgtgcaaccagagacattgctccagacggggaactcatgctgggtcccacaaaccccaagtcttaagcacctacagcacagtgccactttgaaagcccagctcccaccagactgcaaccagtcccgggcccaacagcccctgcatctccacatccccggagtcccactgacatttctccccctcagccaccattgcaggggccaagaaggcagccactggaaacaactcgacccagttttcaccccctgcagagaggcagctgtgcattttcacatgccccaggacaattccactgaccacagctagtcatgcaggtagttatgggccaaagctagtgaagtacacatccctcagacccctgcctatggctgctcccactgaaagcaaccctgccctccccagtagcagggccacagcacacaggctgctgcctgcacctggccatttccccagtggcctatagggatcaccctacccctgcctggctgtggagccagtgcctacacacgccaccaggggtgggacagaggacagcttgactgggatttatcccagggatgcaagcatggttaacatatgcaactcctcacataaacagaataaaggacaaaaaccacatgatcatttcaacacacgtagaaaaagcatttgataaaattcaatattcctccatgattaaaaaaaaaaaattctcaacaaactcggcctagaaggaacatacttcaacataacaaaggccatatatgacaaacccacaggtaacatcatactgaatggggaaaagctgaacgcctttcttctaagaactggaataagacaaggatgcctacttttaccactcctattcaacaaagtactggaagtcctggccagagcaatcaggcaacagaaagaaataaaaggcatccacatcagaagagaaaacgtcaaagtgtctctctttgctgataatatgatcttataactagaaaaacctaaagactccaccaaaaaactcttagatctgataaataaattcagtaaagcttcaggtacaaaatcaacacacaaaaatcggtagcatttctatacaccaataatgaacttgctgagaaagaaatcaagaaggcaatcccatttacaatagctataaaaaatagaatatctaacaataaatttaaccaaggaggttgtcttagtccatttgtgtagctacatctgaggctgggtaatctataaagaaaagaggtttatttggctaatggttctacaggctgtacaagaagcacagcaccaatatctgctactggagagggcttcccggctgcttctactcatggcagaaggagaacgggagctgttgtatgcagagatcatatggtgagagagaggaagcaagagggaggggaagaaagcaccaggctttttttaacaagtacctcttgtgggaaataataaagtgagaactatccacccaggaaggacattaatctattcataagggatctgctccaatgacctaaacacctgccatgaggccccatctccaacatgggaaataaatttcaacacgaggtttcgcaagtcaaatatccaaactatagcagaggtaaaggatctctataaggaaaattacaaaacactgatgaaagaaattaaaaagaacacaaacaaatggaaagacatcccatgctcaaggatcagaagaattcatattgttaaaataaacatactgcccaaaataccaacatcatttttcacagaaatagacaatcgtaaaactcatatagaaccataaaagagcccaaatagcaatactgaacaaagctggaggcatcacactacctgacttcaaaatatattacaaggctatagtaaccaaaacggatggtattggtataaaaacagacacagagaccaatggaatagaatagagaacccacaaataaatccacatatttgtaaccaactgattttcgaccaagcctccaaaaacacacattgggaaaatgacaccccattcaataaatggtgttcagaaaattggattgccatatgcagaagaatgaaactggaccactatctttcaacatatataaaaatcaactcaagagagattaaaaacttaaacataagaaccaaaactataaaactgctagaagaaaacataggaaaaacacttcaggacattggtctaggcaagggctaaaacctcaaaagcacaggaataaaaaaaaaaatagaaaaatcgaactatattaaactaaaaagcttctgcacagcaaaggaaacaatcagcagagggaagagacaacctgttgaatggaagaaaatatttgccaactcttcatcaaacaaaggacaaatatccagaatatacaagaaactcaaacaactcaacagtgaacaaacaaataaataattccattgaaaagtgagcaaaggacatgaatagacattttttaaaagaggatgtacaaatggccaagaagtatatgaaaaaaaaaaatgctcaacatcactagtcatcagagaaatgcaaatcaaaaccacgagatctcttaccccagttagaatggctattactaaaaagacaaaaaaatgctggcaatgatgtggaaaaagggaactcttacacactattggtggtaatacaaattagtatatccattgtggaacaaagtttggagatttaaaaaaaaaaaaaaactaaaaatagaactatagtatgatccagccatcccactactaagtatttatccgaaggaaaataaatcagtatgtcaaagggtaggtacgcgtgcattgcagcactattcacaatagtttattgcagcactattcacaatagcaaagatatggaatcaacctaagtgtacatcaatggacgaacgagtaaagaaaatatggtatatatacataatggaatactatttggccataagaaatgaaatcctgtcatttgcatcaacatggatggaactagagatcactatgttaagtgaaataagccaggcacagaaaaacaaatactactcatatgtaggagctaaaaaatagttgatgtcatggaagtagaaagtagaatgatagacactagaggctgggaagggagagggcgatgaaaagaggttaatgggtacaaacctagacttagatagaaggcataagttccaatattcaagagcagagtacggccaggcacggtggttcatgcctgtaatcccagcactttgagaggccaaggtgggaggctcataaggtcaagagatcgagaccatcctggccaatgtggtgaaaccccatctctactaaaaatacaaaaattagctgggcatggtggcatgtgcctgtagtcccagtcactcgggaagctgaggcaggagaatcccttgaacctgataggcggaggttgcagtgagctgagatcgcgacactgcactccagcctggtgacagagcaagactccatctaaagaagaagaagaaaaaaaactagagtagggtgactgtaatagttacaaaccatgtattgcagtatttcaaaataactagaagcaaaaacctgaaatgcacccaacacagagaaatgataaatactaaaggtgatgggtaccctgacttgatcattacatattctatgcatgtaacaaaatatgacatgtaccccataagtatgtaaaatatcatgtatccattttttaaacccacaatcaaaaaaataaacaaaaaagaattagcttcccctgaaattaagagccaaggatacttcaacgggcttggatacagagctaccgaaacacagcatctttatcagatccaagacctggccttcctctgccctccctggtgctctttcatccaacatttggctttcttctgtgtgcatggcaccattcatttgctcctgtggctgctcatgtatctgtcctgacataggagtcagcctcattttgtgccatctaccacgagggtgcaaccctccttctagtacagctatgtcagcccctgccactcagacacccagcccctgctctgtgctgctaggcactatggtttccagctagccctgcagctaaagctaaatgatgctctggactgcaaagcttcccatagtccttccagcatcataagaaaaatccatttgagagcagtgagcattgacaatagctttaataaataacagtgttggctcaatctgctctattttcaattaagattttagctctcacacagcagggttttaataggactcctaagcctaggagtaggtcattgagaatttataacaccttttttaatgaaccaaatagcaagacttttgccgccatcccaggttgcttttgtatttgtttttaagtcttcttctgtctcccattgctccaaaacatagttgaggacattttcctctcatgaaactatgttactccttccccactagtaattactacctcagtttcttattcccttacaaagctttttaataggactagtaatccaagggagaaactaattagtagatggaatttttccttgtaatatgctgtggtcaaaaacatgcaaattctcaccaggatcccaagaaatgaaacacatatcccaagaagactcaatataggaaaggggagatgtgatctctctgccaatacttcatgtttccctcaagatgacttctgcaggttttggcagcaggctccagataacatcacatccctataaatcagctccgccgtgcagatgtgatttagttagttattcccaggaacaacaggaggttgatttggacttcatattggaggtaaatgaaggggccagccttagagactctgacctctttgttgtgggacagagggactatcttgcttactacaccaaggtattagcttcctggcttgaagtttgtattccaagatgtgtcccactgaagagatgggcaggagatgacaggactcaaatacgccttcagagtcatgaaatggtggacatagaagaggccacaggggttatcaaggaaaacagcgagttaaacggacacatgaatagaagaatggtgaatgaaataggacagatatgtatgcataaattttcccaatgtcaaggtttgtgatatgccacatgcttgggccttttttcaacctttccactcattcaacaaatagttattgtgtgcctaatgggtaccaggttcccaacagtactaagcactagggaaatggtggtgaactagactcttttttttttttttttttttgagacagggtctttctctgtcacccaggctagagtgcagcgatgcaatcatggctcatggcagtctcgacctcccaggctcaagcgatcctcccacctcaacctcccgagtagctggaactacaggtgtgtgtcaccatgtctggctaatttttaaatttttcttgtagagacagggtctctatatgttgccctggctggtctcaaactcctggactcaagcaattcttctgccttggcctcccaatgcgctgggattataggcgtgagccaccacgtttatccaacatttctctttttttttttgagacagggtctcggtctgttgcctgggttggagtgcagtggcatgatcatggctcacttgatggcatgccttgacttcctaggctctagcgttcttcccacctcagccccacaagtagctgggactacaggcacatgccaccacgcccggctaatttttgtattttttgtagagacagggttttgccatgttgcctaggctagtttcaaactcctggactcaagtgatcctcctgccttgacctcccagagtgcagggattacaagcatgagccacggcacccgaccgacatttcttcacatcgcttacagtctagagtttacagtttagttaataaacaaaattacaactgctgcccattaaaaaaaacaaaacaacaacaacaacaaaaaaacgcatgtcaaatggttggagaaggaagagtttaatacatttactgatattctgaacaactgagaattatcatagatagaataaaagggttctcaatttatcaataagtagacttaccttaactactttacatatatatatgtaaaccaaaataacaattctattcattcagaaaatgtttattgaggaccagctatatgctagtcacaaagtgactgacaaaagtcctgtcctgggcagggcacagtggctcacgcctgtaatcccaggacattgggaggccgaggcaggtggatcacttgaggtcaggagttcgagaccagcctggccaatatggtgaaaccccatctccattaaaaatacaaaaattacccaggcatggtggcacatgcctgtaatcccagctatttaggaggctggggcaggagaatggcatgaacccgggaggcagaggttgcagtgagctgagatcgcaccatggcactctagcccaggcaacagagtgagactctgtctcaagaaaaaaaaaaaaaaaaaaaaaaaaaatcctgtccttaatgagctcataatctaaataaaaagatgaaaaaaactaacaaagagcttcaatatgggtgacaaagtctttaacgaaggatggaaaaattctgagagaatggggtggggcaggttattaccttattagggctgggaggagggcagtacttgggacttgaagctgagccttgaagggtgagtgaggtgataccagaaggaaggagttgaggagtccctttcagatggagggaacagcatgtacattcctaactgaaaatagtgcctgctgggtgggcagggagtgcatctgggcagcagccaaagagaagcctagaaagggagacagaggccacaccctgaaggactctgtcggccctgacagtgtggctggacttgatcttgtgggcaatggaaggccaccgctgtgtcttgaccgacaacatgattagatctgcatgtcggaaacgtggttctggctgacctaacatgtacttcctccatcactgaagttgtggctgcagatggaaaaaccagaggaagggaaatggcccaggtgagcaacgttggtgaggtggcagaaggagaagcatcttcattttttctttcaactttgattccaatgaaagaaacatatctaaaaagagtttatccattatgactcagtctgatctcttcataaacactaaatcctacaatcatattacaagaggaataaaactgcttgacctagtaatttcttgttttgagacagggtcttgctctgttgcccaggctggagtgcagtgactcactgcagcctcaacctcgtgggttcaagccattctcctacctcagcctcctgtgtagctgggactacaggcacacaagccaccatacctagctaacttttaaatttttttgtaaagacaaggtctcactattttgccgaggctggttttgaactcctgtgctcaagtaatctgcccaccttggcctcccaaagtgcaggattacaagcatgagccccagcccctggctgatctagtgatttcattaaggaattcccaagaaaacaatctagatgagagaaaataatttttctcaaagatgtttttaactatgctacttaaaatagccaacaaatgaaaataatccaaacatctaaaaataaaggatggttaagccaaatgtcatctatcaacatgactaaatactacataaacattaaattaactacagccatgcatgggaatgtgtatgggagcaaaagcagactccaaaacatgatatgcacaacagctacaagcttaagtacctactatgtgccaggcccaatgctaggttctggggacacagaaatacaccagacaaggtccctgtcttctgaactcacagttcactaggaaagttggactcacacaattgtaacaagaacaaagcatggcacaaagagagcccagaggaggagttgcccaacttagagccaacacacaaacacaacacaaatgtgaatgttcaagtctgcagcagaatcactcatcaattataaattttgatgaccccaaacacatacttgttaattttgtgggtcaggtgtggtgactcacactgtaatcccagcacttttggagggtgaggcaggcagatcacctgaggtcaggagttcaaggccagcctggacaacatggtgaaaccacgtctctactaaaaatacaaaaaaaatcagccagtcatggtggcatatgcccagctacttaggaggctgaggcacaagaatcgcttgaacctgggaggtggaggttgcagtaatctgagattgcgccactgcactccagcccgggcaatagagcgagattccgtctcaaaaaaacaaaaattgttagattatcccggacatgtaaaacctaagatgaggaacactcaaatccccaagaatattgcatggagccttttaagagtccttggatgctagtttgagaaacaaagatctaatagcaggaaggtgcctgtattcgtccattttcacactgctataaagatactacctgagactgggtaatttataaacaaaagaggtttaattgactcagttctgcacggctgggaaggcctcaggaaacttagaatcatggtggaaggcaaagaggaaacaaggcacgtcttacatggcagcaggagagaggtggggaactgccaaacacttttaaaccatctgttcttgtgagaactcactatcacaagaacatcatggggaaaaccactggggattacaattcgagatgagatttgtgtgggaacacagcgccaaaccaaattagctccagtggacaggaagggagacaaaggcccaatagcatctggctcctgattagggtcaagagggaggaagagtcagagatgatgtcaaagtttgaagcctctgcatctggaaaaatggcaacagggctccctgatataagaaacctaaaagaaaagatcaggtttgagagtaagaataagttctatttttcatatattgagtttaagaaacattagagagtaggaaagtggtggtattcaggaatttgctgaaaattatctctggagacttggagacacagagtagagacccagtatccaaagacatcttccaggctgggcgtggtagctcacgcctgcaatcccagcactttgggaggacgaggtgggaggatcacttgagttcaggagttcaagcccagcctagccaacatagtgaaaccccgtctctactaaaaatacaaaaaaattagccaggtgtggtggtgtgtgcctgtagtcccagctatttgggaggctgaggctggagaactgcttgaacccgggaagcggaggctacagtgagtggagatcatgccactgcactccagtctgggtgacacagcgagactccatttcaaaaaaaaaaaaacaaagtcatcttccagagatagctgaagcttgaaatggatgctgcacaacaggtatgaacacatccaactgcattattacatgtacaagatactctcctgttagtccctcacatatttgttaggcatctacttactttcaaaggattagctccttaaaattaataaaaacagggatatagtataaaggatcagagtgaatacattgatctcgtattttttccatgggaaaaattctctacttttataacgaatacagtttgaaagatgatttgattttaaaaaggattaatattaaagcttattttttctacagtgatttatttcatgatcatcttccttctagcctgtgaacttccaagataaggactgtggaactatgccttatttaaattgctaacaaggtacctggaaaatagtaaatacttaatatttgtggtagaagttttgtaaacagaagaatactttgttgtggctctcaaacatcaggaagttgcagagtactatatgagagcatttgtgtgtatgtacatactactgaattctactgcggtaaacaatctgggcttccagtgtggaggtggatgctttcattcatttgaaatctacaattactcacatgtaaattagcagcaatgcagaaaatgtgagaaattcagaattagtttatctttttagaactaccgagattctttttgtgtttgtgatctatatgtgccaacactacaattgtgttatttccagaaataactcaaaaagacattttcaatgatgagttttgagtagcaaaactggaaaggatattgtcaatctgttgtacatttatgatgtgcacaatctagactttccttcacaaatatgcttcaatgcacagaagaaggtgaaaacaacaccataaatctcagggctgcagagggagagctgaaggggtaaaaaacgcaattggagttcattcaccaggttggacaatgaaacaccagctcttgctctgcttctacttgctgaaacagacgtccccaagaagataaagggaagatactttgtacccttcctgaccctctttcttcctatacctttattgttcatgaagacaaatggtatgaaattttagtgaaaaagtccaagcttgggttgagggaagtatttggtttacttaaatccattgctgaggtttatggaacatatcagagcttcccaaagtctaaaaaatttagacttctaggtcctatcatagaaatgctgattctgtaagtctggggtgagcctgggaatttgtatttcctgaaagccccactcacttccacaactgattctaataaccagcccagtttgtgaaccatgaacgagagactacactcagacttggcaaacataaactgtctcacttgattctgacaaatcaagtgcatgtcaatcatctctatttcacagatgtgaaaaataagtcacaagcctgtatgcgtcagtttagaggtcatagtgcaatgctgcctccattacaccattatttgagcaccaaatttctgagcataggtgaactctaacctgatcttgggtctcatctcacagactattcatgcaaccaaccaataactgtggtgtgcctgaacagttcttgcacctgtccatagttcagagagacctctgcatcccaaataaccactattcactacataagcactaaaaaaatccattcaaatagaacttcaataaatttgtattagagcacacagcttgtaatactcaactaatttcattttataaccagtaatgagaaattatctgaaaatgaataaagaaaacaaatagatctttccaaacccacttctgtaaaggaaacaatatccttgcccttactacttctgtaacattctgctgaatgctaattgctttattttaattttaatgcaaaattctacatttctgattaatgcaacttaccaggatcccaaagaatagaaatgagatcccatgtcatcaagaaagggtgccatgagcatcaagtagaggtgtgtgagggagagagagaggaggcagcaagtgatgaaggcggaagactgaaatgtcctggtttcagttgggtttctggttttctatccatgtcactctgcattacctcctgaataggtagacggactttggcagaaaaggatggctcacatactggaaaacaattgcacgcatacctggaatacattagaggaatctctaatgctttagggcaaagggtggcaaattacaatccaccggccaaatccagcccatgacctgttttcgtattatccacaagctaaggatggtttttacatgtttaaatgattgaaaaaaaatcagaataatagtattttatgacatgtgaaaatgatatgaaatccagatttcagcatccataagtaaagttttattggaacacaaccacattcattcatttcatgtgttgtctatggttgctttcacattttaaggcagagttaagtcattgcaataagagaccctatggcccacaaagcctatatttcctatctgcctcttcacagaaaaagtttgtgaactcccattttagggcaaaggaggggtgttaggttacttcctgaaaactgactctgacctagccttagtttgctgaatatgaaataaaatactgaacttagaatcatctgaaatacatttcctttgatattgacctgtaaggtataacacaatctagttatccctgcctgagtgtcccagtattgaattgagactattcctgtggcttcttagcccaaaaacaggggcggggaaggccttctgcacattcaactccattactggaatgatgaacgcataaagagaggagcccagcatactaacccagcagagccctctgcacaggctgcgtttgagccttccttttagcaaagggaataggtagctttaccctgtcagcaactatctcgagcactgctgtcattttcccagcattgatattcaaaaatcagaactgcgggccgggcgcagtggctcacacctgtaatcccagcactttgggaggctgaggcgggtagatcacgaggtcaggagttcaagaccagcctgaccaacgtggtgaaaccctgtctctactaaaaatataaaaattagctgcgcttggtggtgcgcacctataatcccagctactcaggaggctgaggcaggagaatcgcttgaacctgggaggcggagatcgcagtgagccgagatcatgccactgcactccggcctgggtgacagagcgagactctgtctcaaaaaaaaaaaaaaatcagaactgtggcatgtaaaacataattcagagttgaatagcaggagccgctgtcctcccttctgctgaaggcaggagggaagcttgtcagagtccagacagttctggtctattagcagcagcctaatttttgccatctctgaaggcaacacaaattacaaagcattcgctactgttgtaccagtcaactaattcaattgtcagaacatttcaaaccccataatttggatgggaaagagagggagagccttgctcttatgaattgactgttggactattccatgtcacagcttgcttgggggtgagaataagaaaatattctctatcaggaaattaacatttgtaagtaccctggaaagctaaataataagcataatggtttagaatgaaagtaaccaaagcggttcattattaacattgcaagtaaacattttaatttgtggctttgctacacacatggattgttgggtcaactgttagagtattttcactcatctttcaaactacacataattcagtcctctttgccagtgtttttacctaaaccctctgtgaatgacactttctagtttcatgatataactagtccttagattccaaggtaataaaggcgcccttctactcaaaaacttcatgggcttatttccctcttgcaaacttaagtatgctttaatgagccattacactcatttgaattccagctctgcgagggactagctggatgtgtacggatccaaaacctcatttccctgagccccactctccacctgagaaaatgagattaatgccactacttcaagtggtggtttttgactcagtaaatttactttaaaaaccattgaattatacatttaaaacaggttagtcttacaatatatgaatcattcctcaagaaagttattaaaattttaatttgaagaactgctcaagaccagcctgagtaacatagcaagaccccacctctaaagaaaaaaaaaattttaattgtacttaaaagaaggccgggcatggtggctcacacctgtaatctcagccctttaagaagctgacgcaggaagatcactagaggccaggagttccagaccagcctgggcaacaaaagaagactcccaactctacaaaaaataaaaattaataatgtgattaaaagtaaaaataaaaagaggcagccatgaacaataaactatcagtgaataaagcaagagaggactgtctgcagaataaagagtgcaattgtaagataaaggaaaacgtgctgtttgagcagaagagaccaggagaaggtcagagtagctagatcatgcttgaggagaaaagatgggacttacaaagaatgtgttcagatgccatgtcctgtttaaaattaaattcccctgacaccacaacacctctctcctgtctggaaaagttaattaccttttttctaggctgtattttagatatgtttttgctaatgcagtcatcacactgcatggtaactatttgtttaaaagtctgatcctcagtaaactaagttcttacggctcaggggccatgtgttttggcagccctagtccataactcagcccaagaatgtgagataaatgaatgaataattttgttgcttactgcaaaaaggaaaaagacggttttgaagagtcagtgaaatatacatatgtatatgcaaaacgtgtgtatgtattagcacaatgccttgcacatagcgatcattaagtgatttttttattattactagtaaaacatgccaagaactgcactacagttcaagtcaattttgaagcaagtttggtctaacaacaacaacaacaaaatgttcgaacgcatggaaaataagtagacctaaatttagatgatcccctgccctattactaaggtttaaaggcctagatatgggccagacttcaaaaagcctcacagaaccatctacaatttgagatcagaatcctccacattcactgttagcagcaattctactctcactaaaccttgtgcttgcaggcttgtcgccatttgagtagcagttgatgggctttctgaggattcgttcttcaagattttggtctgaataacagaggaaatggataaattcctggacatacaacctaccaagactgaaacaaaaagaaacggaaaacctgaacagaccaataatgattaatgaaactgaatcagtaataaaaaatctcccaaaaaaagagaaacccaggaccagatgactgtcttgtggaaacctacaagacttataaagaagaacaacacgaattcttctcaaagtattccaaaaaattaaagaggagaaaattcttcctaattcattctatgagaccagcattatcctgataccacaaccagacaaggacccagcaaaaaaaaaaaaaaaaaaatagaactacaggtcgggcatggtggctcatgcctataatcccagcactttgggaggccaagacaggtggatcacctgatgtcaggagttcaagaccagcctggccaacatggtaaaaccccatctctactaaaaatacaaaaaattagccgggcgtggtggcgggcacctgtaatcccagctactcatgaggctggggcaggagaattgcttgaacctgggaggcagaggttggagtgagcagagattaggccattgcactccagcctgggcaacaagagagaaactctgtctcaataaataaatagataaataaataaataaataaaaaaataaataaataaatactacaggccagtatctctgatgaatataaatacaaaaatttctcaacaaaatactagcaagctgaatccaacaacacgtcaaagggatttatctcagggatgcaaggatggttcaacacacacaaatcaataaatacatcaatagaataaaggacaaaaaccacgattatctcaacagatacagaaaaagcatttcatgaaattcaacctctctttatgacaaaaactctcaacaaattaggcacagaaggcacataccctcaacataataaaagccatagatgacaagccctcagctacaatcatactggaaggcttttatgaatccctcagactaggttaggaacacccactacagtcccccagtaattgatccttcctttgcaaccatatacgccacaattcatggtactgcttaactgtcttctcagagcctgcaaagtctgcaagatcagagccatgcagagcttgctcacccacagtggattcctagcacacagaaggaagtcaatgttaaaatatgtgtttgaggagtgtcaccacattacatttagtctacatgccaacacctatgaaacagcttcagttctttccttcagcttgaagatatgcacaattctaaactcagaaagttacatattatctgcagtattcatattttattctcctgatgctttggtgaatgctgtctctcccaccagagcagttgatcaaaagaagcaagaggtggcaagcctcaaaactaaccagcttgatttttgaatcttttttttaagccccatgtatttttccacagtgtctcacctcagttacaagggaggcacgatgcccaaaatcttgtcagaattaaaattattaaagtagaaagccttttggcaaaagaatttaaagttcctattttgtgtgtatgctgggattttcagccgaaatcacagctgggtgtactcagccactgccagggacagaggctgtgtgtaagtttaccagcagtttatctagagcagaagctctcaattttaaactcccaaccttccatcccatctttttttttttttttttttttttttttttttttttttttttgcataaatataagagcacagactctggcgccagaatgcctcatttaaaatccctgctacatcatttattggccatggtatgttgggaaaattacttagcattcagcatctagcttcctcacttgaaaatgggaataaaacagcacctattgcataggtttgttgcgaggattagatgagttaattacatgaaaggcgcttagagtaagggctgagtaaatattagctatccttattattaaacacagctggggcataggaatacatgtggaggagaagggatgtgaaacagaacagagaagacagcaaaagtaatctgctgtgtaatgatgagaatggagcactttccacaaattatcacagacctcaggaaaacctttcagtgcaggttaacccgtccaagccacatagccagtaaatagccgtgctggacttgaacccaaacagtttgtctccagagatcccatcctgaaccaccaagaaacactgtctcccatgatcacactttcccctttagggaaaggaattcctgggttgtgaagtgaagcaaaaggacgtgaggaatgaaaagaaagaatggataaacaagagaaggccagactcatctgttttttccatttataagaggtaaaatgacaggtttccctttatcatcccttcacagtcatgaaagagcccgctgtctctgcagacacttggctttgatttcagtaggccaagttgaaatcaaaaccactgttaaagaattcaagagattgacagatccttttcaacccagcaagatccaaatgtgaaatagaaatgatggacatgaagtacaaagggtaagcaggagaacagtggatggggtcattagggacaccggaatctcacctgtgtttagagtggcaagactagcagaggtgctctagagtcagaaagacaaaggattcaaatcctagtttggttctgtattaccagaaaaatgacttaacctctccaaggatcatttctttcatctgtaaaatggggataagaacatctgcctctccatggataaaccactttgatacagtttccaagaaactgggagacaggcactcacgctggtagatgtgtaaactggttcaatctctatggatgcagtctggtaatactgctcttttttcaaacttgacaaacttatatagcgcttaaaatgtgccaggcactacaccaggcactttacaaatagtatttgattcttgaggcacgttgtaaaaatggtggcaatgattcccttcaccgtatccctgcatccctgaccttggggagtctcctcttacacagattctgagcttgactcttgctttggtcaatggaacagcagcaaatgtgacacatgcagaggcttgacaagtgcttgagctccgccctcctgggctactctatggaaccctgagaccaccatgtgaagtagctaggctactggagcatgagagattgcatgctgtcccaaatgagtccccgatgaccaacacagctgtcaagcaccagatatgtgagtgaggtcatcctagactgcccagcctccagcagacccacaagctgaccacagaagcagaaccagaagagccactcaaccaacccacagatttgtgagccaagtaaaacggttatttttttaagccatgatgattgggggtgatttgttgtacaacataaactgagagaatcctcataacaatcctattaggtagctaccattattatccctattttgcaaataaagcaactgaggcaaagaggggttaagtgacttgcacgacatataaatggcagagccaagactcaactccaagcaatctgtctacaggtctgtgctcctaactcctacactatgttgctttacctactaaaaatacaagtattcacatcacttgacccagaaattccactgctatttatcatacaaatacgcttgcacatatgcaaaatcatgaatatataagattattcactgcatcattgttgataatagcaaaataccagaaaaaaaattctagtgcaggcatacctctttttagtgtacttccctttattgaacttcacagatattgtctcttttactaattgaaggcttgtggcaaccctgtgtccagcaagtctatctgcaccattttccaacagtatatgctcatttcatgtctttgggacaattttggtaattctcccaatatttcaaacttttttattattactatatctgttatggtgatttgtgaccactggtctttaatgatactattgtaattgtttcggggcaccatgaaccatactcacatgcaatggtaaacttaactatataaatgttgtgcatatcctgacagctctatccaccaacacttcttctctctctctttccttgggcctctctattcggagacacaacaatatggaaattaggccaattaataaccttacgatggcctctaagtattaaagtaaatggaagagttgtccacctctcactttaaatcaaaagctagcaatgattaaacttagtgaggaaggcatattgaaagctgagataggccaaaagccaggcctgttgcagtgaatggtcagccaggtagtaaacgcaaaggaaaagttcttgaaggaaattaaaagtgctactccagtgaacacatgaataatgagaagtcagtgcctggcttcatggcttcaaaagacaggctgactctcctgttagggactaatgtagctggtgacattaagttgaagccaatgctcctttaccattctgaaaatccaaggagattgatgttgtttttgtgcctgctaatacaacatccattcttcaggccacaggtcaagaagcaatttcaactttcaagtcttattacttaagaatacattttgtaatgttatagctgccatagtgagcccccgatggcaaaataaattgaaaaccttctggaatggattcaccatttttacatgccattaacaacattcttaatatgaacatttacaatatcaacattaacaggagtctggaagatgagtccaactcttatgaatgactttgagaggttcaagacttcagtggaggaaggaactgcactggaaacagcaagagaaccagaattagaagtggagcctgaaggtgcgactgaattgctgcgatctcataaaatttgaatggatgaggtttcttatgaatgagcaaagaagtggttcttgagatgaaactactcctggtgaagatgctgtgacattgttgaaataacaacaaagaatcagaattttacataactttagttgataacaggcaggatttgagaggattgactccaattttgaaagaagttctactatagggaaaatgctatcaaacaacatcacatgctacagagaaatctttcatgaaaggaagagtcaatcactgcagcaaacttcattgttgttttaagaaattgccacagccaccccaaccttcagcaaccaccccgctctagtcagtaagtagccttcaacactgaggcaagaccctccaccagcaaaaagattatgactcactgaaagctcagacaattgctggcattttttagcaataaagtatttttatttaaaatatatacagtgtgccgcaaggcgcggtggctcacgcctgtaatcccagcactttgggaggccgaggcgggcggatcgcctgaggttaggagttcgagaccagcctgaccgaggtggagaaaccccatctctactgaaaatacaaaattagccaggtgtggtggtgcatgcctgtaatcctagctactcaggagggtgaggcaggagaattgcttgaacccaggaggcggagattgcagtgagccgagatcgcgccattgcactccagcctgggcaataagagcgaaaatccacctcaaaataaaataaaataaaatatatacagtgtgcttttttaaacaatgcaattgcatactaatagactacagtgtagtatgaacataacttttatatgcactatgaaactaaaaaattgtttgattcactttatttagatattcactttattgggatggtctggaatcaaacctgcaacatcttcgagttatgcctgcatattcacatttacagctataaagagaacttggggctgggcgcagtggcaccacacctgtaatcctagcacttggagaggccgatatgggaggattccttgagctaaggagagttcaagaccaatctgggcaacagagtgagacccctatctctacgaataaaaaaaattagccgggtgtgatggcacgtgcctgtagtaccagctactccacaggcagaggtggaaggatcacttgagcacagaaagttggggctgcagtgaggtaggattgcgccactgcacttcagcctgggaaacagagcaagactctgtctcaaaaaaaaaaaaaaatatatatatatatatatatatatatataaagagaacttcataaatctataaataccaatcttgtatgagagaaaaatgcgtggtgaagaagagtatacttatatgctaccatttgtgcttttaaaaatgaaaagcatgaatatataactgcttatatatgcatagattatttctagagggacagaagagatgagttaacagcaattgcttctaggaaagggaactagctgtctgggcaacagaataggaaggcttattttcattgtaagcttttgatagcttttaaattttatactatgtaaatgtatcacctattaatttttaacttaaaaggttgttatgaaaatgaaggaagccagtagatgcgtggcacaaagaaaataatcaataaatagtagctaccagcctggacaacatagtgagatctcgtctctacaggaaattaaaaaatgaggcaggaggatcgcttaagcccaggaagtagaggctgcagtgagccgtgatggtgccaccgtcctgccacctgggtgacagagcaaaactctgcctcaaaaaaaaaaaaaaaaaaaaaaaaagtagctaccattataattattctcccacaactgctttctaactttttctaacacaaataattttttaaagcaaccaatcctctgtaactcctggcttgcatggaaagagttcattttggattcaaaaataatgaaggaaataggaaggagccatgtgaagacgtgaaagaagacccaaccatggggttctctggtgttcaaagccctggacagcatggtatgcacaacattagccgtttgtcagagtccatttgggctgctacaatcaaatcccatagactgggtgacttataaacaacaaaaatgcatttctcacagttcaggaggctggaaagtccaagatcacagccccagcagattcagcgtctggtgagggcccaagttctggttcagagatagtgtcttctcacatcatggaagggacaaggaagctctctgaggcctcctttataaggttctgcccttgtaacctgatcacctcccaaagacccacctcttaataccatcaccttgagggttaggatttcaacatatgaactgcggggacaacaaacattcagaccacagcttctctcttcagagcaacccaaatactgggcatcttctgtgctcctactctgtacattccctacacaccttctctttcattcaaggacaccaaaggaaagtaattacttttgattataatagtgtgtctgcacactctctctctgcagttactgatctgccacagttgaagggctgccacatgcatctgccaaactgccaaattatatgcttctccagaaccagacagggtctggggcagaaacaaaaagtttgtaggcaacagagtgtaatgtcaagagccagggctttggagtccagcaaacctgggcacaaatcctgctctattttcctcatagcactcatcactatctgaaactacattatttgtacctttgtttactactttattatctgatttctcagtttgaatgcggcctccaagagaacaaggcttttgtatgtcatgttcctcacagtattcctagagctcagaacagcgcctgcacatagtaggtgcttaatacacgtcttatggaggtgggggctgagtatttaaaatgcagattgccaagctccagtttcagagattctaactcattaggtttgaaacaaagcctaggaatctgcatttgcagcaagcatccacctctttcatcctaaggcaggtagtaggcagatcacatgttaagatactctggtcaatgccctccatctccaaatcgtgattctccctctaacacgcatttctacggatcccatccaggctcttttctttaattaccctgaggcactgagagtaaaaggaggttgctgacccctgaatttggagttcaaacaagtaacctcaccacggccagtttccatttctgctgcatgccaaactagctggccagcctggctggaatcctgttctccccagaaacacctgagcaggtctggactagctccaaaagtataagccaggtaaatttccgtgtcagctcattgagagactttccaggggcagctggggccaattcacatttgctctatactccctccaaagacacccccttcaacacacacacacagaacacttaattctggtaccaccagccaaaaggggcccgagttcccttgggagcagcccagccgctgagaggcggaaatctctgaaagggccactcagatgaccaaagcaataggcgcctacgtaccttacaacaagccaacctcaagttccaacctagagaaatgcatggactctggtgggagagtcttattccgtttttgttttcttctttttttttgttttgttttgttttggtttggttttcttccatttcttctcagccttgtctcttcagaaaatacccctccaccccttccttggcgcgtaaactgtcttcagggtggccttaggagttctgggacaatgtggagggtacccaataggatttccttaagtttcctctactgcttttccacacatattaatgctgagatcctgtatttgattaaagcaccttccatttccaaagttaaaatacaaacgggtctggtaacttacaaagtcgccagcatcttcgtgtcaattaacttccccagacaagtaagaacgagctgcactagggcctgcgctctctccggggctaacaacaagcagcaccagtcccccaagctgtccctggaggtggaagagccactgcagctgagcctgtttatttttcgtttttccacaggcagccttggctggagggtgggggtgagcgcgggctccctggcacctgccggtaaagcagcagccgcagcccccgagggcgccccaggccaggagctgcgcgccgtcggcgggccgtgcctggaggaggctcgcgccttccaaatgccggagtgcaggcatccttcctctccccaaccccagccccggcctcgacctgtcgcccacctggcccggacctggggctggctccgtctctggggtgtgcgccaagggagccccaccgacgcccagcagagctgcccgggctcccaaagaaggaccggggctttgggcagaattctggcagccaggcgggcgtcaggggagccggagaaggggctcgccagcaggcgtggggcggagtgccgggcgcagcccacctcgcaagcgcgggcccagggctccgacgtgccagcgcagccccgaagagtgcgggcccggggtccccgcggcgccccttcccctcctcagtcccccgggggcgaccgcgctccccgccgaggtccgtccccgccgcaccctcactattcccgctgggaggaccccggcgcacgcccccgcccccgcaccccggggcgacggcgcactcaccctccgcatggtgtctgggccgtccgggcggggctcggcgacttgggcgcgagaagggctgggccggcggcgacgctcggccggccgggagctccgcgctgccccctcctgcacacgcctgcgccgcggccgccaagccggcgggggcggggcggggtagcgctggccgcggggtccccggggctctcccgggctgcggcggaggcgcggagccggccaagggcgcactgagctcgcggagctccggggccccggggcctttctgccgccgtcgcagcgtccccgcctcctcgggccgcttcgcccctctcctcttcctcgagttctggccccaccaggagcggagcgagtctccgatgcctgccccgcggcccccagaactgagctggagaagctttggggtgaaagctgggcccaccctacagggaccccaagtttgcggagcaagagtggattggcggagagcgcagatggcaattctcacccgccttaaaagtaccaccttaaaattctccccatgggatgggaaggtggcccgctaatgtccgttcctactcttcgttttctttttaatttttcagacagggtctcgctctgtcccccaggctgagcgcaggggcgcgatttcggctcactgcagccttgcgattctcccaggctcaagcgatcctcccgcctcagccttcccagtagctgggaccacaggcgagtgctccactacgcccggctaatttttgtatttttattcttttgtagagactggtgtctcgccattttgcccaggctggtctcgaactcctggcctcaagcgaccctccagcctcggcctcccaaagtgctgggatgagaggtgtgagccagtgcgtcggccctttaccattctttagattctgcgattgttttttgaaagtcctgagcattcataaagctttccgaggaggggtgggaagagagttaagagcggtaaacagcagatccacccggggctggaggaaacaccgtggaacagagaccgtctggtctcattcaggtgaaggagctcggcaggggaagaggtcagcatccccattccagcgaaacccacgggttttcctagcagtcccctgtgtgcacagctttctcttcacaatcgacctccaccccaacttttccaaacaacacgggagcccatccccaaatgctaatgcttctgcgggaaaaaaatgagaagggggaaaaatgtattccccagatcatgaaaacgctgcacacccttgagctcagaatgcaggatctaaatccgcaagaacaggatggaatgatgtgggaaggtcttccaggaagaaatctgattttattctgcttcgactgctgaacaaagtaaatcaaatagcacggaactcaaggcagcctgaattttgtgtagaaaaaaatatctcttgtttgtcagaggatcctttgaaaagcatccaaggacgcttgtgtttccaaagcggctgtgacaggtatgcaggcagacagcagtgggaatgcaaaggcttgtgccgggtaaacacttctcatgagtgtttcagctttggcattgcctttatgccagttattctggcagatcaccactgccaaagaaatacctttataattttctaacattgattgtcagcagcactatagagaccgtaatattacacgaagtaccttaatgatctaatgaataaaaacattttgtctggatttctctttggtgcctatcagcacagatagggggaggagtgactgatgtgtgagggggaaatgtaagaaacgacaattaatgacacttgctatgtcccttttttactttatcttatgatctgtatgcagtgggttttttcctccctggatatataatctcttctgattgagcttttatgtttttgcctttctttgggaaaataacaatgttagtaagtgtacttctgagccatacctgtcttatcatttcaatccacacaactctatgaagtacgtactgggatattatggtttttttagagggagatactcgagctcagagagggcaggtcatttgcccgagatcatacagcttgttagtggcacagcctggatttcaactcaggcagtctgacacgaggaccctctcacttaatgcccatgcaatactgccctcctctgcttcatagaaaaggtgcaactgtgtaaaggtgttcctggaagtaaaaacgtgagcttttgtcatagattagtcacttgacatctcagagccttagcttcctcatcagtaaaatgacaacttggactaaatagatgcattaaaggcctagccagaagtaaagttcaagatttagagtattactatgtgagtattagagtatcagtattcttgctcagcattgtaagaaatcttaacctggagatacagtgttagccacttcattggtttgtgtgatctcaccacagcgccttgttttaacactacttgtgctgctttctacaacattacctcttcctgctccttctaattaatactctttgctttgcaaatgtgatatctaatcaatttaatgttctttttttttttttcttttctttgagacggagtcttgctctgtcgtgcccagtctggagtgcagtggcgcgatctcggctcactgctacttctgcctcctgggtttgagcaattctcccacttcagtctcccaagtagctgggactacaggcacccaccaccacacccagctaattttttatatttttagtagaggcaggattttaccatattggccaggctggtcttgaacttccaacgtcaggtgatccacctacctcggcctcccaaagtgttggaattacagacgtgagccaccgagcccgtcctaatgttcatttcttactaaacttgaataagactcctggtgtgggggaggggagtcagtttcagttaagtagttgttaggatgatcttgaagtattagttagcctgaatcatttttaaattcccttcagaaaccaagaatgttattcaactgtaccaaataaataacaacacgtcagttgctaatggaacacggtcacactggccatctatggaaatcctcatgtttccaatgctctcattaactaccctgaagaatcaatttaaaagtaaaactagattgaatcagatttcccccttttttattccagggggagggggaaaggtctttgtttctttcatatgtttaaagaatcttcaaaatattttaatgatagagttgtctatctgtttcatattatcatatctccattagccttctaaactcagccatattatttgattccttgaaaaccatctaatgtttaagaacactatattttccccttttttcttaattgtttaacttctccaccagtcacaaacactgttattcagccttaatttttttttttttttttttttttttgagacagtgtttcactcttgtcactcaggctggagtgcataggcaccatctcggctcactgcaacttccgcgtcccaggttcaagcgattctcctgcctcaacctcccgagtagctgggattaccggcacccaccaccactcccagctgatttttgaatttttagtagagacgatgtttcaccatgttgtctaggctggtctcaaactcctgacctcagatgatccacctgcctcggcctcccaaagtgctgggattacaagtgtgagccaccacacctggcctattcagccctcttgatctgcaggctggattcataggtcttcatcttagtacagtaggaagtatactggcatcaggaggtcaagcttacttctttcattacctattaaggtagataggcatttgttataaaattgaacaaaaaggaactagtttacaattttacataaatagtaaaagagaataatttcttcttttcgtagataagaaatgttatcaactggcataatttcttaccagtctgtcatcctccatttagaaaaccattagtaattaaatgttgttttcctttaccatgttcctaaatatgaatccttcataaggcatctattaaatacctactatggggcggtatacattattgattaaatcaatccatatttccctgagaaagaccaagaaaaatttcaaggaaacatgtatcacagctacatgcattgagtactttatatgttccaggcactgtgaaaagccatgtatcaatctgtttcatcctcacaaaactctgcaggattgttgttagtatcttctccatatgatagactatgaaactaagatttatcgagatgaaacaccttgccaaaggctgcatgtttaattagtgacacacttctggcccaaatctgactccagaacccaagagattgaccagtgataggtggatgttaatgtatcacacagacttctctctccggaatttcttcaaagtggtgaaaacgtgagccaagaattttatatccactaaaactgactttcaagtatttatactagaataaagtgacattagttaagaaagaattcttaaaggagatgagttcttagcttgaaaaaatataagatttgaatgggaagagtgaagaatattcttttttcagcctctcaagtagctgggactacaggtgcatgctcccacacccatctctacaattctttttgttcgttttgtagagatggggtcttgctatgttgcacaggttggtctcaaactcctagcctcaagtgatcccccaacctagccctcccaaagtgctgagattacggcatgagccaccatgcccagcaagaatattcttcaaagggtacagtggaatgagccacaaagtagaggtggtgagtcaataaaccattcttagggaaccctgggatgtgtgactttttaatttttattttttattccaatatcacagtcacttaaggatattctgggtcctttattttgctgtaggaggtctgcgtggttgctatgctatttcttttcttgcccttgacaaggcctgttcaacttctctgaaccacaatttaggggcttgacattctattgatcttttttttcttcttcttctttttgtggcctgaagatgcagggtagagtgggaaagaacttacctagagctgtgtgtcgcctttatcataggaatttagtttcttctttcttctaaagctctgtgccagagttcagcccttagtggatatttaaaaagacaaaattcacccggacttgcacccctagtgctacttatatatttaattccatgctcctttttagtcttcgtccaaatgcatgtccatctgcaatctatttacacagctatctctcctactagactctgaactcctttaaagaagggactgtcttaattcttacatctccatggcctaccccaaaataggtgtgcttggtacgtgtttaataaacgaattagtgatgtttaaaccatattatagtctgctgttttcccttggttaatgtttcctatattttacatagccttaataattacctttattggctgctcaatatgcacatctcagtgatatattatcatttaaccttacctcatgttgccatttgcattgtttctactcctttgattgagcccgagagttcaagaccggcctgggaaacatagtgaactccatctctataaaaaatacaaaaataagccaggtgtggtgacacgcacctgtagttccagctactcaggaggctgaaacaggagggtcacccgagctcggggaggttgagactgcagtgagccgagatcacgccactgcactcaagcctgagtgatagagcgagtccccatctcaaaaataaaataaaatactcctttgaaattcccttgagttagtaagtagggatatgacttcatattaagaaggatttggaggatgagaatgtgattaaatggtctagacgtaggaagataagttaggaggctaacctcagtcacacaaaatggaactggtgaaggaaccaaggtcaagattaggatggtgattgtggaaatggaaagagaaaatcaatttctacatccactgccaaagctgggaagatgtaacaagggatttaccctatatagggctaaaaatatgacaaacagtggggacattgtcctatgatggggagcgctattttagcaccatggacagctcccaggttatcaggtattcgttctgggtggtatggaaccattattgctgtccgtgatggtgccttttaataaaaaacattaagtaacatttttgaacatataactagtgaaagctttacatacatttattaattctcataacgaaacaggcacgtaaagattacataatgtcgcccccaaaatcatacagataacaagtggcagagctaagtcctgagtccaggtagtctgggtttaaaacccactacgccggccaggcacagtggcataataccagcaatttgggaggctgaggcgggtggatcacccgaggtcaggggtttgaggccagcctgaccaacttggttaaaatccatctctactaaaaatacaaaaattagctgggcgtggtggcgggtgcctgtaatcccagctgctcaggaggctgaggcatgaatatcgcttgaacccaggaggtggaggttgcattgagccaagatcatgccactgcactccagtctgggcaagagaatgagactctgtcaaaaaaaaaaaaaaaaaaaaaaaatttacaccatactggaaaagacactgatgacaaactatgattatatagttataaaggctatatctttccagctttggcagtagatatagacactgtctccctttccatttccaaaatcgccatcccagtcttgaccttggttctctcatcagttccattttggttacattggaactaagttttgaatgacaaatggaatttaactacagtccagatggccaataggctacctgaagccctgtgttgagaagggttctgagttctaatctaggcccaacaaaaagcctcctgtgagcagttagcaaatgtgatagagagtgataggagacctcaggctaggaaggtaggtaagccaaataataaagggtcttggatgtgaggaaggaagtttagacatttttcctaaaagttttaaaaacccactgaagagttttaagcaagatatggcattaggatgagatttgcattttttaaaaaataatcctaataatttcacggtaaagataacagagtaaaccatgatcacagattctccttttcctaatacctgatataacgaagaaaaactgtagctcagaaagaggacaacaaactcatctgagataaggtgagatgggggccaaggagacttcatccacactatataacagttacaaaaagatctggttggagctgcccatatgaaacaagattaagatgaaaagatgaccatgtacatgtggtacagtcaaaaaagggtggagtggggaggaaggaagataatgtatgcactgtgaagaaaccagtatggaagaaaacataaacccatgaaacacatcctccaggtagtgctttgaactataaatgcctcagaatatgaacctgggtaaataagacctcaaaattgagatgaaaaaatgaccgagagagcaaaaagttgtcagagctaaagaaatgaatcaaaaactgaaacaacaccattatagacctaatatacaaattagaaatgccaaataacaggaaagacatgattgaaaattgaattaatggatagtaaaaggtttacgataatcatggtaaatgcataatttgccacagagggagtaaagtaattagggagaggataataagagaactaagagaaaatcaaacataagattcttggtgtccctaattgatgtagataatccaataagtgtaacaaaatatgcatttagacacataatacaggaagagtttttccaaaatgaagaaagaactgaatctgcagaggaagatttatactgtatgccagacaaaaagtactttaaacagacatcaaaacatagtctggttaagttaacaattttcaagggaaaatagttatttaggtatctaggcagaaaaggcaaatcatctatgaacgtgggggtgggtggggatagaatcaaaacagatacgaacatgtccaaaaaacctcaagctagaagacaatgaaacaatgtcatcagcctggacaacacagctagactctggtctctacaaaaatatattttttaaaatcagctaggtgtggtggcacacgcctgtagttcttgctacttgggaggctgaggtggaaggattgcttgaacccaggaggttaaggctgcagtgggtcatgatcacgccagggcactccagcctgggtgacagagtgaggccctgtctctaaaaacaaaacaaaacaacacacacacacacacacacacacacacacacaccatctacctagcttgaagagagaaaaagtatgacctaaaatggttacacatagccatctgcaggtattctcaagcataaaagaactcacggagtaaaacacacgagccttcttggggaaaaaaaaatccagccaatcaggagcaggagatgaatgaaaaaaaaaaatcaggaacagaagacaccaaggtaaaaggtaaaagtgctgatggtcaacagttcagtatttaaatagagaactaagattaaacaactgatggaattctagcagtggaataaattgaaaatgttacaaattctgacaaagtaaaaataatagaaagatttttaaaattaggaggtgaaggagagtgaaaggaagtgtgagtgctaattacttcatcgtctatctgcagagaaccaattgagatcatccaaaattgaaacataaaagaaacactcaaacttcttaatgatttctgcagttttttcttaacctcaggcatatcttagtaacttctcccatgatggaggaaaaaaaagggttatctgaaactgaattacttcagtttaattattttttattgtgttaaagtaaaacaaacttaaattcagtaattaaaataaccttggtagtcataaaactctctctctctctctctctctctctctctgtctctcatcttctacctttatatataaatagagaggctttttgaattatgttaatactcatttctgggtggtgagattttgagacgtgctgcttttcttttttgtacttttccatattgcttaaaattttttttaaggaacagatatcatttttatttaaaaataattactttttaatgataaatgaatatggctcctaagtataattcaacatggaaagtcatccatgatatattgctgagtgaaaaggttggtttaaaatttcatctgtagtataatctcatttaggtaaaacctacatatcatacatgcttacgtgttcattaaaaagtctagaaagatgaacaccacaatgttaacagtatttatttctaaagttggtgtagagaattgggcttataatttctcagtatcattttctaaacctttttatttaaaaataaaacaggctgggtgtggtggctcacacctgtaatcctagcactttggaaggccgaagcggacggattgactgagctgaggagttagagaccagcctaggcaacatggcgaaaccctgtctctactaaaatacaaaatatatatatattagccggatgtggcagcacgtgcttgtagtcccagctacttgggaggctgaggcaggagaattgcttgaacctgggaggcagaggttgcagtgagcccagatcatgccactgcactccagcctgggcagcagagccgagatagtgccatggcactccagcctaggtgacagaatgagactctatctccaaaaaaaaaaaaaaaaaacagatggccaggaatggtggctcatgcatgtaatgtcaacactttggaggactgtggtgagaggatcacttgaggccaggagtttgagacaaggctgggcaacagagtgagatcctgtctctataaaaaaattgttttaattaaccaggtgtagtggtgtgtgcctgtggtcccagctacaagcaaatgctgagagattttgtcaccaccaggcctgccttacaagagctcctaaaggaagcactaaatatggaaaggaaaaactggtaccagccactgcaaaaccataccaaattgtaaagaccactgacactatgaagaaactgcatcaactaacaggcaaagtaaccagctagcatcataatgacaggatccaattcatacatgacaatattaaccttaaatgtaaacaggctaaatgccccaattaaaagacacagactggcaaattgaataaagagtcaagacccattggtgtgctgtattcaggagacccatctcatgttcaaggacacacatagactcaaaataaaggggtagaggaatatttaccaagaaaatggaacgcaaaaaaaagcaggagttgcaatcctaatctctgataaaacagactttaaaccaacaaagatcaaaaaagacaaagaagggcattacataacggtaaagggatcaatgcaacaagaagagctaactctcctaaatatatatgcatccaatacaggagcacccagattcataaagcaagctcttagagacctactaagagacttagactcccacacaataatagtgggagactttaacaccccaatgtcaatattagatcaatgagacagaaaattaacaaggatattcaggatttgaactcagttctggaccaagtggacctaatagacatctacagaactctccatcgcaaatcaatagaatatacattattctcagcaccacatcacacttattctcaaattgaccacataattggaagtaaaacactccgtagcaaatgcaaaagaatggaaatcattaacattctctcagaccacagtgcaatcaaattagaactcaggattaagaaactcactcaaaactgcacaactacatggaaactgaacaacctgctcctgaatgactactgggtaaataacgaaattaaggcagaaataaataagttctttgaaaccaatgagaacaaagacacaatgtaccagaatctctgggacacagctaaagcagtgtttcgtgggaaatttatagcactaaatgcccacagccccacaggagaaagcaggaaagatctaaaattgacaccctaacatcataattaaaagaactagagaagcaagagcaaacaaattcaaaagctagcagaagataagaaataactaagatcagagcagaactgagggagatagagatacaaaaaaactcttcaaaaaatcagtgagtacaggagctggttttttgaaaagattaacaaaatagaccgctagccagactaataaagaagaaaagagagaagaatcaaatagacacaataaaaaatgataaagggggcatcaccactgatcccacagaaatacaaactaccatcagaaaatactataaacacctctgtgcaaatccattcactttttaaggtttgcaaaataaagatttataattctgcatttctttttcattcattaattgaaatgcttttataaagaggtaatttccccccattggttaactagtattacagtttatacagaaaaggcaaaataaaaccttgattctatgcatttctctcccagttttcaagataatgaattggttccctatcatcttctgaaggtgaacaatcttttaaaatattcatatgaattcacgaatttaaacacttttgataattttaatcaattacaattattaacttccatgaaaactcaaattgtcctgtttttggccaataagagccccttcaatttggcttctcaggttttttttccccatgtacctagatatgtttgatatttttcttgctactgagtataacagaatgctctaggctcatctcatacattttctgtcccagatagaaatcaaccatttctctgaaaattatcagttttcccaggaagtcttcatttctcttagtggtaaatagtgtttcaagaccaggatcttggtactaggaatgctcctggctgctgacttggtcagaaattttaggcctcttcaggggacagagctaaactacaagactgtctatatagataaaatctataaactatatactctctctagctagtattatgtgatatatatcatgctaacagcagcaattccaagtcattcttgtttttatttagcctcttatgtattatatcttcttccagatgagactcctggtagttcgagaccagcctggccaacatggtgaaacctctcctctactaaaaatacaaaaaattagctgggcgtggtggcaggcacctgtaaccccagctactcggaaggctgaggcaggagaatcacttgaacctgggaggcagaagttgcagtgagccaagatcacacccgtgcactccagcctgggggacaagagcaagacttcatcacaaacaaaaaaacaagactcctggttcttaagaacacaagtgatgatagaagtagaatatcctataattacttatttatttatcacacaactctttcagaatggcaatactaatacactaaatattactactgagaacatttaagaacatttttgtatttactctccctattctgctgcctcattttttaactttaatttaatttttttttttagcaacagatctcactctgtcacccaagctggagcacagtggcatgatcatagctcactgcagtctcaagcgcttggcctcaagtgatcctcccacctcagctcccaaagtgctgggattactggcatgagccactgtacctggacttaatatttgcactatattacattatctgatcatttacccattacatgatatcctgttttaacactcacatagtcttaatttaaaaacaactgtatttctaattctcaccaccagtttctgttgtgtgaatcttattctcaagtagaatcctcgggaactgttaataggaacaatatttcttaagttcttactgttgataacagtttgtctattgataacagtcatcgagtgcttaaaagtttacagaatagaatgaaacaattaccttttatttaaaagccactaaaagatattaagagaatgacagaagagatgaaaaaaatttactgaatataaagttcttggctcacatgttcttttttcttaagtatcttaaacatgttaagatatatttattgagtatcttaaatacattaaatatgttatttaattttctcatgaggtaaatcattgctctcaaaaattctggtgttgatataattttttttccctcgctgtttctgcttagatgctcaaaggaaatttttcttctttaaagcagagtaattttattggaatatgtctaagtgctgtcagtttcagtatgatattctccagtgtgcagcatgttcattcatatatagcttcaaatctttttttttttacttcagggaaaaataatttttaatttataattttagaatgcattgttttcttcctttgctttttgtcttcagggattcctgttatctctatcttggatcatcttctatcttgaatatctgtcactttctcttgacagatattcctgtcagataacaaaattcctgtcttaatttctttttgacttaaaaaaatctgccttttcacattctgttcttcttttttcactctgttgcccaggctggagggcagtggcatgatctggtctcactgcaacctccgcctcccaggttcaagcaattctcctgcctcaaccacctgagtagctgtagctgggactacaggagtgcaccaccacacccagctaattttcgtatttttagtagagatggggtgtcaccatgttggccaagctggtctcgaactcctgagctcaagtgattcacccacctcagcctcccaaagtgctgggattacaagtgtgagccaacacacgtggcccacattctatttttctgttggatttatttgtccttagttttccctttagtcttcattcacaaagtttagtcttcatttcttttatttctaattctttcttgaagtttatcacctcatttaaaattattttttgtaatttgatttatgttatttttcatatcttctgttattctcttaatatcttttagtgacttttaaataaaaggtaattgttttgatctattctgtagacataccttgctgtgtggttttgtctgaatggatgttgttttgtttcacatatcttttattcatttttcagagacaaggtcttgctgtgtcacccaggctggactgcagtggtgcaattatagttcattgtcccacctcagcatccctaggactacaggcatgtgccaaccaattttttttaaattttttgtacagatggggtctcactatattgcccaggctggtcttgaacgtctggcctcaagtgattcttccgccttggcatcccaaagtgctgggattacaggcatgagccaccacacccagcctcttttattcttaaaataactttgtgtgggatttggtcttgagactttttattgcttatttttttatgtaaaactcattttcctgaaacccgagaaagaagtgtgaccgaaggtaatatttctaacttcatggaactcccttttctgatatttttataagaagctaaaaaatatactgcagcttgttttctgagatttcctggtccctttctttttaccacttatatctgttccctccccccgccaacccccccaccccccccaccccacttacctccaccccttctctactgcctacttccacagtttctcttcaaggtagaaactttcagtatcctgaaagggatccctggctggtcagttttaagagttctaggagccggactgctccagctccttcaatgtttttacagcaaactccttccactcacctgctattggagttggcaaacctcttcccagttacaaatgctgtcctcagcttggcctgccatgctttccagtgaacgactgttgactatttggggattctcttgttctcagatccatcagaagtcccacagagaaagcccctgtgctttctcctgcacagatgttagtaccatgcaggtctttgtggatctgggagtttgcagggatatcttctcaccaagttttgttgtaaatgtgttcatgggtttttgatttggctgtctagttgttctgtttttatttgggaattcaaagaaattccaaatactacgctgcagctattatcttcccagctcactttattttaaaaatatttttacagcaatcatgtttctctggggggaaaagcaataatatttccatttttggaaaaaaaagatgcacctggccacattctattggatggctttgagggatttaaacagatacaatcagctgatatgaagtagcacagctgtaccattgtcaaaatatttaaatactttcattccaactagaaagtagccagtgctccaacccccaatgcctgtttctcaactgtcctttccctaggtccccctgactgaagtagaagctaaagagtcaatgtctatcacaagggggggtcctgtgggctcctgctccagctcaatggctgattggtcaaagcccatgctgtaatgttggtttaatacttggaatatcacctctgagtagactccatgagatttggagacagtgtgggggaggtgaaagtgagggtttacaggccttctgaatgggcctcagcagaatatttcaaccaacatttattaagcacctcctgtatgccaggcactattccaggcaaagaaggtgcaaagacaataagacaacgttcttggccttggggcaaccacagtctagtgctctgtctttggggctacttatcctctggaaggatgccaatttcactgaattgcattacagagctcagcctctgagcagaaatgagaaaagaagaaaagtgcggacctaatggcaaagctcttactgaagccatgacctaaacaagctcaaatctctctacctttggaacagtgactgctgtaagaggcctggcagctaattaaaacatgtggtaaataagccaagcaaggaactctctgtccttgtacacaatgattcgagcggtctccttagacacaaaagcctgtatccttatctatggagcaaatcaactattaaacgattcatgttctgtgtcctcagtggactgcaatgctttttttgaatgaggaaaaagagacctggaaggaaatctggttggaaacacagtgtttggctaaataataactgcagtttttctcataaaagatttgtaccctgaggagtgcaatgcatttgaggagatgctctgatttttgtttgcccagttactggaagcacaaatcactctgtagagggtggagtggaggggctgggatcaaatgggactagctgtttactgtcagagcccaatgccataagggaaaagttacctcaacacccttatttccccaaagttaataaattccaattaaccacatttattaagcaaatatgtattaagcacttactgtgtgtcaactgtagtccctgctataaccaaattccaccttaaccatcaggaaaattaacatgcagaaaccggctgggtgtggtggctcgtgcctataattccagcactttgggaggccaaggcaggaggattgcttgagtccaggaatttgagactagcctgggcaacaaattgagaccccatttctgcaaaaaataaaaaattagccagctgtggtggcacgcacctgtagtcctagctactcggaaggtgagatgggaggatggcttgagcctgggaggttgcggctgcagtgagctgtgatcatgccactgcactcagcctcagcaacagctcagccttgcctctgtaaagaggtatagaaacccagtggttcccaaagctgaagtaatgcttaaacaggaatcagacgtacattatgagtaggacattattgtttataccttcagttgtgacttccgagagactgatcacagtcaagacaacttgattagtctgtaggagttcatggggcatttgggaacccctacctcagagcaagaaaaacaggccctataaattatcatctgacaaaatgagaatgttatattggcaactgctatcattaacttctagtaatgtagcaattttcaacgcaggaagggaatgtatcaaaaaccttggtgggaaggcaaaggaaaaataaaaggtgctttttcaaattacacgtcccctcttaatagatttgtgtatgttagtggttaagagcacaggtttcggagtcagactgcttaaatgcaaatcctggctctaatccttactagctgtgtgactctggttaaattagatagctactgcatgcctcagtttttgcatctgtaaaatgggaatgatgacattcatggtatcatacaactgttttgaagatgagatgagttaacacatgtaaagtagtacttagaaaagtgcctcccagctgggcttgataactcatacctgtaaacccagcactttgggaggccgaggtgggtggactgctggagtccaaaagttcaaggccagcctggacaacaaggctaaatcccatctctacaaaaagtatgaaaaattagctgggtgtggtgccatgctcccagctactcgggaggctgaggaggaaagacagattgaatccgggcagtggaggttgcggtgagccatgatcacaccactgcactccagcgtgggcaacagagcaaaactctgtctcaaaaaagaaaaaaaagtgcctccctcccaggtcttgtcccactgctgcctctttctgacctacatcaaccatcttagtgagtgtcccaaatctcagaccctgatagaatcaagaaggggaaggaatcttggaggccagctgctcttatccattcaggaatcctctctctgaaatcttggccacatcatcttgaacgtaccctaatgagaaagtttccttcccgctaaaacacccgttacatctctggacacttgaaaggtcttctttgcattaagctagagtctgtttccctgtttcctctgcctgttggaatcagagataacaaggtgattcacatccttttcaatgatggaggccacaaagggtatgcatgagggctgtagggacagcttgcatggattgaacctcagcttcaccatttatcggctgtgtgatcccaggcaatgtaatctctctatgcctcagattcctcatttgcaaaatgggcatcccaatactaccaatctcccagggttgttgtgaggatcgaatgaggtaacatatttagagcttggtacctaagactcagtccattttatcatgatgctcatgctgtggatagcccctcagcatttgcttcttcaggctacacatccctaattccttcacttgttcctcaaccagtaattcccaacacacctcacccctctcctttgagtagctccagttgccagtgttcttatttatttcttcatttatttatttattcattttctttttctttttttgatacaaggtcttgctctgctgcccaggctggagtgcaatggcacaatcacaactcactgtagcctcgaccttcctgggctcaagccatgctccaacctcagcctcccgagtagctgggagtgcaggtgcacaccaccatgcctggctaatttttgtattttttgtagagattgggtttcgccgtgttgcccaggctggtctcaaaatcctgggctcaagtaatctgagtaatctgcccgactccgcctcacaaagtgctgggattacagacaccccaccagtgttcctctttaattatagtcgtgtgctgtgtaatgacattttggtcaacaacagactgcttatacacagtggtctcataagattataatactgcatttttgctgtaccttttctatgtttagatacactaataccattgtgtacaattgcccacatattccgtacagtaacatgctgtacaagtttgtaacttagagcaataggctataccatatagcctaggtgggtagtaggtgataccatctaggtaggtttatgtaagtgccctctatgatgttggcacaatgatgaaatagcctaatgacacatttctcagaacatgtcccacttgttaagcaacacatgaccgtttatccccagaactgagcccaggacttcggtgggctgtggtccacaaagatcaagatgtgccatcctctccccagcttggttgtttattcattcatgtattcattcacaaatgatgttaagagtctatatgtttattaagcgaccctaagagagaattggcttttttttagtgcacttatcatactcttgactcaaagtgaacttgcagtgggctaaaagaagggtgagtaaactcttctgtaaaggggcagatagtaaatgttttaggctttgctgttcatatggtccctactgcaaccactcatctctgctgttgtcacacaaaggcagccacagacaaaatgtaaaacttcatttacaaaaataggcaactgcctgaatttggctatgagccatagtttgtcgacttctgaactaaaacataacataaatgtgttatttttccacctctcacctactgcctcgtgtttgcagttggcggttgttgttttaacagagtgcaagtcctttcatttatctctattcagctttatttcattggtttgcccattcctctaccctgctgagattttcctgagccccgattgtgccactgaccaaagtaacccgtctctcttaaccttgtgtcatcatctgccaatgataaatgtgcctttttatatatttatccaggtaattgattaaaattttgagctggaaagatctgagcacagagccttaatttttgcgacaagcaatgtccctccttgtaaattctgtatattgttcaggactcagtccagtgccacttcttccaggaagctattcttacagctgctctcccttcccaagccaccctgtccagtctgaggagggtgccctttgaatgtaagtccatcctaccttccacatacctctaccctagcactaccactgccctggaattatgcctcctctgttagactttgtactctgttccaaatcatggcacagagtaggtgctcaacaaatgttgctagaattaatgaataaaggaatgaatgaatgaatgaatgaatgaatgtgtggtttcatgtatgggtcctgcttagcatcttcccttcatcaaaagttacttttggggggctagatgcagtgattcatacctgttatcccaatacttttggaggctgaggagggagaatcacttgatgccaggagtttgagaccaacctaggcaacacagcaagaccccatctctacaaaaaagttttaaaaatagctaggcgtggtggcaagcacctgtagtcttagctccttgggaggctaagacaggaggatctcttcaccccaggagtttgaggttactgtgagctatgattgcactaccacacttctgcctggacaacagtgtgagaccctatgtcaaaaaaaaaattacttctttcttgttgccttcctttgatcagcagcttggttactggaatttaataaactaactggagaatggtgtaagtgcaagataacagctcaatgtaccatctctatctcttcccagattgcctgggaggttatgttttagaagagtgtccaatgtccttatctcaaaagtctaaataacatggcaattttaggtgctataggaaagagattttggaaagaaaggtgaatactttatcatccccatctaatcatacggcactgtgttctccttattaggcttttgcataagaaaaacctgaacacagcttctctgaagaatatgtataaatgtttgtggattacaaataatattaataaacaccatctgcaccccttagagtgttccaggcttgtccccagagagtctctaacaaaacaactcttagtctcatctttaaaaccaatatcatgctgttcaattaccaggaaatgcctgtctcaaaatccagcctcatcttgagaataaacaacaatatataaagatagaattggtgttatattgttgtcattgttaatgaattattgaaaattattgagggtctcattcacactggtattggggtagatgaatcctgtaccccgaagtacttggagtgacctaactcctctttggttagaaattcaatagggagtttcctttgtcactagtagttgaaaactgagggttaagacctgggatttatttcccaaacacagatcactcagctccttgacatatattctacttttttttttttttaaattagagacaaggcctcactatattgcccaagctggtctcaacctcctgggctcaagtgatcctcccaccttggcctcccaaagtgctgggattacaggcatgagccaccacacctggcccaaaatatattctactttaaatcagagtaaggggtgcaaactggtggctccagggccaagtcgaggtaggagctatgtacagtgttgtcttctttcctcccttgctccctctctcccttctgtcctttttttatgtataatatttgagctagattttcttttttctttttttgagatggagtttcgctcttgttgcccaggctggagtgcaatggcgcgatctcagctcactgtaacctctgcttcctgagttcaagtgagtctcccgcctcagcctcccgagtggctgggattacaggcacctgccaccatgcccagctaactttttgtatttttagtagagatggggttttgccatgctggccaggctggtctggaactcctgacctcaggtgatccacctgcctcagcctccgaaagtgctgggattataggcgtgagccaccccgcccagcctaggttttcttttagcagagcatgcaccctcttattcatcatagtttcttccattccctgttgcctgtcctacaccaggtagctttacacatttgaattattattttcctggcccctgaagacatttgagttctgttttcagaacactgagcaatttgcaaaagggagggatatttataacagttagtatttcagagcatttactaaggacaggccgtgcacgagaggtactttccacatattatttcacatatcctacatctttaggaggctaagaaagatgaactagtccagagccacaaagctggtagatagcggaggcaggactgataaacagagcctccccagagtaagccacattacaacacatgacagtgtgtgctgttctgaaacaatcacacctggtcgtcttcttaaaaatttaaagaaataattacagaggcttcaactcagcagcaaactacaactggatctgaaatttaaaacttagaaaagagaaaaagcagaaaagccccagagcaaaactgttaaaaaaaaattacccgcgatggcagaaatcctaaataaaatgagaacaagaggtttttctaggctgcttttgaactaactgttcttgtgtgcatgtgtatatatactatattttgtttaaaatatttttattttactagatcctgagtggaaaattttatttctctcaggacagtgcaaacagagcatcagagccaaaagctggcagctgtgtcctcagaagcagaaccagaatagggaaggggtggcaggaaactgggaaaattctggaaacctctggaaaattccaggctagtcaatcttcagtggtgacagaagccctcttaccctccctctggtttcctaacaggggccaagtgaaggcaatacagtaacagtcctgcaaactactaatcttctatcttcaggaagggctgcctttactgaattcacctttatcagggcctgctgctgtgctctgtgctgaaatactgaggcacagtccctgcccttctggagcttagaatctaaagataaagtctttccctttaaattccacttactcagaatttcaaatatttctggcaaccattttcaagcatgaaatgttttctggaaccctgagatttttgtcagacgtggactgtatcctccagtatgtagatcccaggatgctagggactgagttgtcttccttctccctaaattcatatgttgaagccctaatcccacatgtgactgtaccagaaataggggctttaaggaggactaaggttaaatgaggtcataagggcgaagccctaatccaacagaactggtgtccatgcaaaaagaagagatactggagctctctctctgcatgtgagtcccaaggaaaggtcatgcgagcacacagtgggaaggcagctgtctgcaagtcaggaagagaggcctcaccagaactcaaccatgctgcacccagatccagcccccagaactctgagaaagtaaatttatgttgctaaagccactaagtattttgtactttgtttagtaacccaagctgatgaatatacaggaaaacttccagaccatgtcatattgatgaataccaagcttgcttgtgcagtggggagctggagaaagaatcgtcctcagtgtgaggctgttggcgtctcatcttcactcttgtcttctgaacttgcctagtgcatctgaatttgaacagtaaggccattccttgggaagcaaaacctagaagaaaaagacaagctagtacactttttcaatatgcatcaaaacttggatcctaatcacagctaagaaggagaaaccctctacgaggaactctaaggtggttagtgatcaatgaattaaccaggtggtcttccctaattatagaatctatgaagaggaaaacagtaaggcgtatgtgtaaccattctgcatgtgaagttctatatggttgtcccttggtatcttagagggattggttccagaacctcttacatatgctaaaatgcctaagttctgatataaaatgatttagtatttgtatatgacctatgcatatcttcccatatactttaaatcatctctagattatttataattacctaatacaatataatatattgtattatatattatatgtattatatgtatagatgcattgtatataatacctgatataatgtaatacctaataccttcctgctaaagggaacacagtgttccttaaaaatctctctcaccatcatctctcatcatctttctattatcaatcagatcatcagccgggcgtggtggctcatacctgtaatcccaacagtttgggaggccaaggcaagtggatcaactgaggtcaggagttcaaaaccagcctgaccaacatggtaaaaccccatctctactaaaactacaaaattagctgggtgtggtggcacatgcctgtaatcccagatatttgggaggctgaggcaggagaatcacttgaacctgggaggcagaggctgcagtgagccaagatcagatcaagccattgaacttcagcctgggcaacaagagtgaaactctgtctcaaaaataaaaaataagatcatcaatgggctgcatagatacccatgcaccctgtgcatagtaagttctcaataaatatttattgataataatgacataataattttactctcacagttgcccttgaccaatgccagcaacagcatcattcagtttggaatttagaaaccaaatcttcatgggatcaaccctggatgtctccaacaacagatttcctggaagttttgggatcttgctgatatgacctctcgttggtgccaaattctatcaaccttgaacacatctccagaattttgtgactattctaaagaagacttttgtgctgaggattattaaaaagaaacttcctgtgacatctctagtccagttggaaacaaagcaatcttactcctgctaagcagatatgctgctccaggctctgagcatgtagctggaagggtttgctgctccctgcaggcaatccccatccatgactgcacttgcagctggcgcctgagacaactgctccatcctgggaagcagcctttctatacctttctgagagccctgcataacacacaataacatgttggattatttaacattacatgtaaaggtcaaggggaaaaaatggtaatgcaatgctaagtctaaatgacaattgggaatgagtaaatctggttgtcttggtagttggatacctgctttctgctcctaatagtattaggtggcttagccacctaagctgtcatcccctattccattagattctcctatagccttatgctctatccctaatctttttaagaatatgctactagcttctgaaggacaaatatcagaactatgaaggagacaaaggaactccagttataataagataaatgcagatgaaaaccacactaagacaccatttctcaatcatcagataagcagaaatataatattagataacatactctctctgttggccattccaagggctaataggcattcttatacattatcagcaggaatgcaaaatggtataacttctataaagggtaatttggcaatatcaggcaaaattatacatgcatttaccctttgatgcagcaaacccacatgaagactctatcccaaaataaaagaacatgaaaagactggaatagcaccactaaacaaaccctaatgaaatgaaggatctagacaatgatcaccagcagctgttaggaacacataaagagagacatcatgtgcttcctggtgaagttcacaataaaccctgtaatgtattattgcaaaaaaatcaaactgagtcagaccaagcctctagatttaactgtcaaattataggaactataagggacagaggaacatattaaacaacactttaggcgatgcaatgaacaaaatccagactgtaggaaacagtataggataaacagtctggctgagaatcttccagagttcgtgaaatatatgaatccttagatttagaaatcacagtgaatcctaagcaaaacatatagaaaaaaaactatatttgcacacattgtattgaaaatggtaaaaacaagatcttgaaagcagccagagggaaaaatattatccagaaagcatagctcatgaaaaataggagaaactaacagattgaaaccaaaatctattgtttttaaatgacatacaaaatctaaggtccccttcccagagacgggctacctattggcaacaaggagaaataacatagatacataaactctctgcttaaaatcactgtttgtttcaaaatcactcttggatgggtgcagtggctcatgcctgtaatcccagcactttgggaggccaaggcgggtggatcacttgaggtcaggagtttgagaccaacctggccaacatggtgaaaccccatttctactaaaaatacaaaaattagtcgggtgtgatggtgcgtgcctgtaatcccaggtattcaggaggctgaggcagaagaatcacttgaacccaggaggcagaagttgcagtgagacaagatcacgccattgcactccagcctgggcaaaaagagtgagactccatcccctgcaaaaataaaataaaatagaaatcacttttgcctatttttcttatttctattaaggcgtgggaagaaactgtgtccaggtaggagagttgaaattagatgtcactattagtccttgatttctgctcttaggaaacaaataaaagcagttagccagccttccttgcttggcacggtcactttgttgcgcttgcaaagatttggttgggttctgagcgacagctctggtgtctgccatcaacaccaagtgggagataccaccccaggggtgaggatggtttgcacaactaaagaagccactatttgggctgaagacaggagcagcgggagtggtgcatctgataagataggagatcaggcaagtgcaaaactcttctggctggtctctgcctcctgggatcctacaacttctattatgtgaaatcaaaaagaaccacagtacaaactgcctcagagaagagaagcagtcttcaatttggcagaccccagaaccacttctgtgatcattcaggcctcactgaacaatcaaccagagcaggacaatacctgctctggcttggaaaaccactgaaccatggcacttggtgggccagcctcagccaaggccatagggaccttaactggcacagacagagatctgagcaatacggcccctcagacaaaggcttctaccatccctgacaacaaatcaccccatctcagcttgggctgagactttcacttccttcccttgtgaagggaaggaagccttcccttcatggcacatgagccatggaaaaccagcacggtatgtacccaactcagtgcatgcaattatctcatttagttcctaccctgtgaagtcgtacctatccccattatatatgggaagaaactgaggctgggagatactaaataacccgttggtaagtggaagaacttgcaagactgggtgactgcaacacccacattcttcaccactgccataaaatgtttccacatattcaggccagcctggcggctcaagcctataatctcggcactttgggaggctgaggtgggtggatcacttgagcttaggagtttgggaccagcctgagcaacatggcaaaaccccatctcaacaaaaaaatagctgagtgtggtggcatgcacctatagtcccagctagtcaggaggctgagataggaggatcacttgggctgaaaaggtcaaggctgcagtgaggtgagatcacaccaccgcactccagactgggaagcagagtgagaccctgtctcaaaaacaagaaaacaaaacaaaacaaaaaaggtttctacatatttaagactcctgctcctaatgccttcgatgaaagaaattcaggcttgcacaccccggctgatttcataagcttcatctaataatctttatcccttttactcttagagagaaaactgtcctactggcacccttcaaaatatttactctctcaagagagaagaggttgtcctccaacactttctcaatcttaagagtgcctggcacgaccaggtgcagtggctcatgcctgtaatcccagcactttggaaggccgagacgggtggattgcctgaggtcaggagttcaagaccagcctggctaacatggtgaaaccctgtctctacagtccccgctactcaggaggctaaggcaagagaatcgcttcaaccagggaggcagaggttgcagtgagccaagattgtgccactgcactccagcctgtgtgacagagcaagactccatcttaaaaaaaaaaaaaaaaaaaaaaaaagagagtgactggcacatcgttcctccaaaaaatacaataatttttttctattattttagagatgggtatcaccatgttgcccaggctggcctcaatctcccgggctcaagcagtcctcccgctttagcctccccaagtgttagaattacaggcgtgagccaccacgctcagccatagaagcatgtctccagccctagagctggaccatttacttcagtgtctctggccaggcacactgaggatgataaaggctgctgatgccacggcactgactgcaccctcaggagagcaaagcattgccaaagaagcccaagctgttcggtggatgaacagatcccaggtacctggaaggctgagatggaggatcacctgagcccagggaggtcgagactgcaatgagccatgattgtgctactgcacaccagcctgggtgacagagtgagaccctatctcaaaaaaaaaaaaaaaaaaaaaaaaaaggcccggcacagtggctcacacctctgtaatctcagcactttgggaggctgaggtgggcagatcacttgaggtcaggagtttgagaccagccctgccaacatagtgaaaccctgactctactaaaaatacaaaaaaaattagccgggcgtggtggcgcccacctttaatcccagctacttgggggtgctgaggcaggagaatcacttgaactcgggagacggaggttgcagtgagccgagatcgcgccactgcactccagcctgggcgacagagagagacatcatctcaaaaaaaaaaaaaaaaaaaaaagtagcaggatatgccccggctgcctgctactctgtacaaatgataaccaaaggcacatttcatcaaggggctattgagaaacacctggtttacaaggttttgaaaagttttgaaataaccatcacttgagcttcattcagcagttggagaatcaacccaaagatagaaaggtgatatttgatgtcctgtgactactgcatttatttcagtaatatcaatattggcagcaggatgggcctaaattgggtggggagggtgtttgcttcttaattaaaggcccttcctcacctcatatctattctcattagtcagtaactggagacagccatctatgaaagattttgtttttcaacggtgttttattttattttcctaaaatgtcagttggatggccaaggaaatttttcccccaagagtccttggagattattttgagccgaaatagccaccatcacggttggctgagcactaaatgaaaaatagtgttagatgtcaaattaatattttaggaccgaaaatgtacaaaccctccctggcatgtcagccagcgtcatagcaagtgttagctacaaaactgcagggtgacgactggaaggctggagccacaagtggccatcagttcaagagctgaaatccaagagcaggagagagaattacagggagtaggtctctattcatcaaatttggcagactagaggggcaagaaaagacaagagtgatgacgtttttaaatggattcattttgtgagatgactgctgggtgaaaagcagtggattagggctttgtcaaaaccacagctgaagccttaagagaaaaatatgatactgtagaaaatgacaatggaaaatatagcaatgtgacaaaagcaggctacaaaccaaatgtacaacattgtccaatttttgaaaaataccatgagagggggagcacacacaagtgagtgcaagaagcctggttttgccacagaatgttctagaatgttttcttaaaaaatacagatcctttggccccacccctagaggttctaatttattagatctggtttgggtctcaggtacatgggtttcttttttttatactttaagttgtagggtacatgtgcacaatatgcaggtttgttacacatgtatacatgtgctatgttggtgtgctgtacccattaactcgtcatttagattaggtatatctcctaatgctatccctccccctcccccctccccccaccccatgacaggctccagtgtgtgatgttccccaccctgtgtccaaatgttctcattgttcaattcccacctatgagtgagaacgtgcggtgtttggttttctgtccgtgcaatattttgctcagaatgatggtttccagcttcatccatgtccctacaaaggacatgaactcatcctttttatggctacatagtattccatggtgtatatgtgccacatttctttatccagtctatcattgatggacatttgggttggttccaagtctttgctattgtgaatcgtgccacaataaacatacgtgtacatgtgtctttatagcagcatgatctataatcctttgggtaaggtatacgggtttttaaaagctttttaggtggttctctctgatatagagcaataaagagagggttggggggaggagaaaaaagatcagagatagctttatggggcattccattttttttttcttttctctttttttttttttttgagatggagtcttggtctgtcgctcagactggaagctcagtggcacaatcttggctcaccacaacctccacctcccgagcaagcagttctcctgcctcagcctcccaggtaggtgggatcacaagcatgtgccactatgcccagctaatttttaaaaaattttaattattattatttttttagtagcgacagggtttcaccaggttgaccaggctggtcttgaactcctgacctcaggtgatccacccaccttggactcccagagggttgggattagaggtatgggccaccgtacccagcctcatggggcatttatgatttaaatgttttgccagtggattttctatatttacatattgctccatgaatatgcattgtgtttactctcagaaaaggttattagtacaaattctaactcaacttcttaggagaaatagcctctggccacaataataataatgattaatgcttacaaagtgcttcctgaatgccagacacggttttattaatgctgccatttagtcttgaaaataactctgatgtaggcaccagtgttgcagccattttatagatgagaaaatcagaggccagagattctagctcagacaactagaaaaagacacagtatgagcatagatagggactgttactgggagcctgaggcttcactcccacattctatttcatcctagtgaacaggatgcttcggacaggaagaagtctgtggttcagacacccacctgaggcactgagggctcccctcagatcacatcatcccatgcactctggctcctgggcctcaaggtgcctgctttgagcttccctgggaagtcatgggaagtttctccctgccttcccatcagtgtcctgttccttccagagacttcccagagtttgctacttgcctgacaggaagaattctatcgccaggcaagctaaacagagggagaaagtatgaagaaattgaacaccccaggacactggctggctattaaggcatgccatcaccaatcctttgaaaaaattcttaattggttttttaattgaagtggagaatgaacttctgtgaagtaccccataccattgtacatgaggatacagatatgaaatctacaggggttttgactggagagaggacagagcattcattgagattatttccccattttgcagatggcggtgccaagtcattaagtaatgtcctaaaagagaaaagaatgagttgatgcccctcccagaaccaaaggtcttcactagtacaaaaatgttgggagccagccccccaaaacctggccataaactggccccaagacttgccataaacaaaatctctgcagcaccataacatgttcataatggctctaatgggcaagctggatggttgtgggtttaggggaatgaaggcaaggaacacctggcccgcccagggcggaaaactgcttaaaggcattcttaagccacagacaatagcatgagcatctgtgtcttaagggcgtgttcctgctgcagttaactagcccaacctattcctttaattcggcccatcccttcacttcccataagggatacttttagttaatttaatatctatagaaacaatgccagtgactggtttgctgttaataaatatgtgggtaaatctctgttcagggctgtcagctctgaagactgtgagacccctgatttcccacttcacacctctatatttctgtgtgtgtgtctttaattcctctagtgccactgggttagggtctccctgacaaggctggtcttggcacaaagtattctgtggattttaaagattttacaaaatcagtaggtattttaattcattctctttcatggtaaggttgccagataaaacacagcatgccctgttaaatttgaattttgaataacaaataattttttgtaaagtatgtcccaaatattacataaaacatatatatatatgttgttgttttgttttgtttattttattttgtttttttgagacggagtctcactctgtcgcccaggctggagtgcagtggcacgatctcggctcactgcaagctctgcctcccgggatcacaccattctcctgcctcagcctcccaagtagctgggactacaggtgcctgctaccatgcccagctaatattttgtatttttagtagagacggggtttcactgcgttagccaagatggtcttgatctcctgacctcgtgatccacctgcctcggcctcccaaagtgctgggattacaagcgtgagccactgcacccagccaaaacatatttatattttaaaattatttgttgtttatctgaaattcaaatttatctgggagtcctgtatttttatttgcttaatatggcagccctatttcatgggaaacatgatttattttctccttggagattgctttttttcctcagtgtcactagctcaatgatttgaagaagcataaaccagaaaattaatcccagcccatccttttgtgccagacacccacagggtcagttcttttggtagtcagtgagtattacatattgcaaaagcacacatgcatgcacactcacccacacaccttcaagcacacatgcacacactttcacatcaatgttcttacactcatacatacagatacaaatggattctgtttctcctaatatcctaaaataaaaatccctcactccattcagattttcatggctttccaaacacatcattctcctttttggtcagtgtctgtctgttcaaggagaaagtcatatccccagcttgctttgtgtgctcagctacactgactcagcttcccacagagtaggctggcactgagactttatctcttgtatttcagaaaatttgaattctcttttcttgccattgcataaaactgcctgttttagtataaagggatgaaagttgtcttaggatcagataatgaatgcaacttactaacaagaaaaagtacagaactgagaattgaaaactcaagccatataatgaaaacatttgaaaatgagagagaagaaaaaatttttgtgtattcacaggaagcagtatagcacagtggttaaatcatcactcccatagccaggctccttgagttactagatggccaaattatttaccctaatccgtaaagtggaaataataacacctgcctcctaaggttgttgtggtaattaagtaaatatatagaagatgtatgaaattgtatctgacacatagtgtttgcttttataatgatcttcgatttgccaggcacagcagtagcttcttcatgtgtatcctcccgtataattgtcgaaataagccttgagatgtgtggacatgaggaaactgaggctccaagaggttgacttgcccaaggctacacaggtggcatgcagcaaagccaagattcaagtatcaatctcaggacacagccacccatctctcaattacccagtattaaggcgacaaaaggtggaaggttgatggttctttagagaagtgacagcattccgtctacaattgttgcttttgtgggatggtggtgcatctggagatgtttgcagtggtgcttttgggggaggacaggaccctttgttttggttacagacctgacccaagtgtctgccaaccagatgaggaccttactttcttgtgacttctccaagcaaatccccaggaaacgggaagccctgatcccagactctgcctggctttccatcattaaggcagtataaggcagggtccgtcggcatgcggtggggggacagtggtgccagcaggagccccaggactctatcctcaactctgttctctatttgcacgcttaccatagatcatttcattcagtccctttgtaccatttataggctaatgattccctaattcatgtctctagcctagacctctcccctgaactcagactcacaactgcctactcagcatctccactaggatatataataaacatctcagagtttacaaatctaaaactagattttatttaaaaaagcaaaaacctgcttcacttccagtgtccctgggtcaatctatggcaattccattcttccaatagggcagtcctaaagacttgagatcactcctcacttctctctttttatggcttgactatccaatctgtcagctcatcccattggttccaccatcaaaatgcctcctgagccagactaccttccatcatctccacatctaccattttggaccattgcaatagactcctggtctccctgcttccaaccttgcctcctgccatggtctattcttcatactgcaaagtattcctgttaagacataactcaggttacatcactgttttgctcaaacttctccaaagcctcccatttcagaggaaagtcaagatcttccatgacttgaaaagccctccatggtcttagcctgccccagctctctccaacctcacttcccgtcactataaccagccccacctgcaccagctgctaggcctccatgccagtccttgcataaaccaagcacactcctgcattgggcctttgcacttgctcttcttcccatgggacatactccatccaccacaaagtcctcatgcctcacaacccaatgtccttcaacccctgctcaaatctcaccctaacagagaggattaccgcatctacctgcataaaacagccacatgccatcctcatctgagcattccctctcccctaaactgtcttatatatttttttcacagcattcatcctttatcagcacctgatgggatccattcatttattcacttattgcctccatcctctggaagggaccatctatgtggatagagattttgtctgttttattgactgctatatcctcagtgactggaaggatgtgtacacacagtaggtgctcaataagtactgagtgaatggaaagagccttctagatagtctcgtgccagctgaacagactgcttcagcttccctagcacacaatcaggctttcagaagactccgtcctgtactcctttccatctaaggagtcacagctctaggatgatactacatacagtttctttcttcctttctccctttctctctttctccctttctctctctctctctctctctctctctctctctctctctctctgtcttgctctgttgcccaagctggagtgcatgatcataggtcactataactttgaacttttggcttcaagtgatcctcccacctcagcctcccaaagcactgggattacagacatgatccatcatgcccagtcacacagatcttttctgatggcttgcttttgtgttttgtatctctgctctgtttgatttggcagaaaaggctcctgcgcaaagccacgtgcaagtctccctgtatgtcttggctgctcctgtgctcctgatggaaatgtgtcgggggacattattctaaaggatccaaatcaagccgcaaatgatgaaaacctcattgctcaagtagagaggaaaacaaatccatccatcctgactcccactgccatggaaaccccaaatgagttcaaaaggccagtacaggcaatgcttgcagcttttcttatgctctcttgtcatttcaggggattgtgtttgcaggcacatgctgagaagaggaggccttttgaatggaatgcaccaaggaggaagctttccaaaacccaggctaatcatctgtagcagcatcaacataattattattatgtgaggagtttgtagccaaacacttcggtacatctattagggaccctcaaaccacaccaagtgctcagcctctctgcagaaattcactcaccccttaatcaagcaacgctattagaggaaagctttgctgattcagctgggaggcatcaggcaatcctctggcttctgcagcatctcctaacaaagtgttgcttctggaaccctagaatgaacattgaacattcattgcaagtgtcaaatactaggacctgtgatatctctgtacccattcctaaaaagacccaggtatatccaatcaaaagatccaggtaggctgggtgccattggctcacgcctgtaatcccaacactttggaaggctgaagtgggcagatcacctgaggtcaggagtttgagaccagcctgaccaacatagtgaaaccctgtctgtaataaaaaaaaataataataatacaaaaattagccaggcgtggtggtgagcacctgtaatccctacttgggaggctgaggcaggagaatcgcttgaatcgcttgaacccaggaggcagaggttgcagtgagctgagattgcgccactgcactccagcctgggtgacaagagtgaaactccatctcaaaaaaagaaaaggaaagaaaaaaagatccaggcatagcaaaggataaatgaatattatcctccagaattattattagcaaaactgtcactaggccagagtgtctattaatgggtcccaggttcaagaatgcatgttccatccacataaagacagtgccccagtggaggtgcttaactctgtggtttttgatactcagatcagcaatggcacctgagtattcctgaacattcagccagcagaaatttctagctcatcttttaagtatatataatatgttggccaggcacggtggctcacgcctgtaatcccagcactttgggaggctgaggcggtggatcgcgaggtcaggagattgagaccatcctggctaacatggtaaaaccccgtctctactaaaaatataaaaaattagctgggcatggtggtgggcacctgtagtcccagctactcgggaggctgagacaggagaatggcgtgaatccggaagtcggaggttgcaatgagccgagattgcaccactgcactctagcctgggtgacagagcgagactccatctcaaaaaaaaaaaaaaaaaaaaaaaaaaagaaagtatatataatatgtctgtgtacatcatattttattttatctgtcatccatttttaagacagaccattattttgtgtaaaattaagaaagaaaatgattttgtcaattaaattagaatgagtcattgattgtaagatgcgtcctgatcagagacttaaattgtaaaaacataaagcaattgttaaaggtcaacattcagcaggacacaatgaaatcacgttcatgatatctgtgttttttattcgcttacccccatctttcatctcatgctggtagttgacagaactagagagaacatcaaatgttaccaaacagaacacatcaaactcagggagtttggcacatcaaactcggggagaagagcattaacagttttccaaatttatgcattgacaacgagcattttaaggctccaaaatgcagttgattgctaaagagtaactacaagaggcttagaccatttacaggatggaattagaatggcataattcagcagaggggatagacctcttagcaggagagacaagagaaagtataaacctacaaaaagacaccttctggggaagcactcacatgtttgagcatgctgtctggttagagtaggcccaaactcaaaacttttatttctaacctgtgaccccagacatctacacacccaatctgagtcaaacagaaggaattgttcttttctatttcaaaacttcatggagaccaggcatggtggcttacacctgtaattccagtactttgggaggccgaggcaggtggatcacttgaggtcaggggttcgagaccagcctgcccaacaaggtgaaaccccgtctctactaaaaaaaaaatacaaaaattagctgagtgtggtggtgcacacctgtaatcccagcttcttgggaggctgaggcaggagaatcacttgaacctgggaggcgaaggttgcggtgagccaaaatcatgccactgcaatccagcgtgggtgacagaaaacaacaaacaacaacaaaaacatcatgtctcaaaaaacaacaacaaaaaaaaacttcatggggggggaaaagctttaagcacctagcatccattctgtagcaaaagctaataatattcatgcactggaaacttgtattaatgagggttctccagagaaaagaaccagtaggatatatatacagatatattgaaagagacgtattttgagggatcggctccccagttctcagggctttcagatgcagactgggacttacaccatcggcctccccagttctcagggctttgggtttgaactagaactataccaccagcttttctcgttctccagattgtagatggcagattgtggggcttctcagcctccacagttgcatgagcttgtttgaatgagaaagcaattgcttgaagcaacagcagacaatacaaaattcacattttatattgaatcaggaagaggaagcaaaagtataaaatgatgaatctcccctgttccccagttctgctcgggctttgcccactctttcctgcctgcatgtggatatttagaaagtgcacagaggcactggcgttccaaacagtcacccaccgactcggcttcttgcactctgtttgtaactcattcagaaactgcaaaatagagtgaagaagaaaaagcaggtgattttccctgccttcttttaccaaagagggggcatgctgtggccttatttctgcatcatcttgagctgatagagtgttcctcagtcatccccaaaccacagctgggctgctcttccctcctgtacccctgctgaaagtttcggtctctccattttccttaagctactgcaaatcttgtcaccataagggccagacactttgccctggcatgtggaaagacacagggcttgatggcacttgcaaaggggactgtactagtctccatttgtcccccatgcctgccaccatcctttgccctcctctacctgcctgggggcccccaaacgactgatctctagggctgaatcacccaagcccctctgtcctcaggttagacctgggggaaggagggacaggaagtggttggaaagctggtggaagcacggaattagtagggcattacacagatcaaggttcttagttgcagacaatagaattcattcaccatggctagtttaagcagaaagaaatacatgaaaaacttcatttactccgatgtgattattatacattatatgcctgtatcaaaatatcctatgtaccccataagtacatacacctactatgtacccataaaaactaaaaatttaaaaaagagaaatacatagaaagaactaaagagcttatagaatctttcagaggaccagagaaccaggcttgaacactactcagccagaaacaatgcagccagaaaaaaacgtcctctgatggcatgcaactgtttccatgcacaccccagcagaaccaagtgcttccaccactaagcttagcagagaatctgttctctctctgggctcagccaccaccttgctgctgtgcctcacacgttggcagaaactgtcgtgaatatcaatctagctgcaagggagtctaagaatgtagttttttgctttcctgatcgaaagtgattcaaatacgtattgaatgagtcaacttacagtatctgccgcaataattttagggctcctttcctgtggctttattaatatgatttgtgccagaaagactgtgaggtatggcgaaaagaatatgggccatgaaatcagatagaggtggttctttcttttccttgaacacaccaaatttgttcctatcttagggtcactgcatttgttcaccttttgcctgaaacactctgcaccagtatcttctcatgggtcttcaagttccagcgcaaatgttacctcctcagagaggctgccttccctggccagcccatctacagcaacccacctcaccctcacctcccatcatctcaccttttaaattttctttttaggacttcactgccattttcttgctttttgtcgtttatgatccaagctcccctcatcccaaatagaatataaattccataagagcagggacttgctctgtcttgttcacagctgtgtcgctggagcccacaaaagtgtctgatacacgacagtaatagcattgattatataattaccatctgccacatattgtttaatcctcatgctactctttatgaaataattactgttatctttgcccttgcagaagagaaaatagaagctgagacagggtaataattatttgtctcaggccagacagcaagtaaatcatggattcaaacctaggtagtctggctccagagtctaaactcttaactgctatagcatgctgaatatagtagatgttcaataaatactttgtgaggctgggtgtggtggctcacacctgtaatcccagcactttgggaggctgaggtgggaagatagcttaaggctgggagtttaagagcagcctgggcaacatagtgagacctcgcctctaaaaaataaataaaaatgttgtggctaagtgaatggacaccttgtagtcatctcactgacactgtgttgcatttaacactgctggattatctatttctccatctctctcatgggcttctcttcctgaaacccctttcccccttccttaaacactagcgttccccaaacctccatcctgtgtcagctgctcttcttactacctgctctcttgggtgatattattcagcatcatgattgaaccatattatatactgataagtcccagctcaaccataaatctctagcatcgactctcccagagtgagagaattaaatgttcatggcttcctgataccaccctttttatttttttattttttaatttttttatttttttttttgagatagagcctcactctgtcgtccaggctggagagcagtggtgtgatctcagctcactgcagcctccacctcccaggtttaagcaactctcctgcctcagccaactgagtagctgggattacaggcttaatgccaccatgcccagctaatttttgtaattttaatagagatggggcttcgccatgttggccaggctggtctcaaactcctggcctcaaatgatccatccaccttggcctcccaaagtgctgggattacaggcgtgagccaccgtgcctagcctgatatcaccttttgaggatgctttgggcatcccaaactcaacaaacacaagttaacttaatttgctgtaggtacagtcaggttaatcccagccaggctgtgaaaagcattccatttcatcttcccccaaacaaaatctgctccttctcccctatcccccacctcagccaatatcaccaccatttatccagcttccaaggccaagagcctggcaggcattttggagttttcctccctcgcctcattgcccacctgtgactaagtcctgtggattctacgtcttaagtagttctccaatccatcccttcctctctattcctgctcccagcgggactattgaatgtattctgaagatcatatattacagttgtgttgcaggaaaggggtcccgatccagacctcaagagagagttcttggatctcacgcaagaaagaatttagggtgagtctgcactgcaaagcaaaagccagtttattaagaaagtaaaatggtgagaagacagctactccttagacagagtaggatgttgccgaaagtaagaggaggaacacattcaccctagggacaatgcttgtatatatagggggatgtgctctgctacaagggtttgtgataaagaattaattttcttcattactatgttttgcaagaattgatattattatctttaaagcaaaattaggaatgcctttgtgctccagatattgggatatctgcacactcccaagtctgggcctgtttagcaaacattattaatttgttgcccgaaccataaacctctagaggccaggaatgcctaacttctgagaatgcagcctagccagtctcagcctcattttcctagccctcactcaaaatggggttgctgtggttcgaatgcctcttacagtagcatcctaacttctctacctgtctctggtcttgctcccttctatgtgtttcccgaataccccagcatgacctaactgcagtagaaatctgcttgctcgactctagcctccccagtggctctgccattcattgccttcaggacaaacttccagcctgttaaaaatcaaccttgatgcagtccctgcccacgcctccaaatgtggcatcaagcctccctcccccgacctttaccatcaccctatgcttcagaaatagccaggtcaccgcatttccccagcaaaactcacatagagtcatgcttttctccttataaaacagtgatcagggaaagccagtcaacttgagaggagagggatggacatcattagagcttttcagtcccctattttagtttctccttgaggcccagctgcagtcctgccattttatttcaccagacactccaagagctttataattcagactcttcatttgcttctgcgagctctcattgaagtctgttatttgcaaccaaaagagttccaacaaatgcactgatgaactgaaagaaaaggcgtctatttacatgaaatgatttgcatgagaggaaagaaggagccacttcccaggaagagagagatgggactggggaggatggtcgcgccagccccagggattcgtatctgagcacggtggcaagagaagctgcaaacagaagacaaagcctgttttacaaaggctccctcttgaagcacacagtttgtgtgcccaagggacaaagtgccacacagagcagggccttcttgatgcagtgcagctttggcacatttagggttcccagtaacaagaaactgctctggcatctccagggctggctgtccagggatcactggaagttggcattcttgggacagtcttagggttatcccagggggcaccagcagtttgggtggtggaaatgcacattctcaaatggctagctgggcaaaggatatctgtgggtcagagcacaggaagaaggcatcacattacccagtaactgtagaggatacacttgtttgcaatataccctctgagaacttccagaaataactgagtgagacttgagtggggtacttgaggcacccaaacctgaagacgttagataaattcagcaaaatatgggttatcaccattaatgtgcccccctttcaacccacaggccaggggaacctgaggaaatcaggttcatggcattaggctcactttaaaaaatgaaaaagagaaagaataaaataacctactaaactataaatggaattacatgcggggcttttattcttccttcaaagtcttctctatagctctcaagatatttatgaaatgtcatctgctaaaagaagtagtttataatttagcttgttaagatttttcttttaattcagcaaagtagaatgggatgaacttatattccagggccacaggtctgaaagtcataaaattatgaaattataaagtcagccaggtgcagtggctcatgcctgtaatcccaacgcattgagacactgaggcaggagggtcgcttcaggctaggagttctaggccagcctaggcaacatagtgggatctcatctctacagaaaattttaaaaaaccggccagacttggtggcacgggcctgtgctcctaagtgccagccactcaggaggctgaggtaggaggatcacttgagcccaggagttcaaggttacagtgagcaatgatcacaccactgcactccagactagtcaacagagcaagaacctaactctaaaaaaataaaaaaagaaaaaagaaaaaaatcacggggtctctggttaatcaaagagctcttgcacattttcctttatctcattttggaaagaagcagacaggcatttttgtaagcttagttttagtcccacattttatattatattgcttgacccaatggtgaaatggcacattttgcacaggctggttgggattaacccaactgaacatacagtaaatcaattcacccatggaatggatgtcaacagagccttaaagagaaactttatctctacagaaaactttgaactaaattcaacttgacacttacatatccttcatgctcttcaagtgcttttttattcttattagtaatgagataatgagtttttcatttgagctgattcattataaaaatcttcttttaggccgggtgcagtggctcatacccgtaatcccagcactttgggaggccgaggcaggcagatcacgaggtcaggagatcaggaccacggtgaaaccccgtctctactaaaaatacaaaaattagccaggcgtggtggtgggcgcctgtagtcccagctactcgggaggctgaggcaggagaatggcgtgaacccgggaggcggagcttgcagtgagccgagatagcgccactgcactccagcctgggcgacagagcgagactccgtctcaaaaaaaaatatatatatattcttttaaaacatcttaactatgtttattctttgagacggagtttcactcttgttgcccaggctggagtgcaatggcgcaatctcggctaaccgcaacccccacctcttgggtacaagtgattctctgcctcagcctcccaagtagctgggattacagacatgcaccaccacgcccagcttattttgtatttttagtagagatggaatttctccatgttggtcaggctggtcttgaactcctgacctcaggtgatccgcccgcctcagcctcccaaattgctgggattacaggcgtgagccacagtgaccggccaactatgtttattcttgtaacagcctggagacatgaaatgcaggaccattagttcactggaagattaaaaacttggggaattatgtttttcaaacataaactttcaagtaaatgaaatccaggaattaaacttgctatgtgataggaattgtccacagcaattcacaaaaccttatgagaaagacactgttgttatccctaggtcatagacgaagaaacagaagcttggagagcttatgtaactgacttgccaaagaccccacagcttgtgagtgttagggcagggatttaaggcaacctgactacagagcccacatgtactgatcaggatactctgcaacctcccagcttctcctacctcctttcttgagctagcgtgtgtgtctttgggctgttttgttaccaactctgactccatctatacgtgatcttatcttacctagcccctaagaaagtctaactggcagccaagtgcggtggctcatgcctgaaatgccagcattttgggaggccaaggcaggaggattgcttgagcctaggcgttcaaaacgagcctgggtaacatagcaagaccccgtctctatttttttaaaaaagaaagtctaactggtttagcttggattatggtccacatttaaatggtgaggacatgggctggagagtcccttaaatgcacccactacatcttgttgaattctctgcactcaagactggaacaaccaccacaggcaataatatagcaagaggagagtggcaggaaaactaaccagtgttgattacctagtaggtaccaaacactatgcgaagtgttttaaatgcattacctcatttatctttataacaacacaagggctaaaggagaccaaagactaccaaaaggtcaatcaaaaccatttctaaggttaaagaataaagataatgcaagacattagaaagccccaacagcataagaggaatgaggataagaaaaatggcactaaggaagagccttgaaaaaggagacttaattttttttcttaatttatattttgaataaatattacagtaatggggctgggcgcggtggctcatgcctgtaagcccagcactttgggaggccgaggtgggtggatcacgaggtcaggagatcgagaccatcctggctaacacggtgaaaccctgtctctactaaaaatacaaaaaattagctgggcgtggtggcatgtgcctgtaattccagctgaggcaggagaatggcgtgaacccaggaggcggagcttgcagtgagccaagattgtgccagtgcactccagcctgggcgacagagcaagattctgtctcaaaaaaaaaaaataaaaataaaaataaaaaaataaaaaaataatatatatatatataacaacaatggtacaaaattcaaaagatatataagagagttttttgttatttccttgttttatatagtcaaaacagtttattgattgggaccataaacttttcttttcataaaagtttcataatggacatttgtcatttgtgtctgcctcaaatctttttttggtagttcttctatgttgtgaattctcttttccataggaagaaaaaaaacaaacatgccgggtgcggtggctcacgcctgtaatcctagcactttaagaggccgaggcaggtggatcacttgaggtcaggagttcgagaccagcctggtcaacatggcaaaaaccccgtctctactaaaaatacaaaaattagctcagcatggtgacatgcgcctgtagtcccagctactcaggagactgaggcaggagaatcgcttgaacctgggaggcggaggtggcagtgagccgagatcgtgccactgcacttcagcctgggagatagagtgagactctgtctccaaaaaaaaaaaaaaagaaagaaaagaaacaaacaaacacaacacatttctttcaagaccctttgctgctaggatatagacatttgactatcttccaacaaatccaaacctaagcaacacttgaaatataggtgacaggctgcagacacacaatattctagtaagtctggacacaatgctgcctggttttctgcacgaactgtaatgagggtcctggtggtcagttctggttttatagatgttaagcatcatctggcagcaacagcaggatttctgctagaagagtcttaggatatttgggacatgtgtgggatgcttggacattcctcctggctgcttcacttctggctgtgtaatatccaggctttgtttctcggctctcctagaaattctaagtaataccatgtaataaagttctgctgaaactagctagactggcttgttttcctgaaagagattccaaggtattgggaatctggaattgactaggtgacttggttggatttggaagtagtaaggataggatacaggaaaaacatgacatctggtggccaggaagtcactaaaaccattgttagagaagttagcatgacactattcctgcctccatttgttttttatttttatttttttaagagtgagtcttgctctgacacccaggctgaagtacagtggtgcgatctgggctcactgcaacccccccctcctgggttcaagcaattctcatgcctcagcctcctgagtagctgggattacaggagtgtgccaccatgcccggctaatttttgtctttttagtagagatgggtttcaccatgttggacagggtggtctcaaactcctgacctcaggtgatgtgcccgcctcagcctcccaaagtgctgggattacaggtaagagccactgtgaccagccgctgcctcagagtagattgaagcatcaacagattaaatctcaggatgccaaaattagattgagaccaaccaccacaccccctcccccgccacctacctcacccctgccatgcaggatttagaacaggagtgaaggagacccttttccacatctcctagggttctcgatgaaatcaaagatacaaaaggggtcagtgggaagatttagtagaagatggttgaggagattgttttgaagagggttttgctctgctgtgagccctctccccttaggatgagaggcagaggctctgtctcccaaccataagcctagtgagaaggtttttagttgtccactgggagagcttttaaacgtgtgccttgcagttggaagacacagaagactggggcggcctgactaaagagcaagaaacttagagtgcaccacgaactgaagtccaactccaccaagaaaattcagaatgttttcctccgttacaaagctggctacgtgctttggagatggaagaacaagcagggcttctatattgggatcagcgggcactcctggagtttcctgaggcaaaggatgaaggagacttcccaagaccatatgggggtaacacaagacaaggcttgagtcctgtctaccaggtcctctgagaaggacctcagcagaaagcagctgagcacgttcagctggatactcagaggctgaggaaggatttgaaagagacaagctggaatagagatacatccacttgagtcaagggaactgcaggagagcgggcctgcagggagcctctccagcattcctattcaagggccagaagagaaagaatcagcttgagctatcgtccaggccccctgggggttaccagctttaatcatctgcagccccagagagcacgaagctaccagatcaagtagtgactcacttacccctttttcctctcatctctaccctaccttcaaccctggaagagaaagaaaatgacagctagtgggtagaagtgagggtgagcagggaagaaaaaccagagaagccatcagaagtttcttccagggctagaggaaggcccctgaataaagtttaaagagttggtgagaaacaaatataaaatcgcattttgattaaatcatgagttgtgttcatagatgtccacgtcatccagtggcagaacaccaaaattatcacctgtagtgacacagaatgaagtgcctattgaaagcaaggccctgggggctgcagcgcggggattataaaggccacgaggtgagcagttacatctaactgcacgatgaagtttaaagaaaagaaatggcattttcagggatttaaattctcacttcgaagcatggtcagtgaatgagaaaatttctgtgacttccttcaagtactcttttatgtcatgcaggttcaaggctaatgaagctgaaaatcagaggcagaggcagagcctgaagattgatgaatctcaaaattgactgaattcacagtcccgctatgactttctgggcattgattgggaaaaggtggtttttcccctgagtattggagtggaaatattttggaggtgttagataacgccaagaatctgaaaccccaggactcacagagcctcgtaggccaataaaatgagagcagcccttcctccctttctgatgaggctggtcctgttttatgcagagaccctgtatcgagctcactgaatggtcaccttgcaacgggatgtggcccatgggccacgaggactctgctcatggtctccagatccacaactagagtcagattctagaatgtcctgaaatcaaaaccaaacctgggaagagaagacttacgtaccaaaagaatagcaagattatgaagaggtttacacttcctgcttggctgtctaaaagtgagactcaatggtggcctgtgcaggagaagtcagatgccacacaatccttgatgcgctgtggaaaaaggaacccaaagccttagagagatacaaatgttggtgtattagtccattttcacgctactataaagatactaccggaaaccgggtaatttataaacaaaagagatttaattgactcacagttccacatggctgaagaggtctcaggaaacgtataatcatggtggaaagcaaaggggaaacaggcactttcttcacaaggtagcaagagagagagagctcaggggaaactgccactttgcttttttttcttttttgggggggacagagtctcgctttgtcacaggctggagtgcaatggcacgatctcggctcactgcaacctctgcctcccgggttcaagtgattctcctgcctcagcctcacaagtagctgggattacaggcaccggccaccatgcccagctaattgtttgtattttagtagagatggggtttcaccatgttggccaggatagtctcgatctcttgacctcgtgatccacacgcctcagcctcccaaagtactgggattacaggtgagccaccgcgcccggcaaaactgccacttttaaaccatcagatctcctgagaactcactcactatgatgagaacagcatgagggaaactgcctgcatgatccaatcacctcccaccaggtcccttcttccatatgtggggattacaatttgagatgagatttgaatggggacacagagccaaaccttcagttagagtggatttataatcactgatctactcacccaccttcagaaaaaacacacattggtgagagaggagttggcattcttgaaaagcggatgccctctgtaggccagggatgatggtgagagatgctttgatggaaagaggtttccttggggggcaaacatcagctttaaccttcaggggcaagcacgtcctgattcctgaaaaaaagcagaagacttagatgagattatcaaaaggatttgactctaagggatatttgagggtgcttaatagatcctagggcctttggggctgaaatacatggacgctaaagtctgacctaatatgtataacaacaaaatataagtctggggaacagaggactgactagtcgtgatgatggcgagtccagtccttcacccaatgccaggcctgagtcactttccaaacccagagccctttgaatagcagggagacaagatgctcttgaggaacaacccagcaatgacagcacagtgtgtactgaagtcttcctcctatcctttcaggaaggcacttgggacaatttaccagggcaattggaccctgggaaaaggaactcatagacctttcaggatgactatcttttaactaatgctaatcctgcaggccccaaatgccatctgtgattctctggtaggtgtatggaattttatggtaatagctgatagcggggcttactcacagcggggactgttcccagtgaccccagtgggtccttgaactcatagttatttcctcagttcttgagtgcttagttgtaatcaaagtaccggcagaatagtcacactggctccctgacctgtgatgtgaatgttattacagttggaagtgttaagaggaaggctctggaatggtccctccctgctgaaataataaaccaaatgctttgtgtctattaactcattgaattttcacagcaaccctatgatgtaggaaatatgatcgtgcccatttacagatgaggaaactgaggcacagagaagttaagcaatttgcccacgtttacatggctggtaagagtgaattcaaatccagtcaaattttagagtccacataccaaccaaaaatcctcagtcaggctgggcacagtggctcatgcctgtaatcccagcactttgggaggctaaggcaggaggaccgtttgagcccaggagttcaagaccagtaggggcaacacagtgagaccctgtctgaaaaaaaaaaattagctgggcacggtggtgcacgcctgtagtctcagctactcaggaggctgaggcagaaggatcacctgaacccaggaggttgaggctacagtgagttataattgtgcaactgcactccagcctgggtgacagagggagacattgtctcagaaaaaaagtccgcagtcagctgagatgcttgctacaggcaaaagggacatcaaaggagtggtggaggaaagatgttataaacaccaattgcgcccttgtgaatattgtagaaacaaggaatgaagtagctattcatgttgagtatagttaagaggcccaggaatagaatttgaagtcagactgaatgggttcagatcccagatttactgctgaagatgttgaaaaattttcttaacttctatttggctcaatttccccataagttaaaaaaaaaagtggggagaagggaacactgatagttcttatttagtaggcttattataaggattaaattaattaacatttatgtaaagtgcctggaaggcagtgtttgctattattatcttccttactgtatcgagtacattttgatgcagttaactaattttctattttatttcttttttttttgagacagagtctcgctttgtcgcccgggttgcagtgcaatggcaccatctcggctccctgcaacctctgcctcccgggttcaagcaattcccctgcctcagcctcctgagtagctgggactacaggcacctgccatcatgccaggctaatttttgtatttttgtagagacggggtttcaccatgttggccagcctgatctctaactcccgaccttaggtgatccacccaccttggcctcccaaagtgctgggattacaggcgtgagccgctgcacccagcctattttcttatagcttttctcctactattttgtatagtctatgtcaacgatggccaagtttacaacttagttcaggggttatagaataacaagatgggctgcttcttcttcttcttcttccttcttcttcttcttcttcttcttcttcttcttcttcttcttcttcttcttcttcttcttcttcttcttcttctttcttcttcttcttctgttattattattaatattattattattattattattattattattattgagacagagtcttgctctgttgcccaggctggagtgcagtgggatcatagctcactgcagtctcaaactccggggctgaagcaatcctcctgcctcaccctcccgagtagctgggactaaggtgcacatcaccgtgaagagggcttattattaaacttgaggaggaacaaccatcactcagaagtcctggacttggagaaagattcaggagctgctatgacttcaggtctctcctttagggaagagagtgaacatgttctcatttttacaagggatagtaacatctcaaattatagaaagttatatggcttaaaggtagattttctttttctttctttttctttttcttttttttttttttgagatgaagtcttgctttgttacccaggctggagtgcagtggtgcaatcttggctcactgcaacctctgcctcccaggttcaagtgattctcctgcctcagcctcctgagttgctgggactacaggtctgcaccaccgcgcgcagctaattttttgtgtgtatttttagtagagacggggtttcgccatgttggccaggctggtctcgaactcctgacctcaaatattccacctgcctcggcctcctaaagtgctaggattactggcatgacccactacacccagccttaaaggtagatttgctgtggatgctttgcttttaaaaattatgactatggtgaatgttcattaatattcacctatagtttatccaattagttacgatgctggttactgatgctaatgctgataatagcatcagactgtagagctcatagaataattatgtaatgtcatctatttcattaaactgtaagctccatgaaggtcagggtcttttctctcttgttttccatcatatacccagagctactgcagtgtgctgcacacgggatctctcaatacatattagaataaatgacccatttattttgagtatgacgattgtattagttacctattgatggataacagatgactacaaatttagcagcttagaacagcacgcatttaatatcttaccattactgtgggtttgggtcaggagtccaggcatccgtttgttgggtcctctattccagagtctcttctgaaagctgcaatcgcatttctgaccaagactgcagtctcattcacacggttgttggcagaattcatttccttgtgggatgttggactgaggacctccgttttttgctggctggcattgaagattatcttcagttcctgccacataggccactccatagagcagctcagagcagggcacctagatccatcaaaaccaggaaggaagaatgtgttagcaagaaggatattacaaccttctgtaacatactaatgtacatgtaatcacatacatcgcattatctatctactaaaggcaagtgacaagtcccacccacgcccaaggggagagaattacacgagagcgtgagtaccaggtggcagcgatcactgggggctgtcctaggattctgcctcaaaattcaccaaatactctcatcagatcagctaacccggggttgttccctaaggaaggcaggatagttaacgtctgcgaaatggcagtgagtcctcattagctcagctctcattatcaaagtctttgcgttgccaggttgcacagggaagcgaaggtcatcttaagatgaaaatatcactaatattatcaaattagtccccactctagcagacatttctcctcttaatgctagttacatccttgtacatcccatttttccagagcagccgcatgctaattatatgagtctacaatgtaaattcaatcaaaccaattgctcaggttcttcaaaagaaaattatttgaatatcaggggctttggagaggcttttgaggaaactgatgaaatgctcaaataattttgcacgaatgatttttgtttgaatcatgttgggaaatttgagtgtgggagattatgtatcctgctatcatttcatgtttgggagaatactatgaaaaaattccagcaaaatatatatttttttcattctaagaaaattacctacatgcaaaacaacctaaataattgaaccttaaaagtaatttggcctggccaggcgcagtggttcacgcctgtaatcccagcactttgggaggtcaaggcgggcggatcacgagctcaggagattgagaccatcctggctaacagggtgaaaccccgtctctactaaaaatacaaaacaattagccaggcgtggtggcaggcatctgtagtcccagctacttgggaggctgaggtaggagaatggtgtgaacccgggaggcagagcttgcagtgagcagagatcacaccactgcactccagtctgggcaacagagcaagactccgtctcaacacaaaacaaaacaaaacaaaaaaagtaatttggccgggcaccgtgactcacgcctgtgatcccagcactttgggaggccaaggcaggcagatcacgaggtcaggagatcaagaccatcctggtctttagcagtgaaaccccgtctctactaaaaatacaaaaaaaaaaaaaaattagccaggtgtggtggtgggcacctgtagtcccagctacccaggaggctgaggcaggagaatggcatgaacctgggaggcggagctgcagtgagcagagattgtgccactgcactccatcctgggcgacagagtgagactccatctcaaaaaataaataaataaataaataaataaataaataaataaataaaataaaaagtaattttaaaaataacatagtttcatagttttactgtttattatagtttactgtaaattttggtctcttgtgagtggtgctttgattcaaatcctagctatgtcagttactagctgtgtgatcttggacaagttatttaactttcctgtgcctcatttaacacatatataacatggggataccaataataatagtatttatagcactaactacaccatttgactctagcaacaaccctgtgaggtcagtgttatggcaggtaccttggacagagtgacctgtggttgggataagatgaccagatgtcccatcttaatctctaaaatattaagccttagcatcataaaccaggacgcccaagtaattagggaagctcagagggtatctgcaagttttggataatttcctcatccaagtctaactggttttggaaaaagttctgcctaacttgaattcacctaaaagagaaaccaaatgatattctctccctctctttcctcttcttcaactaaacctttcatttcttagctctcccctgctcccaaacccacctcttaagttcctccagggtgctatcaaaggtctttgaacagtacccttaaattctcaggaaaagagaaacaatctaaatcaaaaaagcaaatatacaaatattgaaccacaaccaccttccaactgttttgtttgaacagagagagaaaaacccaaagcaagactcaggagtgttaaagttcattttcaaaacacagaacaaacagcgttcattcttaataagtcaacggagcgtaacagaattcagagggaccaaggaaagggttactgtacgacagatcagtgacacaaacataagcggtggagtccacagaggggcaaacacaggagattgagctgctgcttggggcaagaaaggctcgttggaacttggggttctgagcatgaaacctcgcattccccattcaagcaagtcacaacatctctgcttcttcagatgtagagaataacaaaatccttagaggccaagcttggggaaaagaaaagaaatggtggtatgcaagtagtactgaagtagtattgcctttggaaagtaataactaagggagaaaagaagcatgattccatagttggtgctggatacaatctgaagcatctaataaatttatgtcactgtagaaatttcgattccactttgatggaaatgaaaagaaactataggtaacataacacatggtatttaatcataaggcttgaaagaggataatctccttaacaaaagcacatggagaattcaaaaccatggggtggtatttctcgtctcagtaagatgagaaaaggggattggagaatatttacacttccaggaaccccagaaaaacaagaaccaataaatattttctagatgggtcatagatcttaagttcaaaaagttcttattatcactcataactctgatcactaccatttcaatatttaagggtaaaaaaactctccaatataacagtttattacatatgtgtttaaactctctaatatataacctttaatcttgagtctatgatatctacaaagcttgtaaaccatgtccccgttataagtattagagtgttatttgtaggaaattagatttcctcactgtcttggatcacattgcctagaagcagagcctgagacagggattggagtgtgcatgatttgaaggaatgcaatcgggagaaagggagtgagagaaggagaaggcgggagaaggggctcagcaaaactggggtctcaagcctggagaggagcttcagcctgatcctgcggccagctctgcagcatagattacaactcagaataggtcccacattgaggccaggcatggctgacgcctgcaatcccaacactttgggaggccaaggcaggaggatcgtttgagctcaggagtttgagaccagcctggacaacatagtgaaaccctgtctctactaaaattagctgggcatggtggtgcacgcctgtagtactaactacttgggaggctgaggtgggaagatcacttgagccctgaaggtcgaggcggcagtgagccatgattgcaccactgcattccaggctgggtgacagagaccctgtctcaaaaaaagaaaaaggaattgaagaattgacccacactgaagcaagggggccagcctcagaacctcggtcattggctactgcttgtgactggggaggtagtgtaatttctttatttggggtgaggcaattctcgaaagaaggggaaagctgtgagtgctcagcagccaaaactgcagcacctgagggtgggtgcaccagccaggtagaaggcacctgggggctgggcgtggtggctcacactgtaatcccagcagtttaggaggcctaggcaggtgaaccacttgaagtcaggatttcgagaccagcctggccaacatggtgaaaccccatctctactaaaaatacaaaaattagccaggcgtggtggtgtgcacctgtaatcccagctacttcagaggctgaagcacgagaatcacttgaacccaggaggcagagtttgcagtgagccgagattgtgccactgcactccagcctgggagacagagtgagactctgtctcaaaagtaaaaaaaaaaaggccaagcgcaatggctcacgcctgtaatcccagcactttgtggggctgaggtggggtggatcacctgaggtcaggagttcgagaccagcctggccaacatggtgaaaccctatctctactaaaaatacaaaaattagctgggcgtggtggcaggcgcctgtaatcccagctactcgggaggctgaggcaggagaatcgcttgaacccgggaggcagaggttgcagtgagcagatatcgcaccattgcactccagcctgggtgacaagagtgaaactctgtctcaaaaaaataaaataaaataaaataaaggcactgggtcagcacaccaacagcacccagtgcactcactacagctgcaacacgagctcagccacctgtgacaactaagccactatctacaacctcaccagcctgtgtcaaggaatctcactactataaatatggaagagaggttcttggttgtctgtcaccagtgttcgcttttcccattgaagcctgtttgaaataaatactttctctggcagattcaaatataaatacaatgggaattgttatttttccacagccacaggcaaaaccaattaaagatggataaaagtaaataatgtttaaaaaacaaacgttagaagactggaagaaagttgaattgaatatttatcatcattctcaaaggtagatgatttttcaaacctagaagtaaggaggaaaaaatcatgaaggttttatcgtataaaaatgtaaaacttctggccgggtgcagtggcccatgccagtaatcccagcaatctgggaggccgaggcaggcggattacttgaggtcaggaattcaagaccagcctggtcaacatagtgaaatcctgtctctactaaaaatacaaaaattagctgggcatggtggcagacgcctatagttccagctactcaggaggctgaggcaggagaatcttttgaaccagggaggaggaggttgcggtgagccgagattgcaccactgcactccagcctgggtgacagagagagactctgtctcaaaaaaagacaaaagtaaaacttctatccaccagggaaaaaaagaaaaaacaacagtgcattgacaaaattaaaaggtaaacaacagttagcaaagaatatttctgcaaatttagaaacaaaaattccttgtcaaatcaaagttgcttgtgtgttgcagatagtgttttcacagcatgctccttggccatattccggagtaaaacccccacccaacgaaagaaatgttcctttttgagcgctgtcagtgactagctgtgaccttgaggaagttacttaattgctctatacctcagtttctttataatgaggggacaataacagtacctgcctcttttttatcatgagggctgcaagagccacgggtcctactaggaattaattgtccttatttatttattttagaaacagggtcttgctctgtcacctagactggagtgcagtggcctgatcatggctcactgcagctttgaactcctaggctcaagtgctcctcccgcttcagcctcctgagtagctgggactataggcacacgccatcatgcttgcctaatttttttttctttttttgtagagatagggtctcactatattgcctaagttggtctagaactcctgggttcaggcaagcttcccagcttggcctcccaaagtgctgagattacaggcatgagccaccatgctcagcctaattgtctatacttacagaaagaggaaatcaagagttagaaagagaaaggggagctatggtgggtgacacaggacaactactagggaggaatacacagagatagggttgacagagttcaaggaagtatagccagccaggttctaccatgctctggcatgaagctatccttggcagaggtaaagacttagaacttgggtcagggagttgtcaggtgacccttaacactcccctttatctactatgacagaaacaaaattagtttcttcttcatcttcctgggcttcttgtagtggatgtggtcataagaccaagttctggtctatggaatatgagtggaagtggtgggtgccattgctgggctgacatgcattgtgttccttcctttccaacagctggaaattggatctaatgactcaacctggaccttgcagaaggcaagaggcccgaagacagggcagagccactagatggaaagagcttgggtcccagaattactctgcggagcagaactgccaaccaacctggaacacccacactggcagttttgtgagcaagaaataaacttcattattccttacagcactaaattaacaggtcttgttacaacaatttagtctgccctaatacagcaatgttgagctaagcccgttgataaatggcactaagatcctttcctacagaaacatccaaagcattccagaagttaccctaccaacaaacagcaggagacaacacattcctgctgaaagctacacatacaatttaaagtctactgctaggctgggcgcggtggctcacatctgtaattccagcactttgggaggccaacgcaggcagatcacaaggtcaggaattagagaccaggctgaccaacatggtgaaaccccgtatctactaaaaaatataaaaattagctgggcatggtggcgcgtgcctgtaatcccagctactcaggaggctgaggcagaagaatcacttgaacctgggaggcagaggttgcagtgagccgacatcatgacattgcactccagcctgggtgacagagcaagactccatctcaaaaaataataataataaataaaggctactgccaaaagcacttccctttcccctcttggcctaaagtaggggttggcaaactttttctagatattgtacttggctttgtaggccatttagttttacaactactcaactctgccagggcgccgtggcttacgcctgtaatcccagcactttgggaggctgaggcgggtgcatcacttgagtccaggagttcaagaccagcctggccaacatgggaaacccctgttctccaaaattaaaaaaattaaaaataaataaaaataaaactactcaactctgccactttgttagcacaaaagccaccgtaggtaatactgaaatgagtgggtgtggctctgttccaacaagtcatgatttacaagaacagagtgtaggctatttttggcctgcaggccatagtttgctgacccctggcctacaaggacccctggaatgtccactgttagacaatcatttgtttggcctatatgtaggagggtcttgttaaaatataaacattggcagcaaaccaaattgtaaaagtctgcatgttttgtgttctaatgacagccttatgttgcacctgattttcttgagaaagctacattataataggttgacactcctgaccaagggtctaaggttaaacttttataaaaattatagccatcatatttagtcaattaactttatacctgcccaatgtaatgctttctaaaatagataagcatactttaacagaaaaatattgtgaacactcatatcaattttttctgagacaaggtctcactctgtatcccaggctggagtgcagtggtatgatctcagctcactgcagcctccacctcctgggttcaagcgattctcctgcctcagcctcccaagtagctgggactacaggagcaggccaccacgcccagctaatttttgtctttttagtagagatggggtttcatcatgttggccaggctggtctcaaactcctgacctcaaatgatccacccaccttggcctcccaaagtgctgggactacaggcgtgagccaccacacccggcctcatatcaattttatttaagacatttctagagaaagttacgattgattgatctgctaccatggtccagatgctgagttaggagctttaaatacatcatcacaaaaactcctaaggtgcctcacagagggagaaattgaagcttagaggggtcaagtaatttgtccaagataacccaatcaactgataaataacccgccagacatgtttagtttcaaagcctctattctcataccacagcatcctgcccaggaaaaagaagggcatgggttgaaattttgatgggaaactagaggctggctagaagaggctacatgagttctgcttctcaaggcataggtttctatggtcaaaagtatcaggagaagaagcttggccactgcgcatttgtcaatggccattccatgaataactggcatgtattccaagtgggaattattgtaagtacatgtgagtagcctacaaagaggagatatgaaattaataaatttactgagtacctaccatgtgtcaggcagtgttctatatactttacacggattctatcatgtaatcttcacagtaaggtaagtgctattatcatctccattttatagttaaggagacagaagcacagggggattaaagtaatttgtccaaggtcaaacagaaaatggaaaagctggccaggccggcggctcgtgcctataatcccaacactttggaaggccaagttgggtggatcacctgaggtcaggagtttgagaccagcctggccaacatggtgaaaccctgtctctactaaaaatacaaaaacttagccaggtgaggtggcaggtgcctgtaatcccagctattcaggaggctgaagcaggagaatcgcttgaacccgggaggcggaggttgcagtgagccgagattgcaccattgcactccagcctgggcaacaacagcaaaactctgtctcaacaacaacaaaaaaagacagaaagaaagaaaagaaaaagaaaatggaaaagctaggcttgatcctatcagacctcaaagaccacatcttcatgtcctatgctatactgcttcctgaaacagcaaatggtaaaattctaccttgttataattattcttatcaccatccctgttcatttctctaaataacttatcacaacttgcaatgatgtgtattttgttttctttcttgtctctttaaatagtaagtaccatgagggcaaccgtgtctattttatccaccagtctcattcctcatacaatgcctggcaccttgcaagtatttgataaatatttattaaatgagttcatgggccaacaggggaactcatgataggataatgtctatgcaatggaaagtggttcttttcctagtaaaactcaaaacaaataaacaaacaaatcagagttggaacccttgtgtatggctactaggattatgtgatggtacagatggtatggaaaacagtttggtggtttctcaaagttaaatacagaattacaatataatccagctaatactagtatatatgtagtaagtaatagcatttagtacacgtacagtaaattactggtttaaatattagtaattattatgtattccactcctaggtatataccccataaattgaaagctgagacttaagcaaatacttgtacacagaaattcatagtggcattatttgcaatagccaaaagatagaaacaatgcaactgtctaccaatgaatgaataaacaaaatctgttatatcatatgatagaatattattatagaaaggaaattctgatacatgctaccacatggattaaccttgaaaacattgtgctaagtgaaataagccagacacaggacaaatattatatgattccacttacatgaagttcttagaataagcaaattcacagagacagagcatagagtagcggttaccagaggttaggagcagcggggatgaggagtaatgtcatgggcacagtgtttcagtttgggatgatgagaaatcctggaaatgaacagtggtgatggctgcacaacattataacactgtaagtatacttaaggctactgaattgtacacttaaaaatggttaaaatgggccaggcacggtggctcatgcctgtagtcctagcactttgggaggccgaggcgggtggatcacctgtggtcaagagctcgagaccagcctgacaaatatggtgaaaccctgtctctactaaaaatacaaaaatgaactgggtgtggtggcaggcacctataatcccagctacttgggaggctgaggcaggagaatcacttgaacccaggaggcagaggttgcagtgagccaagatcacgccactgcactccagcctgggtgacagagcgagactctgtcttaaaaaaaaaaaattggttaaaatgggccaggtgcaatggttcacacctgtaatctcagcactttgggaggcagagatcggtggatcacttgagcccaggagttcgagaccagcccaggcaacatggcgaaaccctgtctctgcaaaaaaaatacaaaaattagccagttgtgcacgcctgtagtcccagctactcagaaagctgaattgggaggatcacttgaggccaggaagcagaggttgcagtgagctgaggtcacaccactgcactccagcctgggtgacagagtgacactctgtctcaaaaaaaaagttaaaatgataaatattgttatgtatattctaccaacattttttttgaaataggaaatataaaactgtttccaccagcacatcactcaggtcagagagagccaccaagcagcaggcctgctaggggcacatggatctgagagaacagctgtcctcaggataagggtgctggtgtctgcagagcccaagggggctgaatgatggcagtgagtctctggcaatacagatgatactgattcttcatagagttaaactctgagccacggtaggcagagcccagctcatgctggtcattatgataaagtcctgggcgcaaggaagtgggcactccactgcagaaagagtggtgaacctcagacaccatggaaaacagaagattcacaagacagaatcctgctgcaaacatttccataggatggggacagaaacatgtctttcaactacctgtggtatccaccaatcctctgataagaaaggactgaaggctcatgccagggcctactgcacgcgacacaatgttgtccaaacaacaagtgcctgggactacttactgaacactgcccatagctccaagaaaagtgttacacatttttatcattaatactttggcatgaattagcttgctaagcagataagcaagttaatgactttccaaggcccgaagaaagaagatccaggtgaataagtttttgttttttgttttttgtttttgagacggagtctcactctgtcacccaggctggagtgcagtggcgtgatctctgctcactgcaacctccgcctcccgagttcaagcaattctccggccgcagcctcttgagtagctgcgattacaggcacccgccaccaggccgggctaatttttgtatttttagtagagataaggtttcaccgcgttggccaggctggtctcaaactcccagcctcaggtgattcgcccgcctcgtcctcccaaagtgctgggattacaggcgtgagcctccgtgcctggccccaggtgaataagttttgtaggagacagagatagtatttaggaagaagcaagggatagagcctaagtggatagccagagtgaagcccaagagggctggaggccgcaggaggggaggctctgaaatatccaaaggaagctcagagggcacaaaagagaaggtctggcttctttccaaacgttagtgtccatgaaatggagccatctaacctccagagagtagcgagagcctctcatcaaatgcccttccctagctaaagcaggggccctggagccacagttacactcaggcaagctcattctcatttttaggccttattgatgtgtataggtagcaatgatatgacaatgagaggaaagacattgggactttggagccagtcttcaggatgaatcctgcttcttccacttactggcttaggaattacttaaattccctgagaatcagcttattcattcatagaatgggttaatatcaacttaaggtaacaccatataccatggtaattcctattaggtaagtaggtgctatggattggatatttgtgacacccaccccaccccacccagaattcatatgttgaaatttaaaccccaatgtgatggtattaggaggtagggccctttgggaggtgattaagtcatgagagcagagccctcatgaatggggttggtgccttataaaagaggccccagaaagctctagcccccattctgccgtctaaggatacaagaagttggcagtctgcaactcataagagagcctgccatcaggccagggatggtggctcatgcctgtaatcccaaaacttcgggaggccaaggcaagtggatcagttgaggtcaggagttcgagaccggcctggccaacatgctgaaacccgtctctactaaagatacaaaattagctggtggcgcatgcctatagtcccagctacgtgggagtctgaggcaggagaatcgcttgaacctgggaggcagaggttgcagcgagccgagattgcggcactgtacgccagcctgtgcgacagagtgaaactccatctcaaaaaacacacacaaaaaaagaagaaagcctgcatcagaagccaaccatgctggcaccctgatcttggacttccagtctccagaactttgagaaataaatttctgctgtttataagccacccagcctgtgataccctgttagggcagcccactgcctacaacagcaggtaatacttaatgccgtgtccagcacacagttacatgttccatagatgttcatgtccttcttccatccctaattccagtcctgtgctctgcctaccctggagtgagcatgttgctgtttcatttattctgctccctgaatttgagatgtcagaggtcagtgccttctttttagccagcactgtaagaatttgtagcctttattttcacactgcccctcctctgaggctctctaagggcttagcagcctccaagggggaaatgtaaacaatttctattttaccaagagggaagctggaacacaatgcaagatcagctgtttttcccaaaaaaaaaaaaaaaagaaatttcaaattttcttccattcccatggttcattccactgtgtaaacggctgtcctggaaaccagccaagagcagccagcaatcggggaccattgcgggctcctggggactgctgagcaggggctggctggaggaagattttcagtcatcgcatcttctgcaaccctctcagactgcccctcccaaatgatgacacgttcagctcaagagtcatttcattctgaaacaattgccaagcaccaggcgtgcccagcctgtggataggaatgaatgacgtgcttcctctgatctatgtctgtccctttgagaaaacactcactgctaagtgatgttaacctcttgtatcacctcctatttttagcctcttgagtgagtgataaatcaggttataatctgacaggatgtttaaagacatattagaatcaaattaaatgacagggcctcagacatcatacacacttttaaagaacagagccagaacacattatccccgcccagtttcaatgcatacccattgaaacctagtttttgtaaaaggacttggcttatgtcataaggttgactctaagattaactatgtctcctccaattttaatcaagccccatgtacccagccagctcattccaaaagctggagaccgagatgatttctctggaatattatcattatgctgtgagctcagacactgctggtagaaaccatactctcatccatatctgtagggagcacctacttcatgacagccactgcctgaggcactgtggggacagtggtgaacacagaagacatcattcttacccttgtggagctagcttagtgaggagatagatgttaagcaaacaacccaataaataaatggctgggtcactgggttccactgctgaaattatgctatttggcgtctgttttagtctctctcttcatccatcccttatagctgtcttctatttggcttcattttccataagattctacatgactaaggtggccacttgcagctcctgactactgcggtgctaatgaatgatgaccccagagcaatgactgtccccagagtaccaccaaagtttcaaggaggaggctgactggcccgattcagatcacttgcccgttcctggacccattgtggagaactgcagaagaaataatccggccagcccaggtcgcatgcacactctcaaggtgggaagagggaggggtggtgttggtgcccccggcaccttatggcagagcaggattccgatggcacaggagagagtggtttcccaaatgaaaggatggtagctagtgaatgtttgtccacaagtgttagagagttgatgtttaaagttggtcaagtcaaagaagaaaagaggcagcactgtaaattgtgggtttttttggtgtttcttccacctcgtcttgagttgtgcaacatggtagaaagagagaggccttcagaaccaggcagatgtgggcccacatcctgcccccatcacttcttagtggctatgtggccttgtgcaagtcatctaaccctctctgagacagttccttgctggtatcatggcaatagaagctccgtatgggaagatgaagtgataggattttttttttttttttgagttttgctctgtcacccaggctggagtgaagaggtgcgatctcggctcactgcaacctccaccccccaggttcaagcaattctcctgcctcagcctcccaagtagctgggattatgggtgcctgccactaaggccagctaatttttgtatttttagtagagacgggatttcaccatgttggccaggctggtcaagtgacagaatttaaagaagtaggccaggcgtggtggctcatgcctgtaatcccagcactttgggaggccaaggcaggcagatcacgaggtcaagagatagagaccatcctggccaatatggtgaaaccttggctctactaaaaatacaaaaattagttgggtgtggtggcgcacgcctgtagtcccagctacttaggaggctgaggcaatagaatcgcttgaacctgggaggcaaaggttgcagtgagcagagattgtgccactgcactccagcctggtgacagagcgagactccatctcaaaaaaaaaagaataataataagaagaagaatttaaagaagtacctcattactgggagcactggaggtacctactggatggtgggtatttagaaatctccctggagtatcatgtcctgtaacaagctttgtaaatagtctccagaactgtgcagtgggacgagtgagtgatgcttacagacaagagaaagaaacaaaatataaacaaataaataaataagcacttccatattctgataagtgctctgatggaaataaacaatgtgacaagatgatacagagtaataagggtggaggtctccttagacaggtgagaccagaaaagcatccatgggaagatgacctgtgaactgaatcctgaaagatcagaaagggattgctatgcaaagaatacaggcagaggattctagacagaggtaacaggaagtgcaaagaccacaaggcaggaaaggggtgggcgtgttgaagaaacagaaggaaggccagtggtttgaatggtgagattaaagaggtgggtaggaaacagatcatagaaggccttcttcttttttttttttttttttttttttttgagacggagtctcgctctgtcgcccaggccggactgcggactgctgtggcgcaatctcggctcactgcaagctccgcttcccgggttcacgccattctcctgcctcagcctcccgagtagctgggactacaggcgcccgccgccgcgcccggctaattttttgtatttttagtagagacgggctttcaccttgttagccaggatggtctcgatctcctgacctcatgatccacccgcctcaggctcccaaagtgctgggattacaggcgtgagccaccgcgcccggccagaaggccttctaagacacagtaagaagtttggggccaggtaccagggctcatacctgtaattccagcactttgggaggctgaggcgggaggattgcttgagcccagaggtcaaggctgcagtgagccatgattgcaccactgtactccagcctgagtgacagagtgagaacctacctcaaaaaaaattaaaggaaaaaaaaaagaaataatttgggttttacattgaattatatatctggttaaaattctaataagataattaaggttgttgggtacaaaaataggtagataagggcatacgtggagaccagttaggagaccattgcaattgtctagagaatagacaactggggcccagcctaaggtgatggtactggagatggggagaaatgaatggattaaagatgtttttggtgcgccgggtgcggtggctcacgcgtgtaatcccagcactttgggaggctgaggcaagctgatcacttgaggtcaggagttcaaggccagcctggccaacatggtgaaatcccgtttctactaaaaatacaaaaattagcagggtgtggtggtgtgcacctgtaatcccagctactcgggaggctgaggcaggagaatcgcttgaacccaggagatggaggttgcagtgagccgagattgtggcgctgcactctagcttgggtgatagagtgagactcggtctcaaaaaaaaagatgtattttggttgtaggaccaggaagagtcagaggtggatttgtacatgggaaaggagtgaaagggaggaattaaagataaatcttgacactgaggtataaacaactacctgggagtatatggggccatttattgagatggggaagatttgggatgaaggagatttaagatgttgagtctgagatgcctatagggtcttaggtagtagtagggattaagacatcagttgggcaagtttgggtctcaagggagaggccagggctggggtacaaatttgaaggcatgggcatggatgagatctcaagagactagatgagaagggaagaggtgccagcctttaggctcacctatctgagcctcgagacccgtagaaaagccagcaaaagaaaagaagatctaggagggaaatcaggagagctggagtgatagagaccaagagaggaaaatatttcaaaaaaagcaagcattcaactctggtttaagatgttgaaagactagtgaaatgaggacaaggaaatgaactttaaatttagaagaagaaaaaaaatctaccctttacagtggtacccccaaactggacccttctaaaacaaatctgatcatgtttctcccttgattaaaagattcaagcctggcacagtggctcaagcctgaggcaggaggattgctggagcccaggagttcaagaccagcctgagcaacacagtgagaccctatctcttaagaatttttaaaaattcagtggctcatcacaacttcttattttattttattttaatttatttttgagaccgaatctcgcactgtcgtgcaggctggtgtgcagtggcgcgatctcggctcactgcaagctctgcctcccaggttcacgctattctcctgcctcagcctcccgagtagctgggactacaggcacccaccaccacgcccagctaattttttgtatttttaatagaaacggggtttcaccgtgttaaccaggatgggcatcacaacttcttaacagcttaattaacaatttggcctccatctgctgtcattccacaccctactctgccagctcttccaaagagcagtgaccagattcctcctgcctcgctcggcaccctctctgtgtctgtgcttacgctggatctctgtctgcttggcccttctcttgccctggtggatgtgtacccctgactcagctgagctgcaactccttaggtgaaaacttccctgattctacctccagacagtgttgtttgagccattctctagggactcacaaaccttctccatggatctctgacatagtatagtacttctcaggttccttttattttattttattttattttatttgagatggagtctagctctgttgcccaggctggagtacagtagtgcaatctcagctcattgcaacctctgcctcctggattcaagtgattctcctgcctcagcctcctgagtagctgggattacaggtgcccaccaccatgcccagctaatttttgtatttttaatagaggcagggtttcacggtgttggccaagctggtcttgaactcctgacctcgtgatccgcccgccttactctcccaaagtgctggaattacaagtgtgagccactgcccccggcctcaggttgcattttaatcattttcatattcatgtcacccatcagactatgagcaccttcacagtggggagtgtgttttattcatctttagtgcccagtacaatacctaacccaaagtagatactaaacaggtatttgttgaataaattcccaaaagaccactctttgaaacagacattctaaccattataaaggaaaagcaaagttaaaatgtatcttttgaacttgaatatacacacaagttcccatcacccaaaaaatcatcttagtggttagaaacatattaatacctgtattatgggttgaactgtatctctcccaccccaccccccaaaatattgaagtcctaaccccagtacctcaaaatgtgatcttatttggaaatagggtctttacagatgtaatcaagttaaaatgacatcagtagagtgggctctacttcaatgtggctggtgttcttacaaaaagggaaaatttagacatggagacagacatggtcagaggaaaatcatgtgaagacctggagttgtgaagacaaggattgaagcaacgcatctacaagctaaagagtgcctgaagctaccagaagcgaggacagaggcatggaatagttccttccctagcccctttagagggaacacggccctgtccgcaccttaattttggacctgtggcctccagaactgagacaatgaatttctgttagtttaagctgctcaggttttgttttggcagccctaggaagctaacagacctcacaacatgacagaagccaaaatatatttgctttgctttacccctttggaactctgaaaatttaattcttttcttttttggctgaaaaattgtttttatgctgaaaaaaatccaagaaaacccaaatagcactctgtgcaattttgcctaacagagaattaagaagaatcccaaaagatctcactttaattgggtttaaattaatctacattttacatttataatgacattaaattaaccaaatgcatttttataataataatgcattctgaagggtggaaattggattatgttaattagagtgctctatttttatttagtaaaagaaagttatgcatcttctgctcatttcataactctggatgagcctcattataaaataaaatagtctattaattaaaatgtactctatgaaaactgtagaattctggacggaaagcaacaggatggaggtaagtggtgaaaatttccagaatccacagggaggtgacggagaaggtgtcactaagtggttttggcagtgaaaaaagaaaagaagctgatatgttggggaggaattggtcagtctaaccagaaaacaaaagccactttaagtgtcttaacagagggaatttaatccagggaaaatagacataatggaaaagctacacatccaaagggatagtgaggcaaacctgaaattacagcagaaggaaccactgctggcttcaggctagagcactttctcaacctgggcactcttgacatttctgctgggataactgtttgttgtgggcagttgtcctgtgtttcatcacatgtttagccttcatctctgaccattatccactaaatgcccctccccaagttgtaacaaccaaaaatggctccagacattgctaaacatcccttgggtgtatttgtgtgcagcggctgggggtaagtagtagacagacatgctcccagctgagagccactgagctagaaggacaaaaggagaagtaatgaccagaacccagggccagggtcacccaagcaagaagagctggaaccacgaagcagagaggtctgtccagtagagaaggggaggcctcaggcagagaggggaagggacaaacaccctggcttctcccttgtccccacgttctccttcaggtggctgttggcttcctgccatacagagcagagcaagggaaaagagaggagtggctctgagaacacaggccaggggcagcactttgcttctgaataaggacaacaatttagatttcagatccaactcagactggtgctccttcaatttgccagatccccagacaatggctgcttcacacaggggtccccggatgacggccgcttcacacaggggcccccgactgacggctgcatcacccggggcagacctactgtgaaactaaaggcgcctaaacgccaagccccttacttgggcagactcaaggtccttggagggctctggtaatattttcctcatggcctcacatttagtcaacttggcatcacacttcccctcctgttgagtgggactgaagtgggtgtgggcatctgtttaaaggaaggttgagttggggatcacactgcccttggacctgggcagcagcggctcctgccctgaaccccacacttaggagggcctcaccctggttctcctcctgctatacccctccctttaggttgaaaagcccacagagtccaggagatatgccacccaaaatgtacacacccctcatccccagttcttgcccatactttcagtacctaagaccccaggattctctgctcaaaggccctgagtctgcctccaggatgtacagggtcctctcccctgagtccagccttccaagagtggaccatgctgtcagagtgcacacccttagacccaggaagtggccaaggcaccgctctttgctggaggttgtggataaagcttggacattgtagactagggtatccacatacatgtgtgagaggctgctcatagtatgaaacggagtagggagtaagaagagaattgggggttcagaaatgagcaataaaatcaatagaaattattctgggtcaagcactatggttcgcacctgcaatcctagcaatttgagaggccaaggtgggaagaccacttgagcccaggagttcaaggccagcctaggcaacatagggagataccatctctacaaaaaatgtaaaaattagccaaatgtggtgaagtgtacctgtagtccaagctactctggaggttgaggtggaggaacacctgagcccaggaggtcaaggctacagagagccatgattgtgccactgcactccagcctgggcaacagagcaagaccctgtctcagaaaaaggaaagaaggaaagaaagaaagagagagagagagagagagaaagaaagaaagagagagagagagggagggagggagggaggcagagagagggagacagagagagagaaaggaaggaaggaaggaaggatggaaggaaattattctgacaatgagaagcaaactgtaagccaaaatatattttttttcaaattatacccaaagtatagtaactaactcatttagaggaagaaaggactttcaaacaaagaataggcttttatattgtttgattatctatttattttttatctaacatgaaatactgataccataatccaccagttcaatggggttaccaatgacaaactggctaatgaaggtcatcaattcagaatacttaagatcagtccctctgtgagaaaacttgaaatgtacatgaagtcttacagttcatatatgaaagaaattttctgtggagtttcccaaatttggcaacaatttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccggcaacaattttaaaaatttacatgacttaccaatagccagttctgaggctgaaaatcttttctaatatataaatattttaaaggaagagtattcaaccatgctatagggaagactgaattctctatctctagaaaatgatattacgaaatcattgcatgtgaagaagcacatggaggtatgcaattacaaaaacagaaaagtgtaaagagagtgttgagtagtccaataataaagatattatttttctggatttttgtactatttgtcagcttttaaaactttgtaacatgctataatttcttttcccattttaagtaaaatattcaatttcatacttaattttatatttataactttgcattctttttcctagggaaggagctcacctccccacaaattgtataaaccttagtttccacaaaacctggatcttccctggcatcatcatttattatgtgagttgtttgggtgtggagaggtgaagtgagaggtgcttgagggctatgtctggggaaatttatagaaaattatctgaaagggcagcttctgctgacccataagatgtcaagatgtattattttgaggtaaacatgtcagcaactggtacttctcggatgccttttcagatgactgaattctctcctcatttctccttgtttttgttgtgtagtcatggtggcagctgataagaggtgagataatggggccagggacagataccttagctgtcacctcacagtctcccacaccatagagagcaaagaaagacaatggtaaaaaaaaaaaaaaaatcccacccaggagccccccggaacacgccactcatcctgacaaagagctggtttccaactgggacagatcccagaagcagaccaagctggggtgtgggccccagggcagtaggagccaaaccaacttgtttcctctgtgaggctacaggctgcagagccaggactattcttctcatggaacaaagcacagggattaatttgcaggatgaaatttattatgtcttttacagtaaagacattttgccctgaagcttattaggtttctgagtgctcacattttctgaaaaatagccactgcaatttgcagatttaattccaacctaagttggtgtggttcagggatgtgtccaagacaggctacccggggcaatgctgcgcatccatttcccagcaaagcttctttgatttctgaaagactttaccattaaatatagtgagttgaacacaggctttatctcttctctcttctgaaatctcaatcacatgactgtaaaataacaaaatcggtgtgaagtaggtataaatccacgcagaaaaaaagaatgagaggaagataacagcagactagagattcaacagaattctggaagctggaatcctgagaagtgggacttgcagggcagagaaaactggatcagaaatactcaccctgcccctgccacattaggccagaacagaacacctttcacaaagtaattttcaatgtatatgttatgagattattttctaagatggatcacttatgattataaaacaaagaactttcctttactaaataggaggagctaatcaggagcaagttcattgttattctatgtctgctctccaatccctggccaagaaattctctttctggagagggtgagcccgcaaatccctgactcaggaggacttgggtgagatgtcacagtgcaaacagaggtaaaggtggagttggctctatctgaaacacagactgaagaagagaagagtggtttccccagaggaaaagaagaaaagtggggtaaaaataataataatgtggacaggaagcaaggaaatactgggtagaagagggtggttccctggcaagggccccactctcaagcctggaaacccacgggaacaggcattcttgtttttgtgcccaaatgttgccttttggcctgccacgccccctatcttgtactcatataaaccccaaactccaggttccacaagcagatgagaaaacagaagagcagcagagtggtgcaacagagaaggagagaagagaaggagcatctgaacatcaagaggagttcagctggggacagttggttgggagatcagctacaggacagccaaactccaggggaagatgatcttcccactccatcccctttctggctcctcatccattctgctgagagccacctccagctctcaataaaacccccacattcaccagccttcaagtctgtgtgtgatctgattcttcctggatgctggaaaaggacctgggtaccagaaggacagggtgtaaaaggctgtcaccctgactctctactgagctggtgtagcaattagctgtccacagatgacagctactaaaagggcataaattgtaacaccttcttagatgccaccatggggccagagcccaaaagtgctcaccccagctcctgcatctgcccatctgtgtgctccccctcctgtaaggtgtttgagtgcatggtggtcgaacatttgagccatactcctgctgcatgtcctgccggggggtcagggaactctcccatttcaataagagtttatatataaacctgtaccaaatagtgtttaaaacactttctatacactaattcagttaattcttacacgactgtgtgctggaggtgcaaatatcacttaattttacatttcatgagactgagacacagagaaagtaaattccccaaggtcacactgctggtaagtagcagagccaggagatgaacccagacagtctggggaaaatggttcctgggtgacaaaaacacaaaagttctgccatagttaattttgcggatggtacaattttacccggtttcccataattagaaaatgggacgaggaaatgccataaggttaagctcgttcctctgagcagattcttttctgcagcagcaggtccccctataaatatgggtctgtgataatctgagtaatggcccccaaaagatgtctgtgtctcagtccctggaacctgttactttacatggtcaaagagactctgcggatgtgattaaatgaaggatcttgagatggggagatgagcctggatgggttctccagtcctcacaggagaccccacacccctttccacttccagaccacgaggggaggggctcacagactagaaagccctctgcaaatgctaccctgagcccatatcactattgcaatcactggtaagaatctggggacaaaggtgagtgggatctcagacagatatctctccaagttgggatataactgaaatcggcactgattacacctgacattggatacccatataaccaatggtttatgatcacagaacagcaaactctcccatcaaaatcagggtaaatataccaagatatttgtagaattcaaacaccaatctaacttgatttcattcaggaaacacaatgtctagagtgttaaagactttgctgtggtttcaaggaaagaatcatgaataaagtctggctcagccatgtctataaaaaggattaaactttatgagtcatggatgagagctggtgtgtgatcaacagcccacctgttctcttggtgtaaatcatgtcttttcatttttaagctacttttatattgtaaatctataattctaaaatgacctttatagctggaggattagagaggaaccctattgttctggaatgggccaccagagacttgagcagatgggagaagcaaataatataagccaggaagggcaccaagagagtcatttgtcttagggtatgtcaatcatttcaggtctgcaacaggactctgtgttccctagataaggagcagaagtttattgggtacacccatatgagtcatgaaccaggaaaacacacgttcagccaggagctgcaggcagacattgggaggccatatgactgtcagaggtactaggctcagaccttgacttagaacagagacatcaaaaacatgaggcacactccccattccatgtccatggcagacattactaagtgatcactgcatactttcttgctgagaccagagacagcctcagaatctctcttagcacagatccccattatctatctcctactacctattttgttgttgttgctgttgttgttgttgttgtgagacagggtctcactctgtctcccaggatagagtgcagtggcatgatcatggctcactgcagccttaacctcctgggctcaagcgatcctcccgcctcagcctcccaaatctactacctattgaacagagttgacccacaaaataaaacctatttgttattcctggtccagaacaaaaagaaaaggaggcaaacttcagttggaataaaatctgcattaatacctgtcttgagaatgcaccaaaggcacgtggcattgaacagagagctctggacaagaaaagaagggaggatttccgggcgctgaagccaaggaggcatccagggagttgtagaagatgacactagccacgctgaaatctagatgagctttaatacttcctcatgtctctttggccttaatggaatcaagtgcccatcctgaagcaatcactgtagtcagatgcaagggctttgttgatcggcttaagttaatcagagcccacccatggaaaagaaggaaggcatgtaaaggagtgatgagaagcagctgtgtgagctcaatgggcagaaaacccgtgcattacagagcaagaagaatttgtaagtaagtaaaaagggagccatcaaaagaaagcaagctggaaatccgctacagtgtctttacaagtggcatcaggtgggctgatgtggaactaaagtcattcccacctaaaccacatgactcacagtgggggtgaggtggcgcctcacagaaaactggggtactattaccatgaagaagaggagaggagatttaatgccaaggagtaaataacaggcggcattcacagtaaggtaagatttccaaggactggagtgagagagctctactcgaagtacaggtatctacaaagcaggtgcagagtggcctgaagcccaaagaaatcatttctggagaccaaatgggaagcactttcgttctctgaggagacctagggtatgaaaccggccataaaaatgaggaagcaaatttaggttgtaactcagaatgctcccaggactagcaaatgtgccggcatgaattttcctggagtaagtggttaaggccaaccttccaatgtcatatgagaaagacaccctagagccactcaggtttttcttactgcacctagattcataatagaccacaaagaccctaagagcaaatgatttctacaacctgtgcaaacaccccacgtttgtaattcttccctggatatttccttacagtggttagcaacaaattgctgaagtcagaaagctccaaagtgcttgccttctaggaaagaaagtaaggaaactggcggggggttgtgccccatttctttgtcattcctagaaacaggaaagttcccagggatgaagagggagatggcaacgttgaaaagaaaaggattcagggctgggcgtggtggtccatgcctgtaatcccagcactttgggagacagtagatcacttgaggtcaggagtttgagaccagcctggccaacatggtgaaaccccatctctactaaaaaatacaaaaattagccaggtgtggtggcaggtgcctgtaatcccagctacttgggagcctgaggcaggagaatcgcttgaacccgggaggcagatgctgtggtgagccaagatagcaccactgaactccagccttggacctatggaaaagaaggaaggtacatagaggaacgatgtatttctttacaactagcatcaattgggtcatgtatcttttagctttaagcattaaaaaaccttccccaaactggcttagacagaagaacttattggcttacgaaagagaaaaatggagaatgaattttaggcagggtttgatccagcaactcaagggcatccacgtcttcccatctctactctcttcatcctaatgttggctctcattattgcaagatgctgaccagtagcccctggggctgggagaaggggaaatgtgtcctcattaatatcaaagagaagagaaaggagtctgtgtctcagaattcttgtcaaaggacctcggattggactagcttaagtcttgtgcccgcctttgagccaatcgctgtgtccatggggaggaaaatcaggttctaaccaggagatggctatggagccagccacataaaacctgcagagctgagaatggtgggaatgagtgctggtttccccaagaaaataggatattgttatgatgaatgaagagaaatagaggctggacagccaacaacaggtctcctagcatcagatgtacaggggaaggtggaatgtgtgtactgcacattctaaatcaaaggtaaagttaacagctgaagtttctccctagaagtaacttttgcttgaaaaaaaaaaaatgcaacaggaagagaaggctcccatgatgtgattgtgaccatgctcagctgggtagcagctgctctgccagatgagacacagggatagccaatgcacatgaataatctctgaagatggatctgatacatgcactttacctaacagtcttggaaggactcataggatacaccccaaggagtgagttaatgttgtgtgctttatttattcacaaggatggtttcctcctgaaacccagcactgtgttaacattctgcatgtcactttggttcaagcaagtcccaggaagatggatcactatttattcactgaagaatttcccaagttaaagaagagatacaattaataacgttagagtagcccagctagaaactctaacaagttatataacatagaagacagagaataatgagaacagttattcctttgtgcttcaaagagagtagtaaaatagactcgatagcatgaaaatttttcaatagttttttttttccccactcttggcctaatgggccttgattcatgccaggggtctatggggctgaaagagccaacatatctatctgaaatagagttctccaaccattatgtcagatataacagtagttttcaaaatcttgtctgataatgaggcgattgtttaaatgagttatgatatacacctacagtgaaattgtactcattcatttaaaatgatgctgtaggctgggcatggtggctcatgcctgtaatcccagcactttgggaggccgaggtgggcatatcacttgaggtcaggagttcgagaccagcctggccaacatagtgaaacccccttctctactaaaaatacaaaaaaattagccagtgtggtggcaggtgcctgtaataccagttactcaggaggctgaggcaggagaatcacttgaacctgggagtcagaggttgccgtgagctgagatcatgtcactgcactccagcctgggcaacagagcaagactccatctcaaataataataataatgctatagataaaaatgcattaattttgcctaatgtttacaatttattacttttttctttttcttttttttgaaatggagtcttgctctgttgctcaggctggagttcaatgtcgcaatctcagctcactgcaacctccgcctcctgggttcaagcgattctcctgcctcaacctcctgagtagctgggattacaggcatgtaccaccacacccggctaattttgtatttttagtagaaacggggtttcaccatgttagtcaggctggtctcgaactcctgaccttgtcatccacccacctcggcctcccaaagtgctaggattacaggcatgagccaccgcacccggccacaatttatttattattgagcgagaaaagcagattaggaaacaacatggagaggttataatcatacttaactaaaatattaaaatatttacattttacacagaaaaacgagaagatatactctgaggtattaacagtggttttttttggatgctctaatcatgaatattcttgaatcttttcttgtttatattttctaaattttctatgatgtacatgtattgcttttgtaataagaaaaacacatcagagagattttattttaaaattatgcttgctgcatctgtaagtctttaattgtgcttatactttcctcttcaaaacttttgggtggcagctcatgcctgtaatcccagcactttgggaggctgaggtgggaagatcatttgaggccaggagctgaagaccagcctgggtaacatagtgagacctccatctctactgaaaactttaaaaattagctgggtatggtggtgtgcacctgtagtcccagctactcaggaggcttaggtgggaggatcacttgagcccaggacacagtgggccatgatcgtgcaactgcactccagcctgggtagcagaataagaccatctcttaaaaaaaaaatggcattctttctgtcagcagcgacagtcatctgtggattgatgtaggggagtaaaaggatatgcgcacggaaaaatgaatgaatgaataaacacagcaccaattagagcagtgaaggaaactcaggaatccagaggccaacccccagttcccttcattccatctagctaacatctaaatgagatcctgttccaggctatcctctttccagtcactagaagggacagtccgcaggaggcattttagtgcttccagatctggagatggcgttttcttgctctcaggaggggcatcttaagagtctagactctcagacccttctaaggggtcagccacctccagcctctaccccttgaggaatttatcttttcattgatctctagatccctccagcctccccaggtggggccacagcttgtctcggaaggaatgccatccctgctgaacctcaggggctccttgaccttcaccctgtctcagtcaccttctccagcgttgccacccccacacaaccctcattagtggccaccatcaccactgccgccgtgctgcagccctgttagagacgacttccctcctcttcagtcctgagcaaagagacaaggaaacaccttctcaacagcctcgtgagtctagaaacacagaggtcccattcacggggcttttcccaggtagggaggaaggcgtggactcatcaatcttccatctcggcagcaccccttcctcttcttgttaaccaccctgctagcttgagggacagaaagtgacaaaaaaaggaggcgaaacaaactgaaagcctgcaattagcttaaatgagctatccactagatgctgagctgtagtggattgttgcgaagggccccatgttgacaggtttggttttttgtttttttttttaaatttttcaagaataagcagaaatctagattcttatgtatagtctcccagattttaaacattggtgactcattttttttaagacaaaagtctctctctgatgccccggctggagtgctggagtgccgtggcaccatctctccagtagctgggattacaggtgcccaccaccacacccagctaatgtttgtatttttaggagagatggggtttcaccatgttagccaggctggtctcaaactcctgaattcaagtgatccacggcctcagcctcccaaagtgctgcaatttcaggcatgaaccactgcacctggcttcattctattttttaatcccaatataaatttgtacccattagaaaatctattcagctgcttttttttttttttttttttttttttttagacagagtcttgctctgttacccaggctggagtgcagtggcacgatctctgctcactgcattctccgcctccagggttcaagcaattcttctgcctcagcctcctgagtagctgggactacaggcgctcaccaccatgcccggctaatttttgaatttttagtaaagacggggtttcgccatgttggccaggctggtctcaaactcctgacctcaagttatctgcccaccttagcctcccaaagtgttgggattacaggcatgagccactgtgcctggcccagctgcttctatttcagagaaataatatggcttaagagagagacttctttctctcccacctgaaagaagtccagaggtgggcagtccagggctgcatgtggctcatgagagccctatgtctgaattacatggcttgggtttctttctagcagtttctagaatgcactggagcttcaattccagatcaaccagctaaatgtccctgggaacagccatttatctttctatgcctctgtttgctcatttgtaaaatgaacaataacagcacctccctcacaggttggctgttgagaattaaatgagataatacacaaaaagttgtcagcacagagcctggaacacagccccaaaagtgtaagattaagtgaccccatctccactctttgattacctgggtcattataaactgtaacaacaaagcaaaatcacttgaggtcaggagtttgagaccagcctggccaatatggtgaaacccccatctctactaaacatacaaaaattagctgggcctggtggcatgcgcctataatcccagttactcgggaggctgaggcaggagaattgcttgaacatgggaggcagagattgcagtgaatcaagatcgcgccactgcactccagcctgggggacaaagtgagactctgtctcaaaaaaagaaaaaaaaaaaagaaatgggaatcaggagccaaaagttaatctgtaagaacataagctctacccctccctgaagctttggatagattgttggattttcttcaactgtgaaggggagaggggctttctgagtcaattttatctagatctaaggagcaggaagaccccaagtgacatttgatttgtatagttaatgcctaccctccttctgtccccaaccacttctagagactcttggcaaaattggatgggaattttctgacactgcctctgcttgtacaatactgagaagtcaggaagagcttgagttggctgtaattctaaagggtgaatggatgctgatggtgtttcctagcaacagctgaaaagaaatcaatgtcaagtgatacaagttccatgagtagaagaagcaaaatatccactgaaacatggtgagaagtcacatgacctaggtactgactgtcaggcccaaactggccattgtaagctaatcttgctgttaggatgctgtaaagatgaggcaagagcaaaggggttgtaggaagcctcataaaaatgaccccaaatcaaaatgttcaatcaaagcccagctttggagcaatggccttagccagagaaaaccacttaatttgtagataaccaaaggtcatagaaggttgtcaaataaatccctttaatctaattatgaatgacatttacctcaataaagccacatggtattaaataagacattaataatcatatctcacaagaatggaaatgactctcatccattacccatctcataaacttagaaagcattgatttttagccaagaaccaactgaagaatactaataccctactgcattagtcagggttgtttttgctgccaatgagagaaattcagctggaattaagcaaattcaaggggacagagtaagtcatagaatcaaaggaagtctctctctctctctccttcctagggaggctgggcatggtggctcacacctgtcatctcagcacttggggaggttgaggcgggcggatcacctgaggtcaggagttcaagaccagtctgggcaacacgatgaaaccccatctctactaaaggctggtgaaaccagcctgggcaacatggtgaaactccatctttactaaaaatacaaaaattagctgggtgtggtggcacacgtctgtaatcccagctacttgggaggctgagacaggagaatcacttgaatccgggaggcggaggttgcagtgagctgagattgcgccaccgcacttcagcctgggtgacagagggagactccgtcaaataaaaaaaaaaaaaaaaaaagaaaagaaagagagacagagaaagagagaaaaaaagcaagccagccagcctagggaataatttgattagcttggtgtggaccgcacatatgtcttattccagggccacttattagggccaggaggatggtgtcagaaggcaggaggcagtgtgctgtagttagcagggctagaatgggaaggagaagttttccaaagaaggcggatgctgttttcaaaagggaagaaactgatgctgagcagacaaataccaaatgcccggcacatttattgaatctgtgataagagtgaattttataacctgccactatcattagcttgtctaagttgtcttggcaaaggtaaaacattacagaatccagggctgtctggaatgtactgtggatttgatctttctaaatcatttgtaattatctatcataggaggtggaacgtcagctgtacatctctgaaaataccaaatttcattttcctgtaaataaaagaagggcactataaagataaaagctaatattatagctatatatctaattttgtcttcaaatataaccattaagtgttttaagtaaataatttaaaattgagtttctagtaaaactcaaaggaatattacataaaataacttttaaaaagtctctaagtcattcttgtatagtgatctatattaactaataaaaggccaaaaattaatcatgctttcaggaactgtaaatcagtaaactaaattatcattatttaatattgttgttaagactgggtgcggtggctcacgcctgtaatcccagcactttgggaggccgaggcaggcagattgcttgagcttaggagttcaagatcagcctgggcaagatagtgaaatcccatctctactaaaaatacaaaaattagccaggcgtggtggcgcatgcctgtggtcccagctactcagaaggctgaggtggaaggatcacttaagccagggaagcggaggttgcagtgagccgagatcataccactggactccagccagggtgacagagtgagaccccatctcagaaaaataaataaataaaattgttaaaattttggatctttgcttatgattccaccaagatcgttaagatatgatgataataatactaatgtttaccatatgtcagatgctttacctaacaagtctaaggaagatttaatcatccccgtgttacagatgaggaaactgatttcctcttaggaggtgacagttgcccaacgctacgtgactaagctctgggatggtcctaggtcagtccaactctagagccggatctctttccaatctgtcatactgcttccctgactcaacggtgctggagagaagaacgcatctgttcaggatgtttgttaatcagatagaactctaacaactgagtgttccaaaataattattcagtccacaaccacaccaccctaaacatgcccaatctcattgaaaataattattgaatcataaattatataaatgtgccatacagttggacaaacaagttaacttattagatttttaaatgtactccaaaaatagagtagacacacttgcggtgtgtacgatgagataagtgccaattctaggatcctaaaagaaatctcaacatcaaactcaacgagcaaatacagacaaacaagaaatgagggcaaggcagccattcctccgtcaaacgtaggggagaaactttgctttaagtgaccacaagagaaaatgtgagagtgaaatcttagtttttcaccagtggaaaattagttaagggttttaatttagggttgtgggggctgggtgtgtggagaccgtaagggagctgggacaagcacagctgtgtgacaaatattaatggctatcgcaattctcaaactgagaaattcaggtcagcctgtagggcaagctgcctctaaatgcaacaacctttttatatggctgactacttcttccatgagtaatttttttattttttcacttagctcaagttggaattaatggttctagtgatttgtgttgccttagatgaaattcttaacattgcaattttattaatcctacctgcaaagagagagcactcgcgcctgtaatccctgcactttgggagggtgatttctcatttctcaaaactgagaaaatagtttttcatgtaagttaatatttaaattttcaaattaggggctgggcacagtggctcacgcctgtaatcccagcactttgggaggccgaggcgggtggatcacgaggtcaggagattgagaccatcctggctaacacggtgaaaccccatctctactaaaaatacaaaaaattagccgggcatggtggtgggcgcctgtagtcccagctactcgggaggctgaggcaggagaatggcttgaacctgggaggcggagcttgcagtgagccgagatcgcgccactgcactccagcctgggtgacagagcaagactccgtctcaaaaaaatacataaataaacaaataaatttcaaattaggatccaggttttcttgcatgtaatttttccatcccctttgtattactttgaaaagagtatcatacatcacctaaaattgtgaggctgatgcttacccttatttagtgacataaaaatgactgccaatttttttttttttagcaattttattgtggctcaaacttccaagtccaggctacatgcaggcaaatctgtaaatctgacttctctgcaactggaatcaggtagagccatcacttacagaaattttaaaggcccggatatatcctcaaatgtacatgcagaggttttatggaatacatgtatccatttcaacacaaactttaagtttttaaataaagctatttattagcttatagtaataaatcctggcaaacactactggttcataatatgccaagagttatgaatcagaagattaataatcagggctacatctagtaagaaaggtggctggctgggcatggtggctcacgcctgtaatcctagcactttgggaggccaaggcaggtggatcacctgaagtcaggagttcgagacctacctggccaacatggaaaaaccccatttctactgaaaatacaaaattagcagggcatggtggcgggtactggtaatcccagctactcaggaggctgaggcaggagaatcacttgaacccgggaggcagaggttgcaatgagccaggataacgccattgcactccagcctggataacagagtgagactctgtcaaaaaaaaaagaaagagagggaagggaaggggaggggaggagaggggagaggagaggagcaagcaaacttgggcaacataggaagaccttgtctctataaaaaattaaaaaactagctgggcatggtggtgtatgcctatagttcaagctacctgggaggctgaggtgggaggactacttgagcccaggaggtcgaggctgcagagagtcatgattgcaccactgcactccagcccgggcaacagagtaagaacctgtgtctgggaaaaaaaagaaaaaaaaaaaaaggaaaggaaaggagaggggaggggagggaagggaaggggaggggggaaaaaaaagaaagaaaggaaaggaaaggggaaaagggaaaggaaaggaaaatgaagaaagaaaggaagatagtacacagcagtaacaaattctattactagaggagaagtaataaagccataaggatgctgtatcagtgaggacattcagctgcaagtgaaagaagcataagtcaatacagatttgaagtcaagctataagaaaatagttggggaaatttactggttcatttactggttcatgtcattgaagagtgtaagtgaatgtacttcaggcacatgtagaaccaggttctcagacagcagacatcagcctggaaaacagcgtttctggccaggcacggtggcttacgcctgtaatcccagcactttgagaggctgaggcgggtgatctcttgaggtcaggagttggagaccagcccggccaacatggcgaaaccccgtctttactaaaaatacaaaaattagccagccatggtggcatgcatctgtaatcccagcaactcaggaggctgaggcaggataatcgcttgaacccaggagatggaggttgcagtgagccgagattgcgccactgcactccggcctgggcaacagagtgagactcggcctaaaaaacaaaaaatatacacagacattaacttcctggagccagagctgataaatatggctccattactatgctcttatgatgtgtgcatttcatactatgggcacttggcaccagtgtatgaattaacttgtatttgagaagaatgttaggaacaggacatctccattcatagaaggatgacttgaaagcggggatatagaccgacaggtctttgcaagctgatcacacaagtgattgcaaacccttgaaatgatcaccaattttttggaaacacagcatgacatcatggtaattagtgttctttttttcctgtaaaaattgcttaatgaaactttagaaatttcctatgtataactatttgcatgtttagatgttatttcccacaagaattcttactttctgaaacttcagaatttactgttctgggctgccgctgtttaatttcagtcactatctcacctccaacaaaaattattattattttttttgagacagagtgtctctctgtggcccaggccagagtgcggcagcgtgatctcagctcactgcagcctctgcctcccagattcaggcgattctcctaccttagcctcctgagtagctggcactacaggcatgtgccgccatgcatggctaatttttgtatttttagtagagacgggtttttgccatgttggccaggctagtctcaaacgcctgacctcagatgatctgcctgcctcagccttccaaagtgctgggattacaggcgtgagccactgcaccctgccctaaatctaatcaatacagttttgcttcattatgtctacatgtagagtgcttttgtaggtggacagtggctgtttagtaaatgctcaatacacagattctttactggaataattttgttcaggccttttcccaaaaagtaacaataagtactatgaataaaataaaacaaggaaattcatacaaataaacaataataggaagttcctgaggaagctactttagattagatggacacagaacattctgttgaggaggtgatacttgtaaagtaagatatgaatgataccaaaaaaaggagcaacacaaagatgttaatattctaggcagaaggaagagcaagtgcaaagacctaagacgagaatgaatccagtctttgaagattagacagaggcttgtgtggctgacctgtagtgggtgatgcagggagaaatgagagatgatatctgagaggtaggtcagtaaggcacatcataaacacaagcagggactcccacaggcagttccactgtctttttttttttgagacgggagtttcactcttgttgcccaggctggagtacaatggctcactgcaacctccgcctcccggattcaagtgattctcctgtctcagcctcccaagtagctgggattacaggcgcatgccaccacacctgactaatttttctatttttagtagaggcggggtttcatcatattggtcaggctggtctcgaattcctgacctcaggtgatccgcctgccttggccccccaaactgctgggattacaggtgtgagccactgcactaggcctcttttcttttctgtgaagtgagtttctccaccacggacactgtcctacatatgacaaggtagaaagcattctaatcccatgaatgctgatgttgaccaaggcatgataggcaaggaaaacagacccaaattcagaataagtgcctattcccacaaaaacaaatcatctctccctccaatatggaagaagtcccgtgaaatgaacttgccgcattgacgatactgggcttagatatgtgttttctgttgggatcttcaagaagtaggcactgagacaaagatttgttcccagaaggtgatctcagtaatcatctggctactttgttctaaatctttttggattacagctccaagcctcaaggttcatttgccaagctcctcccaaaacttttacactaatcttccatgttgcttttctccatctctgactatctagccagtgactggttacggttacagatcctcacctcagatcatgtttctctcaagtcaaagtacatgataaaagacagtgcttggaattctgcctacaaattgagatttgccctctactgtccttcaagaccaccccaaatatacacagtacatttctagctgatagtgcctattgttcatggtatctgtaagccaggtttggtttttttcattttcagttaactggataataatgctccacaagggtaaagggacagattggtaggggcgaggtgtgggaatagagtagttaaaggcacagggtcgggagaaatctgttcaaaggaaatgtgtcttcatggcctgtctggtcccacctgctaggtgatggagtgctgctggaaatggtcaactttatgagtagatggattaaatagcacctggtgtcccatagcctccaacatccccagaagcaaattagaaccgtttctcaaaaggagaatagtaatcttccagaagggggtatgaccttgctccaaagtcctgtgggcttccattgtgattctcctggagaaatttgtctctgacttcaataagtctcccaatcagccagatagactttgagagggctgagcagcagagctgcttggactgcagactgggccacctacagggactatttttgctctgccagcttttcaggtcaccaggtaaataaataagtgcaaaacacctgtatgttatatgctgtctcaaaagtccagggctcaaaaagccaaaacagcacactgaatagtctcttgaaggcactgaattcaacctgatccagctaagtaagggatactcaggacatagggctgtagtagactagtttcttatgaatgaggaagtttcaaaataactggtttttgcatgttggttctttagcacagttgttcaaaacattggctgtaaatggaaccacaaggtgggtgcagggagaggttttaaaaattactgatgcctggaacctgccttcagagatgctggtctgattgcctggcttctagattataaaaaagctaatatgcagccaagggcaaagaccattgttctagttccttctagatgtccctataccaataggcagggtcccactctatcccttcattttcatataggaaaccaaggaggtaagctaactcatataattaccctgcgtttcacttataacccgaaaggtatctgagacaggtctcaatcaattcagaaagtttattttgctgaggttaaggctgtgcctctgacacagcctcaggaggtcctgacaacatgtgcccaagtggtcagggtacagcttgcttttagacattttagggagacatgagacaccaatcagtatgtgtaacatgtacactggttccgtcaggtaagactggacaacctgagatgggggcttccaggtcataagtagataagagacaaaaggttgcattcttttgagttcttgagcagccttccactgaatacactttagtccggctcagtgaatccgtatttttaaataaacaataaggcagaggaagcaatcggtatgcatttatctccagtgagcctcagagatgactttgagttctgtctgtcctttgtccacaaggaatttcaaggaaggagatatgtagctttttatctttgtagctattaatatcttatttagggataaaatgggggtcaggtttgcctgacatagtttccagcttgacttttcccttggcttagtgattttggggtcccaagacttattttcctttcacacacttgatgccttgagttgagatttgagaatcaaggtttattctctcttaagtcattcaatgcccttggaaacaaccacctgactccataatcctagcatttctttccattgctattaaattgttccatggtggctgctaaccagtctccaggggccttatcctaagggggctcatggattctggtgactaaaggcaatagcctgctaagctccttgatcactggagctgtgagctttccatctggaatgcagagagatgtgggcctttcaccctacccagacacaacaaccagttccaaagatcccgcatcatttccttgaaggtcttttgcctacctctggtaccaatctggatattaaagacttttttatttgtaagcaacaaaaaaaatctgtgaccctagttagcttaaagaactaagaatatattggaatagagtctaggatagtttacagtttaaaatgaaccattaaagaaccagactcaggaaatacgatatctctgataacctccttagagagcgtcaataaaagccacccagttttgatgactttcagccttcgtgtctctccattcaagttccaaattcccatgagaaaatctggcttggcttaggtcttcccatataatgagctatggtagtaaggtacggtcccaaagcacaaacaggaccacagaggctgtttccagaaaagggaactgtaaaccaggcagctaccccaatacaagtctacttcaatcaccatgtttggaagcatctattttgcagttggaaaacaacaaagtgaagggcaaaaaggcacgaaagacattgtttagtcacacaattttaattgtgaattatagtgaatggtaaacagtaaaagagtaattacatgaaaagctccatattttgcatgtttcaactgttcttcattgtctttacttgtaaggtgttgaaggtgggatccactcctgaatcttctttctagtggtagaataaggtacatattgttctggggtgccagtcacgttgaatttatggttcgtccaaatgaatttacgagcagtaagtggttttgttgttggaggatcatcagtcatactgtgaagccaacgatgccttaaagaggggaaaaaacccaaacagttatgaagaggcagtacagcatagtggaaggacggttaaaaacgtagccctggaactattttgttgcttgggttcaagcctcaactccatcagttactagctgaattcttctatgccttagattttttccatctgaacatccctactcctcagggatggtataaacataaaaggagataatagacataaagcacatagaaaaattcttgtgtgtggcagatacgcaacaaatgttagctaccgttctcattactgtatttttttttcttcgttttctttctttctttcttttggagacagggtctcactctgtcacccaggctggaatgaagtagcactatcatggctcattgcagcctcgaactcctgggctcatgtgatactcctacctcagcctcctacatagctaacactacaagagcatgccaccaccatgcctggctgactttcagaagatttttgtagagataggatctcactatgctgcccaggctgatctcaaacttctgagctcaagggatcttcctgcttcagcctcccaaagtgctgggattataggcatgagccaccatgcccggcccattactgtatcttatcaaatctgacactatccattttcagacatgccatgattttatctacctctaagaaagaaaagatgctaccaaataaattatggccactactgattataatatgtatcctaattttagacgtggaaatgcattttagaactgataaaaatacagtattactattaggtgctagaggccgattctggattttcagtatgctcaggttactctggctcatgaaggtttagtttaaaacccatgaggctcctgctgagaagagcctgatgcattgtaaattcaagcatgtgagtgtaaacactagagaatatgcaacttgttatattaaaaaattaaatcagggccaggcacagtggctcatgtctataatcccagcactttgggaggacgaggtgggaggatcacttgaggccagaagctcaggaccagcctgggcaacatagtgagaccctgtcttgagaaaaaagttaaatcgacccccaattcacaaatatttcagtcataagtgcttaacaatttaagaggatatgttccagaaatcagacctaaaagctggatacctggagttgaaagggaagagaccaccgatgctgctgctaatgacagggaaaggaggaatcaaagtttgtgggacagagtgcaggaagctaagctgaggggtttacatgggaaagaagggaagacagaatttgtcccagcctctaagacctggagctcacaagacagagatgaccttattgggggaaaagaaaatgagaagacagccacagaactgcagcccgggggtggggggaaaagtgattatctagctgcagagaaaaggacaagaggaggatgtttcagtggaataactaaaactaaagctaatgagaaaaaatttttgttgctatgtaaacctaagaatatttgctagcagtaattgatagatatagctaggtaactgactaaaaaccagtctgaatagagataaaatatgattacagttgctatgtttatgtctaaagataattgtatcatgatcagcttatacaatgaagaatgcagaaggctgtacaagctaggtcagtgtctgtcttacatcctctaaaggaagctggggattagtgaaagtgacctggaccaataaactgtaaccattcatatgagcacacgagcgctgaagcccttatgagacgatagtggtgagccaggctccactaaccactcagaggagggattagctgttaaagtcaaggctgtcacttatcaaggggctttatgtgagcttacggcacagctgaaatatttaacttttacctcactgagtcagcttaactaaagaaaaattttattcaaaaaattgctgtcaagactccggaaggttaaaatgatatttaaggaaccatagtcccaagcttatgcctattcagttacttaagtgaggaagtgaagagctcatggagaaatggaaaatgctccaaaaaaggaaaagataatttttatcacaatacacaaaatctgaaaatatttatcctagcaagcctacatgcaagaatcagggaattaataaataataaactatacccattatggcagtttataaagaattataagaaataaggaaatgtttatagtctgctaggcaaatataacccttgttattttattattaaataaggggtaaaaaaaaatcatatctttcagattgccacaccagagagttttacttgcaaaacagactcttgggtctttttttttttttttttttttgagacagagtcttgctctgtggcgcaggctggagtgcagtggtgatatcttggctcactgcaacctctgcctcctgggctcaagtgattctcctgcctcagcctcccgagtagctgggattacaggcgcatgccatcatgccgggctaatttttttatttttagtagagacggggtttcaccatgttgtccaggctggtctcgaactcctggcctccagtgatttgcccgcctcggcctcccaaagtgctgagattaaggctaccgctctggtccacaaggagcagtaaaaaaaacctacaatgagatattatctcatcccagttaaaatggcttttatacaaaagacaggcaataataaatgctgggaggatacggagaaaagggaaccctcaaacacgttggtgggaatgtaagttagtacaaccattatagagaacagttaggaagttcctcaaaaaactaaaaattgagctaccatatgattcagcaatgatgctgctgggtataacctaaatgaaaggaaatcagtatatcgaagagacttttgcactccgatgtttgttgcagcattgttcacaacagccaaaatttggaagcaacctaagtgtctgtcaacagatgaatgagtaaagaaaatgtgatacttaaatacaatggggtactattcagccataaaaaagaacaacatcctgtcattagtaacaacatggatggaactggagatcattacgttaagtgaaataagccaggtacagaaagacaaacattgcatgttctcatttatttgtgatacttaaaactcaaaacaattgcactcatggagatagagagtagaagaatgattaccagaggctgggaagggtagtggggttggtttggggattagggggaggtggggatggttaatgggtataaaaaaaaatagtcagaaagaatgaataagacctagtatttgacagcacaacacagtgactatagtctataataacttaattgtacattttaaaacaactaaaagagtataattggattgtttgtaacacaaaggacaaatgcttgaagggatgggtaccccattttccatgatgtgatgatcacatattgcatgcctgtgtcaaaacatctcaccccataatatatacacctactatgtacccaaaaaattaaaattgtttttaaaattgaaaagtgtatgtcctaaaacactataaacaggattaaagactaaaagaaacaggggaaaatatttgtaatatacagaaaaaaggttcatctatcattacaaatcagaaaaagtcaaatatccaatagaaaactggacaaaaaacatcaagagatgtcaacaaagaaaaaattatagtggcaaacaatgaagtttaatcaaggcaatgcacattaaggtataattttttacttgctaaattagcaaagattttaaaaaataaaacccagaatcagtgaacttaaagagaaatcagtactcatatactattcaatatatttatcctgagaatataaattggtatagcccttctagagggcaatttggcagcaggtatcaaaaacttataaaacatgtatactcctggtggatccatttccatttaaggaaatgaggatatgaatactcatgtacaaggatatttatcagagctttatttataacagtgaaagaatggaaagaacaaaaccaaaaataaagggaatagctcatggcatatccatatgatggaagactaaggcattattaacatttatgctatagataatattttggccaggtatggtgcctcacacctgtaatcctagcacttctggaggccaaggtgggaggatcgcttgaggccatgagttcgagaccagcctgggcaacatgagaccccatgtctacaaaaaatgcaaaaattagccaggcatggtggcaggcacctgtagtcctagctacttgggaggctgaggcagggatcacatgagcccaggagttcaaggctgcagaaagccatgatcgtgcctggacagcgggggatcccatttctaaaaaaagagaagagagagagagacagagaatattttatgacttgagaaaatgttcaccatatatgttttaaaagcgggttatttgcctaatttatttaatacttatagatagcatttataagtcatgggcactaatctatacactttacaaatattaacctatttgatccttataacaactcgtgataaatattattatccaaatatagtaagtgagaaaaccaggctgccaaaagttaaaataacttgcaaacccaggctacttcttcaaaaagctcaattacattaataacaaaaacaaaagaatatatatgcatagaaatcgaggagataagaataaacagttgtccctagtgtctatgggggattgattccaggacaccctgtggatgccaaaatccacaaatgatcatttgtggatatgcaaatgtagcatttgcatataatttatgcacaacctcctgtatactttaaatcatctccaggttacttataatgcctaatatgatgtctgcatatgacttcattcatgtggattcaacataatactcggcacacagcaaatccaagttttgctttttggaactttgtgaacttttttctgatataatttccatctaatgttggtttaatccatggatgcagaacccacagatactgaaggtcaaatgtgtatcaaaatattaatagcagtggtttctacaagtggtgggataacaggctattcttatttcttttgttattttttgaattttctataatgaacatgctgagcagttcctcattcaccaagagtaatacatagtttatttccacattccacatatggaattttccaacaaggcatctttgtaaaatgttagaatcaatattaaatgaagcaatgaatactcagtgaaatgtgttaaataaaagctgagttttaaaaatcaaaacaatcttgtcttctgcttataatgaacacattttaacagagaaagggtataaagaaaagtaacattctgtaacataagagaaactacccaattaatgcagtttgtagtttcttagaacacagtctcctaatattctgatttttctggagcagaaaataaacattaggaaggacttactttgaagaaaatattatctgccattgacagctagcaatttatttagagaaataatattttagaagactgtaacaggctaggcacagtggctgtcacatataatcccagtgctttgggaggccaaggttggaggatcacttgaggccaggagtttgacaccttctctctcaaaaacaaaaacattagctgggtgtggtggcatgcacctatactcccagctactcaggaagctgaggcagaaggatagcttgagcccaggattttgaggttgcagtgagttatgatcacggcactacacttggcctaggtgacagagcaagaccttgtgtcaaaaaaaaaaaacacccctccgcccctgccccaaaaaccccacaaaactgtaacaaatgattcagtgggtcaaagtactaaaaaggacaggttgaaattgcaatgtaattcagaggtaaatctagtttcaaattcattagaaagctataaaggagtagcagaagatgccatttttggatcagctaaagtgaagaaaactgattatcatacccaaaaaataatgtttgtttcaagtaaaatgtatatgtacatccattcattcaacaaaaatctattgcagaaatactatgtggtaggcactgttccaacatggtatttggggaaacatacaataaattaaataatataaaaaaaatgttaagcagaggtagttaagtgccatcaaggaaaaaaccagagcaggggaagagtatggagtatgagagggaacagggctcttatagactagaccacctgaagagccaccagatgggcacttgaataaagtgaaggtgtgtgagccatgccaaatctggggaaacagctagtgcagagactgagttgggagtatgttcactgttcaaggaaaagcaagaaggccaatgtggccaagtcagagtcaacagggctgtgactaggacagtgcatgcagactgtgatcacataacgcctcgcagagcatggaaggagttggggtttttactctcactgtgatgggaagccactgggtcattctgagcagagacttgatgtgtctgatttacatttaaaaatatgcactctcatcacttagcatgttgggaacgctagtgcactgcaagaatgttatcaaaccagttgggaggtgactgtagatgtccaggcaagagataattgtgccttggactagggtaacagtcatagaggcagtgatgagatgtgggatatatggagaaacgaaagcaggatgaacttgctaacagactggacattagagaattagactgggggatgacactgaagttttgggcttgagtaaacaagagtcatttaagtgcttaggaacattttgcttgataggttaatctgcctatgcactggggatttgaagaattgaaaaaactcaaatatcaaatatgttcaatttataaatgtgactaaactgcttaaagagatgtattaactaaatttgcaaatgggtattactgtttaggacaatgtaatcctttccattagagtttaccgaacattcatcaaagaacaagagaaaatgattgttccttatttttatgcaaaaagtaattcaatttactaatctttttatcctatttataaattgaacctcaagaatgaaaaacaattaggtttttaaatttgcaactataataaatagtatattaattttaaatccaaattgcccaacaatcctttctaaatacaaaagccccacagaaactaaaacactcgaactgacacagtatttagtgagacaggaaaaatgtctgtgacatattaagtgaggggagggagaagcaagtcagaaaatgttgtatacattatatgagaaatgtgtaggtatatgttatttataataataagctttcttctaaagaaggtgtgaccaataaactacaatcagtttttcacactgtggtctttaaaaaacattcctctgtggagtcccagctacatgggaggctgaggcaggggggatgcttgagcccaggagttcaaggctgtagtgtgctatgattgcacctgtgaatagctcctgtactccatcctcggcaacagagcaagaccccacctctaaaacaaacacccccaaaacattctttctctacccaaaagcagaccctcaaatagttgttgaatcagtgaataaaatattaacagtattgcttctgggccaaagaattgtttctacctcatattaataattctccagatttccaaattttctatagcaattgtatattcttataatcagaaaaaatcttttaatggtgattataaggattgttttaataacatgaaaaattgcttataatattgatggaaaaaagcaagtaaaatggagtatggttatgaacacaactacacagaaaggattaaaaagggacggggtgaggtggcttacacctgtaatcccagcactttggaaggctgaggcaggcggatcacatgaggccaggagtttgagaccagcctggctaacatggagaaaccccacccctataaaaaaaaaaatacaaaaattagctgggtgtggtcatgggacctgtaatcccagctacccaggtggcagaggcacaagaattgcttgaacctgggaggtggaggatgcagtgagctgagatcatgccactgcactccagcctgggtgacaagagcaagaccctgtctcaaaaaaaaaaaaaaggattaatggaactatgtccaatattgacagtgcatgtctactaggggctatgtggatcactctcctttgctagaatgttcaaacttttctgatctctcctcatttctttcaagaacagattctatgtagattcaatgaatttcatattgccaaatcacacggacatttttctgtcatcatcttcctcaacctcttggcaacaatcaatacaacgaggcttccctggctgaaatactcctctttcttccctttcctcctaccttgctagctacttaccttgttctttgctggtttggcaggtttgaccattgtcctaagctcgatttgtatattcagctgtttacttgatatatatctaatcatgtagatttcacaacaggtatcacacacttactatgtccaaaaagaggcttctgattctaattctccacccctaccaacccgcccttctacaagtcttctcatctcagtgaatggtcccagcattatggtaccaaccactcaggccccaaacctatgaatcatccttgattcttctctatcgcctccatgtaatggccctcacctgccaccctgtttctctacaaaggcttctagaacacatcacgccaaatgaaaaacagctgaccaccacgatgttaagcatcttaaacaaattggcctttcaagggcaaaaccatttattaatttttccctgggcacagaaaaattttcagggacaaaattattttctgttaaaaaaaaaaagaaaccctttaccatacactattattttttaaatgatgtatttatgtattacttcagtaaattaattttaataagaaaaatcaatgtacgaggagagactggtgtaactatgctgagagagaaagacatgttactaagaaatgaacagaaagtgccaccaagtgggaaaacggtatacgtgcaatagagaaaaatctaaccaagccatgtcttgctttgtttttttttttaacttggttcaaaggacttcaaggttccaatacttcaaaccacaaaaagcacatctttatttcttctgatacaagtgaaaacaataattttatacagccgtgcatgaaatagcccaaactttctacttttctacactaattctatataaatgctaactaccataacaatgaaaatgaagacttctgtgtgttactgtgtagacggtggcaattagataacttcagaataaaactgaaggcaataaaattggcattgaacaaaataaagacaagaacaagagaaaaaaaaagaaagaaaaagtagtatagaatagtacttgagctgggcacggtagttcacacctgtaatgtcaacactttgggaggccaaggcaggtggatagcttgagcccaggagtttgagaccagcctgggcaacatggcaaaacactgtctctactaaatacatacatacatacatacatacaaacagtagccgggcatggtggcccgtgcctgtagccccagctactccgggtgctgaggcaggaggatggcttgagcccaggaggtcgaggctgcagtaagccaagatcgcaccactgaactccagcctgggtgatagagcgagacactgcctcaaaataaaataaaatgttatttgttatctacttaaatactttcagggtattctactcaatcaaattaaatataaattcctgaagaagaaattaatatcttgttgctgatcccataagagaataaaacatataggaaaatgaaggtactgtaaaaaaagacactaaattagaacacagtattagtactagtattcattaagtgcctataaactacaagagaacaaagaccatacatatttcactcaccactgtgaatatataaacccatcaaggcctgacatataggggggtgctcaatatatatttgttgaatgaatcaagtttgtaagcagactgtgttaggttctaggcaatccgtttcttattttcaaggcacgtgtagctcaactgcccatccaagaagtttgcaccaccatcttttgtttttgtactggtggacttagcagcctttactggtggctggtagattcaaagaagtgaaggcctttagaccagagagataaaatgagctcatttttccacaagatttctaatgtttcccataagattagagaacattaaatgaaacagagaagctgactaaaattctatccaaaacgctaatgtctctaagggaaatctttccctaggtgagattatgcagctactgaacagactcataagactatcataggccacacttggcatctgagaactcaggacagaggacaggaatcacagcttgccagctgggcagcatcagatgttcctctccctgggagtctgtgcagttgttcatgcaagtgacagctcacccagccgtccagaagctattttctttttcttttcttttttttttttttttttgagacagagtctctctgttgcccaggctggagtgcagtggtgtgatctcggctcactgcaagctccgcttcccaggttcatgccagtctcctgcctcagcctcccaagtagctgggactacaggcgaccgccactaggcccggctaatttttttttgtagtttaagtggagacggggtttcactgtgttagccaagatggtctcgatcacctgacctcatgatctgcctgctttggcctcccaaggtgctgtgtgtgagccaccacgcccggcccagaagctattttctttaactccctagatgacacagctcaggctcaagggagatgagagcatcatgagacaggtgcaggagctgccctaacttcaaagctttacgctccaccagagccaacgtctctagtaactccaaaggcatagcttcaggattccctttcccacagggtcatgccagttctaagagcagcagcactcaccaggcatttctaattcctctcaatccagaggcaatttcccaatcagaggtcgattttatattgcaatactgttaaaacaattttatctggtttccaggataacagagctaggcatttaactgaaggtcatattctcctaacccttaatttataaagttaagttgaatactacactagataaaatcaaaccaaaatcctatctccagcatcaatctctagcctaaccaacaggctagttttcaactgtctactcaccttctcacgtggtcgtctatcaagcttctcatacttaacgtagactacctcttctaaacctgctccccctactccactcttccctatctcagtaactgtacctctagtagttcaggccaaaaatattgaagtcatccttgactggtttttctctcaaaagccaatcaatcagcaactcctgctgaccccatcttacttggcaccctctaagagggcctccaacgatcactgcctcctggtattcacacccttgtataataccctcattttaagtgtggctggactgattgacttgcttctaataaatagacaactgaagtatgggatatcacttcctagatgaggtttaaaaagactgttccttccaccttggtctggggaagccagacgccatgtcaagaggtggcctgtgcagaggtctactgaatgagctgggaagcaaatcttctgaggtctgtctacagccacatgagtaagtgtggcagtgggtccttcccaagtcaaaccttgagagcacagcagcctcagagaagatctcagctgtaaccttgtgagaccctgagcctggggcacccagctaagctacactcaaattgctgtgagataacatttactgtcttaagctaagtttaggataacttgttccacagtatagacaactaatacgatcccaaatctcacaacctgcatcactagcaccctagtccaaccccatcaacagcctaggccatgacttacaacagcttcttaagtgagtagcctgcttccacacttgccttgcctccttcctttattcttcacagcaaccacagagatgctttaaaaatgtaaatcagagtgcaaaagtcattaagtgggcccgaggaatgtagcacttggtatgtgagggagggtgttgcggtagcccagcaagatgtgtcagagcctttgtggggagaagagcctgtccacacaaggagaagggagggtggcaagctggtttggggtgctggaggcaaaatagggtaaggaggaagtccagtgggggaggggggatgagagggcagcaatgggaacttagttacacacagtggaattgatcaaataactatattaagaagaaaccagctataaatgtggaaagggagaaaactggagtgtaaactgtagtgctggactgccgtcagtggtactggtggggacacacaatcattacccatgtttcctagcttgtccactgagaaggcctggaagcactgacattccaataatgatgagcacatctgacattcatatcttagtttctaataccactctccactaaaaaacaagcaaacggccgggtgtggtggctcatgcctgtaatcccagcactttgggaggccaaggtgggtgaatcacctgaggttgggagttcaagaccagctgacgcaggagaatcgcttgaacccagaggcggaggttgcggttgagctgagattgcgccattgcactccagcctgggcagtaagagtgaaactccgtctccaaagaaacaaaaaagcaacaaaaaaaagcaaacaaacacagggctcctcagagaaatggctgtctccaaggctggaacagagaaactctaagatgaacctggaacacctcatgtcagaaagtaagaaggtgctccaagaatgatgaagacttttcaaaatgaccccctctaatgctaatagccaaaaaaaaaaaacaacaaaaaacccatatatatataatatatatatatggaattaaaaaaactcaccatcctggccaacatggtgaaaccccatctctattaaaaatacaaaaattagctgggcgtggcagcgcacgcctgtaatcccagctactcgggcggctgaggcaggagaattgcttgaacctgggaagcagaggttgcagtgagtcaagatcgcaccactgcactccagcctggcaacagagcgagactctatctcaaaaattaaaattaacataacataacataaaataagataaaataaaataaaataaaagcaaagtggctgggcatgatggctcatgcctgtaatcccagcattttgataggccaaggtgggaggattatttgaggccaggagttacagacctgcctgggtaacatagggagactgtgtttttataaaaaaaatttttaaattagtcgggcatggtggcacatggctgcagttccagctacttaggaggctgaggtggaaggattgcttgagcccaggaggtcagggctgcagtaagccatggtcacaccactgtacttttgcctgggcaacatagcgagaccctatctttaaaaaaagtggttggtaggccgggcgcagtggctcacgcctgtaatcccagcacgttgggaggccgaggtgggtggatcacgaggtcaggagatcaacacaatcctggctaacatggtgaaacctcgtctctactaaaaaaatacaaaaaatttagctgggcatggtggtcagcgcctgtagtcccagctactcaggaggctgaggcaggagaatgacgtgaacctgggaggtggagcttgcagtgagctgagatcacgccactgcactccagcctgggagacagaacaagactccatctcaaaaaaaaaaaaaaaaaaaaagcggttggcagggacaaagtacccagacatttctcagaagacatacaaatggtcaacagctatatgaaaaaaatgctcattgtcactaatcatcagggaaaccagatcagactgtgcaacatagcaagagctcacttctactaaaaataaaaataggccaggcacagtggctcacacctgtaatcccagcactctgggaggccgaggtggacagatcacctgaggtcaggaatttgagaccagcctggccaatatggtgaaaccccgtctctactaaaaatacaaaagttagctgggcatggtggtgtgcacctgtaatcctagctactcaggaggctgaggcaggagaatcgcttgaacccgggaggcagaggttgcggtgagctgggatcacgtcactgcatcccagtctgggcgacaagagcataactctgtctctaaataaataaataaataaataaataaataagctagtctcagctactcaggaggctgagttgggaagatcgcttgagcacagcatattgaagctgtagtgggctattaatgtgccactgaactccagcctgggagacagaacaagaccctgtcttcaaaagaaaaaaaaagaaaaacaagcagagtagaatggtggttaccacgggcaggaggagtggagagtataagaaagaggagatgttgataaaagagtacaaaatttcagttaggaggactaagctttagtgctctactgcacagaatggtgactgtaataaataataattcactgtatatttggaaattgctaaaataattttaagtgtttttaccacaaaaaaatgataagtatgtgaggtaattgatttactaattggcttgatttaatcattccacaatgtaaacatgtatcaaaacatcatattgtaccccacaaatatatacaattattatttgtcaattaaaaataaaattttagcctgggcaacactgtgagacccctatctcctaaaaaaaaaccagcaggttgtggtgatgcacccctgtagtcccagctacttgggaggctgaggcaggaggatggcttaagcccaggaggttgaggctggagtgagctgtgaaagcaccagtgcactcagcctgggcgacagagtgagaccctatctcaaataaaatatttttaaaaactgagaacccctcccctctaaaaacctccaaagaactccaaatgcagcttgaatgggttccaactagtcaaattgagcccaatttgaacaataaaagaaccatttaaagcaatggattataacccattgattaaaataggagttgatacagatacaaataatgaattaaagctttgatgagtaaggggatacttacataacctcaaagtgtctccccacaaaatgctaattaatttcaaagggaaaattagtaactttagaatggagaaaaccggcagaccccttaatcacgtgatagaggttttcattaataataggacaaaaacaaatcagctgctacttaatagagtgcaacaagaaaaacatggcttcagtgacaggaatgtcacagaagcatagcctgaacctagtcatgaggaaacattcaacaaactcactgagggaccttcaacaatataactgtcaagtaattttcaaaagcgtcaaggtcatgaaaatcacagaaaagttgaggaaccaatcaagtgtgaaggagactaaagaacttgagatccatatgaaatgtgtgattggatctctctataaaggacactgttgggacaactgacgaaacctgagtggctgaagttcagaacacgctgctccaaaatatgcagctctggcatatggactatgctgagttaaaggcacttgaacaacagcaggcacggctgggtgtggtggctcatgcctgtaatctcagcactttgggaggccaaggtaggcagatcacttgaggccaggagttcaagaccagcctggccaacatgatgaaaccccgtctctacttaaaatacaaaaattcgccaggtgtagtggcacatgcctgtaatcccacctacttgggaggctgagataggaggatcatttgagcccaggaggtcgaggctgcagactgtaccactgcactccagcctgggtgacagggcaggacattgtctcaaaaaaaaaaaaaaaaaaaaaaaaaggtaaagaaaaacagcaggcacaagaataatatggcctttttctttctgaaagcaggagaaaaaattcccacatcaaagatatcctccctataccagaaggaaactatcattctacatcaaggacaggaaattgaggtcaagggaaatctgcacaaacgttgttaaattaacttttatcttcttagtcacttctccacccaattaacctactcaagcccaagtccctttgtcttctcattttcagtgttctactccttgtccaattcagtatctaagtgttcaacatgaactgcatctttgggtcttcatcccttatgagggctccacatcacggaactcttatattaaataaatttgtatgcttttctcctgttaacatgtctttaattctcaagcccaaccaaaaagccctaagaggataagggtaaaattttgcctccctttcatagtgtatctttgttactttcctgatatttatggtcatattgtggttatgtaggacaatgttcttgtttgcaagacgtacacactaaagtattcaggagtgatggggcatcaatttggcaacttacttttattaaaatattagtaatgattctgaaagttcgggattattccaaatgttaaaaaactgtaaatcagatcacaccctatcttaccttccagtgacttccaaataaattcagacaaaaagccgaagtatgtaccatggcttactgaaagattctccctgaggcctgaaagcttgaagagatgaataactcctcccttctcaggcccagtcccaagcttgggccagcagcgtgggtcagcaagacagcagaagcaggaagagagctggccgaaagacacatacccccttgaagattgaggggcaggccgtccaggtactatgtagcagttacatcagactgagacacttcctgtttacaggagactataaaacccctgccccatcctcatttggtgctaacgccattttaggcatcagcccacctgcacccaggcgctcattaaaacagtgtgttgctccacactgccatgttgtctgctgatgcactctcagggttcgagccgatacaagaacctttcatcttacaacatctacatgatttgggccctagctatttctcctacctcgtttcttaacatcttcccctcactcattccattccagccaaactggccatactgctgttctttgaacagaccaagcaatacatctcaaacatacaggctttgcacctgtggttccctctgcctggaacgctttctccccgcttctacgtctttcctcaaatgtcactttctcaaagaagctttctctaactgctgtataaaacagccacctgacccttccattgctcttgattcccatgaggcccagcttcatattatcttccttgcatttttcattaccacaattatataaaggatgtttttctgccttcccctatgaaaacaaggaccttgttttattcactgctttaccccaggttcttggcacctggtaggtactaaatagttatttgaatagggatgataaattgtatctgtacaattactctctacacgtgataatacctagctctctaattagagatatatcaacccaacatcaaatttattcatgaatcaaaggtaagaatccacagatttagaattccacagtgtgtcacggtcaacaaagaggggtttgagaaacaaacagctaagcttgttcaacaccatttctccctaaaaagattcatcacaagccgtgaagcttcccatacaaataagggtcatcaaaggtactcagaccttaggaggctcctctccacaaagaaatgcagctttgaatcctcacttgcccttaggcacctgctggagtgatcttctacagctcttagcttcattttcatgtggtctcagatcaaataaaaggacttgctccactgaatagaacttttagcttttcaggtttttactattttataattttaaacataattaatcgcacataattgaaatcacacccctacccctcatctcccaaaatgtggcccctgagcaccaatgttagatgaacattttgaagcaggtagatgtcaatctgaataagacagctcacatgccttctatagcctcccaggaccaattccacccaagaaacaatctctcagttaaacaaaaaccaggacacctcagctcctaaagcctgaattccatgttgacaccttggtctcaaatagtcctcctaacatatagaatgcccctttggagaaggttgatggttctaaacctaaaaccaaagctcaatgcatgctgggcttaatacctaggtgataggatgatctgtgcagcaaaccatcatggcacatgtttacctatgtcaacctgcacatcctgcacatgtaccctggagcttagaataaaagttgaaggaaaaaaataaagagacatagaatgtggaaaaaaaaaaaacaaaaaaaccccacagctcctcagaccttaacggaaccacaggttgttatttcccactaaaaagagtgcaacagcaatccccaaatgatgtagcatgagaaagctcctaatcagtgctgctttctcacggtaagaaccaaagagctttttttattcagagacagggtttcactctgtcacccacgctggagtacagtggtgcaatcatacctccttgcaacctcaaacccctgggctgaagggatcctcccacctcagcctcccaagtagctggaactacaggcatgtacaaccatgcctggctaattttctaaaactttttttatttatagagatgaggccttgttatgttgcccaggctggtctcaaacttctggcctcaagcgagcctcatgcctcagccttccaaagtgctgggactacaggtatgagccaccacaccaagccccagtgagcttttaaagatattatccattatcatattcttcaaattacatcactgacacagtcagtgctcacaattagtccaagtagtagaacaggggttgaaatctggttatagctcagcaaaaatgtacagtacaaatatgttttgcttagctcacagtatttgaaaaacaaacaaactattctgtccaatcgagtagcctacttatcttaaataaaaattttaaaatgtcctcagttgcattatccacattttaaagtgctctagaaaggccaggtgtggtggctcatgcctctaatcccagtattttgggaggcagaggttggcgaatcatttgagtccaggagtttgagaccagcctgggcaacatggcgaaacctcatctgtactaaaaatacaaaaaaattagctgggcatggtgccacatgcctgtagtcccagctactcagggggctgaggcaggaggatcacttgagcccaggaagtcgagactgattgtgccattgctctccagcctgggcaacagagtgtccccgtctcaaaataataataatattaataataataaaatgttctgggccacacgtggcaagtggttaccctattggacagggcagataaagaacacttccgtcattgtgaaaagttctgctagataatgctgtatttaaaatgtcaaatatttttaaaaattaattgaaaaaaaaaagaactgacccggtgcagtggctcatgcctgtaatccctacactttgcgaggccaaagtgggtggatcactcggggccaggagttcaagaccaacctggccaacatggtgaaacctgtctgtagtaaaagtacaaaaattagccaggtacggtggcaggcacctgtagtcccagctacttgagaggctgaggcgggagaattgcttgaacctgggaggcggaagttgcagtgagccaagatggtgccactgcactccagcctgggcgacagagtgagacgctatctcaaaaaaaaaaaaaaaagcaagaaaaaacaagaagtctcacaaataaatacagatgtccacctttgaaaaatcatccagaaacccttcgcagaattctcacctgatggaactgcaggttgctgaataagcctgctgccctctttgacaagtctgtacttttcagttcactgcagtctccactacgtcctattgtttcatagctgcacttcactcacttatgtcacatatctgggtttccaagtgactctttagaacagaggcaaatacactgagattatcccactttctactgaagacagcccaaaactagctctgatgatcaaattcaattaaaataaaatgtcacagcccaccagatatacttatttctagtttttgggtgaaattttctagaccactggaaaggagctccagagtttaattgtatatcaactgtatggtattatttcagcaatctatgaaacagatataagtactttgctttgaaatacgtcatgcaaaatttggtaattcaagtgagcatttagaatttcatttcaaaatatgcgtattataaagtcatacaaattttagagacctaaggaattttagggctctcattttatagacaatgagactaacccccagagaggttaaggaacttgcttaaagtcaaactgccagataagattacagccaaagttcttttcacctttcgcttcacccagacaggtgatactatggcatattgtttttccaagacagccacaccattacacatcccaatatatactgtgatgttgacatgcctccatcaagagataggttcatgttttctcatgtagaacttgggtggagctttctaattgcctcaatcaatggaatatgaaagtgacactggacaatttgcaagactaagttagataaggcaatatggttcctgcctagctcactctctcagagcacttgcctgtgtcagcccaggcaacaggaaggtgttccaacccacaggcccaactatacccccagctgacagccagcaataaatgccagatactaagtgaacaagttttcagatgattccagtgtccagacttggagtcttccagctgaggctccagacatcagacatctaggagcagagactagccaccctcgttttatcttgtctgaactcctgacccaaaaaaaaactatggagagagaaacagttgttgttttaagccactaaatttaagggtaacttattatgcactcaatgtaaataggacagatactttcagaagaacaccactgactgctttatagagagatattcaataaatatttttgtaatgaaataaatattgccaagttaaataaaataaaatgaaccaggcatggtggctcgtgcttataatctcagctacttggaagggtgaggtgagaggattgcttgagcccaggagttccagcctgggcaacatagcaagatcccatttcaactaaaaaaataaataaaagctgggcatggtggctcatgcctataatcccagcactttgagaggccgaggtgggtggatcacttgagcctaggagtttgaggccagcctgggcaacatggcgaaatcgcatttctataaaaaatacaaaaattaggccgagtgcagtggctcatgcctgtaatcccagcactttgagaggccgaggcgggtggatcacctgaggtcaggagttcaagaccagcctggccaaaacggtgaaaccccatctctactaacaatacaaaaattagccaggcgtggtagcatgagcctgtagtcccagctactcgggaggctgaggcaggagaactgcttgaacctggcagtcagaggttgcagtgagccaagatcatgccactgcactctagcttgggcaacagagtgagactctgtctcaaaaaaaaaaaaaaaaaaaaaaaaaaaaagccaggcacggtggctcatgcctgtaatcccagcactttgggaggccgaggtggatggatcacctgaggtcaggagttcgagaccagcctggccaacacagtgaaaacctgtctgtactaaaaatacaaaattagccaggcgtggtggctcacacctgtagtcccagctactcgggaggctaagacaggagaatcgcttgaacctaggaggtggaggttgcagtgagccaagtttgtaccactgcactccagcctgggcgacagaatgagactctgtctcaaaaaagaaacaaacaaacaaatttaaaaacaaaacaaaaattatccgggtgagatggcatgggcctgtagtcccagctactagggaggctgatgtgggaggatcacttgagcctgggaggtcaaagctgacatgagtcatgatcatgtcactgcactccagcctgggtgacagagtgagaccctgtctcaaaaaagaaaaaaaagaaagacaaataaaatgttgtcttagcttaccattcaggaggcaccatgcttccatccacatcccagaatgtgtttttgccattcatttcagtagtatatacaacccatcggtgacggcctgggtgggaagatgaacatttaaaaagaaaaacttttttttttaaagcatagatgcataatatcaaagaagacaacctttttattaagaaaagactttttgtgatcttatataagagagctattggaggaataacaccctgggtgaattcgtgaaggtaagctccaggaggtgtgtggcaaactttaagcagcaacccgcagcaaggactgagatgattcactgctgtgggtggggctcaggcctttcccacaggggagaatccttgcttccctgccagctccccacagagggagtagcagacaggataggaaagtgtgttcccagatgtacagggtattcagaaaagaaggtgttcctcttgagactggggaaaaaacacatttgtagcaatcatacttgaattctatgtctccacataagtatttttttaaaaccaccctagatccttttggaaatttgtgaattatatacaataagcaaacattagaaatgatggttaggtacataggacagctcatgtcatcaaaataatatggctgcactcctcatttaggaaatttctgtgcactagttgaggggcctaaccactacttatttacacaattgggtccttaaactgagcaaagacttgggctttgtcacttattatcagtggttattaggcaaattttatgagcctcagtttctttatctagtaaaagtggatgactatacctacatcttagagttgctgtgaaaattaaacatcacatacattcacctagttcagcatcagccatataagcacataataagtattaattccttctaccccttccttactgctcttacctgccaatagggaacactgaatccattcattcctatgatggactttaaaccaataagtaaaaggtaatctgcatttcatttacagggttttcccaggtaaacatataatcaacaaaaattgactaacggtacttaaacatgacctcatctctttttaaaaatacagatttcaatcaacatttactgcttcatttagagaaataaatcttaagaatagctaactaaaagtaaactataatccagtgaggcaggggaatgtgcaggcagatggaggagaccttgggaaaggtttcataagtcaagccctgacaatacagttaggctataatgatggaagtgggccctaacaatctctctctctctctgtctgtctctctctctgtatttcttgaaatgttaaatgcctattctcagactcagaaattcaactttatttatttatttatttatttattggagacggagtctcgctctgtcgcctaggctggagtgcaatggcgcggcctcggctcactgcctgcaacctccccttcctgggttcaagcgattctcctgcctcagcctcccgagtagctgggaccataggcatgtgccaccatgcctggctaatttttgtatttttagtagagatcaggccagaaatttatttaaacacatgaatgtagttacaagcaggtttacagtagcatcattcctaatagcaaaaagtcaaaagcaatctatgtgtctatcgatagtaacaggattgaagaaataatggttcttccatacactggaatgttgtgttgctatttttaaaaatgctgtgcattttttttttttaataaacacaactggctgggcacggtggctcacttcttaatcccaggactctggaaggctgaggcagggggatcacttgagctcaggagttcgagaccatcctgggcaacatagtgaaaccttgtccctacaaaaaatacaaaaattagctgggcatggtggcacatgcctgtagtcccagctactctcaaggctgaggtgagaggatcacttgagcacgggaggcagaggttgcagtgagccgagatcacaccactgcatttcaggtggggcaacagagagaccctgtctcgaaataaaagaaaagaattttaaatatacataaagactaaactattgaaagagttgcaaaattataaggggagggagctttcatacaccaaatatatataaatacatacatatataggtacacacacacacacacacacacacacacacacacgagatgggggtctctatgttgcccaggctggtcttgaactgctggcctcaactgatcctcccaccttagcctcccaaagcattgggattacaggcatgagccaccatgccaggccctaatttttttttaattagcaaaaataagaatatttccaatgcaagggagaacagaagaaaggaggctggctgcagtggctcacacctgtaatcccagcactttgggaggctgaggcgggtggatcacgaggtcaggagttcaagaccagcctgaccaacatagagaaaccccatctctactaaaaatacaaaaaattagctgggcatgatggcgcatgcctgtaatcccagctactcaggaggctgaggcaggagaatcacttgaacctgggaggtggaggttgcagcgagccaagatcgtgccatggcactccagcctgggcaacaagagcaaaactctgtctcaaaaaaaaaaaaaaaattaaagaaaggaaagaatgtaatattatagtttgtaacaatacagtgagaagtagaaagaataattaccccaggttctgccattaattacatgattaagtctctttggtaaagatacttccttgggcctcagtttcttcatctataaaacaatagtttttagacaatctcttaaaatctattctaggtctaaaattctgtgatttatgtattaaaaatatcataactaggtgtgacagtatgtgcctgtaattccagctcctcaggaggctaaggcgggaggattgcttgagctcaggagttcaagaccagcccaggtaaaatagtgagacctcatcacactcacacatacacacacacacgcacacacacgcacacacatagagtacataagatgtttacttcttatagaccaacatgcatccaaagcaaccacattcctgagaaatattcctaactattcaatgacttaccttcttcatctgtgaaatgggggcggaggagcacagaagtgcttatctcaaggagatgttgaagattaaggtagataacgtatgtttttgtttagcacagcacctagcacatggtaatcactcaataaatgccaggcaattattttttcacgttatacattgttcccctggatgaagactaattgctttttcctctttgatacttttcatctcaatcaagagagtatttttttattattataaaagtaacaaatgcacatgggagaaaattcaacaattcaagaaggtacaggttgggtatctccaattccaaaagctccaaaattggaaactttttttgtgtgctgttatgacactcaaaagaaatgctcattagagcatttcagatttcagattagagatgctaaactgggacgtataatgcaaatattccaaaatccaaaaaaacctaaaatctgaaatacttgtggtcccaagcattttgggtaagggatactcaaactgtaaaaataataacagcagtcacagtgctaatatttattgagcacttattatgtgccaagcattaggccaatggttcttaacagatggaaattttgcccccaaggggacatttggcaatgtctggagacatttttggtttgtcagtcagtgctgctgctgctggtcattctatgatgcacaggacagcccctcacaacaaagaattagctgtctcaaaaaaagaaaactacaaaccaatatccctgatgaacacagatgcaaaaatcctcaacaaaatattagctaaccaaatccaacagcatatcaaaaagataataatatatcatgatcaagtgggttgaatactagggatgcagggatggtttaacatacccaagtcaatgtgatatatcacataaatagaattaaaaataaaaatcatatgatcatctcaccagatgcagaaaaagcattcgataaaatccaacattcctgtatgataaaaaccctcaacaaaattggcacagaaggaacatacctcaaagtaaaaaaagccatatatgacaaacccacagcaaacatcataccgaatggggaaaggctgaaagcattctccctgagaactggaacgagacaaggatgcccacattcaccacttctattcaacacagtactggaagtcgtagccagagcaattggataaaggaaagaaataaagtgcatccaaatttaaaaagaggaagtcaaactgtcgctgtttgttgatgataggattatatatctagaaaaacttaaagaccatccaaaaagctcctagacctgataaataaatccagcaaagtttcaggatactaaatcaatgtatacaaatcagtagcacagctatacaccaacaatgaccatgctgagaatcaaatcaagaactccatcccttttacaccagctgcaaaaaataaaataaaatacttaggaatatacttaaccatggaagtgaaagatctctacaaggaaaactaaaaaacactgctgaaagaaatcatagatgacacaaacaaatggaaacatatcccatgctcatggatgcacataatcaatattgtgaaaacgactatatggcccaaagcaatctacagattcaatgtaatttccatcaaaataccatcatcattcttcacagaactagaaaaaacaattctaaaattcatatggaaccaaaaatgagcccacacagccaaagcaatactaagcaaaaagaacaaatctagagacttcacattacccaacttcaaattatactacgaggctacagttaccaaaacactatgctaccggtataaaagtagctaggtagaccaatggaacagaacagagagcccagaaataaagccaaatactcacagccaactgatcttcaacaaagcaaacaaaaacataaagtggggaaaggacaccctattcaacaaatggtgttggaaaaactagcaagccacatgtagaagaatggaagtggatcttcatctcttgccttatacaaaaatcaactcaagatggatcaaagagttaaatctaagacctgaaaacataaaaattctagaacatcacatcagaaaatctcttccagacattggcttaggcaagaagtcataactaagaacccaaatgtaacaaaaacaaaaataaataaatggtacctaattaaactaaaaagcttctgttcagcaaaagaaataatcagcagagtaaacagacaacccacaaagtgggagaaaatatttgcaaactatgcattagacaaaggactaatatccagaaactacaaggaactcacacaaatcagtaagaaaaaaacaatcccatcaaaacgtgggcaaaggacatgaacagacaattctcaaaagaagatatacaaacagtcaacaaacctatgaaaaaaatgctcaacatcactgattatcaggaaaatgcaaattaaaaccacaatgagatagcaccttactcctgcaagaatggccataattaaaaattcaaaaaataatagatggtagtgtggatgtggtgaaaacacaacacttttacactgctgttgggaatgtgaactagtacaacaactatggaaaacagtaaggagattccttaaagaactgaaggcagaactaccattcgatccagcaatcccactactgggtatgtacccaaagaaaaagaagtcattacatgaaaaagacacatgcatacacatgtttatagcagcacaatttgtaattgcaaaaataaggaaccaacctaaatgcccatcagtgaacgagtggataaagaaaatgtggtatatatacaccatggaatactactcagccgtaaaacagaaagcaataatggcctttgcagcaacttggatggagctggaggccattattctaagtgaagtaactcaggaatgataaaccaaatatcgtatgttctcacttacaagtgggaactaagctatgaggatgccaaggtataagaatgatataaaggactttggggactcaaggggataaaagactacatactggatacagtgtaacactgctcgggtgacagatataccaaaatctcagaactcaccactaaaaaacttatccatgtaaccaaaaaccacctgtactccaaaaactattgaaataaaaaaacaaaaaatgaatagaattatctgccccatagtgttaacactgctgaggctgagaaaccctaatcacagtaagttcctcccattcacttttcatcttttaatacagctttaggaggcacatattattattattctactttacagatgagaaaactgagggttagggaagttaattaagttaaccaggtcacaaagttataaagtggaggggcagaatgttgaatctctatcatctgattctatgagtttattgagtttccttccaaaatttaacatgcacacaaaaagcatgtattttctccttttaaggataccaaacattgttctgctactggaatttttttatattacacacatctttgacatctctctatattaaatttataggtttatatcattcttaacaacaacgtattccaaaacacgtatacatatgtaacaaacctgcacgttgtgcacatgtaccctagaacttaaaataaaaaaacaacaacaaactattctaaaaaatgtttaattcatcagtatccaacttacgcacactaatgttgcttttaaaatttactagcacggtggctcatgcccgtgatcccagcactttgggaggctgagacaagaggatggcttaagcccaggagttcaagaccagcctggggaacaaagtgagaccccatctctttaaaaaaattaaaaaattaaccaggtgtggtggtgcatgactgtggtcccagctacataggaggctgaggcaggaggaaggctagaacccaggaggtcacggctgcagggagtcaagatcacaccactgcctccagcctaggcgacagtgagaccctgtctcaaaataacaacaacaaaaacaaacaaaaatgctgtggccaggcacagtgactcacatctgtaattccagcactttgggaggctgaggtgggaggatcacctgagcccaggaattcaagaccagcctaagaaacatagcaagacctcgtctctccaaaaaaaaatttttttaaacaattagccaggcatggtgacacatgcctgtaatcccagctacttgggtggctgaggtaggaggacagcttgagcccagaaagttgaggctgtagtgagccatgatcgagtcactgcactctagactgggtgacagagcgagaccctgtctcaacattaaataaataaataaatttttaaaatataataaaacaatgctgtgatgtatgttggtttgcaagaatatttgtagaattaattcttttttgagataagagtctcgctctgttgccagactggagtagagtggcgggatctgggctcactgcaacttccgactccctggttcaagcgattctcctgcttcagcctctcaggtagctgggattacaggcacacgccaccacatccagctaatttttgtatttttagtagcgactgggtttcaccacgttgggcaggatgctctcgatctcctgacctcgtgatccgcccgcctccgcctcccaaagtgctgggattacaggcgtgagccaccgcgcccagccgaattaattgttaaaagtggaagtgctgagacaaaggatatgtgcaatgtaaatttttacaaatgttaccaaattatccctccaaaaagactgcattaacctacatatttatatggttttgcccacattgggatttatcagcttgaaaaatactcaaggctggacgcagtggctcacgcctgtaatcccagcactttggggggccaaggcgggtggatcacgaggtcaggagttcaagaccagcctggccaatatggtgaaaccccatctctactaaaaaatacaaaaattagccggccatggtggcgcccgcctgtggtcccaactactcaggcaggctgaggcaggagaatcgctggaacccaggaggtggaggttgcagtgagccgagatcgcgctactgcactccagcctggccgacagagactccatctcaaaaaaaaaaaaaaaaaaaaaaaaaaagaacaaaaacacttcaaaatttgataggtgaaaaatatataacactgtttttaaagttgcatttctgttgttacaagtgagaatgagcatttttccataccttcattggctgtttacttttcttttttctgtaaattatcttttttcattttctattgagtttttcatccttttccaggtgttttgtaaaagctcattgcataatatggaaaatagactcaaatcaaatcccaatcccaatccaattattcatactaaaaaatactgcactcaccaaaaaattgcttgttgtcttcatagtatttgtttccatatttgtcttcccccactaatgtaccaaccttcgcatcatttgtcctgtgaatacccaaaagaaaacagacattttagaatgattcttagttcaaaacataaacggaaataaagtgagagtaacaactttcagacacaagggctgctgcatcaactagcaaaatgaagaagtgctggggatgggaaaagatgaattgacaactgatgtgctcaaattacactaaaaatataaatgtagtctcttcagattacaggactacttgtatctactatccctcagccaggaggcactggaattagcaaaacctttaggaaatcaaaaagccaaagtatttcatcttcttacaatgatacgaaggtctccaggctctttcattccactctgggtctccatttaggtttctgcgaaactatgctgctcgtgggatcagtgaatgtcaggaagagaagggaccatcattattaccttcaacgccttacagacaaggaactgtacggcagtgcagggaaaaaaactttaccagggtcactgagttaatgtcttgtaatcctcattactctccagggcgtgggaaaagaggggagcccagatgcccttgcctccgagtcacagctctgactctacagatagcttcggtcttgtatcggggatatatgggacagagaccagcctgggggtggcaaggcagagattggggcggttgtccttgacaagagctgtggattctccaaggtgacccgagcctgggaccccttccaagaaatcagccagcgaaagtccagccccagaggccaagagcatggctctggccgcctacctgaaaaaaacccgtagatagcctcggagaccgccgtggccggtgatctgctgcagcccgcgtttcaggacctgcactaactccatcttgcctcgctggccccgcctcccgggtgcgccgagcaaaacccaccggatggaagctgccactcagccgcaggaagcccacgcccagaaggttctcacgcgaacgccagacgtggtggctctgcgcgtgcgcagagctaggtcttgcctacgcggtcatgttctggcttcccaagtaggcagaattggtttcccctggaagcaaaggtaccttaaaatttagttttcagaggttaaatctagaaggcgggcatatgctggaaagctcacctacacgaggctttctcacacggggattccccctttgggaatttcagtttcctcatctaaaaataattggctctggtgggcgcggtggctcactgttgtaatcccagcactttgggaggccgggtagggaggatcgtttgagcccaggagttcgagaccagcctcgccaacacagcgagaattctgtctctacaaaaaaaaaaaaaaaattaaaaattagctggatgtggtggcgcgtgcccgtagtcccagctactcggtaggctgaggcttagatgggagcatcgcttgagcctaaaaaatttcaatattacttcatttgttaaccacaattcttctacaaagagaaacctcccttcaactatttggctcctgagatacaattaatgtaggaaaggcagtatgggtgcttgattctcttactttttttttgttttttaattttagagacaggctctctgtcacccaggctgaaatacagtggtgtgatcatagctcactgcagcctcaaactcctgtgctcaagcagtcctcccatttaagtaagtgccaccacccctggctaatttttttttttttagagatgggcatcttgttatgttgcccaggttggttttgaactctggcctcaagtgatcctcctgcctcagcctctcaaaatgctgggattacaggtgtaagccaccacacccagccgattctttcccttatgtgtgttttcaaaataacaatttagttccctagctttttttttttttttttggtagtggtggttaaaaacacaaaatataaaatttaccattttaaccatttttaagtgtacagtagtgttaaccacatgcacattgttgcgcaacagatctctagaacttattcttcttgcaaaacagaaactttatatccatggaacaactttttcctctttctccatcccctgccaaccaccattctacttctgtttctaagagtttaactactttagatacttcatataagtagaatcatgaggtgtttgtcttttaggacctggcttatttcacttagcatgatatccacaaggctcatccatagtgtagtatatgacaggattttcttctttttataaatgttgaataatattccactgtatgtatatgccacccagttacctgtccataaacatttctgctgattccgcctcttggctattgtgaataatgctgcagtgaacacgggtgtgcagatatctctaagatcctgttttcagttcttttggatatatacccagaagtggattgctagatcatatggaaattttattttttatttttataggaatccccatactgttttccatggcagcatcaccattttacattactaacaacaatgcacaaaggttccaatttctccacctcctcaccaacactacatattttctgtgtttgtttgtatgtttgtttgtttgttctgagacggagtctaactctgttgcccaggctggcgtgcagcggtgcgatctcggctcactgcaacctccccttcccaagttcaagcgattctcctgcctcagcttcccgagtagctgggattacaggcgcccaccaccacccccggctaatttttgtatttttagtagagacgaggtttcaccatgttggccaagctggtcttgaactcctgacctcaggtgatccacccgccttggcctcccaaagtgctgggattacaggcgtgaaccaccacgcccaacctgtgttcatttgttttttacagtgggcatcctaatggatgatgaggtgatacctcattgtggttttgatttgcatttacctgattactgatgttaaccatgttttcatatgcttgttggccatttgtatatcttctttggagaaatgtttattcaagtcctttgcccatttttgaatcgggttttttgttgttgttgttgagttgtaggcattctttatgtatcgtggatattttctcccgttccctaggtcatcttttcattccgttgattgtgtcctttgctatgcagaagtttatgtttgatgtagccccaattgtctatttttactttgtctgtgcttttggtatcatatctgagaaatcactgctaaatccaatgtcatgaagcttcccccgttgtcttctaggagttttatagtttcaggtcttacatttaggtctttagtccattttgagttaattttggtatatggtgtagggtaaaggttgaacgtcattcttttgcttgcggatatccggttttcccaacactattctctccccactatgtagctttggtacccttgtcaaagatcacttgaccagatacttgagagtttaactctaggttctctattctgttccgttggtctatatgtctgttcttatgccaataccactctgttttgattactgcatctttgcacaatgttttgaagtcaggaagtgggttctctattctactccgttggtctatatgtctgttcttatgccagtaccactctgttttgattactgcatctttgtacaatgtttgaagtcaggaagtggaaggcctccggctttatttttctgaagattattttgtctattcagggtcttttgagattccgtatgaattttaggactttttaaaaatctgcaaagaaaaatggccctgggattttgataggtattgcaatgaatctgtagcttactttgggtagtatgggattttaacaatattaagtcttccaatccacaaacacgaatgtctttccatttatttgcatctaatttctttcagcactgttttgtagttttcagtatataagtcttttgcctacttgattaagttattcctaaatattttattctttttgatgctattttaaatgtgattgttttcttaatttcctttttgagttgttcattgttagtgtttagaaggcaactgatttttgtgtgttgattttgtaccttgcaactttgttgaatttatttattagttctaaccattttttggtggaatccttagggttttccacatataataccacatcatttgttaatgaagataattttacttcttttccttttttttttttaaggcaaggtttcacccttatcaccaaagctggggctcaagtgatccccctgccttagcctcatgcacagctgggactacaagcatgcaacatcatgcctggctaatttttaaaaagttttttgtagagatagggtcttgctgtgttgcccagactaatcttgaaattctggcctcaagcaagcaatcttcccgtctcagcctcccaaagtgttgggattacaggatgagccaccgtgcctggcccttcttttccaattttcagcttttatttatttattttttgcctaagtgctctggcaagggcttttagtaatatgttgaatagaagtagcaagaatgtacgtacttgccttgttcctgatcttagaagaaaagctttcagtttttcactattgaatatgatgttagctgtgggcttttcaaacatggcctttattaggttgagataatttcctttcattcgtagtttgttgagtgtttttgccaagtgctttttctatatcaattgagatgataatatggtttctgttcttcattctgttaatgtgcctctcaacttaaaatggcattacattctgacatgcccattgtaaataaaaaatatctaaataaaaaatgtaccgaggccaggtgtggggtggctcacacctgtaatcccagcactttgggaggctgagtcaggcagatcgctttgagcttagaagttcaagaccagcctgggcaacatagtgaaaccccatctctacaaaaaattaaaaaaaaaaaaatggctgggcatggtagcatgcacctgtgaagctgaggctggagaattgcttgaacctggggagcaaaggtttcagtgagccaaggtcatgccactgcattccagcctgggtgacagagtaagaccctgtctcaaaaacaaaacaaaacaaaacaccacaaaaaaaatgcattgtaaacaccaataaacccatcataaaacaaaaaaattgtaagtcaggtcatgatcagttgcaaaccatttgtagtccattacactgattgatatttgtatgttgaaccatccttgcattccaggaataagtcaagtcccacttggccatggtgtataatccatttttttttttttttttgagacagagtctcactctgttgcccaggctggagtgtagtggtgcgatctcagcttattgcaacctccgcctcctggattcaagcgattctcctgcctcagcctcccaggtagctgggattacaggcgcttgccactatgattggctaatttttgtatttttagtagagacagggttttgccatgttggccaggctggtcttgaactcctgacctcaggtgatccacccgtctcagcctcccaaagtgctgggattacaggagtgagctaccatacccggctgtataatccttttaatgtgctgttgaattcagtttgtgagtatttttgttcaggatttttacatgaatatccatcaaggatatctatagttttcttgtagtatctgttgtggttttggtatcagggtattgctggcctcataaaatgagtttaggctgggcgtggtggctcacacctctaattctaacactttaggaggctgaggcgggcagatcacttgagtccaggagtttaaaaccagcctggccaatgtgacgaaactgtgtctatactaaaaatacaaaaattagctgggcctggtggtgcatgcctataatcccagctactcaggaggctgagacatgagaactgcttgagcctgggaggcagaggttgcagtgagctgagattccaccatcacactgtggcctgggtgacagaggggaaactctgtctcaaaaaaaaaaaagagtttaaaagagttaccttggccaggtgcagtggctcatgcctgtaatcccacgcagcattttgggaggccaaggcgggtagatcacctgaagtctagagttcgagaccagcctggccaacatggtgaaaccctatctctactaaaaatacaaaaatttagccaggtgtggtggtgtgctcctgtaaccccagctactcaggaggctgaggcaggagaatcgcttgtacatgggaggtggaggttgcagtgagctgattgcactattacactccagcctgggcaacaagagtgaaactccatctcaaaaaaaaaaaaaagtgttaccttctctctttcttcttttttttttcttttctaatgagatggggtctcactatgttgtccaggctggtctcaaactcctgggcttaagtgatcttcccacctcagcctcccaaagtgctgggattacagatatgagccactgtgcccagccaagtgttaccttctctttaattttttggaataatttgagaaggattggtattaacttttcaattaattcaaatgtttgctagaattctcctgtgaagtatctgttccttggcttttctttgttgggagttttctgattactgatttaatctccttactagttatgaatctgttcagatgttttcttctttttctttatttaaaatttttgtttgtttgttttgagacagtctcactctgttgccaggctggagtgcagtggtgtgatctcggctcactgcaatctccgcctcctgggttcaagtgattctcctgcctcagcctcccgagtagctggggctacagtcatgtgccaccatgcccagctaatttttatatttttagtagagacgggttttcaccatgttggccaggattgtctcgatctcttgaccttgtgatccaccctcctcggcctcccgaagtgctgggattacaagtgtgagccaccgtgcctggtctctttttctttatttttatagatgggatctcactctgttgcccaggctggagtgcagtcattcagtcatagctcactgaagcctcaaactcctggcctcaagcaatcctcccaccttggcctcccaaagtgcttggattacaggtgtgaaccaccatgcctgccctgtgttttctatttgtcaaagtattttccttttaatttcttctttgaggcattggttactcaagactgttttgtttatcactgctgcttggttggttggtattaaaaaaaaatgtgttgtttcatttccacatttgtggattttccagttttcgttttgttttttacttctttttcttttcttttttttttttttttgagacggtgtctcgctctgttgcccaggctggagtgcagtggcatgatctcggctcactgcaacctccgcctccctggttcaagcgattctcctgcctcggcctcccaagtagctggaactacaagcacacaccaccacacctggctaatttttatatttttagtagggatggggttttactgtgttggccaggctggtctcgaactgctgaccttgtgatcagcccacctcggcctcccaaagtgctgggattacattacaggcatgagccgctgtgcccagccctttgcttttgatttctagctttattccactgtagtcagaaaagatacttggtatgatatcaatcttcttaaaatttgttaaaccttgttttgtgacctaatatgtaatctatcacagacaatgttgcatgtatgcttgacaagaatgtgtattgtcattgttaggtggaatgttctctgtatgtctgttaggtccaattgctctagagcattgttcaagtcctctgtttccttttcgatattctgtctgggtgttatatccattattgaaggtggggttttgaaaactacttttgttgtgttactatttctatttctcctcaattctgtcagtgtttgcttcctatatttgagtgttctgatgttaggtgcatattgaattgttatatcttcctagtggattaacccttttatcattttgtaatccctttgtctcttgtgacagtttttcacctaaaagtctattttgtttgatataagtacggccactcctctttttttgttaccatttgcattaaaaatcctttttctgtcttttcactttcaacctatgtgtgtccttacatttaccctatgtaaatctcttatagagagcatatagttaagattctggtgggttttttttttttttttttttttggtccatttagctaccctgtcttttgactggggagtttaattcttgtacatttaaagtaattactgatagggaaggatttactactggcattttgttaattgttttctgtattttttgctgttgtgtctctctctcctctcttgccaccttccctgtgtttcattggttttttggtagcaatttgccattcctttttcattttcttttgtgtatcttttataggtattttctttatggttatgttgtccctaggtttttttttttttttttttttttcaaactgaggcggggttttaatatgttgcccaggctggtcacatgctcctgggctcaagtgatcctcccatcctagcctcccaagtagctgggattataggcacatgccactgcacctggtgtctctagcatttttaaagtacaatatgtacttatagatttaaatgtttgatatgtttcaacccattgcagttattattctaatcaattaccaaattgttttatctttggttagtagagacctcttcaggttggttcctgagtttctgagacacaatctagtcatctttgatagttttattatcattattttatttttggtgtgacaagatgttcccagctcatcttacatatttcctacccggacctgcaatcagcctttcttctggggagctctactccagggcttatggttgcttaaatctcaactctatcactgtattagtaccctctcacactgctaataaaggcatacctgatactgggtaatttataaaagcaagaggtttaattgactcacagttcagcatggctggggaggcctcaggaaacttacaatcagggtagaaggggaagcaaaaacatccctcttctcatggtggcagaaacgagaagtgcagagggaaagggagaaaagccccttataaaaccatcagatctcatgataactcacccactatcatgagaacaacatgagggtaattgctcccataattaaagcatcctttccacaacatgtggggattataggattacaattcaagatgagatttgggtggggacacagccaaaccctatcaatcactaattagctatattgagcaagttgcttacaccttagtttactcatttgtaaaatggggttaataatattacccatctcatgagatcactgtaggcattaaataaggtacataaaaaacacagtgcctggtgtatcataagtactcaataaaggttagtttgataaattacttctaaataacaatagagacatatgtcttcttgagcagatttttcacagaacattctgacttcctgttctaattttgatcagttgtctttaggcctcattcatgaatggatgatcattctgggatttcttttcattgtgtttctgaataaatgagtcttattttatcttggatcctgcatatttttctttcttagaattctctcatttagggttgcttgttttttttgtttgttttggtagagcacatttttgagacttttttcaaaaatgcatgtaggagataacatttccctcgattgatcctttacttggtcataaaaccctaggttcaaaatagtttcctcacagaactctgaaagcattcctccattgccctctaatatctaacatttagctgggtgtggtggtgcatgcccatagtcccagccacttgggaggctgaggcaggaggattgctacagcccaggagttagaggctgcagtgagctatgatcgtggccactgcactccagcctgggtgtcagagtgagaccctgtctcaaacaaaaccccaaaacctctaacatagttgatgagaatcctgctgccaatctgatacaaattcatttgttaaaaacctgtttttcaatcttttgaagtttttcagatttttctatttgtctttaaagttctgaaatttcatgaagatttatctagggcttttgtagttgatgtttgttggaattcagcatcatctttgaatttggagatgtgacatttttagcagtagaaattgttttaaataatttttcccctacattttctgttacttctttccgaaatctgggtattaggtgaacattgacccttctggattgatcccctattatctttttaacgttacctgaatattttgttttttctgcatattttccattttcatctttgtgctttacattctgaaccatttctttgcatttatgtaccagttcactaatttgttccttgtctaggtccagtccatcagtcctgatagattttttcaacatgatttttagtttaaagaatgcttaaaaaagaaagaaagaaagaactctttctttaatctctcttccttttttttttttgagacagagtctcactctgttgcccaggctggagtgcagtggcgtgatctcggctcgctgcaactccacctcccaggttcaagcgattctcctgcctcagcctcccaagtagctaggactacaggcgtgcgccaccacactcagctagtttttgtatttttaatagagacagggtttcaccatgttggtcaggctggtcttgaactcctgacctcgtgatccgcctgcctcagcctcccaaagtgttaggattacaggtgtgagccattgtgcctggccagtctctcttctttttcatagtatcctgttctgattttttttgtcattaacttggtatcaacattattatagaacaactaaagttaaagagacacacagaattcagttggataataccgacatgttcatgtgaacaaacattgccagaagccttaattctttcttcaatgatcttagcttcaatttagctcatccattttgatcattttccctcttaaatttggtacattgaacatacgtacctcactgaagaaatcatatagttccattttctgaactgatttcccactcctagcaacaactacttccaacccttttagcttagttattccctaccatatttctaaattacatgcttatagtatttctagagtttttccaactttaggcattacttgttgacttctcaacataggtgaggacttttagggctttcacacactcccctcctcacacctagctccccctccaacttcctgctccatttttcatatacggtttactaaattttctgttacatatccatgtaaggacaatttagtgtttacaacttctcaagggcttactcccctcccttggatacagggaattgtggaggagatctggagatctaacagcacctcattttttccacataaggatttatttttctatcaaatattgggaaatatacaaaagtgcctatttgatcttaagaatctacagtcagcttaataagtagaatagtatcagagattcaagttttcaaaaaacatggctgaaaaaacagctttgattccctaaactcttccagaatcttcccactttcctgtcaaagggcatagtttatcttcccttgaatgtgggtgggtctttgcatcaataaataaaatgacatggaaagcaatgttgcttggtttctgagggtaggttagaaaaaaccatctggcttttccctggcacttcctctctcaacacttcctccagcagccacatggaaattacccttcatttcccacaaaatggagtccagtctgtagctgagtagttttcttagccatctcctgcccatacaagtttgaaggtccaagatgataccctcctgccattttttttttttttttcaaattttagagacagggtctcactctgtcacccaggctggactgcagtggcatcatcatagctcactgcatccaccagctcctgggctcaagccatctttccatctcagcctccagactagctagggcagccatgcaccaccatgcccagcttaagatgttacaatcctttaaacttcttatgatttcttatgtatcaatttgtaaacaattccataagatgaaaaccacccccaacctcccaggccccaatcttgtccaggtaagccttgtctacctgggtttccaagtgaggctgctgagatggaatattttttcccccaaatgagggaaacatttctagtatttctggttccatatgctcttccagaagcttgccacttcatcatcaggaggtggagtctatttcccctccttttccatcagcacagacctttgtgacttcttcgatgagtagaatgcagcagaagacactgaattagtgtttttttcatttttttttttttgagatggagtcttgctctgtcacccaagctggcgtgcagtggtgcaatcttggcttactgcaacctccgcttcccaggctcaagcgattctaccacctcagcctcccgagtagctgggactgcaggcacatgccagcaggcctggctttttttttttttttttttttttatgtagagatggggttttgccatgttgtccagtctgatcttgaactcttgaactcaggcaatctgcccgccttggccaaagtgctggaattacaggtgtgagcctgtatcccctgcctaacactggatgaattctaatgccaggcaagaaatggtaacagagctcccacgtggccttctcaacccttgttcttggaacctagcctctaggttgtgaggaagggaaacaggactaggtatgtgttctggcttcagctccacctgaagtcccagcaaacagtcactatcaacttccagacatatgagtgaatgattacatacattccaacctcactatttgagctcacctagctgtggctgaaaggagcagagacaagctgtctctcccaagctctgtccatgttgcatattcatgaacacagtacatgttgttttaaaccgttacgttttgggatggcttgtttaaaagcaaatagttagaactctgtcaatacttttcaagccccttgtattctgtttttatcctcttcccaccccttcagaagtaactagtattctaatttagtattatttcctttgctttcacaaaattagctttcccacataaatacctctcaacaatgtatctgcctgttttcagtaaaccagttaaattatggttttgtatacttttgggcttttttcatacaacattgtattttggggattcacccatgtttatagtttattccttttttagtgttgcatagtattccattgggtgattataccacaattaacttctccattctcctgtcaatggatatttgaacagttttccttttttgctcttacaatgctgacatgaatatttttgtatgccccctggtacatgtgtgagtttctctaggataacttcatgcatgttcaactttctatttaatgcaaaatctttcccgaatttattgtaccgacactccctccatcaacacacatatttttactccacatactctacgtttggtttcgccagactaaaattttatcattctggtgggtgtgtatttacttccaaaatagactttcagcaaatccttcatcttcccctccagagatgtcatagtacaagagcattttggaggatctgtggtacaaatcagattgcttcacagttttccacactgcaggataaaaagtccttctcaggtttgctaggatcatcactactaatctatttttagctttcaaaaagttgtggttatcatttatttctgtcccatttttttgtctttgtaagatgcattaaaaaacaaacgaaaaccataaagcaaaccaggtgtggcagttcacacctgtagcccagctaatcaggaggctgggagactaatcaggaggctgaggtgggaacatagcttgagcccaggagttccaccctggccaacacattgacacttggtgtctaaaaaaaataaaaacaacccacaaacctttagctgttttaatgcagttttagaaggaacttagggttaaatgtatgcattcaaggcatctttcaccaggcattaattttttaatttcagtaaattttttctaaatgttttttggcttttcaaatctacttggttatttttgctgctgtttcttgtttacttttagattcaatttttttctccttaaaacatatcatatagttgcattctgcatgtgacaattttaatatctaatactgtctttgagggtctttatgtattgcttatttccttgtgagtttgataattttgtgtactcatatttggttgagcctaatctgtgagaatatcaagattttaaattaagggttggtaaactatactccaagagccaaatccagtccactgcctgtttttgtatacgctttattggaccacaggtatgcccactcatttatgttgtgtatagttactttagcactttttgagtcgttttaacagacactgcatggcctatgaagccaaaaatatttcctttctcaacttctgttctcaattatgaatattttctccagagaagatttacacttgcttctgccaggacacagggggtactactgacctgaaacaaccttagccttctttaggaagtcatctcaatttggtgaactcagctaatagatcaaaggccttcagagtatctgttcctctatgctgctaaaaatagcagttgtcttctttgactatatgatgatttcaagatgccatatcttttaaaatttataatggtggatcatttccacccacagacatgtgtccttttgtggaacttttcttacattatttaataatttccttttctgaaatctttcctattttccctttcttaaactcttagtattgaaagtgttagaccttggccgggtgcggtggctcatgcctataatcccagcactttgggaggccgaggtgggcagatcatttgaggtcaggagtttgagaccagcctggccaatatggtgaagtcctgtctctactaaaaacaataagaaattagccgggtgtggtggcgtgtgcctgtaatcccagctactggggaggctgaggcagaattgcttgaacctgggaggtggaggctgcagtgagctgagatcgcaccactgcactccagcctaggcaacagagtgagactcaacccccctttcccctgccaaaaaaaaaagaccttgtttgattctctgattttatcatttctatcctattttctattcctttgtcttttgggtttactttcagggtgaattcttcaattttatctctcaatccttctaatgaattgccttgactatcatttttaatttctaggggcaattccttgctccacattttttttgggaaaattctgttctccttttatggatacatctggtttctctcaagatactaattatatttggggaatatttttctgatctttgcgttttgtatctgctccccacccctcatgtctggtctctcatgtatagagattttccttaaatatctggctatcctgggctgtaagttcacatttaataatagggcactaaagaactgaatggaaacccaatacatacacacatgacttggtaattggagggcttcattgaagagtgataaggtggcaaacaggctttatttatttatttttttatcattaagggataaccaaaatggagatcttttctctggggccatttagcttctccaaagaaaaaaaacctggcagagaaaactgtacttgattgccagtatcctgggaaaagggtagcaagcctacatatcaaccaaatgcagacttttttttttttttgaaacagagtctcgctctgttgttgcccaggctggagtgcagtggcacaatctcagctcactgcaacctctgcctcctgggttcaagcaattctcctgcctcagcctcctgagtagctgggattacaggcgtgtgccaccatgcccggctagtttttgtatttttagtagagacggggtttcaccatgttggtcaggctggtcttgaactcgtgacctcgtgatccacccaccttggcctcccaaagtgctgggattacaggcgtgagccaacgctcccggcctccaaatgcggattttcacttcctccacattttcaaccctgtatcttattcacaccatttgttatccctggtatcctgttaagtcctatgctcttccagttcagtttctcagaagaattatctctggcctcctcctgcttgaaaagggagaagagaaagtggccacctttttttttttttttttttttttttctgagacaggatctggctctgttgcccaggatagagtgcagtggcatgattttagctcactgcaaccttggtctcctgggctcaagccgtcctcccacctcagcttcctaagtagttgggattacaggtgcacactaccacacctggctaatttttttttttttttgtagagatgaggtttcactacattacaccgggtagtctcgaactcctggactcaagcaatctgcctcgctcggcctcccaaagtgctgggactacaggcatgagccacggtgcctggcctccacccaacttaagtagggctggggaaagacagtcgaattattctgtatccagacttgccaccaatctatttttttttatgtctcaagcatcatctcttcttctgagcactgtttccttcagggtactgagcatcttgtttggtatggcttctttctcattgcattgccttttgcagtcactcagttaaagcttctttagttctggttctactaaatcagtcattctttctctacctgcattttgttttccaaaaatttactttactctatcctttgatttcttctctcctgttccatttgtcctcgtgtagttattatattttatggacattttactgagatttcgggaacgaaaacaaaagctaatctgcagtatttagctgggagtcttcaaattgaattgtaaataaccctaaaatataggacatagaaatgtttccatgtttttctcttcctggagagagaaaatcatgatttaattaaaatcaccccacctaagagtcacctattatatcagtggcgattcttattagagctttcttaatatagcagatctatacttgctatagatgaaagcacaatggaacaaacgaaggataagcaatcactgaaaaggaaaatgaataatatatttacaaatatactggtaagacacagaaatttgtaatgcaagtcacattttaatatagttttaaagtcttccaaatatagtagcaaatttaatcagaaaaaacacctgaaacatcttaactattagtacattattttaaaggattatttccctgattccttggcttactaaactgtatttataaaggtataaactactgatttttccatttgagtattatactaaatgtaatttagctgataattataaataaaattgttgactaagatcatgttttaaatagggaaaaaagtttcccttagtaaactggtaaagactgtaagttgatattttcaaacttttgattactataaagtagtaagcaataaaatccacatccccacaaaaacttcacttttcttctattgcaaaaatctttacaaaaaatgtactctgagtgcattatccgtgtttgctttaaaaatcaacaaacataccaaaataattcatcaagaaatcaaagcaaagaaacagttatcagtatcaggtttgctaaaagaataaattactgtggaagacatccgaggagtctaaaatgaatttgttgtagcagtaacaaggcttcaggctgattcttatactgttgttaaagcagccctcccgtgctttacagtgaaaaaaatcagtgaatatttctttattttaaaaaattatcaatagcttcaaaataatgtttaaacttgccttgagaacatgtactggctatgataaatccattatttgacatattgggtgagtttttttagtgatctaaaagaaattggctaaaacccatacatgacaggtttgggaagctctaactcaggtcagaaaagtgggagagagatcagatcctttttatggaatgaaagagcaacaatttaaatatcttttttgaaatagtgaaacattttgggctcaattagtctttattactttctttctttttacagagacgaggtcttgctatattgcccaggctggtctcgaactcctgagctcaagcaatctgcctgcctcagcctcccaaagtgctgggattataggcatgagccactacacctggctagtctctattattttcaaagacagcagtaggccaggcacggtggcacgcgcctgtaatcccagtactttgggaggctgaggcaggatcacttgagcccaggagtttgagaccagcctgggcaacagtgaaacccacctctataaacgaaaacaaaaacaaaaacacgagcagtaagctaaaaatattaaaatatcaacactagcttattctcaaaaacaattttctgctatataaagtgcttgtaactaataatatacattaaaaatggcaactcttaagatcatgaatggcctgtctcactgccagcaatgagagtagtatatgctaagggacaccatgatatttagagaagacaaaaaatatgtattcaattatttcctatagttctaatactgtcattataccagtaagcataaaataatcttattttgatatggtaattaaacaaaaattattatggcagagtaaaatgcaaggaactaactccttagggatttctgaccattaagtatttttactagttcataatgaagttaaatatgactagaacacaattcagaaaaaagagactaatttatttgttttataaaatagaatgagcgcttagtttagataatcaagaggtgacagcttcaggtatcatcttcaccaagaataaatttgtagtgtttcatattcatttaaaggaatcaggaagaaaaattcatttaatttctgctgcctgcccagtcacttcaaaaattcttaagggaagctaaaataaaaataccttggattctggttactttttaaagtaaaaatttccagatgcctcaaaagcagtgagttcaatttggtgtcttgtgttctggcaaagaacagttaagtttacagcactgcagtcacagttttcaaatgctgtgaccaattatttgagagttataatctgcaggctccattttcaaaatatgtgggataacactgtcaattcgtatattgccaatgagacctttgaaaaacaattcttcagtgatggtagcattcatcagtcttaaagctggcaatctgagtagtagtctggataacctaaaaaaagaaagaaaaaagggagaggaacaaggttgtaaaccagaaagaaatttagtagaaaaatatgagtaatttctgcatgtggcctaatttaataaagatagcattttcaaaagttaaaatcaaaactttagtattctcaagccttagaacatatggcaattacctggctattaatgcagtctgacagactccacaggggaaagccctgctcttaatgctacactgtactgcctccacttggctgtaaggactgtggaactgagttgttaaaccatgcatcaagttatacaattttttttttttttttgagagagggcctcgctctgctgcacaaactggagtgcagtggtgtgagctcactgcagcctcaattccttggactcaagtgatccttcccgcctcagcctcccaagtagctgtggctacaggagtgtgccactatacctggctaattgtgtttgtttttttttttttgtagagacagggtctcactatattacccaggctggtctcacactcttgggctcaagcaatcctcctgccttggcttcccaaagtactgagattataagcgtgagccattgtgccgggccaagttatacatttaagaatggcggctgggtgccagtggctcacctctaggaggctgaggtgggcagatcacttgaggtcaggagttcgagaccagcctggccaacatggtgaaacctcatctctactaaaaaaaataataataaaataaaataaaatcagccgggcatgaccagcctggccaacatggtgaaaccttgtctctactaaaaatacaaaaaataattagccaggcatggtggcatgtgcctataaccccagccacttgggaggctgaggcaagagaatcatgagaattgcttgaacctaggaggcagaggttgcagtgagccgagatcatgccactgcactccagcctgggtgacagaccaatattctatctcaagaaaaagaaaaagaatggcttagcaactcatttcaggttttaaaaatggcaatgttttgtgttatcaggacataagacattttcttggttttgctctgcaaaaaactactggaagtaggcaatagttgctattactgggaaaagcacagaatgtggaatcaagaccgctgggttcaaatcttgattgaactgcccactacttatataaatgtgtgcttgccacttactgtctctcacagtgctgttgtgaggatgaatgaaatgatccctgccaatttctgtgccaggtagtgaggtttcttagggtaagaccctatcttgtgtcaaagtgccttataagttgaaaactactatccaaggataatgtattatttttaagtaaccaacaatgtaaaaaactgagaaagctgcagtcacaaaggaaaaaaatttaaatactgtatttatttgtataatgaggcatagagtaacttttaaaacttaaagatgctgaaaaacaaccacaacaaaaccaccttttcaaaaagactgtggtgggtttatccttctgtcctaacgccttgcactctaacacctcagaccaaattagaccagcagcccccaggattatcttcctggagctgtgtgctctactcctcaaattacttagcatccacatcaaattactcagcttttacagaactggtagaaagcagaataggaaaacgagttaaagtaaggctgatatttaagatgagactggcttataaatctacattatttaatatatgtaaaaaaattattatatgtaaaaatgttatcttactagtttgaagtatgccaaactaataaaatgttttatttattataaacaaacacacttatatagcccttactgtatgacaggcacagtcctaagcactgtacatatattaactgatttaatccttaaaataattgtaaaaagtgggtattagtattatctccatttataggtgaggaaacatgcccaaggttatgaagctagcaagtgcaggagtcagaattcaaatccaggtactctggctctataaccaggtgattaacccctcggctataatatccctctttaaagaaagtggctcttataaaaaaagaatttttctcaaagaatattggtgagaaatagcttggagtgaatttcataaaccatgtttcaaaattaattataaaacaatctaatggtatttgtttttattttttaatattttttagacagggtctcactctgtcacccagattggagcgtaggagtatgatcacagctcattgcagtctcacctcagctttctgagtagctgggacttcaggcatgcgccaccaagccgggctaatttttgtatttttttgtagaaacagggtttcaccatgttgtccaggctggtctcttgattattttttatcctccttttgctaacaaaattcattattttatccaaagaaaaagagtttggattttagagtcagactacttgggtcacagtcaggtgctatcatttactgtgtgaccttaagcaaagttaacctctctgtgctgaagtctcctcttataaaaaatataagaactggatgaaatattttatgtaacgtacttgcaacaatgcaatactgctttttatagcattagtatttcaaagttaaggttgcctaaaacatttaattattgtgagagtagtaataatgagataacagatccacaaaaggtttttcaattattttaattatatagaatttaactctagatacctgtaggtgtcatctggatatgttttggttatataatcttggaattccacataagccttttcctgaaatttctctatctgttccatgttttctaggcttggatgatctgaaacattaaagaaaacattggtaccctagttctgaatgttcatttaagacagagtggatatgaaaagagacagaaagaatagtcaaaatagaagccccatcataaaatgtgtggctcaggccgggcatggtggctcacgcctgtaatcctagcactttgggaggctgaggagggtgaatcatctgaggtcaggagttcaagaccagcctgaccaacatggagaagccccatctctactaaaaatacaaaattagccaggcatggtggcgcatgcctgtaatccaagctactcaggagactgaggcaggagaatcacttaaacctgggaggcagaggttgctgtgagccgagacagcgccattgcactccagcctgggcaacaagagtgaaactctgtcttaaaaaaaaaaaaaaaaaaaaaaaagtgtggctcattcattccacaaatattgattgaggccacctactatataccaagcactatattttacatatttaaaattattttttatctcgtatacatatgctaacaactaataaaaaataagcgggtgttaccaaaacaaacagctttctctccattccaaaagtagtaagaatgcatttgataactttgcctttaataggagcaaaaggtaaatgactcagcttaaaaagacatcttaaggctgggtgtggtggctcatgcctgtagtcccagcactttgggaggccgaggtgggggggatcacaaggtcaggggttcaagaccagcctggccaacatggtgaaaccccgtctctactaaaaatacaaaaaattagctgggtgtggtggcaggcacctgtaatcccagctacttgggaggctgaggcaggagaatcgcttgaaaccaggaggcggaggttgtggtgagccgagattgtgctactgcactccagcctgggcaacagagtgagactccgtctccaaaaaaaaaaaaaaggcattttaaatccatgaaatatttgcagattatattctatgccatatttttctaagtcaaaaattctatttttaggtaaaaaggtatataagaaattatgaaaccacaaatattatctctatcagaaaaataacagaaacatgaaaaaatctatataagcatttcaatggtcactataacattacacaaaaacagaaatattaaaagaacttcataaaaattatgcatagcttaagaaatgttgaatatggaaagctctgttctcatggatgaaaattttaaaaagtactaaatggaaaaacctaaaaatacttagtaaaataaaattacattagaatttaaacttcaaatctatgttccttcaattttcacctaaggaaaataaaggtgacaaattgtgctaagaatagagacatacgttactaactcataagaaacattagaagaaatagtacaagctttcatgttcttactggtattactgacagaaagaagcaggtttcctcagataattttattatgatgcacaagaacagaaacatatcagaatgaaaaatacagaacctaagagaacagtcaatttctcttattcagaaattgatcactgagagcttaccgtcattttaccatctgtgaaaactgtaaactggcaggaaaacaagaaaccagttttttaaatttgttggtaactcatataagatgtttggaaatctagcccatcaacatagcaaatagtcatctctcattctgccatttagtaatgcctaaaaaaatacacctaagaattcaaatgttgacgtgacaacagaaataaaggtctataacattttttacattttcatttatttttgagacagggtctccctctgtcacccaggctagaatgcagcagcatgattagagctcactgcagcctcaaattctcgggctgaagtgatcctcccacctaagcctcccaagtagctgaaactacaggtgcacaccagcacatccagctaattttttctgttttgatttttgtagagaagaggtctcattatgttgcccaggctggtctcaaactcctgaccagtcctcccatctcagcctcccaaaatgtgaggattacaggcatgagctactgcgccctgccaaggtctatcatattatttcactgacttctcaacctcccttttcatacccatataaatgtctaacatccttaaaattcaccaatttaaagtatacaattcaggccaggcgggtggttcactcctgtaatcccagcactttgggaggccgaggcgggtagatcaccttaggtcaggagttcaacaccagcatggccaacatagtgaaacttgtctctactaaaaatacaaaaatgaactgggtgtggtggtacatgcctgtaatcccagctactggggaggctgaggcaggagaatcgtttgaacacaggaggcggaggttgcagtgaactgagattgcaccactacactccagcctgggcgacagagtgagactcagtctaaaaaaaaaaagtatacaattcaatagtttttagtatgaatatactgataattgtacaactatcactacaatctaattttggaacatttttgtcactccaaaaaaaacactctacccattagcagtcacttcccatttcttccttctccttagaccctggcaaccacttacctattttatgtctatacaggtttacctattttgcgtattttatataaatgaaatcaaacaatatgactggcttctttcatttagcagaacttttaaaggttcatctgtgttgcagtatgtgttagaatttccttccttttatggctgaatgatattccatcatatgtatatattaaatttatttcttcatctgttgaccgacatttgggttgtctccactttttgactattataaataatgctgctatgactatttatatacacattcttgcatagatatatatttttcatttctcttgggctgacaagagtgaagctgctgagtcatatgataactccatgtttaaccttttgaagaactactgaactcttttcccaggtaactgcaccattttacatccccacttgcaacatatgagggcttctatttctccacatcgtgaaacattttattttgaataaaaagtaaatgtttatatacctggactgaagagtactattgccttcaggtaggcatattcgtatccatcaatgcagagtttaaccatgctgttacaaaactcctgtagtttgaagatgtgctccatcaataattttcttctttctgttgacattttatctttaattaaaaataaacaaatgcttctagtgtttgtctaaaatgaacaactactttcatccaatatatttccctctcaggaattttgaaaaattttttaattcttaaattttttttgagacagggttttactcctgtcgcccaggtggcagtgcagtgcagtgcggtgatcttggctcactgcaacctctgcctcctggactcaagcagttctcctgcctcagcctcccaagtagctgggactagaggcgcatgccaccgcgcccagctaatttttgtattttttgtaggatggggtttcactatgttgcccaggctgttcttgaactcctgggctcaagtgattagcccacctgtgcctcccaaagtcttgggattacaggtgtgagccactgtgcctggccttcctctcatgaatttcaagctttgagtataaccaatctagaaatgtttaaaattaagtatttctgcaattatagctaaaactaatcttaagatattattcattcaagaacaagctgttagtataatctgtataaaaatcgtaagtagaaaggtttatatttatttttcttgagacagggtctcgctctgttgcccaaggctggagtgcagtggtgcgatctcaactcactgcaactctgcctcctgggttcaagcaatcctcccacctcagcctcctgagtagttgggactacaggtaagcgccaccatgaatggctaaattttgtattttagtagagatggggtttcaccatgttggccaggctggtcttgaacccctgacctcaagtgatctgcctgcctcagcctcccaaagtgtgagccactgtgcccagccaggtttatatttcatcttaattcttttgatgttgtaaaagtacttttaaaaaatgaattattttctcatggtaattgcttttggggaaaaaactatatataaaaaatggatttggatgtttatggcacttggcttgttaaaaaaaacaacaaaccaaacaaacaaaaaaagaaaactctaaatgtaatggttccttttttttttttttttgagatggagtctcgctctgtcgcccaggctggagtgcagtggcacgatctcggctcactgcaacctctgcttcctgggttcaagcaattctctgcctcagcctcctgagtagctgggattacaggcgcttgccaccacgcctggctaatttttttgtatttttagtagagacggagtttcaccatgtttgccgggctggtcttgaactcctgacctcatgatccacccgcctaggcatctcaaagtgctgggattacaggcgtgagctaccgcgcccaacacccccctccccaccctttttatttttttaaagaaatggttctcactctgttgtccaagctagggtgtagtggtgccatcatagctcactgcaacctcaaattcctgggctcaagtaatcctctgcctcagattcctaagtagctgggactatgactataggcatgcgctaccatggccagctaatttttaaaaaatttctgtagaggtggggtaccacaatgttgtccaggctagtctcgaactcctaggctcaagcagtctcacctcagcctcccaaagggctggaattacaggtgtgaaccaccccacctggctgaaatgtttgctttcaagatatacctttgagaagataggatgtaaagataaccatctgaaacactagacaactaaaagtacataagactcaaattttggtaataggattttatttaagcttatattggttgggaaaaaatgagcaaaaccatctacatgtttcactaccaagactactataataaaaacagatatttagtaaaaacactgttaagaagaaaaaaactgaagcagaataaagttttacaataaagattttaatttattgtagagggacatgtttaaaacccatccattagtaattagtcaaccatagctttcctgaaggtaggctttataaccattacaggcatataagacatgaaccaggggtaggagtccataagtaagatgggaatgtgatgctgccttctagtagatctatttttgatgacattttaaggtgattacccctctgctgttaaacataaggaggaagcaaatgatttaaaaattatataaaacaataagaaatagaatatgctaaagaactaaaaggtagtccccaatttataaattattcctgagctcaaaaggcaattttccccatttgttgatggggcactgttttgggtagtcataagccattctatagttaagcatttataaatcagtgattgctcgtcttgtgaaatgaatgagggctgcaattaccttggcatctaggaaaggaaaaacagaataaaaaggattgttcctgactcttcagaactatttaggtgagagaatacactctgatgaattgatacaaaatcaacctatcttaggattcaaagggctataataaagaaaggtcatttaaaaattgctgagtagtatatgttttaaaatatttgaccacctctacataagctcaccctggattctttgatagttgcacaaaaattcacaaggcctggtcagaaatagcctgccagacttaagtatactgttttcaattttgttgcactctatttaaaaaatatttttagaggattagtaaatttataaaattgtaaaaattatctaaagtaagaagagcattggtacctaaaacactaatataataattattagatatctaactttagtcataacatttaatgaaactcatgcctcctcctacaacctggaaaaggtaaggaaggtgctttttaccttgttgaagactattgtgaagacaattgacaaatgttgctaatatagttgctacattcatcacttgccagcactgggcaagaccaagagtaaaaagttcattccagtaagctttcaccagtgatatgctgttttcttgcctattaaaaacagtaataaaagcacaaatcagatattattaaaataagttttataaaccttacagctagtccaaatacttaaaaacagcatattactaaactaaaattattctagaaagatttgagcaagtctgtgttttgtatagctgataacaaaatgagaaatgaggaatgcttaggcatttaaatagtagctagctcatcaatcagccagtttataagaacaattgcaagtaatattcaaactaaaaaagttggggctttaacttcacatttcatagaaatggaataaagattgttcttaaaagcaaaagcatatattaaaaaaaaacttttgctttgaatataggtaaataccttttaaaagaaagagcaattcaaattattttattgttttgagacagagtcttgctctgttgcccaggctggagtgcaatggcgtgatctctgctcactgcaacctccacctcctgggttaaagctattctcctgcctcagcctcctcagtagctgggattacaggcatgcaccaccacatgtggctaatttttgtatttttagtagagacaaggttttgccgtcttgaccaggctggtcttgaactcctgacctcagctgatccgcctgccttggcctcccaaagtgttgggattacaggcgtgagccactgctcccagcctctagaattattttatagtaggcaagcaaccaattttaggagaaaaatggttcattgtatgtttcagaggagatattagtatccctataaataagatacccaggattttactatgaataacaagagattagaaaggtcaaaagttctctcctgaatttctaagtaactgatctcagcagcacaaggaggctgaggcaggagaatggtgtgaacctgggaggcagagcttgcagtgagcagaggtcgcaccactgcactccagcctgggtgacacagcgagactccgtctcaaaaaaaaaaaggaaaaaaaaaaagacccccatctctacaaaaaatgaaaacattagccgagcatagtggcatgtgcctgccgtcccagctacttaaacctatttatccatttgaaattaggcaaacttcccaggtctcaggttgtctaatgatacaaaatgcagagacactatacgtcctatatcttgctcagagttattaagaggtgaaaggtaagaattagctggggctgggcgcagtagctcacgtctgtaatcccagcacttcgggaggctgaggcagacgcatcacttgagcccaggagttgcaaaccagcctgggcaacatggcgaaactctatctctacaaaaaatacaaaaattagctgggtgtggaggtgcacacctatagtctcagctactcgcaggctgaggtgggaggatcacctaagcctggggaagttgaggcttcggtgagctgtgatcacaccactgcactccagcttgggtgacagagtgagaccctgtctcaaaaaaaagagagagaattaactgggtgctgtggcacatgcctatagtcccagctactcaggagggttgaggtgggaggactgcttgaggccaggagtttgaaggggtagcacaccatgattgcatctgtgaagagacactgcactccagcctctaacctggcacaggaagaccctgtctcaaaaaaaaaaaaaaaattgagaaagtatatgccaggtactggagaaatagcaattaagagattaagtttgccttcatgaaaaaaaggggaaataacaaatatataatttcaagtattttatataaatatacatatatgattatacataattttaggtaataaaaattctacattagtataaaggatgtatattagaaaatgggaaggttcagataaggtggttagagaaggcatttctgaggtggtgacatttgactggagaaagatggcagagaattaaaacaaacaaacacaaaaaccaaaaatcagatctaggggaatagtatcccagggagaacaagggcaaatgtgctaaggtgagaacaagcatattcaataaaacaatagatattcaataaaaattgttaagtgaattactaaatgctatcctattgtcttggaaggtcctttcgtagccttgttttcctggctaatacctactgatcccttaaaatatagctcagagttcactttctagaaggaacattattcctctctcaacatattcattcccccttcagtgtcacgcacacacgtatcctcactgaaggcagagactcccttgcgcatttctgtatctcagagaccaatgcagtacatggtacacagaaagaattctgcaaatgatttctgatcttagcgagtacagaacaggcagatgtgagaactttgatgaaaagagctgtgggcccttttacaattaatctttaaaccaaacctacagactttattataaataagatgatgcaactataagatttctttccttaaatctctggagagatataagttggtaagaacgtcctgataggaaatatgtccaacttaatgaatggtacttatatatttttcttcttaataaagctttaaaattaggataatcagtatgtttaacagaaatcattcgttaagaatcacagccttatgacattacattttattaaataatcgaacatacttgcaacaaatgctaatactgtcaactcagtcacagcaagtttttttttctgagaattattaatgtgaaattttaacttcaggctgatctcttttccattcagtatccaagaaggatcactggccacaagaaactgcctgtcatttgaaagtaaagtttaaatgcaaagaaaaccggtattttataatattcctatagaaaatgcttaaaaatatcaatcttaaacaaaatcaaaggagataaaaataaaggatactattttcattaaagatggataaaatccagaattgaggaagaggtgaggaaataagtattcattctcatacactgctgacgtgaacataaactggatcaacatcttttcagagaacagtttggtagtacccatcgaaagttgaaatgtgcactttcttagacccagcaatttcacctctaagaaactatgttatagaagtacagtcatgcatagcacaatgttttagtcaacaatgtaccacatatacaatggtggtcccttaagattgtaataccatatttttatggacacttctctatgtttagatacacaaacatttactattgtgttacaactgcctatggtattcagtacagtaacatgctatacaggtttgtcctaggtttgtagcctaggagcactaggctgtagcatatagccttgatgtgtagtaggtttgtgtaagtacactctatgatgttcacaatgacaaaactgcctaatgatgcatttctcagattacatagccatcattaaatgggcaacacatgcctatactaacatgaccatactaaaaaaagtgggcgaaaatacatacacaatgccacaaaatgcacattgtagcactggatataataacaaagaaaactggcaacaacccaaatgtctactaataaggaatgaataagtgcataaaatggaatactataatagaagccatgaggacaaatggggtaaatttacatgtactaacataggaagaagtctatgagtgtaaaaagcaaggcaaagaataggatgtgtaaatatgtgtatgtatttaattgtctaataagtatctcacagaaacattctagtaggacaccaaactgttaacagtggggttagttacctctggtgagtgaggttttactttataatcctatacttcaatattactttaaacattaaaaaaaattaaaagctaacatgaaggaagttagagtaaactcagtttcacttttaacctctgattctgaagttttaaggaggaaacagctaaccaaagtagtttgctagtaaacacaggaaaggaaaaataaatggaaaaaaatcagagctggcttgtgctatgcatcttgtagtaagaaagtaccttggcattgctggagaagctcagaaaaaaaggagtataagtgcaaaggataagaataccaaaattattactaaggaaaaaagacaccagtggcagatgagaaataacctaccagattattgtgtttccaaaagaaaagggaaaaggactgtagaaaccaactacagaaaggtatctatttacatttatctaaaccccaaaccaaaaaccctgatggtatagctagctatgtttttaaaagttcaattatgttaggaaagaaaaacagcaaggctactctaaaaagatggtctttaagagaatgacgaagaatgaccttttattatctactttgcagcaggcaatggcttagatgcatttacattcattatctcacctatgtgatgtagttcataatgaagtgtttctgctcccaatttacagacactgggcctcatttaagttacgtggtccaaagacacaaaagccagcagatgtataaaaacagaatttgaacctttatgctcctttaaacctcattacacaatttagcaagtgaaatgctaaagtcagtaaatttctcagtagagactcctccatttaaggttaatattttgggatggtaagggcatgtttgctaccagtttttcctgttaggaaaataaatgactattgtagtttatgttcaaaacatctttaagaagcaaaaagagctgagtagagactgtagttaaggttatcactaaggcatctaaaaagcaacacgaatgttgagattaaaaaaaaaaaaaaaaaaggccggatatgatggctcatgcctgtaatcccagtactttgggaggctcggctgggagaattgcttgaggcaaggagttcaagatcagcctggacaacagtgagacctccatctctagtttttaaaaaagcattaacttgtaaaattagtaaatatgttaatttcttttacaaataggtacaggtatttttctctaactactacactatattgtgggtttacttttttttttttttttgaaggagagtctcactctgtcacccaggctggagtacagtggcatgatctcagctcactacaacctccgtctcctggattcaagtgattctcctgcctcagcctcctgcgtagctgggattacaggcagctgccaccatgcctggctaacttttgaatttttagtagagacagggttttgccatgttgcccaggctggtcttgaactcctggcctcaagtgatccgcctgctttggcctcccaaagtgctgagattacaggcatgagccaccaggcctggcctatattgttaacattcattataggactcacaattagaggttatataattgtttatactatttattttcataaaggaatataacttttgagcccctcatatctggtaatactgaaggcaccagtcctcagggaaaagtatcagtgatagtcaaaatgaacctaaaaagttacaggtttcaaaactacaaagttacaggaaacattacattatgcttcagtggtaatttaaaagattcagctgtctggcttggcatttaatggaaggctattgattacattattcaataaataaagtctcctgtggtaaacggtggtggcttggagcttttggttatattttaagaatctaggtagagatgactgctgccatacttactccaggcaaatcatgacaagtattctccactaccccgcaatggaatctaccactattcatatagtcacttaacctaaattttgcagggagaacttaaaaccaacaactgaattactctaagtactgaaactacaaatcttaaaacagaaaatcaatacctttgtaaaatacagaagccttgtaaaatattagtagtattaactgtatactgacaatcaacacctttgtaaaatatagaagccttgtaaaatacaaaggtactaaccatgcactgtttagtaaaattatttaagttactgttcccttcaattaaagtgatcaaaacaatcttgatttcagaaaatgattaatgttgcttatctgtttctctctgtaaaattaggactttgtcaccaacttttatatttttagataaaaatgcaatcttggccgggcacggtggctcacgcctgtaatcccagcactttgggaggcccaggcaggcggatcacgaggtgaggagatcgagatcggcctggctaacacgatgaaaccctgtctctactaaaaatacaaaaaattagccgggtgtggttgcaggtgcctgtagtcccagctacttgggaggctgaggcaggagaatggcctgaacccgggaggcggagcttgcactgagcggagatcgtgccactgcactccagtctgggcgacagagcgagcctccatctcaaaaaaaaaaaaaaaaaaaaaggaacctaatgccagtttctacttttagaatagcttttatttccatataatagaatttttccatcatgagcactttgtccttatccgtatgattaagtaaacacataaataagatctatgaatcatctagatagggataaaaaataagagtttacataatggccttgactgctagatcaagttattctaattacaaagaatcttgtggttgttacattgaaactgattctcaatacagatcacaggaaaatgtggctaccactataaaaatgacttattttataaacagaaacctcctgaggccttatttttggtttctcaacatctgcgttatttccataggataattatactcaatttaatagaagtacttaagatcaatggtggtgtaaataattcaaggagttcaaaccactccccaaaattcctcccttttgttgttttattataataactgatagcctatcatgaaaaatatcaccacgttactttttagacatgtgaatgtgagttacaagatgagtgaactacacttaatattttaaaattagtcaattgctggctaggcacagaggctcacgcctataacaccagcactttgggaggctgaagtgagcagatcacttgaggccagcagtttgagaactgcctggccaacatggcgaaatcccatctctactaaaaatacaaaaattagctgggcttggtggtgcacacctgtagtcccagctactcaggaggctgaggcataagaattgcttgaaactgagaggtggagattgcagtgagccgagatcacgctactgcaatccagtataagtacttattttaaaaattttggtcgataatagactaattgttctccagattaccccacccctcagtagtgtgtacttggttttctgtatcctcactatatttgatactattgatcatttcagtaattacaaagtagaaaaaagactctaacccaactaactaaaaaaaaatcaattgccaatatgcaaatttacattttatttttttctacaaacacacacactggacgttgggcgaggtggtgcatgcctgtatgggaggcatccatataggaggattgcttgagcccaggagttccagatcagtctcaatgacagaggaagaactcatctcttaaacaaaaaaaaccccagaaaactagagaaatgctgaaaattgaatgttaaaaaaggactaacaatcattttaaaggttaaccatcctaaatcaggcttttagtctatgtaactataatatctgagcacatgatttaatgcatagtataatgctgattaataaaccaaattataatgttaaatatgcctttattcaattctctgtatgccttttacaatcatgttcacatatttctttgttatattcaaaatagtctttgaggataacaggtgggcaattattattcccatttggcaaatggaagaacaggtatacaggatgtgaaactgaattgtttacaaaatcatactggtgaatagggtcctaggagttgaataaaaactttctaactttgaataaaaactttctaactatgggcttaactttttccattgctttgcctttagacacaccagttattttaaaacaatttaaatacatttggcaaactttaggtaaagcttgagtttcttatagtaggccattttctatctcatctgatttcttcagaacagaatgtagatatactcttttttaagagacagggtctagctccgtcccaggccggagtgcagtaagcaatgtgatcatggcttatttcagcctcgaacttctgggctaaagtgattggccccccttagcctctagagtagctggaactactagtgtgcatcaccatgcccagctaattaaaacattttttttctttttgtagagacagggtttcactctgttgcccaggctggtcttaaactcctggcctcaagccatcctcctgccctgacctcccaaaatgctgggattacaggcgttagttaccatgcccaacctcagatgtactcttgagtggtaagactaaccctctaagtcattgtagtggtactatgaggttttacattttctttttttttttttgaaccacatgattggaaaacaattatctctacttttaacataaccactgtaggcaaaattcagctctttagtaacatgcctgggatgaacactgaaacagtagtgatgagagagaaacaagaacctagggcagtcttacagtctctctatctttgagccaatgaaagatgaggcctgttacaaatgctagccatagtcttatcaattctactgatcatattccatccaaattcttaacttagtcaaactacaaaatatggatactcttccacataaatacagagaaaatactagttagctgccatgatttgtcatttgaatgacacaacttaaagctataatgttatactgttttttcctttaatgcaaatcttcccaaaataaaaagttttgtttaatgtacatttgcactacaaaatcacatttatattcaagatttcaaaacactcaccctagagcctggaaagaaggaatcgaaagtgcccagtgcattgataagaacagcagtctggaggcagactccccaatgtagtgcacattcaggtactcaggcataggagaaggcatggtgagctagtatgaacagggatttaggtaaattatcttatgactgaaaagttctaaattatcatttctttgaaaaagtttaaacgtaacacatcaaatgagagctaatatattcacaaaaaaagctaatcttgaaataatccaagtcactagaatttacagctaacagggcttagaataaataagtagcccatagtttctaacaagccaatatttagacaagcagaacctcaacaaatatcaacgatgatattatctggttatgttacttcctgtcttggtctaacaatatgtttcttttccttccttctctccattaatgatagcatacaacaaattcagtttaaggagaaattctgtccgctaaatgtttctttcatttaggctaaggggttaacaaattcaaatgcttacaaagccaggagagtaaggagtgcaacaggcttgctggtaccaactgggaagagcatatttattcccagataaaggacacagctgtgaattgaattcagtgcagtgaaaacatatggaattgtgggctgagcactgccagctctttcagtttttcaaagagcacattctgtgtgaaacctccctatttaaaaaaactggcaggccgggtgtggtggctcgtgcctataatcccagcactttgggaggtggagacaggtggatcacgatgtcgagagatcgagaccatcccggtcaacatggttaaacctcatctttactaaaataccaaaaaaaaattgagccgtgtgtggtgagcagtcccagctacccgggaggctgaggcaggggaattgcttgaacctgggaagtggaggttgcagtgagccaagattgagccactgcactccagcctgggcaacagagtgagactccatctcaaaacaaaacaaaacaaaaaaacccaaactggcactaaataaaaaaaaaatgttttaaaaattacaggtatgcctgtggacatactactagtaagtggtcagtttatattgctgatctagttctttaaaatgtctgaccactgttgaaacttttttctactttgtaattactgaaatgaccaatagtatcaagtatagtgaggatacagaaaaccaagtacacactaccaagggtggggtagtctggagaagaattagtctaccatctaccaaaattttgaaagtaagtacatgcaataataccacttctaaatctctgttccagcaaaatacttgcatacatgcacaaaaaaagcatgtgtaaggatgtccattgcagctctacatctaacaatgaaattaaatgctggcaacaacccaaatttctatcactagagaaaagaataatccatgctatagaatatatgtgggcattaaaattggaaagataaactgagatgtaatggtatacaaaaaatctcacagacatccaagtggaaaaaactgtaaaacagtatgtattaaatagatgacccaatttatgttaaagagtacatatatatgtatacctaaaaagtacagaaggaaacacgccacacagttaacagtggctacctctgggtggggtaggtagatgtgtccatatgtatttttctggggaatgactattatagctttcatcagattctcaaaggtatcttttttttttttttttttttgagatggggtctcgctctgtcacccaggctggagtgcagtggcgtgatctcagctctctgcccaggttcaaatgaatgtccttcctcagcctccccagtagctgggactacaggcgtgtgccaccaggccccgctaattttttttgtatttttagtagagacggggttgtaccacgttggccaggctcgtctcaaactcctgacctcaggtgatccgcccgcctgggcctcctaaagtgctaggattacaggcatgagccaccgcacctggcctgtcaaaggtatctgctatctaaaataccgcacctggcccctcaaaggtatcttctatctaaaaggcttgaggtttgaaacaaagaaaagttacataaaaatgtaaaaaacaacccctgcctttgttcattattagccaagaatggtttacctatttataaattgtaccaagtaataaaacaaaagggcaattaatagttgaaattctgtaagtgagaagaaaattttttacatatttaagaatgtttgagaaaggtttactacagcagtaagttaaaatacaattatttaagacaattcttggctgagcgcagtggctcgtgcctgtaattccagcactttgggaggccaaggtgagaggactgcttgaagccagtagttcaagaccggcctgggcaacataacgagacccatttctacaaaaaaaaaaaaaaaaaaaccgacacacaaaacaaaaaattaaaaatttagccaggagtgatggctcacacctgtatcccagcaactcgggaggctgaggtggaagagctgcttgaacctaggaattttgagaccaacctgggaaacacagtaagacctcatctctaaaaataaaaaaattagctggacatggtggtgtgcacctataatcccagttacttagcagactgaggcagaaggatccctttagcccaggaggtagaggttgcagtgagccaggattgtgccactgaactccagcctgggtgacagagcaagaccacatcttaaaaaacaaaatatatcatatcttttcagaattacccaaggtgagtaaaaaggaagtctgaaaaactaagggaattaccaaaaattactagttttgggggaaggggcaagtaagatgcaaaacaacaacaaaaaagtcctttgtaaggctaggcgtggtggctcaggcctgtaatcccagcactctgggaggccagggcaggcagatcacttgaggtcaggagttcaagaccagcctgccaatgaggtaaaaccaggtctctactaaaaatacaaaaaattagccgggcatggcggtgtgtgcctgtaatcccagctactcgggaggctgaggtgccaagaacagctggaacccagcgggtagaggctgcagtgagccaagattgtgccactgtactccagcctgggagacagagcaagactctgtctcaaaaaaaaaaaaaatcctttgcaaaatagtttaaaattgcatttaaataaaatattaatacttgtaatgtgtaaacactggatataatggttttgctttacacaacagtggtggtaactctgaaaactttctgctggtttaatcataaaatggaaatagtttacaacacacactaaagggactcgttatttaaaatattactacaccatgttaacttataaagagagaaaatgtttcataatctgttctacatgctcaataaaactctagtattctgaatcagaaagctaatgttggctgaagaaacaatagtccatttcacaagtctttgagactgaaaagacaaagatttattcctatataaagagtgagcttccccaaaatgcctgtatatctttaggtttataaattgaattatacacatttttcaaattagaaaagttcaacatattgagtgaatttttaaagagcattgacaagaactaaacctgaccaatctgttttagaagttattagttgcttctacaattatctttctagcagtttctgtattgaaatcttataacagcctgcgtgatatagctttttttttttttgagatgcagtcttgctctgtcgcccaggctgcagtgcagtggtgccatcttggctcactgcaacctccgcctcccgggttcaagcaattctcctgcctgagcctcctgagtagctgggattacaggtgcccgccaccacacccggctaatttttttttttttttgtatttttagtagagacggggtttcaccacgttggtcagtctggtcttgaactcctgacctcgtgatccacccacctcagcctcccaaagtgctgagattacaggtgcgagccaccctgcccagccgatatagcttttaaaaaatcactggatggccgggtgtgatggctcacgcttataatcccagcactttgggggggccgaggtgggcggatcattggagctcatgagttagcatgggcaacatgatgaaacctcgtctgtatttaaaaaaatacaaaaatcagctgggagtggtggtgcatgcctgtagtcccagctactcaggaggctgaggtgggaggatggcttgagtctgggaggcagaggttgcagtgagtcgcgatcatgccactgcactccagcctgggctatagagccagtctgtctcaaaaaaacaaaaacaaaaacaaaatccttggaggctgagcacaagcacagtggctcaggcctataatctcagcacttttgggaggtcgaggtgggaagatcattgcttgtggccaggagtttgagaccagcctgggcaacatagtgaaacctcatctccacacaaatagaaaaaaatcatttgagttaggagatctggattctgcttccaactttttgttaatcacttcgcctaattaccagtatgaccctagattacatattcattcagtaactatttacttagagttcactgggaaccagtaagtgctattgtctcagtggaagaataaaataaaaactgaatgagctatagaaaagggctaagaaagctaatggcatgtgtgagaaaccatgagcagctgggtcagaatgtggagggccctaaaaggtcaagttatagagaccggacttaatttcataacatatgggcaatgggaagctactgaaggctgggcagagtgacataatttgatttttaacaaatataacgctggtaccagcacacaggacaagatggaaaagaaagactggaagcgaagatattagggtaacaaatcaagaaaggaattttaaaaggcctaaaatatggtgaaggaaatgaagaggaagggagaaattcaagcaatggaatggttaaaattcagttatggaatgagaagagtgaggcttagggagagtaactgcctctaaagttgcaaacatgggcgaccagaaagactgactctaatgtgaaaataataaaattttagaaataagtatatgcaatttccaaaaccacctcacttctgttgcatgtatataatttctaaaatgggaatatgatctaccatattcttaaaatcttctaaggagattttaagaatcaagtaaaataaagtacatgaaatcataccaaaaattatgaagtttaataaaaatctttttctttttttttgaaagatggagtatcgctctgtcacttaggctggaaggcagtgatgcaatcttggctcacggcaacctccgcctccccgggttcaagcaattcttctgcctcagcctcctgagtagctggggttataggcatgcaccactacgcctggctaatttttgtatttttagtaaacacgggatttcgtcatgttggccaggctggtctcgaactcctgacctcaggtgatctgcctgcgtaggcctcccaaagtgctaggattacaggtgtgagccaccacacccggccaataaaaatcttaaatattactactgcccttgatttttcaaaatcaaacttcaagtttcattattagactatttctccctactaccaagattgctttgaacaagacactaaacatctctacatctctttcttcatccaccaaatgagaataaaaattctaaccctaccaggtatggtgggttacacttgtaatcccagcacttcgggaggccgaagtgagaggatcacttgaggccaggagtataagataagcctggacaacaaagtgagatcccatctctacacaaaaattttttaaattagctgggtgtggtggcacatgcctgtggtctcagcaacatgaaagactgaagcaggagaatcccttgagcccaggaggtcgaggctgcagtgagctgtgattatgccactgcgctccagcctgggtgagagtgagaccctatctcacaaagaaaaaaaaaattaaaaattctaacctcagcttatgtggtgaggcccaaaggaaacagtgtatgtgaaaatatgctgcaaactacagtgtacatagaaatgcaacagaggaacaaaatgctattcagctcagcaagtaagaaaggactgagttgtttgattacagatgtaaggtcttgaaacccatgatcagaaaacttcaatgtgagaaccatgaaattaccagactctaggagctaagcagggaaatcactgaaaagtcaaacatttgacttcacaaggctgtaagactccgagaaagatgaagtggtccttttcaggagagtaagaaactttatagtgctgactgtgaggatacttaggaagacaaagatgggaatgacaaaagccaatcctaagaagaaaaaaaagttgtaatttgccaaattcttctgtccaaaacatttcaagcaatcaaaaactttgaggaccaacattaacaataaacaggtaaactacccctactttctaaagagcactctggtccttttccctcacaatgggtcctgttcctacatctgtctcatttcatccttcctcccatttaaatccaaagcagaacataaacctaagaaaacaaaagagtatcttttatttagaatacgaaagaacaatgggaaaaatcaagttttgccttgctccacccttgtccataaatcttaccataattttttagaatgatactgattattccaattactttttcttatagcactcataaaaaattttcctgtagagtgtagaaaaaaaatttctaattttttccatgtaaattatctttggtaaaattttacataaaaattggcttcactgatatattttattgactacatcaaattacactattttaagccactgagttttctctgtggctatttctaccaagtcaaattttatagatacaaatattactttgcactcataacttctactggtatacatatttatttgatagctgtacatattctcctaaaaaaatccatggaattttataatctatagtaaaagtatgagcagtcaccctcaggtattccaagactgctatatattgctaagtgaaatctatatgcattcaatccctttgcatacatcttgctaagagtatccacagctgagtggttaaaatggaagagtcaaaacaacaggatcgtaatgtaaggtctccacagtgagcatggctataactctgtccaagcattatttgaatgacaaatagtagaaagtgattttctagtcttctacatgtattatttctagtattctgcatgtattgtttctgtcataaataaattaggttggtgaaaaagtaattgcagccttaaaagtaatggcaaaacccacaattatttatgggaacaaaataaattataaatgtaccttctccaaaatggctaaaaagtgtaagttaaaaactaaaagttaaaatatattaaataatttgtatctttttaaattttattatgtaattttaatttataatagagatgaggtctcggcatgttgcccaggctggtctccaactcctggactcatgcaatcctctggcctcagcctcccaaagtactgcgatgacaggtgggagcagctgcacctggccaatttgtatcttataataatgctggaagccagctaattaagatgatacataacaaatggagctctttgtagttactatggtaagagcaaactatctgggtcttattgattacgatatagtagtagctaggcattgaacaaaagcagtccattcaacacatcatgaatgccaatacttaaagtttaacaaaatgtgctgaaaagttataaaagctaacttttaaacgcaataactgctattataactgacttaacaggatgctttattacgccattatcttatctacataaggctttagcctcctgcatagatgcacactaacatgcccagcttattcagtatcttgataaacagaagagaaaagcctaaagacattttgtttctatatgcagatgagtttttttttttttttttttgagacagagttttgctcttgttgcccaggctggagtgcaatggcgtgatctcggttcaccataacctccgcctcccgagttcaatcgattgtcctgcctcagcctcccgagtagctgggattacaggcatgcaccatcacacctggctgattttgtatttttagtagagacagggtttctccatgttggtcaggctggtctcgaactcctgacctcaggtgatctgcccaccttggcctcccaaaatgccaggattacaggcataagccactgtgcctggcccagatgagtgttttagctgctgttctgaaattctatcagggatatttctgactttaaaagcacaacaaacatactttgatttttgaaaggtagatcaaaatcaagcaacacaacatacaagttaaaaaaaacatatagaaataccctgaaagctacatgtgaatcgctgagaagtggcccctctttttcggtgtaatttatgcttgaatctccagtgattaggtgtacacttccttccatgcccgctactgagctctggcaggctgtgctctctccaggattcaatgcttttgcaagagtgtcaaatgccctgtatgaagacatcagaagctatgagcttgaccaaacaccgcaataaaataacaattctacataggattctggaattaagatttaagcctaaaaaactggccaggctggtctagaactcaagtgatatgcccgcctcagccttccaaagtgctgggattacaggtataagccacatgcctggcctaaagtctctttttaaaatcttgcataattaagggggagaagcatcttcatattttcatataataatatgtttttaaaagttatatattttatcgcttgagtccaggagggcagggctgcagtgagctatgatcacaccactgtactccagcctgggtgacacagcaagaccctgtctcaattaaacgaaattcttttcaattaattattttttaagaacattatatgtatgatatatatatatatgatactacaagactatcagcctatttattttgtatacaaaagttacttagaacaagggtaagaacttatgtcaactttattatacacagtacaataggtcttaaattttatttaaaaattcagaaaacattttactcatgtttatttttgaaacacattctccctgtgtcagcaaggctggagtgcagtggcatgatcatggctcactgtaatcctgaactcctgggttcaagcaagcgatcctcccacctcaacctcccgagcagctgggactacatgtgcgcaccaccatgctcagctaatttttaaattatctgtagaaactgggcctcactatgttgctaaggctggtctcccaactcctggactcaagcaatcctgccaccttggcctcccaaagtgctgagattacaggcatgagctactgcacccgggcagagagtattttaaaatgtgtggtcacatagctaaatctaaactgtaacaatttgatattagaataataacaaactaatgttagcaaataattactcaaaatagttccccatatttttcaataagcctcctagagtttcttaaaatctcatgttcaacaaagtattacttattgtgactcttaaatgtagtttattcagtatatatattatgttttgttgttgtttgagacagactctcgttttgtcgcccaggctagagtacagtggcgtgacctcggctcactgcaacctccatctctggggttcaagcggttctcctgcctcagcctaccaagtagctgggattacaggcatgcgccaccacacccagctaattttttcatttttagtagagatggggtttcaccatgttggccaggctggtctcaaactcctgacctcaggtgatccacccctctcggcctcctaaagtggtaggattacaggcatacgccaccgtgcccggccaattcagcgtatttttatcatatctttttttttcctttagagatggggtctagttgccggttgactcaaaatcccaggctgaagtgatcttcccgcctcagcctcctatacactaatgtgttcagcttattcaatattttaaatgataaacgcagtgtaggaaaaccctgaataaactgtttctatatcctaagcattaatatttacagaataaaaaacagaattctgatactactttcttcaactgtaacttaaaactgtagttgattaaactaaaccttttacattaattttcatcactagaaattgaggagcaggatcaatatgattgcctagaaagacaagtgtttcgctctccatacacatcttcatctttagaagaaaaaattcctaggttttaagaccacatttctaatcttctaatattcacttactgattttgtcatttagaatataacctttcataatgaatgcaggttttcagtgaaaacttactatgccttaaattttctaagtgaaaatagaaatgtaggttaagcattcctaatactaaaatccaaaatgctctaaaatcagaaactttttgagcaccaacatgatgccacaagtggaaatttcacacctgacctctcatgatgggttgcagtcaaaaagcaggtgtattacagtttattcagtgtttattccctgtccccaagggaaaaaagatcctcccagctgagataaatcttttctgtatacgcccagactcccccaagtaagcacgcccactaaggatgataaaatggcacatgtacaggccagacatgccaatggcaagttcccccgattccccatgaggagccaagacctatgtgtattactcactgtggatttttgcatattctcttctttgtggtgtaaagatatttttgaaaaggtcagaaaggcctgcatggtacccagagtaatgcaaacattccaaaatctgaaatctgaagtgtttctggtctgaacaaagcatttcggataagagataatcaacctgtatttagataatcaacctgtatttgttttctgaaacttttataaatagcatttaacataaaaatgttttaagaaatactgaaagacatgtaaacaaaaggacattgataatcaaaagataccttaccttgaaacatcaccgttggtctgcatttcttgaaattcacacaaagaggtatcatcattgcttaagctttcaatcatagacatttcattactattttgagaaagatctttagtttttccaagattcgctaatgatgtaaccacattggccaatgtacttaaatctccctgacatgattcagcctttaaaaaaaagggtattaaaattctgtgaattggtatcactatttttttcaatctgaaatatccaattatagattatgatatgccaacaaaagaacagtatgataaatgaaacctggaaagttaaagggctgagctttcagaaatttactgaggaaaatacaagtttaaaaacatcaagtgtatttcttaagaaatgtttatatgttactttgttttttttttttttgggagatggagtctcactctgtcactaggctggagtgccgtggcatgatctcagctcaccgcaacctctgcctgccaggttcaagcgattcccctgcctcagcctcccaagtagctgggattacaggcacatgctaccatgcccaactaattttttgtattttagctgagacagggtttcaccatgttggctaagatggtcttgatctcctgacctcatgatctgcctgcctcggcctcccaaagtgttgggattacaggcgtgggccatcgcgcccggccgtatatgttacttttttttaagagacaaggtctccctttgtcacccagactggagtacagtggcacgaccacagatcactgcatccttaaatttctgggctcactgatcctcctacctcagcctcctgagcagctgatcctacaggtgtgcactgctatgcctgggttgttttttcatttttagaaatggggtcttgctgtgttgcccaggctggtcttgaactcctggtatcaagtgatcctccctgcctcagcctcctgagtacaatttctaaaacttactatacaaactataaacttgtatggaatatgaagaatactagtgaagagcgggggaaaaaatggcaaatgaattgttgaacagacttcctaggatgccaacttttgccaaacattgtgttaattaaatgtgttaaaaggcactgtgttaaacacaaacattaaaagaaatagatcagttacccattattctcttcacttttttgtcactggagttgaaaactctctttatataggtaagatactgatctatttgtctttttttttttgagacagagtctcactctgtcacccaggctggagtgcagtggtgtgatctcagctcactgcaacctccaactcctgggttcaagtgatcttcccacctcagcctcctgactacgggcgcataccaccatgtccagctaattttttaattttttgtagagatggggtttcatcatgttgcccaggctggtctcaaactcctgggctcaagtgatctacctgccacagtttcccaaagtgctgggattacagacatgagccaccgtgcccggcttgtcttcatttttttaatgtttgttgaaaatgtgtatattacttgtgcattagctacaattcttttataaaaaagaattttctctcaactcttttgacaactcagaaatataatttgtacgggaaaggcaggtaagtgctttatttttcttttactttgttatcaattttcagagcaagaagctgatatcctagcaatttctaattatgatacatgagtttttctgagtataatttttaattcatagattttcatatatttgatttaaatttattaaattcttttgtaaatcctttcccatcctaacctaatgagaagccttttaagttgccttctatggcctactgggccaaccccttaatggtatcttcttattaatactttcttcatggttttttctttttggtgtttttttttttttttttttttgagacagagtcttactctgtcgccaggctggagtgcagtggtgcgatctcggctcgctgcaagctccacctcctgggttcacgccattctcctgcctcagcctcctgaggagctgggactacaggcgcccgccaccatgcccagctaattttttgtatttttggtagagacagggtttcactgtgttagccaggacagtctcgatctcctgacctcgtgatctgcccgccttggcctcccaaagtgctgggattacaggcgtgagccactgtgcctggccctttttggtgttcttaatactaaaataacacatatgttcccatgatgtttcatttattataacaatcagtttctgtgagattttggtgaatcagtagaataaaataatttttgtgccttctccaaattaatcaatggtccaaaaatcatttactgaaaaccctaccagttatcatgttcttacataattaatacctatatatgcattttatttaactcccataacaactctgaaatagaaatcatcattcctctattgctaaccagaaaaatgacccaaatagtagaggtgggactggctgactgccaaagtctatgcttttttttttttttaagagacagtgttttttagagacactcctatcgcctagactggagtgcagtgccaggatcatagctcactgcagctttgaactcctaggctcaagtaatcctctgcctcagcctcccaaacagctgggactacaggcatgtaccaccatgcctgggtaatttttttatttttagagacagagtctcgctatgtttcccaggttggtctcaaattcctagcctcaaggaactcttcaacttcagcctcctgagctgctgggatacaggcttgagccactgtgcccagaaaagcccataatgttaagcactgccccaagaaattttcttatatttgaataaaaagtacattagttacaattttaaatgctttaatattcacctaaaacttagaagcttatatagtctcttctacctagcaacatatctaactagattcttttttattttattttatttttttattgatcattcttaggtgtttctcgcagagggggatttggcagggtcataggacaatagtggagggacggtcagcagataaacaagtgaacaaaggtctctagttttcctaggcagaggaccctgcagcgttccacagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagaatttttctttctaactagattcttaagtttttgcccctaaaggctcttagccaacatagaaaactttcatcttgtgacttcagagttttggggcaatttatcagagaagcttaccatacggttgtcataacaatttaatacaaagatatacaagagagcacagtgtctgggcagagtagtttgtcaaggaaacctagttcccttcctttcttaaaggagttaatatgtcagtaaaaccaattatcattctaaccttgaatcatgcagacagggctaagtgaagttttccaaaatatatggcaagaggccactgcctcacctagcaattacatgctaaagcccaaactgtaagatacttttattactcttattttacagatgagaaagtaaggcactaagaggtcaaataacttgcctaatgttatatagctagtaagtggtagatgaaatttgatttccgagcctaagtatttagagcgccttaaagcatcaagtgacaaatatataacaaatcttgcataaacaggacaaataatcttataggttatataaaatcagatcccggccgggcgcagtggctcacgcctgtaatcccagcactctgggaggctgaggcaggcggatcatgaggtcaggcgattgagaccatcctggctaacatggtgaaaccctgtctctactaaaaatacaaaaaattagccgggcgtggtggcgggcgcctgtaatcccagctacttgggaggctgaggcaggagaatggcgtgaacccaggaggcggaggctgcagtgagccgagatcgggacactgcactccagacggggtaacagagcaagactccgtctcaaaaaaaaaaaaaaaaaaaaaaatcagatcccagctaggtagggaggctcatgcacataaccccagcaatctggaaggctgaggtgggagggtcacttgagcccaggagttcgagaccagctgggtaacacaatgaaactcggtctctacaaaaataggaaaaattagccaggcacagtgtcacgtgcctgcagccctagcttcttgggaggctgaggtgagaggatccctggagcctgagaggacgaggctgcagcaagccattactgtgccaccaccgtacccccagcttgggtgacaagaggggaccctgtttaaaaaacaaacatggttgagagaaaccctgatcataggcttcctaaaatctgttttcagatatgagttttcaggagaaatttttgcttcttgttctcccaaagggcttctgacaagtacagaaactcttcatgttcaatttaaataaacaaactgtttttcctttagacccttggtctaacatagagctgctccaatctctaagagaactggatgacttggatacataaaaggagagctcttgcagtcctattcctactcttgactcaagtaaatattttgatggaggtgagctaagaatttccttttacctgaaatattttaagtattttggcactaaaaaataaaaaaagtattttggcactaacaaatctgtaagggagcataaaagaaatattaagaattgtacggctgggcgtgctggctcacgcctgtaatcccagcactttgggaggccaaggcgggtggatcacgaggtcaggcgatcgagaccatcctggctaacaaggtgaaaccccgtctctactaaaaatacaaaaaaattagctgggtgtggtggcaggtgcctgtagtcccagctattcaggaggctgaggcaggagaatggcgggaacccgggaagcggagcttgcagtgagccgagactgtgccactgcactctagcctcggcaacagagtgagactccatctcaaaaaaaaaaaaaaaaagacttttacacctataataaatgtcttactgaggactcgtatttcaagatgagggaagagtacgtgtttgttgctttcatgttgaagggataatcatcctagtgaaattatgaacatttctgatttttttttttttttttttttttgagacagagtttcgctcttgttgcccaggcgggagtgcaatggcactatctcggctcactgcaacctccacctaccgggttcaagcgattctcctgcctcagcctcccgagtagctgggattacaggcatgcgccaccacgcccagttaatttttccatttttactggagacggggtttctccatgttggtcaggctggtcttgaacttctgacctcaagcgatccatgtgcctcggcctcccaaagtgctgggattacagatgtgagccactgtgcccagccgaacatttctaatttatattaaaaaaaaaaaggcaacttgtaatatggaatatttaagaacaaagcaatttaccaaagcaaaggaagtgattagaaaacattttaaaatgcttaaaattatctaagctttaaattgtactaaacacaccttatctgatgtcatcagcacagctgactcagtttttactccagatggatgaatattcatgaacattcctgaatctaacagtcctgttgacctgtaacaaatcagcacaaattttggcctgagtttcattgggaagaaaaacaaaatgaccagctactcagtgtctgttttactttaccttgtactttcactatctgttacaaaagttggagttgcagttaatgggctacgaaggtcctttcggatatagattttttctgttgaagcggcacagttggaagatttttctcgtgatacttcaatgggttttctttcacattggacagctacaaaaatgtgttaaactattatatcacaatataggatttacagacaattagaaatgtaagctgtaggtaagcttaatgctgctaataggagacatggctaccatactaaactccaaagataaccatcaatctttagaaattatgtgcaagttcaacaaagttgctttagattagtaaaacaaaccaatttgcatctctcattctttttgccaaacacaaactacaaatacgtgctttttacacaggtattcaataaatattagttgaataaataaaaaagtacatacgtaggtctgtattcttatatttttagttggaaaactgtaaactaaaaagtatacatatttgacatattttgttaatttcaatactcttgtagtttgctggaatctttaaaaagtattttctccttaaaagctaatacatacagtcttgcttcattccaaacgcaatacatctctgtaacctgcagtattgacagcggtttcggtggtgcttattaataatacaatcctttgatcctcgacatgaatatactaaattttttcggatgcttcttttaaaaaatcctttgcagccttcacaagttactgctccataatgacgtcctagagagaaaatgtttaagaaaatataaaagtcacattatttcagaacagaaatgacataagccaatttcttccctttaaacaacatataagatgaaactgatttttgagcttctgacatgaaaaacatttttagaagttatttttatttatcataacttttttagagacgggatctcgctctgtggcccaggctgaagtgtaatggtgcgatcacagttcactgcagtctcgaactactggactcaagggatatccccaactagctgggactacaggcttgcgccaccacacccgaccagttttattattatttttttttgtagaggcagtcttgccattttgcccaggctggtcttgaactcctggcctcaagcgatcctcctgcctccactcccaaagtgctgggattacaggcatgagccatctcacctggcctaatgtaatatattattaaagatcagaagtcattatttttaaatgattcctttgccaaaatttctagttttcacattaaaaaatgtttctacagctgggcgtggtaactcacgcctgtaatcctagcactttgggaggccaaggcaggtggatcacttgaggtcaggagttcaagaccagcatggccaacatggcaaaagcccgtctctactgaaaatacaaaaattagcagggcatggtggcacacgcctgtagtcccagctactcagaaggccgaggcaggagaattgcttgaacccaggaggcagaggttgcagtgagccgagattgcaccactgcactacagtcagggtgacagcgcaagactccatctcaaaaaaaaaaaaaattttttttttacatgttcactttcaaaagtgaaatatgcattttatttcattacaaatcatattaaattgcactgaagttaaaaaatataagtgaataaagaactttgggaccgggcatgggggcttacacctgtaatcccagcactttgggaggccaaggaggggagggtggatcacctgaggtcacgagtttgagaccagcctggccaacatggtgaaactccatttccaataaaaatacaaaaattagccatgcgtgctggcatgcaccttagccccagctccttgggaggccgaggcaggagaatttcttgaatccaggaggtagaggctgcagtgagctgagatcacgccactgcattccagccggagcaacagtgagactctatatcacaaacaaagaactctgggaaaaaattagttaaatgttataggctacaaatatgaaccataaaaacgacatactcctttatttctcttcttacttttagtagaagaaacatggtagtgtggtagttatttcaacaacacgacacatataggaggttattttttttttctgtttttaggaggttattcttaatgttacctgatgctttgtctccacatactacgcaaagatcaaaaaccttatttggtccttggtctggagaattatctgttaggagctaaaaaaaaaaaaaaaaaaaaagaaaacaaaaacgaaaacctgttgttactcaacagcactcattctattaaaaaaattaaagaacattcagttggtcttgctttgttgctttctttttcacaagttatttttaaactttgtactctatgaagagctcagaacctttccacatgtaatgacgacaaaaataagcttataatggcataaagagataactctaaaccttttaaatagaaaaggggctataaataaatttccttgaggtaattataatcatgcagatgtgctcgctatacaaaggtatggacttaaaaagctcatcactaggcacagctaataagatactggcaaaggaaactagtttcttctttaaaaaacaaaaaaaggctgggtgcggtggctcacgcctgtaatcccagcactttgggaggctgaggcgggcagatcacctgaggtcagaagttcaagaccagcctggcctacgtggtgaaaccctgtctgtactaaaaatacaaaaaattagctgggtgtggtggagagtgcctgtaatcccagctacttgggaggctgaggcaggagaatcgcttgaacccaggcggcagaggttgcagtgagccgagactgcaccactgcactttggcctgggagacagaacgagactccatctcaaaaacaaaacaaaacaaaacaaaaaacagcaaactagtttcttcctttaggtttatctttcaaccttttcatcattttctttcaatcttgaaatgtgaacaaataaattcaattaaagaaaatggaatggcatttgaattcctccaggaatacttctgattttatgaactttaaatggttcttaaaatgactgccccttactatgtaatatatagcatcatttcttcttatatcaccacaaaaatcagtcttcagtaagtacttaagcttctggtactagatgtcctatgaaagcatctatggcaagtattactctttaatagcctacctgttgcaaatggtgctaatcttttatctattattcctaagtctggaaggagatattgagagattaagggatttacccacattcatgagaaaaacatcagaccaagtccaatagtggcacatcctacaatatacctggccagtactcctcacgtaattgtcaaggtcatcaaaaacaaggaaagtctgagaaactgtcctagccaagagaagcctcaggagacatgtcaactcaatgcaataaggtatcctggatgggatcctgggacaaacaaagccattaggcaaaaactaaggaaagtctaaacacctataaacttcagttaacaatgtatcagtattgctcattaattatatcatgaatgtaaaatgttaataataggggaactgtgtgtatttacgggggagtaatatgggaactctgttctatatgctcagtttttctgcaaatctaaaactattctaaaatatcaagtctactacttaaagaaaaattaaggtacatataatgttatacatttttttgtgacttttgtcttgttgataaaacaacttcttataaatctgtgactgtatccactttctacctttatttccaaaactaatacaaatatcattggatgaatagatgatatcaggatatacagacaaaatttcgtgttttatgaattcagagtttttcaatccaaagaggaattttctttcgtgagtttttcatcataaaagatagaacccaattttaagtagacccccttcaaaaagtttctgaaggcaaacttcagagtacattatatttgtattcaatcatagcaaccagcagtgaaaacatcgacataaccacaggcatgtggtgtataaaagtttttgagtctttgaagaataatgtgtaattttctattctagcgaaaactaaaatgatgtaatgttaacatatactacttcattccagagtaaagcaggagcccatgactgcactgcttgctatttcatgaagatgtgcatgacaacaaaggaggcacaatgttgaagccagcagctatagtccaaacttcttgatttggcagcttcctgtttgtagcacaggcagcttggttctggaaaatacagctacaaaagctgctcctgatttgacaatttcctaattatgaagtaggaggtctcttagaagccagttttgcagcatgctccaatagtcgatcttgaaaacctggcctagaactgtttcttcaaccttcctaacaattctgcaagctctctgtatcctttattaaaggctgttgtcctggctacaatagccagagtggatcttactgtatgcaacaaagaatccccaaaatatatgagtgtgaggaaagtacagtggcccataggagagggctgtcactgtagatactgtgttacacataattttatgcatttttttcctactgaatatacatagatctaaagtcttcatggcagggcttatgattaaaattttttttttatatatgtaagaggaaaagacacttctatagttatttacctgcaggtgttgtgcagacagatcaggagtggtaaaaaataactggttgacacctgctgcatctggagttgtaaggaaaacttttcccggagtggaatcttgcctggccagaatgactttgcttggagtagagccgtcgtgatttgtcagaatgaactgcttgccttgggtattatgatcaagtgctgtcacaatctggattttctgcccagtttgctgctctgtaacaatctaacaaaatcatgaaaaataatcaatgaaactcaataatttttctttaatgacacaattatcttcttagaaaagcacattacatatatattcaatataacacacacgtaccttttaaactaccgattctattgccacaaaattctatcctacagaaataaacaaatgtgcaaacaaaggtacaatagtaagaacattttgacctcactattttgattccctccttccccttccctcccatgttccatttagacaaacatatattgggtgatttatattagctgttctgcatactgggatgtagcagtgaataaaacaaaacttttgccttcatgaagcttttattttagtggggaaagacagataataaataagcaaataataatattgtcatgcggtactaaatgctatgaagaaaaacaaggcaaggtgagacagtaacagaatgagggcaatgagggaagctcacgctaaggaggtgtcatttttgcaaaggcctgagtgaagaaacagaccaaggcttaggactacctaggggaagaacattccaggtagaggaaacagagcatataagtaggtcccagggcaggagggaggtgtttgacacatgtgaggcacaaggcacagcaatagagatatatgatgagtaagacagaagggaagacagggattacagtagaatatgggatctgagtgacagctgggactcagagggctttgtaggccaaacaaaagtctagatttcctaatgtgtgaaatggagagccaccaaagggtttggagcagaggagtgacaggattttattttttaaaaaggaatcagacaggcacagtgacattatctataatcccagctacttgggaggctgaggcaggagaatcacttgaggccaggagttcgagaccagactgggcaacacagtgagaccctgtctcaaaaaaaaaaaagaagtataaaaaaagcattctaaatttagtgtgaagaacagactgcaaatgttcaagagtaggccgggtgcagtggctcacgcccataatcccagcactttgggaggctgaggcaggtggatcccttgaggtcaggagttcaagcccagcctggccaaaatgacgaaaccctgtctctactaaaatataaaaattagctgggcatggtggcgggtgcctgtaatcccagcaactggggaggctgagacaggagaatcgcttgaaccctggaggcggaggttgcagtgagctgggattacaccactacactccagcctgggcgacagaggactctgcctcaaaaaaaaaaaaaaaaaaaaggggatggacacagtggctcatgcctataaccccagcactttgggaggccgaggcgggcaactcatgaggtcaggagattgagaccaacctagctaacacagtgaaatcccgtctctactaaaaatacaaaaaattagctgggcatggtggcatgtgcctgtaatccgagctatgtgggaggctgaggcaggagaatcacttgaaccagggaggcggaggttgcagtgagctgagatcgcgccaatgcactccagcctgggtgacacagtgagagtctgtctcaaaaaaaaaaaaaaaaaaaagttcagaagtaaaattaagggagatcagaaaggacactactgcaggtaccatcaatatctggttatgacatatgggcagaaatactgaccaggaacagggtagcagccatgctgggggtgaaaaacaattaaattgggatttacttacttatttatatattatttatttattttaagaagagagaagtaacaaaataatgctgatagactgaaggggaatatgaagaaagaagagtcaaggatgattataaaattttggcttgagcaattgggaggacagaactgccatctgccatctgggggggaggaacaagttcatgaatacacagaactatttcagcattgagagtttctgttattcagcaaatatatcccagattaaacatcattaagccaattaaattccttgattcaattttaaaatggcaaagtccgtttgtttctaattttccaaaattccaatcctgttccttctgtaccaaattttttctatttttattttcctgaaattatttcaagattcttttctatgcaaaatttaaaacaaagttctgattcactaatcagtttatgtctaaagcaaattgtttggataaaagactaatagttcatactgacttcttagagaagagcatttggcgcattcatggtccaactgctcctgggttgaaacattctgcttaaatgagtaaaaggacattactgcagcataataattgtaataattgaatatttgggcaatccaaagagccttcaatagagaagagtagtaaattatgtaaacagttcttagcttttaggactctttatattctaaaatattactgagggttccaaagagctttttttttgagatggagttttactcttgttgcccaggctggagtgcagtggtgcgatctcggctcactgcaacctctgcctcccaggttcaagcgattctcctgcctcagcctcctgagtagctgggattacaggcgcccgccaccccacctgtctaattttttgtattttagtagagatggggttttctgcatgtgagttagaaattcaaagagaaattttaaaaatagttgattcatttaaaaattaacaacccattaaatgttaacataatttttttaaatttatttttaattttcgtgggtacataggtgtgtattatctttggggtacgtgagatgttttgatacaggcaggcaatacataataatcacatggaaaacagggcatccatcccctcaagcatttatcctgtatgctataaacaatccaattatactcttttagttattttaaaatgcataattaaattattattgactgggcgcaggggctcacacctgtaatcccagcactttgggaggctgaggtgggcggatcatgaggtcaggagtttgagaccagcctgagcaacaagctgaaaccccatctctattaaaaatacaaaatttagctgggcgtggtggcaggcacctgtaatcccagctactcaggaggctgaggcaggagaatccattgaaccagggaggcggaggttgcagtgagccaagacagcgccactacactccagcctggacaacagagcgagactttgtctcaaaaaaaaaaaaaaaaattattgactatagtccctctgttgtgctatcaaatactaggtctaattcattcatcctatttttttgtacccattataacctatttcttaatgactaaaaagtttattttccaaacaaacaaaaatgtagtgcagagagtggctttgttttacatttctacaaattgctttaatatctagtttaacagaagttggaatctcatatctgtttctttatttaatctgttagactatgttgttttggttataacaaggctgggcacagcacctcacgcctgtaatcccagcgctttggaaggccaaggccagtgaactgcttgagcccaggagctccagaccagcctgggcaacatgacaaaaccctgttgctacaaaatatataaaacatcagccaggcacgtgagcacaaaaaatggccacaaaaaatcagccggaaacctatttcttcaccatatatatacatatacatacatacatatatgtatatatgttaaagaaaattcagcttcgtatttattggttgaaaaggggaaggatattttaatacccttttcaaactgtgaaagttgttcgacactacatcaactcaacaagtggcagcttttcaaaggttagcagcaatgtagagtcataaactatattaaaatctgttggtctatcctgcaatttaaatggatccttcactcatgcataattttgtaacattatacactggtcatccggaaagcaatgattcattgagttatgtacaccttataaatgctgacacatttcatcatatagtatcatcacatgtcacacagtctgtagaaaattccattgtatacctgggagagaacaatactgaaaaggcaaataacatttcagtattattataaaaatggtcttcacctggttgattctctgaagtgtccccagataatactttgagaacttccaaattatgtggtatctcttactaagtaataggacacaaccatttaaaaaaatgaagatgtcagtattgatgctgaactcctactgatcccaccaaaactaggctcagattgtaccctctaaaaagaattccctcaaaagcattcctactcactctacagctctttaatttctttccttccttccttcccttcattcctttcaattttcttctgtgctcccattgcacctgatacaatgacctgtcacagaacttaccacattctactatgaattgtctgattattcaactatctctcagtagcttgaaaagctatcttaagttagggaatatcttttatttctggaactccagaacctggtatatgcatttagtaggaattagaaaagtttggtgggccagtgcatcaaccgtaaactagacatacctctcccatctgttgttcaataatttgatgtgcaatttcttctatggttgccatgatctacctgccaaaaataaaaagatgttttataattaaactcacaaaacactcttattaaataatttacaaataaaactatatgatatttaagatttgcttcaaaataatctagttaaggtgggagggttggctttttctgaagtttcttttttccattcatgggttgccttttccatgtgtcttttttattttttttttttttaaaacaaggcccacccaggctggagtgtagggggcaccatcacggctcactgcagtctcaacctcctgggctcaagtgatcctcccacctcagcctcctgagtagctggaactacaggtatacaccaccacacctggctaattttttattttttgtacagatggggtctcactgtgttgcccaggctggcctcaaactcctgggctcaagcaatcttcctgtctcgacctcccaagtgttggtattggaattatcagcataagccaccatgcccacccctccatgtatcttttttttttttttttttttgagatggagtcttgctctgtcacccaggttggagtgcagtggcatgatcttggctcactgcaagctccacttcctgggttcatgccattctcctgcctcagcctcccaagtagctgggactaggcacctgccaccacgccagctaatttttttgtatttttagtagagacagggtttcactgtgttagccaggatggccttgatctcctgacctcgtgatctgcctgcctcggcctcccaaagtgctgggattacaggcgtgagccactgcacccggccccagccctccatgtatctttatatgtttatacggtcttccctctgagtgtctgtgtcctcttcatagaaggacatcagttattttggattacggtacactctaatgaactaattttaactcaattatctcttttaaggccttatctccaatatactcaattctgaggtactggtggtcaggacatcaccataggaatttgggattcatatgattttgtgggagaaccgaattcagcccataacactcaggcataaacccaataaggaacatgcaagatctaggtaggcaaataaaactttaaaatgctgcctaaagacaagaaaatctacacttggaccggccccggtggctcacatctgtattcctagcactatgggaggccaaggtgggctgattaccggagatcaggagtttgagactagcctggccaacatggtgaaacgccatctctactaaaaatacaaaattagccaggtgtggtggtacatgcctgtaatcccagctactcaggaggctgaggcagtagaattacttgaacctgggaggcggaggttgcggtgagccgagattgcaccattgcactccagtctgggccacaagagtgaaattctgtctcataaaaaaaaaaaaaaaaattagccaggcatggtggcgggtgcccgtaatcccagctactcaggagactgaggcagaagaatcccataaacttggaaggcagaggctgtggtgagccaagatcgtgccactgcactccagcctgggtgacagagagagactctgtctcaaaagaaaaaaaaagaaaaagaaaaactacatcttaaaaggacacataagaaagaaaatggatccaataagtacctccaaggaaagaaactgcaagtttggaaacaggaatggaagggagacttatttttcattgaataagtgtttgatgcttttaaattttgcttaaatacaaggattaccacaaaaattaaagtaataaacaaataagaaatctcttccagaaatcctaaaatcaacaccagtgtattggtgcattagactcaaagaagtcacctcctaatgaaaacttagggagataaactatttgtttatctgaatgaattccagggactcattagatcaatatatagtcatgtactgcacaatgttttagtcaatgaatgagactgcatatacaatagcggtaccacaagtttacacccataacactgtatttttactacacctcttccacgtttagatttgttacttacataaatactactgtgttaaaactgcctacagtactcactaaagtaacatgctgtgtgggtttgtaaattaagagcaacaggctatgctgtatagcctatgtgtatggtaagttataccatttagttttgtgtaagtatgctctatgatgttcatctgtgataaaatcacttagggatgcttttctcagaacacatccccataacatatgactatattttccaagactaaatttaactccgaagataaggcaacacacacattcctttttttcccccataattttgtgactggatgactgaaaaaaaatgcttttaaacattaatccatccatccatgcatctatgcatccatgcatgcatccatccatccatccaacactcactgctgctactgcatggggattctcaaccttataaaaaaaaagcaactctccctttccctaactacacctttcagttgattgagtccctgatgtcttccaggatctatgcctgaccctgggataggataataaagatggtctctaccctgaagagatgagaaagaagtaggtaagtaatggtgtaagttaaggctgctctgatagcagtgtctgttttcttcccattcttcccaacttcaaataggatccagcctgataaactggccttgagtagccaatacaaaagtaaaatttacaagttttttttgttttttgttttttgtttttttgagacagaatcttgctctgtcacctaggctggagtgcagtggtgcaatctcggctcactacaacctctgcctcccaggttcaagcaattctcctgcctcagcctcccgagtagctgggattacaggcatgcaccaccatgcccaggtactttttgtatttttagtagagaaagggtttcaccatgttggccaggctggtctcgaattcttgatctcaagtgatccgcccacctcagcctcacaaagtgtggggattacaggtatgagccaccacacctagccaacacacacattctttatacactgttggtggaaggttagactgttttaaccttcctagaaaagtaatttgccaatgtataccaagagccttaaaaatgttcatattgactggctcaaaaatttattcaattttcttccattcaacaaatcacttgttgaatgcttactaggggccaggcattcacagaacgacttatccttattctccagcttcagaccatcagtgctgctttaatggcaagggaacaaagttttaaccccttcccttggtattcattcaatatttattatgcattcacaaggtgcctggcactgtgaacaccacaatggagagttcttttataatccgacttccccctattctcatttcctatcactcccaagaggggcctctgttcaggtcaaactacgatgttctttattcccccaacatattcctactttctccctcatttaaattccacctgacttttaagatttggttcaagccaggggcgatggctcacgcctgtaatcccagcactttgggaggccaaggcacgtggatcacctgaggtcaagagtccaagaccagcctggccaacatggtgaaaccccatctctacgaaaaatacaaaaatttagccgggtgtggtggacggcgcctgtgatcccagctatgcaggaggctgaggcaagagaatcgcttgaacctgggaggtggaggctgcagtgagccgagatcgtgccattgcactccagcttgggaaacaagggcaaaactccgtctcaaaaaaaaaaaaaaaaaattttgattcaaatagttttttacccagtctttcttgaagggtcgaacaattattttgtagactaaggttgttagctaggattcagaaatagatttctgttaactcctaatactgtctgtaaaattttatctaaaggtgcatttttctagacaagttcataaaagacttcaagaggctgtagatggtcttgtcactgaaaaacggcaacgaattatatttatactattatttattgtatgctgttttgtttttattccccaagagtagggattatacattgtgtggcagacacacagacggtgtgtgtttggggatgtttgctccctcaaaatccttccttaagatgcggtgcctgtaattccagctactcaacaggctgaggcaggaggatagcttgaggccagagatctgtctggataacaaaatgaggccccccaccatttctataaaacaaaacaaaaaaacctttcctagaagaaactaacatgccccttgaaaaactaagattagcaacatttcataaaacccacttttttttttttttttgagacggagtttcgctcttcttgcccaggctggagtgcaatggcgcgatctcagctcactgcaacctccgcctcccgggttcaagcaattctcctgcctcggcctccggagttgctgggattacaggtgtgcgccaccacgcccgactaattttgtatttttagtagaaacggggtttctccatgttggtcaggctggtctcgaactcccgacttcagatgatccgcccacctcagcctcccaaagtgctgggattacaggtgtgagccaccgcgcccagccgcgacccacttttaatgatagaaatacacatcgctttttcagatatactaactggacttaaagcaaagtttaaaaacaatcatcggccgggcgcggtggctcacgcctgtaatcccagtactttgggaggccgaggcgggtggatcagaggcgggtacatcacgaggtcagagtatcaagaccatcctggccaacatagtgaaaccccacctctactaaaaatacaaaaaacaaaaacaaaaacaaaaacaaaaaaactagctgggtgtggtggctcgtgtctgtaatcccagctactcgggaggctgagacaggagaatcgcttgaacctggaggcggaggttgcagtgagccgagatcgcgccaccgcactccagcttggcgacagtgagactccctctccctctcaaaaaaaaaaaaaaaaaaagaaaaaaaaatcgagtatcaccaaccacacagcagaaatggttcaaaaaagctcaaaatcgaaggtccatttacaaattctagcggtactaaaccctaaaggccgtaattttaggtctttctgcttttgctttccggttacttttttaaaggctgacctacttactgaagattatgggacaacctggcaacattcgtactgcacaaaaatggtatctgcccgagttggaagaattatttcttaacaaaagagctatctatcggaagcttggacatgccccctgcagtgagaaccctggggccgttccatttcttctgaaaagatccaggcccacaggcagcgacgaccctggccagatttgccgtgagagaaaagtgaaagtggggggagtcattctgtccgtcccgtgaaagcacgggagttagtgacgggatgcaggccgggacttgcggccactagccgagggtcggcctctcccacgtctcactcgtgccggcgttagccgtgcgccctggaagccccggcgctgcgcgcggctctcccgggcggggaaagctgcagcgccgcggaagctttccctgcaggttaaaggtcagaggcgctgcggtaagcgcagctggaaagggggttgtgtgctccaagccgctcgccgtccggccccgcgtcccgccgcccctgtcgcccccgcctctcccggggccccgcgcatttggcgccgcagctccgcgctcccagccgaagtcgagcagccccaagcggcgctcccaaactgaacggctccgctggccgcaggacgccggccgggggatgcgctgggaccgcgtccgttggcggttggggtgaagggcaccccctggcccccgcccccgacgcggtcgctggtgtccccacccagcgtttcttaccggcgcttttgcgccctgctgactccggcgtcgggcgccgacgcgacagtcccgcggctgccactcgtggattggggggcgctccgggaagagaggttgaagaaagccgacgggatgtgggatcgagattcacggcggagagagctttctgtgtttgggtatttctggggggtcagagttcgtgacctctttctcggctcggcggcgcgctatcccgccagcgcctgcgcattagcaacggggagaagcggcgagaggaggtcgtgacgttcccagggtggggtggagggatcggagggccgagcagcggctctgtgagtccactgcccccttttggcttggaggcagagtgccccgccagagctacgcgttcccagccaggtaatttttgaagccacgtgcaaaggtttaagcatcgtttgccaaaggtgggcattaggggaggttttgagtcaacgttttagatttgagtaataaataaccctctgggtcttaggcatatctgtttctaatttctggaaaactgggctctggggtagagtccaatcatatttaaacttttttttttttgtattacactttaagttctagagtacatgtacacaacgtgcaggttcgttacatatgtatacatgtgccatgttggtgtgctgcacccattaactcgtcatttacattagtaagctttatatataatgacaagctgaggccgactcatgcaaatggtaaggcaaagtttcacttataaactgttgtgagtaaagagacataatggctaaacagggcaagaatataatcactagagactgggcacggtagctcacgcctgtaatcccagcaagttgggaggccgaggcggacggatcacttgagcccggttgtttgaggccagcctggccaacatggcgaaaacccgtctctacaaaaaaattagccagtcctggtggcgcgtgcctgtcgtcccaattacttggaggctgaggtgggaggatcacctgagtcaagacggcagtgagccaagatcacaccaccgcactccagcctgggtgacacaatgagtctttctctctctctctatatatacacacacacatatatatgtatattccacatcctctctataatatatatattattatatattgaggattatcctcaatggccgttttttgtctgttttgctcagtgatgtattaccaagcacataggacaatgcctgctattcaataatgatgtatgaaatgaaagccaggcaagtggctgctgggaggccaaggaaagatcacttggggccagcagttggagaccggcttgggcaagataacaaaaccctgcctccacaaaaaaaatttttcaaattgtgaaatgaagagacattggtggaacatcgcattctgacagtggccacctgtagtggcaaggtgtggcaggaataactgccctgtgtgcaaagtactctgcgctttagattttgaagcattcttgaaatttctagtttttttttaaatctcctttgttttgtcatgaaatttctattttatctagcttaggtcggcactgtaggaaagcagccacaaactcagggcagaaatccaaggaaggaaaaacaaacgtttgctgggaatgagaacatctctgttatttctctctggaactaggcagacggacagagatcaaggcatgaaacaatccctaacaagtaaaaatatgctttatccctcattaaaaatccacctctgctgagcacagtggcttctgcccccagagccttgggaggctgaggtaggaggcttgcttgatgccaggagtttgagaccagcctgggcaacatagtgagactccatctcttaaaaaaaaaagaaaaaaaaaaggcatggtggtgcaggcctgtattcctagttactgaggaggctgaggtgggaggattgcttaagcccaggagtctggtccagtgttggcaccattgcattccagcctgggcgagagtgaaacttttttttttttccaacctctaccttttagcattatttgttgtgtatttggtttggttttaagggagacccctgccaataccataagctggtcccaaaggtgaaaattatgaaagtatagtcacgtcagggatatgttctgagaaatgagtccttaggcaatttcattttactctcatcatagagcgtacttatacaaacctagatggtctagcctagacacacctaggctgtatgttgtagtctgttgctcttaagtcacaaacctaggacaaacccgtacagcatgttactgaatactgtaggcagttgtaacataatggtaggtatttgtgtatctaaatatatataaacatagaaaaagtaaactaagtccttttaaaaaaaaagtgcagtaaaaataggggattataatcttatgcaaccattattgtatatgtggtctgtccttgactgaaatattgttatgcagtgcatgactgcactataggcctaatggatacaggcaatctgagacctcttcactattcttggtggagaatatgtatgcctatagtgatgcttgtggttaccccttatcacccaattaattcacttaagtcacaataagttgacttgttaaaacttggaagtagaagccattttaggaacatcatttgtaggtgaagaagcgtttccattaattatgcttcaggaaaagaggtaaatgaagtttatttatttttgagacagagtctcactctgttgcccaggctggagtgcagtggcttgatctcagctcactgcaacctccgccacctgggttcaagaggttcttgtgcctcagcctcccgagtagctgggattacaggcgcacaccacaatgtctggctaagctttttgtatttttagtagagacagggtttcaccatgttggccaggctggtctcgaactcctcacctcaagtgatccgctcgccttggcctccccaaagtgctgggattacaggcatgagccaccgtgcccagccgaagttcatctttaaatgtgtgactctagccgaagttcatctttaaatctatgatgctggccaggctcagtagctcacgcctgtaatcctagcacttggggaggttgaggcgggtggatcacctgaggtcagagtttgagaccagcctggccaacatggtgaaatcccgtctctactaaaaatacaaaaaattagccgggcatggtggtgcgcacctgtcatcccagctcctcaggaggctgaggcaggagaattgcttgaacccaggaagtgaagattgcaatgagccgagatcgcgccactgcactccagcctgggcgacagagcaagactctgtcttgagggggaaaaaaatcacaccaacaaaatatattatagtaaatttattttgtataaatacatattaacattatttacaatgctaatttttttatttataaagtatatatggacaaaaagatacaaactgttatcattttaagtacaaagtatttctagaaatacattataagccattaaaaaaaaaacgatatttcaagattggttcttacatgctatgaccaactcatatgaaagagcaagttgctcccccttcattccttcccccaactccaaagggaaaggaatttgatatttaggctttaaaaaatttcctactacctttatcttttaaaaaaccctactcaaaacaactatctcttataagggaaaatatcatagataagattttcctttagaaaatgacattaaaagtggcatgagccctagaatgatatgtgtattagaggcacttaaaaaaaatcagaagggatccataggaaggaatttaattcagcaaatactgagtgtccactgcatgcaaggtaccctgccagaaatctcaaatgagtaagttgtccttagggatagaaggtgctaagcatcatgcaaaagatatgaactgaaggctgtgtcggggctgcaggaaggagacaggatctagtctggaggaataggggagagaaagactaagggtcagctatcacagagaagtcttggataaacagagatgcggatgggtcaatgaggaaggaaaaggaaactgtgtgaacaaagaaaggttgggtaagagttagctggaatgtatggcaactgaggacgtgttccatgccaagtcactgggaaagccactgaggcatgtaaaagtggggatgaaactagattagagctatgttgttggaagactgctctggccgtgtttaaaatgggatcacacaacggcattggaattagaagttattgcaataatgggaacaagtaacaaggacttgaaccagggcctatgtaataacagcagggcaatgaggatggaaaggatacttgagtaattgcagagtcttgttgagagttagaggcagattctggagtctcaaatggtatctttctcttacagaagaaaataaacagatttgaatgggaaggaagttgagttttattcatgtaaagtctgagatgcttgaggactcatatagatagccaataggtagttacagatgtagctttgcaggatagtggagaaagtaggtctaaggtccaggttataatgtggatattttcaggctgtgttggagttgtagatgacaagaatcctgttttcaattgaacaaatattttctctttaaagaccctcctaggaagccaggcctggtggtgcatgcccctgtagtcccagctactccagaggctgaggtgggaggattgcttaagcccaggcatttgagttcagcatgggaaacatagcgagacccggtctcttaaaaactaaaaagacctagggcagtattatggaagacagtgatatattaagtacagtatctgccttcaaggagtgtgtggtacactaagaaaaacaatatgtatctctggaaatcccattgactacatttgactaaagtggatttcaaacttttcaaaagctgagcacaatggaagcacactccaaaacataccaacatatgctgtgatataacatttacattttaactaaattaccaaataggagactttccccacatctagatatattctatgaaccaaatataaaatacacatttggctgacaattatactttaaaactgtcgccttctctttgttgtgtcattacagctttcatgtgaatcaagggttggtctgatgatctcattttaagaaatgctactacacactcaaagaatcaagaatcttgggcaaccaaaatacaatagggggatgctgggtacattacagaaaaagggaaaagagattggaaagagtcggaaatgtggatgatgccagagataattactctcattttcttaggactctgatgggtcctgtacatttatagctgccacagataaaggtggactgctagttggggacactaacaatgccagccttcccctggttcagcctggcgtctcatctacgttatgcttagcatcatttttagcttagctttataaatgccctactctttcctccttatgaattaaaaggagatacctgaaaaagggtttgatggaagcacaggcacacatatctgtataataaatatagtatccttggaatctagatactacttaacttttctccccatttatagactgtgcccaatatcatttttcctctaaaatactagcaaaatatatttttatagctttttttacaataaattgcatataattaggttcttagttgacaatgaatgagccaggttacataaataacaattggtcagctttagtaagttatgaaggactcataaaggggcaggggaatgtaatactattccacatttaaaacatctttttgggagaaggataattggatagcttccacaaagactacacatttttctaaaccctccatggggctaagccaataggtaatacagtcacatgcattttacatgtaattaaagagactgtaagtttgtgccagatttcttccctctctcactctctttagatttagaactggctcatgattcagccaggtcttagaagatagaatagcctggctgatattttttagattataaggcttaagccaaaccttgtagtcagaaggctgagagctcaagaggagggaaagaaaacccaaataacttgtcttgctaaatgccagacgcagaaacagtttataaggtacaactttagcctccaaaaaggaatacactaaaaactgcaacgattctaacatggaagccttatttatgtgatcttgattatataaaattgagctacaaagaaattttagtgtacctgctatgacagaaaggggatggcatgttaggattgtgtatgaggttcaaatgactccatggcaaaaaatcgccacaaaaaactatagcagccaactctagatctagtagggactctggtgctgtaccaaacagcattcaaaaggccccagaaaggcactcagtaatcctcatggttgctgttaaggatcacactgaattaggaaatcctttatttagaggcagaaaggaaaattcttgtaccctttaaagaaatattatatggataaccttgctgttcaattttttttttttttttttttttgagatggagtctcgctctgtcatcccaggctggagtgcagtggcaccatctcggctcactgcaacctctgcctcctgggttcaagcgatgctcctgcctcagcctgctgaatagctaggactacagccatgtaccaccacgaccggctaattcttgtatttttaatagagatggggtttcaccatattggccaggctggtctcgatctcctgacctcaggtggtccaacggcctcggcctcccaaaatgctgagattgtaggtgtgagccaccgctcatggcagttaagataatttatagtttaaacttagttaataaattgtgtattgtgaacatcagggatggcttttatcacagtgttatttcattttcttctgctaatcaacaattgtatgtgcaaggtagttcatatgttaaacagtaagtgcaccagaattatgaatctaaatctttcctaaggaggtgtgctgatagctgcttatagagaaaggatttgttgtttttttttttaattaggagggaggatatcacaaactggcagaaaaagaccttttgaaaatgaatactatagaatttcagttattactggcttataattatgcttttctgatatagtaattccagttccatttgtaatgcacaatatttttggaaatgtaacattacttatagatacaaatatcatcattgacttgggctcagaactcttataatagcagggaatattatgtgacataatgcttgctatattttgctattttaaaaaatgatacatttatgtttgtttcgaagtggtagattttttaaaagattggacttaaaagccggaagagttggttatttgtggtattctgcaaataaaaacatcttcattcctactcacagttttaaaaaattcagattctatctctttgctataattctttgatgatgtaatattaactcctgccaaagaggtacctaacaacagaaatactttagataatttactgaaatttcagttcacagttactgaggtagaagctggccatgtttttccactaaaagatacaaatattcacccaagtttattgattcaaagacatgcatttttttcatcagcagttttataataatcacaattcctaaaccaagcactttgtggaaatttgctccttgctatgtgttttttccttacaaagactttccaccagtaagattgttacaatgtaaggtaagaaaacagtgtgaactatgtcacgaatagttaatacagtatacagtattaagatagtttttctggtctctaaagaaatggtactttagaattcagtgtgtctcagaaataattctgaccattaagtaaacatcaaaattttaataaataacataaatgaaaaaacaaacaccttttaaaaattgcttatacctaacaaaacaatttctttgatgaagggtctggttggctttatcttggcagtgttcatttttatacaatttttgaattgcatttactccattctgatgaaattccacctctttggaatcacagaagagatgaaaccaatactgctacaatattgtgccttcctgaaatgcttctatccacctattgataagagaaatcggttagatttgtaaaacctaatcatctgacgtgtgaacaccatatagatgacagctgggcctgtggtcctcattaccataacaacataggtaagatatatatatatatgtattttttttttttttttgagacagagttttgctctcgttgctcaggctggagtgcaatagtgctatctcggctcaccacaatctctgcttcctgggttcaagcgattcctcccaagtagctcgaattacaggcatgtgccaccacacctggctaattttgtatttttagtagagacggggtttttccatgttggtcaggctggtcttggactcccgacctcatgtgatcggcctgcctcggcctcccaaagtgttgggattacaggcgtgagccaccgtgaccggccagtaagatcttttcttgcagcaaattggccttctgcatacatggaactaccctttatttggtaatttggtccaaaatttagcctggaaagtgtgcctctcatttctgataggcataaggaagggaccatttcatgtataaaggttctatgaagtcttgatgctaccaattaatttattttggaagttgatatttcagtgaaggctttattacaacttcttttttatctggaatttggactcagtgcttttaggaacactagttccctgtctcctcctaccttaactctagctatcagagtttccttgtatatcccctaatccagacctgtttcaagatttgcaattaaaaggaatctggcatctagtgttgatcaaaagtttgcatgctgtatgagagcttctcggctgggcgccgtggctcatgcctgtaatcccagtactttgggaggctgagttgggcagatcacctgaggtcagaagttcgagaccagcctggccaatatggtgaaaccctgtctctactaaaatacaaaaattagctgggcgtggtggtgtgcgcctgtaatcccagctacttgggaggctgaggcaggagaattgcttgaacccaggaggcagaggttgcagtgagctgagactgcgccactgaactccagcctgggcaacagagcgagactgtctcaaaaaaaaaaaaaaaaaaagagcttctcaaagtttcacagacatctttccaaaattctttagtctcaaagttttatctgacaatatacacagctgcaattattcagaagatacttgagagtagtctttttcctccctactaatgtaattgcttctgaactttttcttctttcttatggaaatatcatttcttacggtattattttatgtaggctgggcatggtggctcacacctgtaattccagcactttgagaggctgagataggtggactgcttgagcccaggagtttcagaccagcctgggcaacattgctagactctgtctccattaaaaaaaaaaaaaaaaaaaaaaaaaaaaatatatatatatatatatacacacacatacacacacacacacacacacacagaagagagtccagagaactatgaacacttgaaatcactcagtttaattattttgtaaaagcaacctataacagattcagttcaaattttaaggaattttcaaaaatttaatattgaacataaatagcatgttatactgccatagcaaggcttttttcccactaaaattaatacattttaatattctgtcatgtacttcaaaaagcaatccatatgatattaataaagagaaatttataatttagcctgggtcaattctaaattataagtaaactgacttcctttacctaactacatgtaattctgtcttggtggcatttctatcttgtcaactcaatgatataagcaaaagatgacatatattgaaaagcagtactttttttcagtttgatgaaaattgtaagaaagctaatatctgacaatattagggcaattactattttgtctaaataatttttatagaaaagatggttaagtgacataatttaaaaatattctccagtagccaaaggaaaatatttggaagaatagctatatactgttggatatcctaaaatagactgaaaaaagagtcttacagagtgtgtgtaacattgtgcctggctggtattcagggatgtgtgcaattctggtacattaatcttaactgtcttaagaaactaaaagctttgctcactcaaagcattcttttttattttcatgcacttttaagcttgtggagaacacatgaacacctcttcctgaaaacaaaaatgtattcttttgtgaagccaaggtaaaaatcaaatgagagatgatgaactattttgttcaaaagagacctaatttcacagaggtagatacgcatctctatgttaagcaaactgataacatctaagtaaagattcttgctggaattctgaggagactgtttcagcctttgccatctaaactgatagccatttccttctactcagtcactggaacagcatgggagtctcttaatgtgtttgaccttttccccaaagaagttagcgagcagctgtttaaactcctgctgttccatggcacaaatgaatcgctggattgccaaagtcctggaatgtttcaagggaagattcttaccctcatagaaggagaggtcaaatgccttagctttccttcctttcagcagagcagcatcacgctgcttcctctgagatcacgtgtagataaaatactttgtataggactacctattttcttttcccctctgcctcctgaaaatattccagatacccctgccttgtctttaaaacaattctgaagagtttaaataatacgttaaatctttctaattaaaatctctgatgtaaattttgagttgtccccatgccttaaagtaggtcattttacaagcaaccattaaaaaactgaaatctcatgaataaaagaaaaatatggccagattacttacttctgagccgaatgagcatcctctgctttgaatacataaaataacatgtttttgtgcagtaactgaaatactttagactcggaattctcatctttaacttgaataacagtgaatcctaataaaggctgactctccaaagcggccacgtcctaatttaaaaacatacaaatggagaaaagtttttagattgagacaaaattcagatttgaaaactcttgatctacatagctctaatttaatttcaattattcacatataaggtaatgataattctaacaacttactcacttctcatttattcaataatattcattgagccactccctccctaggtaccctatatgccaggcactgtggcacacaatttctggcatgttcacatctactgaatttcacaacatcctcactaaaccaaggaaggcacgtgattatattactttcattttatggatgcagaaaacagctcagaaaggtaagctattcacctggatctcactaaggaaaagtgtggaccctacagcagtgttttcataggatggtggaacacagggtgatcaggtaggagaaaaggacagaattagagtaaactgctagaattgtttataatccaaaaaagcctatcttatctatgctgctgtcagatcaatgcaatctaacgatgacagtaaagggagtatcactcaagagagcttggcagaaagaaacacagctctgcctttttttttttttttttttttgagacagagtctctctgttgcccaggctggagtgcagtggcacgatctcagctcactgcaacctctgcctcccgggttcaagcaattctcctgcttcaccctcccaagtgtctgggattacaggcactccactaatatttgtattcttagtagagacggggtttcgccatgttggccaggctagtctcgaactcctgacctcaggtgatccacccccactcagcctcccaaagtgctgggattacaggtgtgagccagtgcacctgggggcagctctgcctttagtaaagtaattagtagtcacacgacacacacaaaaattgcattttaataatatggaaaattcctaacacatttgagaaagagctctccaggtacaaagcaagaacactgttcacattaaaaataacagcaacaacacctcccccatccaaaagcaaagcaaaaaatcttatgtaaaataaatggatttttaaaatattgtaattacttgcagttggcattacaaaaccccaaattactcatctttagatttcagatcttacctcacttgcagcatatgtatatagtactttattttttatgacaaaccaaaagtgtttccagggttttttattgccctttgatctgtacaagtagccactcatagaagaatcctctgtgtttgctgatacctagataagaaaccccatacaaagtttaatggttttcagacaaattataacagcaaaattatttgcaaccaataggtgctgaaagcaataactgtaatgatagaatgtttcagaatgaaatatattttcaaagtgctactatacaaattgaactctgctattaacatgagcacaaaaaagaagacaaccatgttagaggcaattatagaattttacttggtttaactgtgcctgcacgtgtttgcgtatgtttcttggtgggttcatctgtgttttctgggttggcaggtgaagaaaaatagttccagaagactaaaatgcttttctaaaagctggatttggggacttggggatttgttttttattgctcttattttggggcatcagggaaaattatttgaacctttaattctgttcctaaaaaactttttggacttctaaaaaccatacaaacagaataataaacagaaaattctactattaaggaagctcattttaagaatcaatctttgcttcccaaattatagtaagaaagaaaagaggctaatttttacttcataaaaagttgaaaatgttttcatctctatgcaaaaagacagtaagcttttactgattgattttttttttctttttttttttttttttttttgagactgagtcttgctctgtcacccaggctggagtgcagtggcccgatctcagctcactgcaagctccacctcccaggttcacgccattctcctgcctcagcctcccgagtagctgggactacaggcgcctgccaccacgtccggctattttttttttttgtatatttttagtagagatggggtttcatcatgttagccaggatggtctccatctcccgaccttgtgatccacccgccttggcctcccaaagtgctgggattacaggcgtgagccaccacaccggcctttttttttttttttttttttttaagacagtctcactctgtcacccaggctggagtgcagtggcacaatctcagctcgctgcaacctctgcctcttgggtccaagcacttctcgtgccccagcctcccgagtagctgggattacaggcgtgcaccaccatgtccagctaatttttgtatttttagtcgagacagggtttcgccatgttggccaggttggtgttgatttgcctgccttggcctcccaaagtgctgggattacaggtatgagctatcgtgcctggcctattgactctaataatggttattaaaagctgtgttcttaaaaatgtaggagtagataaataacaaaatgtttaggatctaccttagtaatggtatggcaggcacacgcttaaggtggcttcccatgacccttgctgtagagagtcacactgctgtacattctcctccccctgagtgtggacaggacctacgacttgcttctaactaagaatttggtgagggtgataggatgtcactcccatgatcaagctaccttatatatggccctgtcttgttaggagacactctagaaactttcttccttgctggctttgaacaaagtagcaatgttgagaggtccacatggcaaggagctgaggacctccagccaaaagctagtaagaaggcaaggcccccagtcttgcaagtacaaggaaatgaattcccagatgagcctctagatgagaactcagtacttgccaaaactttgattatagccctgcagagtcccagctaacccatgcctggactctggagataataaatgtatgttgttttaagctgctaagtttgtggtaatttattatgcagaaatggaaaactaatacacatgcgctctgtgaatttttaaagtgtatctttaattatattaatttcttataaatttcatgaaaataattatatattgtttagtgggaaatttaagatctaacattaaattagaaatatttgttaagcaacagtaggtttatataaatacatccttataaagactaccaagtaattttttaaaaaactagaattgtttcctatctcagtgaaaaaaaagaggaaaaaaatccaactagaatgtttaacattcaaatgagattttgcttaaaatatagttacattggaatcctactatattcttatctaagttgttattaatgttgctcaaaatatattacatttctcctttataccaatttaggaccagtttagtagccacacaagaagatcaaccataatactgaatagccatgactagacctatattttcaaagataaaactggtgttcaccaacttaatcacctaactgatccacaaaacatgtcttccaatgatttgattatttacaaaataaatcagggttgtgggggtgagggactataaaactacattttgggtacactgtatactgctcaggtgatgggtgcactaaaatcttagactttaccattatacaactcatccatgtaaccaaaacccacaggtaccccagaagcaatgaaaattaaaaaaaaataatccaactccaactcaaaagctgtagtctgccattactgagagtactgaggctctaaatgtaattctaaaaagaggagtttctaaaaatattttaaacattactagaataagaacacaacttcccagttcctcaaaaagttaaacatagaattaccatatgagcaagcaattctacttctgggtataaacccaagataaatgaaaacatatgtccacacagaaatttgcacatgaatatttctgtcagcataattcgtaatagccaaaaggtggaaacaacccaatattcaacaagagatgggtggataaactgtggtatacacaaacaatgaaatattattcagacataacaagaaacgaagtatggatacgtgctgtaatttccatgaacctctaaaacactgtgtttcaactgggaatatactcgtaactttacataagaaacatgatcttgatcaaatttttagagttctttccttccactatgtatgctagaacacctcctcagtaaaaaagcaagagaaccaaattaaaaactactctgctggccacaaaactagcacaggcggacctcactaataaactgatcataacggagtagccaaaatggcaatgctgtttgttctttgacatctaaatttgaggaaatgggataggatatcaacaaagtctgtggattacaccattagcaggtctaagcatacaggctattatcactatttaaagttttcttttaaaggaagtttaaaggaaagacaacctactatcagtgatatcagctgtgcataaccaaccaatgcctacaaataaaccgtgcagatcactaaatgctaacaaaatgcccaaaatatcctgtggacttcttccctctggcaaggatcttgctcaaagtcattttaaaaaattcatgtgtgtccaacttatctttactttctatcactgctattaaatgttctctaaacctttcaatagccattttctaaatgacttaggtcagacgggagaccaagcaagattgtgaggcatcagccacatccatcatcagtattaaaattcatgacttaatagttgtgggaaatgacatcttcctttatgaaagaaaaacggtgtattatatgcatatgaataattcagcctctatcacattgcaaatttaatggaaacacttacttctttgagagcagctgggatttttttctgtttcctccctgatggaatgctatgtaagactgatgataaggcacttgaaggagatttgtgatttccaggagatccaatcctaggggagtgctggtgatctagaacaaatcaggcatgcttatgtaggcaatgctcagcattttgcaattcaatttcattcaaatccataaacactgttgcataaaatatccatggaaggacactaagaaacaacattgataactcctggaaaaggacaatggatggctgggagttgagtggcaggaagactttctactatctatggttttatactttttgaactttatgtgaaaggattactcttgtgtgcctttagaattatgaaacacgtgactatactaccaacttaaaaaaaatccaaaaaaccttccctactgccgtaaaccccaaagaaccctggtattgttaagtgtctagatactagaccagctacaatgaacaaagcagcttaaaaaagggggctatcggacacggatgaagaagtaatgaattctgattgcagagggttcagggaaagctgagaagataataagataaaagctggccatgatggagtaagtaggaatttgccaggttaaaacaagcaggaggaacactgtgcgctaagaggtcagcatgagcaaaggcagagaggtatgaaattaaatcatctatctggagaataatgaggccagattaaaaaaaaggggctggtttgaagcaaactggactgttgtttatatgttttaggctggggagtgacatgagcagattaaatttggaaaaatagattatatctggcagtactaaggagaaaggactaacagcaagaaaacttgttaggaaattattatagttgtctagatgagagataacgaaggccttattagggctgggatggagaaatcaagacaaagatttttgatgataaaattgacaagagttactgaccaaatgggtataggtgatgaggaaggagaattcaaagacgaattttgaatgtttgcagcttataccatatacccagactaaagagaggaacataaaggaagagatggatgggtcttcttggaaaatgtacacaaataataataaattattcatctagaaatatgtggactctgaaataccatgtcatccacttagaaattcctccttgctaatgaaaagctatccttcagggaaatgaagaacagactttcaaaaatttagatcctggccaggcgtggtgccttatgcctgtaatcccagcactttgggaggctgaggcgggtggatcatttgaggtcaggggttcgagaccagcttggccaacatggtgagaccgccccgcgtctctactaaaatacaaaaattagcctggcgtggtcacgcgtgcccgtaatcccagctactcaggaggctgaggtacgagaatcgcttgaacccgagaggcagaggttgcatattgtgtcactgcactccagcttgggcaacagtgcaagaccccatctcaaaaaatatatataaataaaatttagatcctacaggtttcaggaatttaactaaaaatctcttcccaaaacatagacctgagcagtcctgctaagctgcattcattttactggaggatacctgcaaataatgagcagggaaataggaagtatcatttttgtgttcggtcaaaaagctgcacattcagatgtacattaacatctcactaaatcagattaactgactagaattaagctaacgaagtgccacctaagtaaagagaattactttacatatagataaaatgatttgtaatgagcacactatcatgtgaaactatagacttcaaaattacttgaaagttaaagttcccttttactgttttaagtgttttaccctgtaattacatttctacagttttcttagcaaaaccttttacacagactgaaaccaaatttcagcccaacctctcccagaattacaacaaaatatgaattaagaaagcttactacaaatttggagataagtatcaacaatcatattgctaatgtaccgaaggtgtttctctcagaaggttgtttgaaagcatctggggaataaaggaatttttggttaaatccttacttatatattacctaatttctgcagttcttggaaacaatgttcacatactcttgctggttgatttttcaggtaatctaagccatacttattagacgaacaagcttggcatacaatctgaaaacacattggaattatgtcattaatttcattagaataacttgtgtttctacaccataaagtatgttacaatttacagtgctatccacttttcaaaacagtttcagagtcactgagtctcacttcgtctcaataataactctggagttcaggcatatagtgaactaatgcatagtaccacacttgaaagatgaaggggccacagatgattacttacagagggctgactacataaaataataaagtaaagcagttaatatatgcaaaatgcttagaaccgtacctggcatgcaaaaaggcctgtgaggtatactgatcaccagcactgtcatcatcataatcactgctgcagcaacgaccacgtctctgcaactctaccaagtttttgggctccatactaaatgctctctaaatacaacctcatttaatttttagagtgactctctgatgtcactgtttctacacccattttactaatgagatcatgaaggcttagaaacatcactagagataacttcaacactgaacattccccgtactgaatactatggatacttagtactagagagatgcagtttaaataatagctgtaaatgtgagggcctgtttaattgtggatttgttagattttgtttttgaatcagttattactgatgttctaatgtaactctgaagtaggagggtggaagttcactaagaagattgcccctgccccctaaatatttagagaaaacaccattcatgtttgctaccattaacataataataataatagttattgttattcttgaactataatggtttatgaggggaaatatgcttcctcactatgtacagcctggagacagtaaagaccacaatggagatgggtgttatcatcgccaacctttccacaggcccggcagtggtgtcgtctccaggtgagagtgaattcgcttgtgcagatcatacacattgtggctctggtatcaggaatccagatgggagccttcgatccaagaggactaacttcttctttattttctgagtctgcctgtggaagaagaacaacttctgattatctccatgcacactgcctgcctttttattcggcagtggcatctcacactaccaagatggggatgagggtcaggcacagcagctcacgcctgtaatcccagcattttgggaggccgagtcgagtggatcacatgaggtacggagtttgcgaccagcctggccaacacagtgaaaccctgtttctactaaaaatacaaaaattagccgggtgtggtggcgggtgcctgtgatcccagctactcaggaggctgaggcaggagaattacttgaacctgggaggtggaggttgcaatgagctgagattgtcccactgcactccagcctgggcaacagagtgggactccgtctcaaaaaacaaacaaacaaaaaagatggggataaaatatgggccattggctgggcatggtggctcacgcctgtagtcccagcactttgagaggccaaggtgggcagatcacaaggtcaggagatgaagaccatcctggtcaacatggtgaaaacctgtctctactaaaaatacaaaaattgccaggcgcggtggctcacgcctgtaataccagcactttgggaggccgaggcgggtggatcacctaagattgggagttcaagaccagcctgaccaacatggagaaaccctgtctctactaaaaataacgacaattagcatggtggcgcatgcctgtaatcccagctactcaggagactgaagcaggagaattgcttgaacctgggaggcggaggttgtggtgagccgagattgtgccattgcactctagcctgggcaataagagcaaaactctgtctcaaaaaaaaaaaaaaatacaaaaattagctggtcatggtggcacgtgcctgtagtcccagctacttgggaggctgaggcaggagaatcacttaaatctgggaggcagaggttgcagtgagccgagattgcaccactgcactccagcctggcgacagagcaatactccatctcaacaaaaaaaaaaaagaaatatgggctattggccaggcacagtggctcatgcctgtaatctcagcactttggaaggccgaggcaggcggaaaaccagaggtcaggagtttgagacctgcttggccaacatggtgaaaccccatctgtactaaaaatacaaaattagctgggcgtggtggtgcatgcctgtaatcccagctgctagggaggctgaggcaggagaaccacttgaacccaggaggcagaggttgcagtgagctgagtttgcgccattgcactccagcctgggcaataagagtgaaattctgtctcaaaaaaaaaaaagaaagaaaaagaaaagaaatatgggctattatatttttcacgtgctcggaatactaagtttagctacaatctaaaaattttctaatacaaaattaacttaaaaagacgcctgtggtagtgggatggcagctgattagtttctgccttaaactgtttcgtattttctaaatttcctacaatgaagttttatagctgggaagaaacatgaatatgctatatgctatcacagacttgcagtgagacaacaataggaggataaacttttagcgctgaaatgagacattaatctgtagagtaactctctgatgtccagtccaatcattttctgaaacacatgttgctttcttaaacccctgtgaaatgtttaaggtaaaaactttgaaatgcactggaaaaaaaaaaaaaaggagaaaacaatacctcatcaagactcctactaggacagaaggtgattcttttcttggcatactcttctattgccctggaaatcgcttctagccattcatccctttctgtggcagaactgttgggggcaaaaggtttcatcaaccagatgtcagtttttgttcttttcctttttcttcttttctttctcccatggcaacagatcccaccaccctccaacaataccagtcaaaaaagtagcaactcctcagagttgaggcaggtttagtgaacagatcatcagaacagacaacagagaacccgtgatggcattttagcaaatacaatgcttattttttctttccaaaagttctgctttatattaaatagcttttgaactctcctaaacttgaaaatatttttggtttggtttaaaggataattgtacaattaataattatgattatttatatagccagggagtttcttaagacatcatcctagaatttaaaaacattccaataagtcaagtttcaaattccaatttatagcatagaatactaaatatctttagattactaaggattactaaaattttctaggaagggcactggggtgaagggaacatatttttttgtattagaaagcagatgttgacaatgaggttcacacggtaaaggctgcagtttttgttagggcttctctacctatttcacccaccaagttctctgtccctacccagctcatcaggaggtatctttaattcagcgctagatgggaatgggccaaataggggcaaacttggtcagacaagggtattttttttttctgtttttccaaccatgcctttttcccaaaaccatgttaactccaaatcattactggtatcagcatacttatgaaaccactgtttaaattttgttttgtatatttaaaactgagaggcacatgttaggtattataaataaaaataaatatataaatctatacatacacagtacagaaagagcagaaaagaggaagggagagggaatgagagaaagaaagactttaataaataattaaaactccatcataataaaacaaaattcatcagaatgggattgtgactgtgttaaaaaaaaaagtctgtagtttaatttacagaggcattttgaggtatacagaagtaaaatcggccaggcgtggtggctcacgcctgtaatcccaacactttgggaggctaaggcgggtggatcatttgagctcaggagttcgagaccagcatggccaacatggtgaaaccctgtctctactaaaaatacaaaagttagccgggtgtggtggtgcatgcctgtaatcccagctactcagggggctgaggcaggagaattgcttgaaccaaggaggtggaggttgtagtgagccgagacagtgccactgcactccagcctgggtgacagagcaacacactgtctccaaaaaaaaaaaaagcagaagtaaaatgacctgatatctgcaatttgttttaaaatagaaaattatgaaacaggaaaatcagtggcaaaatcttgatgattatttttagtttgggtgcctgaatatacagtttctggtattatttgccctaactttaagtatatttgaactcttaaagagtgtttctaaaataaaaaattccaccattaataatggtacatatagacatatgttgctgtattttagagaacccaggtcagatcaagaatagaaaccactcaccttccctacaatcatcattctcagaaagcgcctccctaatccatggcttgagtgccatttagaatgttcattcatgtggattaaaaaaggtagagatccactttacaaataaaattttaaatcaaattaatttctcaaattttcattacatacaaagaacagcaaaaaagaaataatctctttctctctaaaccaaacaaaaccctgccttatttaccgctactattctagcattactgccaaaacaagatgccatttaacagttactacgtcagccaactctgctaaatgcttagcaaatgtcaccatgtctcaccctcagagcttccccatggaatacacattggatcttacaccccttgcccccaactacaacatcatcacccaccttcaccatttacaggtaaggaaactgagaattagtaatgtttgataatttgctttatagacaacagactaagtgatgagctgttattaaacccaagtgtagttaaggactggacctctcaccaccaggtcattgctagcctctgctcatgttctctgcagaactacatgatgagaatacatgctcagggttccaagcaaacattcataaaacattaccatctctccctccctccccggctcctcaccagaagagtaacagaaagcagagaggcagatggtaaatttgagaattgctgttggattcttctggagcccggggagcatgtggaatgtgattcaactgtgtaaatcatgtcacatatgctgttctttcatttaatcattcctggctctctcctgtgtggggttctgccaagacaatgtttaccagctcttgataacacatttctcacagaccacacacatttgcccgcagcatccagtggagatattctagtctccttttgtaacatgattagcagaagaatcagcatcttcttcaaactgaaaaactgttaagtcaagtattattttctttatagaatgtgtatagtacaagaaagcaaatttgtgtcaagtaagtaccactttcccaatgactgggatgaattgccaagggttaaaaacctggccgggcgtggtggctcatgcccgtaatcccagcactttgggaggccgaggagggtggatcacctgacgtcaggagttcgagaccagcctggccaacatgtgaaaaccctgtctctactaaaaatacaaaaattagccaggcatggcggtgcgcacctgtagtcattgctactcaggaggctgaggcaggagaatcacctgaacctgggaggtggtggttgcagtgagctgagattgtgccactgcactccagcctgggcaacaagtgagactctgtctcaaaaaaaaaaaaaaaaaaaaaaaaagaccatgccacaccatttactacatggactaactgcaggatgcttctctgaggttcaaaggccacatcactttgatttgtgagtaacgctgtgagtaacattcactgggagcctactaagccaggacctaagccaagaactgggcacacaaaatatacctcacttgtaaggatgcacactgaattgaggtgaaacatgtattaacatatgatatgacaaatgtagataaataacatagaagtagtaaattaccttatgtaagtagcagggatggctctgcaaaggtgatgacaaagttaggacttaaagagttacaggagtttggcagggaactctctgtgtaccctcattcagtctgccagccgtggtcatctctaagctaatggtgcccaaatatatgtctctggcccctacttccctctgaaatccagatccttacagaaactgccccttgatggctgcatttggatgttgcatatgcacctcacattccatatgcacacctgaaactcaactcccaatttctcccctaaagctgttcctctcccagtgctccctgtcacagtgcatggcaccatctcccaattcatagtatatgctggagtctcctctgaagaactcctcttataccctgtgtccaatcagtcccctcctttaggccacctcccaaaccagattccatgcagcagccggatactctttaaaaaatgccaatctgatcacatcattcccttgtataagcctttcagcggtttcctgtggctcttaggctaaagaccaaatcccacaagatggttctgcaccatctaagtcacctgtccctccaggcttatcctgggtcattctcttcctcattcttgagctcgtgccacactgaccttccaattctctgaatatgtcatgccccttctcacctaaggacctttgtacacagtgctcctaatgaccaggaggctcttcctttttcctctttgcccctctgactcctacttatctttcctaagtcaatataaacagcagggtttgtaggaaagaggctgccctctctcccccattgcagtttaaggtcctttgctttacagcctcctagcccctggtactttttctgtgcaccatttaatcaccacaatacttaattgtgttaatatttgctaagtgcgtgtcctcctccatggaatgtcagctcagtgaaggaagggcccttttaattttttttttttttttttttgagacggagtctcgctctgttgcctaggttggagtgtagtggtgcgatctcggctcactgtaacttctgcctcccaagttcaagcaattctcctgcctcagcctccagagtagctgggattacaggcgtgtgccactatgcccagctaatttttatattttaatgtaaaatattaaacggggtttcaccatgttggccaggctggtcttgaactcctgaccttaagtggtccgcctgccttggcctctgaaagtgttgggattataggcgtgagccactgcacctgacttgacccttttaatttttaatccactgtgtcccgatgcgcagcacaatgcctggcccaaggtagaggctccatattccttactgaacgaagggatgaactgcaggtggaggtaacacctgtggaaggcagatggctgtggagttgtctggcatgcatggagtcacacgcagatccgtgctgatggagcatgcagtgtgttggtgggaagagatggagagactccttacccactttaatatgggatgcagtacctgcctaactggttggaggaatctggaaggagagcatggcataccgatgacattcaatatgccttagctctctttccctcatgccagcttgatcctcccttggaaatttatttttcctttatcaagaacttttcagttcaatgatttcccctgcagagcccacattcagcccattagtaatcctattgggtttttttctgattcataccattgttcatcactttaacccaagacacaccatcatctgctgggcactcactacctggctgcccaacttctactgtagtctcctgatggtctgtcttctacaaagaagccggtgtgatctttcacaaacataaattagatattatcacttagctgaaaactcttaaaaattcaatgaccttactatgggtggcccctaactcttgcccctaaactgtaactcacatttaatctcccctggtactaggggagtactaggctctccccggagtactaggctctacctatattggaattcttgctgtttctttaacatactataccctttcctgcctccctggtatgtcttttgttcctgctgttccttccatctgggatttgcttctggtctctgatgctcctcagagataacttttctgatcccccccccccccaccccatataagttcttgacctcatcactttctatctgctcagcctactttattcttctttataacattgaatactccaaattatttctatgtgcatagatataaataaacctgattattatgtatctcccactttagaataaaagcttatccttaaggacagggattgcacacccccagctcctggacagggtaggtgatgcccagtaaacatttgttaatggttgatagcagacaatcgccttccctcatagctctccatatgccagtctccaaacaatgactttctctcatcactaaagttagtttgactcagcaatgattgctctcagttatcactgcttatcactaagccccagactactaacaaaagcacaaacaggactgcccagaccagctggctgcttgctgccgtggctacactgtctcgcccaccatgtcactactgctgccatccacaaggctcccaactcggaggctaatcgcactgttggctgtatctgttcccacgactttctaggagactcctgtggcattcttttttcccacccttgggactctaaaccagtgtgcactatggagcttggcagagctgcaaagctggcaccagaattcaccaagagcaatgtgaagttgactgcccttgcaacagacagtgctgaggaccatcttgcctggagcaaggatatcaatgcttacaatagtgatgagcgaacagaaaaatgcccttttcccaacattgatggtaaggatcaggaccttgccgtcttgttgggcatgctggatcctcctgagttggaagaaaagggaatgggtgtcagagcttatggtgtttatttttgctcctgacaagaaactgaagctgtctacccagctaccactggcaggaacttggatgagattcacggggtagttatctctctccagctgacagcggaagagaggttgccaccttgattgataagaagaatggaaatagttatgttgctgggcatggtggctcacggctgtaatcccagcactttgggaggccaaggtgagtggatcacttgaggtcaggagttcaagaccagcctggccaacatggtgaaaccccatctctactaaaaatacaaaaaaaaaaaaaaaattagccgggcatggcggcgcacccctgtagtcccagtgactcggaaggctagggcagaagaattgctcgaacccgggaggtggaggttgcagtgagccaagatcgcgtcactgcactcctgggcaacagagcgagactctgtcacaaaaaagaaaaaagtcacagaaatataaatcttgatcagagctgttcattacacctgtctggtactgatctggaaatcatgaacatccagatattcacctaacaaccaaggaaagaaacattcactataatttcttgaatgatttaatcttaataaaatagattactgtttttcaccaaggctcatttttacttgggaaatagaagtgcaattaaaacttgacttttctataggcatttctgccttggaattttgaaaataacctcttgattttaagaaccaagctcaagcactcactgggaacatgatatacatggtcttaatgttctttgaactttcttttttttttttttttttttgagatggagcctcactctgttgccaggttggagtgcagtggtgcgatctcggctcactgcaacctccacttcctgggttcaagcaattctcctgcctcagtctcccgagtagctgggactacagataagcgccaccacacccggctaatttttgtatttttagtagagacggggtttccccacgttggccaggatggtctcgatctcctgattttgtgatccacccgcctcggcctcccaaagtgctgggattacaggcatgagccacttagcaccggccttgttctctgaacttttgttcaaactcctctatccctcaaaaacgaaaaaagggctgaacacaatcctgcctgtagcactttgggaggctgagtgggggtggatcacctgaggtcaggagttcaagaccagcctggccaatatggtgaaaggtcatctctatcttaaaattaaaaaagatggccagacgtggtgactcacgcctgtaatcccagcactttgggagggtgaggtgggtggatcacttgaggtcaggagtttaagaccagcctgggcaacatggtgaaaccctgtctctactaaaaattaaaaacttagctgggcatggtggcgcatgcctgtagtcccagcttcttgggaggctgaggcacaaggatcgcttgaagccgggaggcgggggctgcagtcagccgagatcgtgccactgcactccagcctgggtgacagagcgagaccctttctcaaaaaaaaaaaaaaaaaaaaaaaacacaacaacaataaaggaaaagaaaagaaaaagtcacaatgctaagtgattgagagtttacctgcactctctaaatattggtatctggtggatgcttcaggtacccccaagaaatttgcttgttctgactgctagctgcgaagcatttgacaaaccctagacacaggtatttgtcttctcctgtcatcctgtatgtcaggcagcagtagccattgcatttcagaggagtagcacaccccaggatgactcttgtggtcctctgattttgggaagtcagacatttggtttgagtccttgacattcatggacgtaagcaaaattataaaggttgtcagaaacacctaggttcaaatcacagctccactgcttactactcgtgtaaccttagatgtgttattgaacctctctgagcctccatttttctaatctggaagatcaagataatatccaccccacaaagttatcatagaacttaaaagagaaaataaatataaaacgaaacatgagcactgtgactgatgcagagtaataaatgattctggccactactccacctgctcctaagatcctagttgatttcagtggtatggacaattggaaacagactgcctggtttcaaatcctggctctgctagtatagctgagtggcttttctcagcatagaatgggtataataacgacaacttgccttacaggttgctgtgaagatgaaacgaagtactacacataaagtctttatgatggtgcctggcatacagtaagtgttacaaaagcgtttgcttctatttttattagatcaaaggttaggtctgagaagacagtgtctcattatttagattgtgcagtggagcatgctatgactattggcatctctcccttcaccagtcaaaccttcccaaatacccacttccgccactcagtcagtaactcagtaatgtatttttatgagtcatagagtttcaggtttcctcagcacttgaattacattatggcaacatattaagtcactgcaggttccggtctggggcaaggtggtatcataaataataatggatttcttttcccgccctccctccattctttctgagatggagtcttgctctatcacccaggctggagtgcagtggagtgatctcggttcactgcaacctccaccacccaggttcaagtgattctcctgcctcagcctcccaagtagctgggatcataggcacatgccaccatgtctggctaatttttttgtatttttagtagagatggggtttcaccatgttggccaggctggtctcaaactcctgacctcaggtgatccacccgccttggcctcccaaagtgcttgattacaggcgtaagctactgcacccagcccataacaatggacttaaaagcaaaagacttcgatttgcatcctggctgtgtcaaatatgtatccgtaagacagcaactccatttttctgtaatttagtttcctaatttttagaaggagattacacctacctcataggtttgttagaacctttaagtgacacctacaaatttcctaataacctataaagcactagttgttcttaaaaacaatttgaaatagccacttaaaaaatgatcagcaaagcactttcaccattgttattctattcagaagaacattttaatctctgtgcttctagcatactgttgcctctgctctcagccacttccttgcatggtaaatcaagagtaaaactgcacggtattgggaaagaagaaaaagaagaacaaaaagtcagtagctaacctaagtgcaaaaagtgttggcaatatctttccctgttatactcacaaaaatctatgtttatgtattcttaaaaataggccggcacagtgactcacacctgtaatctcagcactttgggaagctaaggtgggaagattgcatgagctcaggagttcaagatcagcctggggaacatatggagaccccatctctaaaaaaaaaatttttttttttgagacagaatctctctctgtcacctaggctggagtgcagtggtgggatcttcgctcactgcaacctccgcctcctgggttcaagcaattctcctgcctcagcctcctgagtagctgggactacaggtgcctgccaccatacttggctaatttttgtattgttagtagagatggggtttaatcatgttcatgttagctaggctggtctcaaactcctgacctcaagtgatctgcccagctcagcctcccgaagtcctggtattacaggggtgagctaccacacctggcatacaaaaaaatatttttaaagttagccgggtatggtagtgcatgcctgtggtcccagctactcaagaggctgaggtgggagaactgcttgggccatggaggtggaggctgcagtgagccgtgattgtgccactgcattccagcctgggtgacagagtgagatgctgtctcaaaaaaaaccaaaaaccaaaattttcctgacattccctagcaagcagactcagaatgagaaaaaaaaaaaaaaaaagaagaagaaaaaatttacctggctgagagaatgaaggaacgttctacactttcaatctttaattcattctgataggcttcttgggtaggttttctgacctggaagaaagcacaacaatttgagccgactcatcctactgaaaaccatatcaatgagctgaagttgtccaatggccctggctgcttacatccacaaccaatcttcctatccagctttctctactgctgttctccttcatctactctatgcttcagatgaattgaaaagcccacacaccagcccacctttcccacctccaggactttgctcacagtatgccctccacctggaatgcctttcccttacatctcagcatggccaaatgtgacctatactttaaggtccactggctcttcctcctctttctccttctttcctagctgctctcaaaagctacaggccagtccccaccatgaccatcaaacactgcaagttctttattttctgaattcccaaaactgtaattgtgcctttatagtgatatttattactgtctactttataggtatttacgtgtagtgtactgtcttcccaactagttgctaagtccctgggggaggaaagacaataagaatcatgcttcaacttatcttcatatcttccaccaaacccattactgttttgtttatagtagttctcaataaatatcctatgaatacattaatgcatgagtgaacaaatgactacatgaatgaataatcaaatgcataaacaggcagggcgcagtggctcacgcctgtaatctcagcactttgggatgcgacggtgggtggatcacttgaggtcaggactttgagaccagcctggccgacatagtgaaaccccgtctctgtgaaaaatacaaaaattagctgagcctgtagtcccatctactcaagaggctgagtcaggagaatctctcaaactcgggaggcagaggttgcagtgagctgagatcgcaccactgcactctagcctgggtaacagagtgagactctgtcacaaaaaaacaaaacaaaacaaaacaaatgcataaacagtaacatatatagacagaaaagtaaaggatataagaaagatgtttatcttagggaattttctctaaaatatatatttgttgttgttattatttttaatagagatgggggtttcactgtgttgcccaggctggtctctaactcttgagctcaagttattatcctgcctcagcctcccaaagtgctgggactacaggtgtgagccactacgcccagcctttatttgggcttttttttttttttttgagaaggagtctcactctgttgctccagctggagtgtagtcgcgcgagctcagctcactgacacctccgcctcccaggttcaagcgattctcctgcctcagcctcctgagtagctgggattacaggtgtgcgccaccacgcctggctaatttttgtttgttttttttttgtatttttagtagagatggagtttcactatgttggtcaggctgatctcaaactcctgaccttgtgatccaccggcctcagcctcccaaagtgctaggattataggcatgtgagccaccacactgaccttatttgggtttaaaaacaaatcacctgggtgggcatcatgtctcacacctatgtaaccccagcactttgggaggccaaggcaggctgatcacctgaggtcaggagttcgagaccagcctgccaacatggtgaaacccgtctctaccgaaaatacaaaaattagccaggcgtggtggtgggtgcctgtagtcccagctactcaggaggctgaggcagaagaatcacttgaacccaggaggtggaggttgcagtcagccaagattgtaccactgcactccagcctgggtgacagaatgagaccccgtctcaaacaaaacaaaacaaaacaaaacaaaacaaaaaacaaaacatctaacagatgcacacaccttcattccagccagtgagagcatgttgttcagtttatacatcccagactgcactggtgttgtatacagcagggcatcattaaactgaaagtagaaacatttcaggggagaaagtaaagaaacacattactgccacaaagattttgacaagatacaagattaaaggataaataatacctctttgctaatagctctctgaataaaatacttatattctgctatatacactagaactacccagaatgtttattagaatataatttaaaaggcactttctggaaaacgtgctttatttccaagttctgtaacagatttaatgttttttgaattctaaatcccacaaaggtattagtctgcctaaacaaatgattagaacaattttccaagttagaaatggaataaattccaaaaagaaataatcttctggttatacatcataacagacgttatttcccatacttgaaatgcaattaagtggtacggccagttcaagaagctggtgaggctgatatttgaaggtgctaagcttatctaccatgtataaacgtctcctttccttaagcaactatccctacctcggccacatcagaactacacaagtcctcttaccaggaaaaacattcgaggttgcatcactttccgagacagcttcatcagaattccttctttgagaaaaacctgattcacccaaacaaacacccatttagtcctaccatcacaacacaacgacaatataatttccttttcaactttcttccctgagaatttttttcatgacagactggggagccacagtttccttgagattttttacagtcatagttaattttaaacccttaaatcatttaggaatcggacaagcaagcagggttggataattccaatattggcccctgggatactgtatggaggcacatgtaattgactgagcgtgtacttgatcctgaagcatacccaacatcctgacaaccgcattttgtaattttcccgaattaattccctaggccacttttgtgctatatgaggaggatcaaaataccaatctcccccctcccttcataatcctctcttacattaaagatgttaaatgaaattgtcttcaaaactgtgtgaggtcgctggcatcacacaagaaaacgatcccattaaatcagatactctgtggggtcccttgccgctcccctaattgaactggacttacttcataaatgggcttattcctaattgaattgtcacagtgacttacatcatgaatgttttgaacggataaagtgatcaaaattgaatcaatgaagagtaacaaaaacaacctatttttataaaatgataaacagatacagatggtacctaaatgcatcgtattaagtttgcgaaaagcaatgtaaaatgcttacccgaccaggctgcacaatttcatggtgtccatttaagctgtactgaatttgcataagtttctgaaagttgtcctacagaaagacaatggaaagcatatgaaggcctgggctttcaggttcaagaccacaccagccactgacaacaagacacttactccttgcttcatggtgtcattggcgtggttggctacctctataacaacagcaagggcatctgaaataggcaggaacaaaacgtgcatttagtaattacaatggaaacaaatagtttgcaacattaagcaattccaggggacaagatagctagtttatagcaaccaacctctggaggagcttattgactgtgagtaggcagaaatataaggttcaatgaaggcaaaaccaaaccaaaccaaacaacaccaccaccaccaaaaacctggccaaaacaatatatagggaaacaatgagccaaaagaagactctaaagagacactgtagaccatgtttactaacagtatgaatgtcagggttgttttgtgctgtgatttgattatcctattcaagtttacaaagataaggatgggatttcacctggaagataaggaccagcccagtataaactgtcttgggagaaaaggatcgtgaggaaaaaggatcttgttataggaaataaaaactacaagaaatgactaagatcaggtctcagtctcttagtctgattccaagaggcatgaattagaaatgggggaaatgccacatggaagcatcccagatcttaggaatttgcaagtgtcattttgtgagctgggttattagcttcatgggcctatctgtgttttattctttttattaaccctttgcctttagcaaagtgtttttccatactccagccttgtcatctttataactaggtctaaaggaaaaagtctgcattttctcagctttggggctgcagttattctcaacccaaggccatagtgctcccttagggacatgtgaacctgtgtaaagacaatttttgcttgtcacaatgaccaggaagatccactggcctttggtgggtaggaggcagggatgccaaactccatgcaatactccttagaaacccacacaaagattattcagaacaatatgacagtagcattcccactgagaaaaactggtagagtgttagagagggaagcatctcctcctgaggctgctgtggcagtgacagtggtcatcaaaaaaaggactattaaaaaaaagagtggctgggcgcggtggctcacgcctgtaatccgaacactttggaaggctgaggtgggcggatcatttgagctcaggagatcgagaccagcctcagcaataaggtaaaaccttgtttccacaaaaaatccaaaaattagctgggtgtcgtggctcatgtctgcagtccagcaatttggggcgctcaggtgggaggatcatttgagcccaggaggtcaaggctgcagtgagcccagatcacaccactgcattccagcctaggtgacagaatgaggccctgtctcaacaaaacaaaacgaaacaaaaacaacaacagtaaatcaatttctgaaaaggggttgaggtgttttggtccagttattgtaatctatcaaaggactgtcttcctggtaccagccgtggaggcttctgtattctttttttttttcttgctctgtcacccaggttggagtgcagtggcgcgatcttggctcactgcaagctccacctcccgggttcacaccattctcctgcctcagcctcccaagtagctgggactacaggcacctgccaccacgtccagctaattttttgtatttttagtagagacggggtttcaccgtgttagccaggatggtcttgatctcctgacctcgtgatccgcccgcctcagcctcccaaagtgctgggattacaggtgtgagccaccacacccggcctgtattctttccacatgtatcatcatcactattattaaaggaaagcaggtttttccttatatagagaccctgactatatatcagaatttttttttttttttgagacagtcttgctctgtctcccaggctgaagtgcagtggcatgatcttggcttactcaacctccgcctcccagattcaagcaattctcctgcctcagtctcctgcatagctgacattacaggtgcacaccagtatgcccagctaatttttgtatttttagtagagacggggtttcgccatgttggcagggctggtctcaaactcctgacctcaggtgatccacccgccgcagcctcccaaagtgctgggattacaggtgtgagccacggtactcagccatgtatcagaatttacggtgcctggtacccttttcacagcaggttcaagaggttaccgtggacacatttcctgctttctggcctgctggaattcccggtggacaggggagagatgccttaagatttaatggatgacaaagctgctgctgctacttggtcacctggtctcccaagctctaccttccctactccatgctgtgattctactttccccacgtcatcccgttaagaggccctgatgcctctattcctttaactcttctgcctacctttcaaagttattcttgcctcaccttccctcacccttgaagtctcatccacactgctcaccactctttttttcctgagacagagtcttgctctgtcgcccaggctacagtgcagtcgcgggatctcggcttactacaacctccatctcccaggttcaagcgattctcatgcctcagctactgagtacctggtattacaggcatgcacccccatgccccactaatctttgtatttttagtagcaaagggttttgccatgttgcccaggctggtcttgaattcctggcctcaagtgacccacctgcctcggcctcccaaattgctgggattataggcatgagccaccacgcccggccactgctcaccatatgattgctgtgcctctggccatacagtgggcctcactgttcactggttttctcatctatgtctttgctgtcacatgtaatttcctttaaataagctccttaatctctgaccctgaatttgttttatgtgtaaaatggagctaataactcactttcattgaaggcagaagcccaggacccaggacagatgttttctttctattctataagttccatgtataatttgtatcctcacgagaggggctgccgtcgggaatgctcatttttcctctcacccactctcccactcatctccagtcctactttttcctgcaaagcttccctgcctctttaaccttcacacttttctctgtcatccaaataattctgtcctgctcggtgcacccttactttgaagtcatttgctttgttctttatttgatggatattataaacttcttcatcaactagatatgatcactgaagacaggaaacttgtcagatccccaaccacaagcttttcctttaaaaaaaaccgcctttaaaagcataatgtacacaaacagaagatgttaagagaagtaaaatgattaaaagaatatataagaatctctacaaaaagggttaaaaatgttcactttttactctgcaaatgtaaaggatatacaagaatgtgatcaggccaggtgtggtggctcatgcctgtaatcccagcactttgggagactgaggcaggtggatcgcttgagctcaggagttcgagaccagcctgggcaagatagtgaaaccctgtctctacaaaaaatataaaaattagcagggtgtgatggtatgtgcctgtaatcccaactacttggagggctgaggcaagagaattacttgagcccaggaggttgaggctgcagtgagccgtgttcatgccactgcactccagcctgggtgacaaagtaagactctgtctcaaaaaattaaaaaaaaaaaatgtgatcaaaattcataaaattaatggacttgcttaacatgtttctgcagttagacccaggcgttgctgggcatggtggctcacatctgtaatcccagcactttgggaagccaaggtgggcagatcacttgaggtcaggagttcgagaccagcctggccaatatggtgaaaccccatctctactaaaaatacaaaaatcagccgggcatggtggtacatgcctgtagtcccagctacttggggggctgaggcaggataattgcttgaacccaggaggcagaggttgcagtgagccgatatcgtgccactgcactccagcctgggtgacagagtgagactctgtctcaaacaaaaaaagaacaaggggtatacctgtgacatttgaaagaggttgttgggaataaacagaaacacccaaacagaattaatctgtgtgtatgtgtgtgtatctgcgagagagggagggagagagattgtgagggagagagacacaggcacacagacacaggaactccaattatcccactagctatgagtccctcatgttgtaatggattgtttcccttaagtactactagggctgagggaaggctaatatcctattgttagacagtgccagaataatatgcttttttagactcatccctgctttgtagtttagtcacttcatggactcatgattttgaagcttgaggaccttgcagatctggttcaatccctgtttttgaaagacaaagaaatggacctctagggaaactgaatatggcacgggcacagagtgactgagcacaggagggcaaagattcctgacctcagccaccacgctggcttcacagtcgcaagaggctggttcccatgcagggctggccatgggtctcccctgcccatatcatctcacctatccccagcactgctttactacttaactggttctatgttaatctgctcaaaatggagtttccaggaaggcctcaagtctttttttttttttttttttgagaaggagtctcgctctgtcgcccaggctggagtgcagtggcgctatctcggctcactgcaacctccgccttccgggttcaagcaattctcctgcctcagcctcccaagaagctgggattacagacgtgcaccatcacacctggctagtttttgtattttttttagtagagaaggggtttcaccatgtaggccaggctggtctcaaactcttgacctcaggtgatctacccgcctcggcctcccaaactgctgggattacaggtgtgagccaccgcacctgcccttcaagtcgtatgaagagagtttgtaatggattttgttatcaatatatttttactttctagccctacctaaataaacataatataaaaacttctgcaaccacagaagttatttaccttgagtgtctctgtaatctccagcatcttctatgagattcttcaaataatctagaaaagaagaaaaaaaagtatttaagtacaataaaccagtgagccccaaacacatatctttctttttcaatacttcattagtcttgctggttaatatacatgctagtccaacttgtgctaactttctaaaaatgtgaaaaaataaagccctgagatcaatttgaaatcaagacatagagtcagagctagaaaaagccttggaggaaacattggttattttagagatgaggaatcagattactgagcaaaggatctcacccaactcacacaacctctagttggcagagccagcatgagaattcaggtctcctaatgcccaattcagcttttatcccaacacataggaagtactttaatcttgagatcagacacacgtctagtataaaattctaaggcattaatccaatccctaaaagtctcctggatttgttaatctaagagtctaacaatgctcaggacaccaagggaactcaatatatgtatttaaacaggtggttttcaaatggggacaaatttgccccctagggtacatctggcaatgtctggagacagttgtggttgtcataactggggaaaagcgggggctactggtggctagtggttagaagtcagagatgcagactggactcggtggctgatgcctgtaatcctagcactttgggaggccaaagggggtggatcacttgaagtcaggagttcaagaccagcatggccaacatggggaaaccccatctctactacacacacacacacacacacacacacacacacacacacacacacacacacgtcagacgtgctgctaaatatcttataatgcagccctgcaacaaaaaaaaaaattatctgaccccaaatatcaataggtctgaagttgagaaaccttggtttggataaagatagtctgtaaataagtaatatggtatatagtagttcttgtaatacagaaaaagaggtaatagaagaacctatatttaataaatctttaacaccaaggtaagtcatggaatttcaaggcaatacttccttctctgttgagaaatgctggatggcctcccattacctgttaaattaatacaaattcctttctggaatttaaagccccctgctacatggtccctatcaatttttctctctctcttgctactgcctaaaatgggccctttgttctgactaaatttgatctgtgcaaccccttaaacactccccatgtgtccccctggcttcacaccttttgtctctaatagtccctttttctccatcccttcctctgtctcgcttatacaaattctactcacactcttcaaggctcttcttaaatgccccttctcttacaaaatttccatttgaaagaaacgttttctgcctttgaataacacatgacacagcagtctcactttatgcttctatcattttctttttcattagactcaaagctccttgtgagcaagtcatctgacacatctttctctcacatagcacttagtcaggggctttgcacaaaggggacaataaatgcttactgaataaaaacagttcacttactcattcaagacagagtctcaccctgtcgtccaggctggagcacagtgctgcaatcattgctcactacagcctcaaattcctggactcaaccaatcatcctgcctctgcctcccaaatagctatgactactggtgtgtgcctccatgtctgcttttttttttttttttgcagaggcagggtctcgctttattgcccaggctggtctttaactcctggcctcaagcaatcctcctgccttagcctaccaaagtgctggaattacaggcagtgagccactgcacctggccaagaatatattattttttagataggattgtattttagttgaggtaaaaggcaataaatgctgaaaccaattctaatgccagtgggaactgaggaaatgaaaggaggaaaggtgtgttcagtgactgaatatatctttatcagacccaactgctagttagtactattatggaatagatacaacttcatctcatggatttatgacatcatgctcagaggaacaaaggaaaacaggggtattggtgccagatcttcaaacataacagatgacacaaacacgcgcccaattgctgaaacttcgtaagtctttgagacagtgatctaagagcctgtgtgagtctagacgtgcaccttataaatatccagcactggcaataagccatggtgagatgttatgtataaacatattaagcttccctgcgccatggcataggttctatcttgccagagaccatcgctagcaatttagatcttaatctgaatgaagagagcatcccccgcaaaatataaaggaaaaatgaagtgggcacacacaaaaaataaaaaattcccaaattaacaaaatacataagttatatgttacacttagccccatctggagatgaaaataaatattctcactctgaccccactcagaatgcattcaatatattacataatccgtgtctggtgagtgcaaacatttaacatttctatggctgacagttgacagggttggggagacaaacttaccctaccctccctattagatgttctcaaaccctaagctacctcattaatcaagtgattttccttaagctgttagatagttactatatcttgttgtgggaaggaatgcagatttacctaaatattggactcatggcgacttcctagtttgtcttaaatttctgttttttaatacagaagtatatccatgaaaacagagacatttctctaaaccaaaagggctccccagaagatgtccatattaggaaatcctgacctcagaatcactgtgctgagcctcataaacttctaagttgcattttctttgcttgtactcaaacatgaacttttatgaacacagttgaaatacactgagcagaaaacccaccgttaacacgttgcaacatcatgctattaatcaaggaagtaacggagttaggtttaccctccttgccaatttttaaaaatatctttatggtctacaaaatccaactctccaacttatccatccatccatccatccatcaacccatccatccatccattcatgtttttagggcatcttcttgcagtatatctttttgagaacttttaccttggcaaagagagcagggcctggatctccttaaacagttaagaatcacctggggccttaactgcagcataagaatgtgactgatcaccctgagtcagatgggaggaacaggaaaccagtagctgccccagtaactgttataacccaggtgaaacccaggaaaggagaccagacagacacgcctatattggtcatagtgaaccacctattacctatcacttaggacctggtattcggcagaagctttcctaataacaacgaggagagcagtcatttcagtttgccatgttagactggtagtattctatgacctttctgctcctgccaaaacaaattgagcattattcaaaacttcactaataaaactgcctcaaatgccactgaggttatttttatcaaaggaaaaaaaaagcagatgttggttcagcatgtaggtacactacaaaatgtactctctggccaccaggtggcatcactgattaataaaagttaattaactccatcaccatcacccaacatgagtagcaaaaaattaactggaacacaacatactatgtgcaacttctagggatatgcaagctgccttttttttttctttctttttttggagggtctcgctctgttgcctaggctggagtgtgcagtggtgtgaccaatgctcattgtagcttcaatctcccaggctcaagtggctgtcccacacctcagcctcccaagtagctaggacaacagacctgtactaccacgttgggctaagtttttgattttttgtagagacgatgtctcactatgttgcccaggctggtcttgaactcctgaactcaagtgattctctcaccctggcctcccaaagtgctgggattataggtgtgagccacggtgccagtacaagttaattttgttctcatataaaatgcccaaggccaccgggcgcagtggctcatgcctgtaattccagcactttgggaggccgaggtgggcggatcatgaggtcaagagttcgagaccagcctggccaacatggtgaaaccctgtctctactaagaatacaaaactagctgggcatgggggcgcatgcctgtaatcccagctactcaggaggctgaggcaggagactcgcttgaacctgggaggcagaggttgcagtgagctgagatcgtgccactgcactacagcctgggtgacagagcaagactctgtctcaagaacaacaacaataacaaattcccacggccaggcataatggctcatgcctgtaatcccagtactttgggaggctgaggtgtgcagatcacttgaggtcaggagtttgagactagcctggccaatatagtgaaaccccatctctactaaaaatataaaaattcaccaggcatggtagtgggcacctgcaatcccagctactcaggagactgaggcaggagaattgctaactcaggaggtggagtttgcagtgaaccgagattgtacctctacactctagtctggatgacagagcgagactctgtctcaaaaaaaaaaaaaagaaagagagagagagaaaggatgaggacccaatatatactatatcttgttggaaatctaagttttctgtataagggttcccagggagccttaccaccactcattgattacctaatcaatacataaccaacttagagcagaaactagtcggaagtcctgttaaccattaataaaaattagtcatctgtgggaatctgggactttttgcattcaacacccagtcagattcctggaccgtgcactgagaaatgtttggcagcaaagcacagaggaaatgagtgtataggagggataacattccaaagtcaagtgttttgaatttgaggacatgtcttgctttgtatttttcagatttcttctttcctccataaatatgtagtgggatcagcaacacatacagaattatgggatccagagaaaagtaagtctagtcaatatgactttgtaaagttttatgaagtttcagattttgcaagaaacaacctaaaattagcctgacttgtgaaacaaagtactgatcattttaaataccaaaaacaagcatcaagtgtcaacttacaaaacatactgacacttcaaggcagcttggcgaagtggtcaagagcccttgctctggaattagaagacagaaattcctgggccaggtgcgatggctcatgcctgtaatcccagcactatgggaggccgaggtgggaggatacagcctgggcacatagtgagacccatctctaagtctttagatgatgatgatgataataataataaagatagaaatgcttactctgcctggtccagccacatctagttgaggcatgggactttggccatgccccatagcatttttgtgtgttaatatcctcatgcataaaataactaggctgaaccagaatgaaaactgtaacgattctcattccaaaatatcatgaaacatattttgttgaataaaataaaaaatgaaaaatttgaaaaattaaataatgaggaaaacttaaactatgaacatctctgagaaaaacaattactaaactatttccttgtttttataaatgcttgatttgacttaaaaaccatcctaggggtatatcatacagtacttaggtgttctattagctctttagtgcatttaatttgttttggctatttacataagtaggatggcaatacaaccttatctccccatatagtcctgccttatacctgctgtccaggcataattataaatactgtcctcttttacttttgtaagttaatgggtttggatttataagtaacactgattagcactgtcggctggtgtggtggcttacacctgtaatctcagaactttgggaggccgaagtgggcagatcaccggaggtcaggagtttgagacccgccttgccaacatggcaaaaacctgtctctactaattagctgggggtagtggcacacgcctataatcccagctactcgggaggtggaggcaggaggatcgcttgaacccaggaggcagaggttgcagtgagccaagattgtgccactgcactccagcctgggtgacagagcaagactccatctcaaaaaaacaaaaataaaaataaaaaaataggccaggtgcagtggctcatgcctgtaatcccagcactttgggaggctgaggcgggaggatcacgatgtcaggagttcgagacctccctgaccaacatggtgaaaccccatctctaccaaaaatacaaaagttagccgggtgtggtggaatgctcctgtagtcccagctacccaggaggctgagacagaagaactgcttgaacccaagaggcggaggttgaagtgagctgacatcacgtcactgcactccagcctgggtgacagagtgagtccgtctcaaaaataaataaataaaaataaataaataaataaataaataaagcatgccttcttccatatttcagattcttttcttgggatcagggagaataatttatttatttatttatttattttttattttttttgcttcatgatttgtgatatagaaaaaaattaaagttaaaaaaaattttaggctgggcatggtggttcatgtctgtaatcccagcactttgggagggtgaaggaggtggatcacctgaggtcaggagttcaagaccagcctggccaacatagcgaaaccctgtctctactaaaaatacaaaattagtagggcatggtggtgtgcgcctatagtcccagctactcgggaggctgaggcaaggagaattgcttaaactccggaggcagaggttgcagtgagccgagatcgcaccactgcactctagcctgggtgacagagtgaaactccacctcaaaaataaaatgaaataaaataaaatattaaattatttttgggtgcttgatacatatcacaaaaaacctttcctaaagggatgtgaaacttttaatacaaatatatgagaataacagtttcagtaaatgccaattttgtgtgctgcagttttttattgctaatagaattggtaactgttttatttgatagttatcattcgaaggacacaatacaccactatatatttattatgtgctctttttttctaagttattatatttgttcatatttttagtctagatgtctatttttagtatttgtgctgaaatgaaaatttcctagaggtatattttctgatgtgctgtttgcctttttactttgactgtattttaaacttttataatattttaatgttattataatggtgcaaatgtgcctcaaaaaataaaataaataaaatgaaatgaaaagtgtcaatattttcatttacaggctggctgctgtggctcacccctgtaatcccagcactttgggaggccgaagcgggcagatcacttgaggtcagttgtttgagaccagactggccaacatggtgaaaccctgtctctactgaaaatacaaaaaattagccgggcatggcggcaggcacctgtaatcccagctactagggaggctgaggccggagaatcacttgaaccccttgaacccaggaggtggaggttgcagtgagctgagttcacatcattgcactccagcctgggtaataagagtaaaattccgtctcaaaaaaaaaaaaagatatatatatatatatgtatatatatatatatatatattcctttataattaatttttctgggcctacaaaactatctttcatcctgtcctcattttagagtttcaataaatagccagttttataattcttcatatttagctctgattttatttgtagtatatgtattaatgtaggaaccttaatttgtttttcaaattattattatttttgagatggagtctctcctgttgcccaggctggaatgcagtggcatgatcttggctcactgcaatctccgcctcctgggttcaagggattctcctgcctcagcctccccagtagctgggacgacagatgtgtgtcacaacgcccagctaatttttgtacttttagtagaaatgaggttgtaccatgtcggccaggctggttatttttcaaattattaataggttatttaataaacaatcttttttctattgtcttgggtttcctactttgtcatacattagattcttataaacagtccatttcaagttacttccttattacataaggaataattccttttataaaaaaattaatagatctattcttgcaatgctattgtgtaactttaattgttgatgccttagaatatgtatgcactggcatttgcctcccagaatattatttaacaatgtacatatcctatttatttctatacacaaaatcattttgacaagtaacaataaaactccaaaattctaagttaagtttaatgagaatatgtaatgtcatgaatatattagaagctaagtaaatggtactataatataaggtatcattttatgcacaaatgctaaaactgtggccttcctgaggacagaaagcctgattttaattattgttgtagcccctgcacctagaagaagatctgctatgccaggcacagtggcttgcacctgtcatcccagcactttgggaggctgaggcagttggatcacctgaggacaggagtttgagaccagcctagccaacatggtgaaaccccgtctctactaaaaatacaaaaattagccgggcgtggtggctcatgtctgtaattccagctactcgggaggctcaggtgcgagaactgcttgaatccaggaggcagaggttgcagtgagctgagattgcaccattgcactctagcctgggcaacagagcgagactcagtctcaaaaaaaaaaaaaaaaaaaaaaaaggctctggcctttggctctaattcttctgcttctcaaatactcattcaattctagtccttgaatctgtatgtggcctagaaccacctcttatagatgtggtgcttgcctaagttagaaagtgtcatctcgggaggggcacagtggctcatgcctgtaatcccagcactttgggaggccaaggtgggcagatcacatgaggtcaggaattcgagaccagcctggccaacatggtgaaacctcgtccctaataaaaatacaaaaattagctgggcatggtggtgcatgcctccagtcccagcttcttgggaggctaaggtaggagaatcacttgaacctgggaagtggaggttgcacagcctgagcgacagagtgagactctgtcaaaaaaaaaaaaagcgatctttctgggctctcaggttgcctttctgtgaattagaaaaggtccctttcctgggccaatgcaccccctcctcaccagggcacaaaatatggcaaggaaaggatcacctgaggacaggagtttgagacaagcctggccaacatggtgaaaccctgtctctattaaaaatacaaaaattagctgggtatgatggctcatgtctgtaattccagctacttgggaggctcaggttggagaactgcttgcaggcatccttgtccaagaattatgtaaggaagccctgatctatcctagactttgacacaaccctggtcctgaggcggcatccccacagaactcacaaaccaaacccaactccaggctcatcctaaggcaaaattttgacacagatctcatgatagatggtatctccccaggtccctttttagtgggaaagtctagctaggcatatccagaatgttctaagaagaggcaaactgcaaaagtcaatatacattttttttttttttgagatggggtctctctctatcccccaggctggactacagtggcgctatctctgcttactgcaagctccgcctcctgggttcatgccattctcctgcctcagcctcccaagtagctgggactacaggcgcccaccaccacacccagctaatttttttgtatttttagtagagatggggtttcaccgtgttattcaggacggtctcgatctcctgaccttgtgatccacccgcctcggcctcccaaagtgctgggattacaggcgtgagccaccacgcccggccaatatacacactattttgacttgacttgtctgagactgcttttctttcttcctttttttttttcttttttggagacagggtttccctctgttgcccaggctggagtgctatagctcactgcagcctccaccaacctcgacctcctggactcaagcgatactcctgtctcagcctcctgagtacctgagactacaggtgtgtgccaccatgcatggctaattttttttttttaaagaggtggggtctccctatgttgcccaggctggtcttgaactcctgagctcaatggatccttctgcctcggcctcccaaagagctgggattacaggcgtgagccaccgtacctggcctgagactgcttttcttagtggatacattttctagtagctgccagtttattaagcaggaatcttaagtgtacggaaatggccttggcacagtcgagccacacttaaaagaagctgttacccatatttggtctgtaccaccctgagtatcaacaaagcaaacttacgtttagggacataagcacattttattacctaacagccaagcgaagaataaagcaaatgtaagcaccacagttcaaatttgattaaagttcagtgttttctccaactgaaacaggtcctgatgagagcccatgattctgactaaaactgtgagagcaactttagcaacagattctgcttgctatagctctgccaagacaagtcccagcaacagaggcaattggttacttgcaggaaatctgggtcaaatctgcacttagaattggaaaaagaatggctttgtagcaatgtctatgggtagaatttggggtatctgcaaacttggagggcaaaaagaggcacacaaacaaacccaccctattttcactaacctctacgtgtaaaataggattttcttccatcataaatgtaggtgcaaaccacaacagtatcagtgatatctgtgactttatcaccacagatatttttatagcatattacagttgtggcagacatcttatccctcttagcactcctctcacccctacttcaaaatcgtggtacttattacatctgccacctgatcttatttaatgcagtactaaagaagtgcatgcattaattactatgtcatgattaaaaaatattttattactgtgattgtggtatagcaaaaaaaaatttttttttaataactgtacttcagcccagttggttttccctttaatcttatgtagtttattcagcacttaaaaaaaattattctgagaagggctcataggctatatcagactgccagaagaatctaggcacaaaaaaatttaagaactcctgttctacagagaaactaagattacatttaaaagctctaagctaataaaacaggtggatgaaatgtgctacccttgatcttagccaaaaggccgagaagcgatgatgaaatgtgcttgcctcatataccctaaacactttccatagcattaaaatatttcatggatggctaggtgtagtggctcatgcctataattccagcactttaggaggctgaggtggaaggatcccctgaacccaggaattcaagatgagcctgggcaacatagtgagatcccatctctacaaaaaaaatagaaaaaattagccgggtatggtggtgcatgcctgtagccacagctacttggtacgctgaagtgggaggatctcttgagtctggaaggttgaagctgcagtaagccatgatcctgccaccacactctaacctgggaaacagagcaagaccatgtctcaataaataaataaatatttatattttgtggatacctggatacaatttattcaatactatctctcaaaatacctttttcacaactacaattaaaaatgaattccttctcaccgactgccgccaatatggtgttcaggcacttcatggaggttggctgggcaacctacgtcgcctttggacctcatgctggaaaattcattgtgatcatagatgttattgatcagaacagggctttggttggtggaccttgcgctcaagtgaggagacaggccatgcctttcaagtacatgcagctcactgatttcatcctcaagtttccatacagtgcccaccagaagtatgtcccacaagcctggcagaaggtagacatcaatacaaaatgggcagccacacaatgggccaggaagattgaagccagagaaaggaaagccaagatgacagattctgatcattttaaagttatgaaggcaaagaaaatgagggacagaataatcaagaatgaagttaacaagcttcaaaaggaagctctcctgaaagcttctctcaaaaaagcacctgttgctaagggtgctgctgcagctgctgctaaatttccagcaaaaaagatgaccgctgtgggcaagaaggctccagcccagaaggttcctgcccagaaagccacaggccagaaggcagcacctcctccaaaagctcagaagggtcaaaaagctccagcccagaaagcccctgctccaaaggcatctggcaagaaagcatatgaggcaactataaaaacaataaaggttctttaaaaaaaacaaacaaaaaacaaaggccagccatggtggctcacgcctgtaatcccagtaccgtgggaggctgaggcaggtggatcacttgaggtcaggagtttgagaacagcctggccaatatggtgaaaccctatctctactaaaaatacaaaaaaattagctgggcatggtggtgcatgcctgtaatcccagctactcaggaggctgaggcaagagaactgcttgaacccgggaggtggaggttgtagtgagccgagatcacaccactgcactccagcctgggcgacagagtgagactcagtctcaaaaaaaaaaaaaaagaaaaagaaaaagaaaaaacagaacaataaaaattagccagacgtggtagtgggcacccataaccccaactacttgagaggctttggtgggagaattgcttgaacccaggagtcggaagttgcagtgagctgagatcataccactgcactccagctggggtgacagggtgagacttggtctcaaaaaaataaaaaataaaaaaacaggaattgcaacagaacaagaactgagcaaattacaacatgaattctgaattctgagttgcattatcttcctaatttaacatggttggaactaccttatatcagacacctttgggctcgtcagaaactagataactagattccttgtctggagtgcaggacagccctacttttttttttttttaaatcaagttctgccttagagaaagtgttaaaataactttgatacatacaattaaccctaggttttaaaataaatacttgctaaacagaagttttccgtaagggtttttaaaaaagagtcatctattagcggctgggcgtggtggctcacgcctgtaatcccagcagttagggaggccgaggcaagtggatcacgaggtcaggagttccagaccagcctggccaatatggtgaaaccccgtctctactaaaaatacaaaaattagctgggcatggtggcacgtgcctgtagtcccagctactcgggcggttgaggcagaagaatcacttgaacccaggaggtggaggttgtagtgagccaagatcgtgccactgcactccagcctgggcaacagagttagactccatctcaaaagaaaaaaagtcatctattaatttaattgtgatcttttttatatgcgcttgttagcctgtacatagctcaaatttatagcttcagaacactataacagatgttttaaatatctcattttctaccaacatgagaaatcctagatttctaaaacctagaggcagttaatatcatcctaaaggcaaagacaacgagaaaaagtaatataatatgttgttaaagtagccttttatataacataaatattttgaacaagatcaaagaaaccacctgatccacatttaatcaaaggactatttttttctaactacataagtggaaaagacttatcagaggaattttaaaattcctgtatcttatattttctctatcaggatccttactgatttaacttgtttcaacactaatgtaataaccttccacaaatgaaaggcttttttctgaaaaacaaattatacaacatatagcacaggtagatggaaaaaaactaaaaggatatgtgatagccatctctggatggtagaagatgaaaaaagacttagttttttcataatccttaaatatttttgtatgcacaaaagatcccttcaaagacaaaaagtggcccttacaaaaataacacatcaccagaatatactttctcaaactgagtgagtatcttttgtgactgctacttgcactgaagtctgcctctgactttatttttttgagatgggggtcctgctgtgtcgcccagggtgaagtacaacaggcacgatcatggctgattgcagccttgaactcttgggctcaagtgatcatcctgcctcagcttcctcagtagctgggatgaccggtgtgtgccaccacacccagctaatttttaaatttttcttttgtagagacagggtctcactatgttgactaggcaggtttcaaactcctgggctcaagcgatcctcccaactcagtgctgggattacaggcacgagccaccatgcccagccctgcctctgacttcaaggggtttacaatctagtggagaagataaggcacagatccatggtataattaaacaactaaaagatttagtcacaagacaaagggcaagatcaatacaatttttaggaattgagaaggagaaggctcagtgggggcctaagtgattgggcatgacctcaaagaggaagactgtaagccccatcagggcaggggccaccactgggttgtctgccagtgtatatgggtgtccagctcagggccaacttatataaatatttgttggtggagtaattaatggaggagagaatctggttttgaaggacagctttcaggagacagcaagaaacctactatagctagactaaaggaaaagaaggttcaggtaattctgggttataaactggtctttatactatgaataagtgggttttcaacttttctaataaacagaatgaaagtgtgtccttggaagagaaattaggcagtaactgtgctaggctacatggaggggtgataagaggtagcatgaccaccagcaagatattgctataaaatggcgtgagtttagaagggcctggcctggagcctaacagagaaatagaaggagcagaaactagaggtggaggaaaatttgctggcagatcctacagggaggaaagagaaaagggaaggatttcagtcctttccataattttgtgactggatgactgaaagaatgcttttaaacatttattaatccatccgtccatgcatctatgcatccatgcatccatgcatgcatgcatgcatccatccatccatccatccatccatccatccatccatccatccatccatccaacattcattgctgctaccgcatggggattctcaatcttataaaaaagagcaactctccctttccctaattacacctgtcagttgactgagtctctgatgtgttccaggatctatgcctgacactgggataggataataaagatggtctctacccggaagagatgagaaagaagaagataagtaaaagttaaggctgctctgataactacaagttaagaaaacagataagtctgttttcttcccattcttcccaacttcaaacaggatccagcctgataaactggccttgagtaaaatttacaagttttgtttgtttgttttttctgagacagagtcttgctctgtcacccaggctggagtgcagtggtacgatctcagctcactgcaacgtccacctcccaggttcaagtgattctcctgccttagcctcctgagtagctgggattataggcgcatgctaccacgcccagctaatttttgtttttttttgtagagacagggtttcaccatgtcggccaggctggtctcgaacttctgagctcaagcaatctgcccacctcagcttcccaaagtgttgggattacaggcgtgagccatcatgcccagccaaaatttataaatatttaggcttaaattatataaatcactgattttgttatacaactatatgcattcttttagatccggtttgaactgatcttaaaaaaatactaacaagaatgtaggtgtaagtgttttactaccatgcaggaagagattgcccaaatagaataccctatagaaacccaaagtaagtccagaaaagaaaacactggaagacaataccatggttatttgaacagcagtgacagactgctctatctggggatttccgctgatcttttctaaaaggattccagaagaaaccatcttatcttatcatctatgcatatctcagtgggaggcacaaacctacttacattgaatcaggcaggactccttccccttctcagcctgaaacttaaaacagcaaagttgccaggagttgcctcaaatgaatgaagtaccactcctgcctgctcttgtatattttgtgcatttggaatcaatccaaactccaaaatggaaataaaagtacttaacctcacaaagttgttggaggattaaatcatttgagctttattatccaaagtaattaacatgtttgaaagatgcaaatttaagacttaaaatccaactttaaaaaatctcagactgggcccagtggctcaggcctgtgatgccagcactttgggaggccaaggcaggaggatcacttgaccccaggagttcgagaccagcctgggcaacatggggaaaccctgtttttacataaaatttaaaaaaaaaaatctcagtgcctagacagcagtactttcacagcaacagtagatatgtcttgcaaagtaaagagtaatcagaacatcacaaaaatgagtactggaaaatcagaattttaaataaaaataaaaagcatcagttaacaggatggatcacttaaatacaaaaataaaaataaaaaagcaaatctttagtattgacctgcaaggttataggaatgtccttaggattataggaacataggtgcttcaattaaagctgtgtagccttgggaggacatttcacctttgtgcttgtgcctttctttttaggagaagatatcatctctaatataaatgttgtctcaatgtcattctttggacaaaaaacattttggctaaagagtttttttttttttttttttttgagagggaggttgctcttcctggctaggctagagtgcaatggtgcgatctcagctcaccacaacctctgcctctcgggttcaaacaattctgcctcagcctcctgagtagctgggattatgggcatgtgccaccatgcctggctgatttttgtatttttagtagagatggggtttctccatgttggtcaggctggtctcgaactcctgacctcaggtgatctgcccgcctcagcctcccaaagtgttgggattacaggcgtgagacaccacacctggtgagatgttttaaacctagcttaaaaccaatctaaattacttcctgaacagcttcaacatatccaaaactgacccagatattttggaggccactaaattatagatataagacacactccctgaactcaaggttggagaactgaagcaatcagagatggctacaaagagaatggacttctgacctgacttcaggtcaggcttaggggaaggaaagaattttaagcaatggaagaaaaggcataggatgaagaatacaaagtctactacgttctttaattttagtcctgatttcgtggccttgaataagccattcatcacttttcccccttcccaaatccaccagtatcgagggcctattatatataaggtattgtgcaacaattaacgaatggaaaagccgaggtgggcagatcatctgaggtcagaagtttgagaccaggctggccaacacagcaaaaccatatccctactaaaaatacaaaaattagccaggtatggtggcaggtgcctgtaatcccagctacttgggaggctgaggagggaggataacttgaacctggtaggcggaggttgcagtgagctgagattgtgccactgcactacagcctgggtaacaggcaagatttcatctcataaataaataaataaataacagaaaagatttcccaatctaagattaagtaagaggtagctcaaactaaaaataactccaagctcacatgatgttggtattataaaacaaaattcttcttcttttgtttaagagacggaattctcactgtcacccgggctgaagtgcagtagcatgaccatggctcactgtagcctcaaattcccgggctcaagcaatcctcccggctcagcctcctgagttgctgggttataggcataagccactacacctagttaaaatctattttagtaaagagagttttttaaaacctgcttttgtcatttcacactttctcaataaaaaacaaactaagcatgaaacctaaatttaacatatgtagactttttactacttagaacagtcgtagtgtgtaaaataaaataaataatatggccgggcaccgtggctcatgcttgtaatcccagcactttgggaggccaaggcaggcggatcacaaggtcaagagatcaagaccatcctggccaacatgttgaaaccccgtctctactaaaaatacaaaaaattagctgggcgtggtggcatacgcctgtagtcccagctactcgggaggctgaggcaggagaatctcttgaatccaggaggcggagtttgcagtgagctgagattgcaccactgcactccagcctggcaactgagcaagattccgtctcaaataaataaataaataaataaacaaataaataaataaataatatgtaaaaattaatctttgcactaaattttcagattcttgttccattcccctcccatttgaaactacagctgtcttttgccactaaaaacagtacttcatttgacagctatggaaagagcctatgccattcaatagctggtttatgagaagcactgagtttatctagcaaaaacacaacatgtgtatcagtacttccctttgtcctgtgtattctaaatctctgccaaaagcagaagtaagaaagtacagagggacaggatatccttaaattattcagttggctttatgtcattccagacagaaacctagtgcctgattcatccttagaaatttaaattaagggccagttgtggtggctcacgcctataatctcagcactttgggaggccaaggtcggcagatcacttgaggtcaggagtttgagaccaacctggccaacatggtgaaaccccgcctctactaaaaatacaaaaattagccgggcatggtggtgcacacctgtaatcccagctacacaggaggctgaggcaggagaatcgcttgaacctgggagatggaggctgcagtgagccaagatggcgccactgcactccagcctgtcctggggctaaaaggtaggtcttcctcgtgagcagtctgtcactaggcaagctttgaagtgctgaagccttttccctaaagagaaatgaggaaatcctggtttttcaggattcacctattatctccaatatagctcttggcttaagagagtgaagttaagaagaaaagcatggacaccatttcttaaggagagtaacagaaacccagtacctccaaatttacttatagaacacattgactttacggttgtggccacattttgacgttcttgtccattttgatacaattttaatgcgtattatatatgcatattaagtcactgtacatccaatacagttcagcaaatattccagagaccctagtagtaggtgttgggtaactatgtttggtactgagactacactagcctttttgtgatgccaaaccacttaatttcaataagcctgttatctcatctgtgaagataaaactgatatttgcaaggctatggtgaggatttaaagagccagtgaatataaaggcctgattacagcaagttccttcactcaaacacagtgtttttgcttttttctttccttcttttttccttactaaacagacatagctctataatcttgaagcttacagtctagtagaagatagactattatcataaggaaataactatcaggataagaatactactattactaataatagtaaaagctaatacttatgtagaacttgttataattaaagcattattcctgttttttttagacaggggtctatgtttcccaggatagtctcaaactcctgggctcaaagatcctcccgcctcagcctctccagtagctgggactacaggcgtgtccactgcacccagctacggtactattctaagcactgtccacatttagctcattaatcaaaccttataacaaccttctgaggcaagtaactagggctatgataatgctatataaatatgtgggagtgaccctctaaactccactctcgagtagttggggaacgtaccttcttggaattaataatattagccaggtgaaatgatgcacgggtatgggcttgggatggtcaaagatgttctgaattaaaaagcagctacatgtatgaatgccctgaggtgaaaatgcacacatggatggatgatcaaagaaccgaaagccgttcagttcaggcaacgtatatgtaaagtatataagcaatctacaaatccacgtattaggcaacgtggtgacgggggtgatatacaaagagaggcacccgagtttcataaaggcaagaagagttggctgatggataaaccaactgggtggttggcaaaatgctggagaagcccacctgtcagcaacagcctgtactgggggatcctctgaaccggcttgagcaggtagtgcttgagggccagattagcacagcgagggctcatctgaaaggagaaggcatctaaattaacacagtgttttctaagaagcaagggacccagattcaagtgctcaggaagccaaactttaaacatcaagcaactctggaaggagattcgtagagaggctcccttttattttaaggtacagctgttagatacactgagagtgaaccccagccagactgaccaccaacctccaccctttcctgtaggcagtccctgaaaccatttgctcctaggaaaaacttgttaacaaccctctcaaagagcgtggtagccacagtctgtgtcctaggctagttagagcccaccctactcagcagctcccacttgtattgataaatacaaacaaatcccaatggaccaagaaggaaatgcatggcccctaaaataaggcagtggaaatacaactgccaggaattggattcaaatgataatcagagccttgtggtcaatatagtcaaaataatggtggtggcagggagaactgtagaaagtaaagataacctgaaaagcggccttgctaagtatcccttctttaagaagtctgaagaatgtaaaagtcttttgcagatgaatggccttataaaaagatagcccccaaatcacagcatttataggaacatttgattatggaaccacattttggcttgactacaaagacatttggttatcccttgaaacctctcttccttagtatgtacaacagacatctatctcggcccattcctgagcctcaccctcattctccaacctaagagtttactgtgaggtggcatcaaaaaggccaagtgaaaatgtccctgcatcctaagaactacaaaaaagagtcacgcttctaacatagcgcaagttggttgataagttttgttagatttgctcagacttttatcattttctaaatatgtaccaccactatctggtacacagagtgattatgaaattataatgataatgcatgttaagaaagtatctttcatccaagcatcattaacccagattactaattctcctggccttatggctccccgttttcttttgctaacaaggtaacacaactcactggactcttaccaaaacctgggtcaatcatcagttgccacaattacattgcactttgttttttgatagcacaaagacaacagaggagaggaaaagaagaaaaaattacagatgactttaaaatttaattatttgtctattgcacaaatcagaaatcagcaataccatactattttaaaaacttttcattttggttgggtgaggtggctcactcttgtaatcccagcactttgagaggccaaggtgggtggatcatgagatcaggagttcgagaccagcctggccaacacagtgaaaccctgtctctactaaaaatacaaaaatcagctgggcatggtggcacatgcctgaaatcccagctactcgggaggctgaggcaggaaaatcacgtgaacctcggaggcagaggttgcagtgagccgagatcacaccactgcactccagcctgggcgacagagctagactccatctcaaaaaacaaaacaaaaacaaaaacaaacaaacaaaaaaaacccttttcacttctagttttgtgtgactggaattcaccgatcttttaagcttcaaaacagagaagtactaaaatacagtacgcaaattttactccaaactgatggaggggacttgtgattttatctctaattaaatcagggttccaccctcacagctctgagttaaaagtcaaagctttggctgacacatgctctgaacaggttattactttttcttaactttggcaccaaaaccatgttatttatttatctaaagggaaatataaattctatttcccatccatcattgtaagttaattgttaggataaaagaagaagttaaattaaaagttaagacatgttccttaatcaagttcattgagtcagaaagcagaatggtggttgccaagggctgggagggaagagagaatagagttaatgtttaatgcctatagagcttcagttttgcaagttgaaaagagttctggggatctggttgcacaagaatgtcaacgtacttaacattactgaactataaacttgaaaactgttaaaatgctaagtttgtgttgtatgtattttaccacagtttaaaaagtcccatcaaaatattctttccagctaggcacagtggctcacgcctgtaatcccagcactttgggaggccgagcagggtggatcacctgaggtcaggaattcgagaccagcctggccaatgtggtgaaaccccatctccactaaaaatacaaaaaattagccaggtgtggtggcacgtgcttgtaatcccaactactcgggaagctgaggcaggagaatcacttgaacctgggaggcggaggttgcagtgagccaatctacgtgcgaatgtactccagcctgggcaacagagcaagactctgtctcaaaaaaaaaattctttccaagtcaaaatattcccatgtgcaataacagattttcaaaattaagtcatgtacattcttgagttctcaccatttaaattgttcaattccatctttgattttgaagggattactttttaactttttctttgtttgcaagctttgttttcaatgactgcaacttgttattaaagcttcaacaacaaaaagaaagagaagtgttcaacattagatagtagcaaatacctcaaattctctaacaacagcagcaaaacctggatttttcttgcactgttcatccagcaaggctatattcttatcaaattctttgatgtatgtggaatacatttttagatatggtcccttctttacaaagatatcagcaattctttgttgttcagtcctatggatagagaagagatacacaaaaaaatataaagagagattgatgaacatatgcaatgatacgcagagtccacatctaagccgccaacttatctttttttctcttcttgtaagacatacctcaaaatgcctacttttcaccatttccactgccaccatcccatcttgcctggactctaactggtctccctgcttccattcttgccctctccaaaccattcttcaacacaaggagagactcttaaaaaatgtttaccatggctgggtgcagtggctcatacctgtaatcccagcactttgggagccgaggtgggcagatcaccagaggttaggagctcaagaccagcctgaccaacatggagaaacccagtctctaccaaaaatacaaaattagtcgggcatggtggtgcatgcctgtaatcccaagacaggagaattgtttgaacccgggagggggaggttgcagtgagccgagattgtgccactgcactccagtctgggcaacagagcaagattctgtctcaaaaataaataaataaataaataaataaataaataaataaataactcactcactccttggatgggcacgatggctcacgcctgtaatcccagcattttgggaggccgagacgggcagattacttctgatcaggagtttgagaccagcctggccaacatggtaaaaccctgcctctactaaaaatacaaatattagctgggcatggtggcaggcgcctgtaatcctaggtacttgggaggctgaggcaggagaatcgcttgaacccggtaggtagaggttgcagcgagccgagattgtgcccactgcactccagcctaggcgacagagtgagacaatgtctcaaaagaaaaagaaaaaaaaaaaaaaacttcttacctggcatacaaaggcctgccctttctgacccctgtcacacttctcttcctcttccccatttctctcccaccacactggccttctttatcttctttggagacatggaattcatttccactatgcagacttccactaatggttctacatgcctggaaatatagaaccctggctggctgctcctttcctttcagatatcactgtaaatatgccaccttcacagagggctttccctgaccactcaagcttcatttgctaccacagcgtcctatttcaggtctctgcaactcagaaactgcttctggtagttttcttgtctatttatctggtccttcccctactaaatgtctgctccatgaaagcaggatgtctgttttgtgcactgtgatatcctctgcatacttaagagcacagactagcacatagtagatatgcaaaccttcttgaatgtgaaaataaaatatttcatcaattgttgttaaaagccaatggaaaaatgttatttcagaaagtcaactaacaccaaagaatatgtattgacttgaaccctaagagaaaaatattttaataaatagaaaattaggctaggtgcagtggctcatgcctgtaatcctagcactttgggaggctgaggcgagaggatcacttgagcccaggagcacaagaccagccaaggaaacacagggcaacctgtctctacaaaaaattaaaaaaattagccaggcgtggtggggcacacctgcagtcccagctacttgggtgggtgaggtggaaggatcacttaagcctagggaagtcaaggctgcagtgagccatggtcacaccactgaactctggcctgggcaagaggtgaaaatctgtctcaaaaaaaaaaaatcggaagcaaataagccccaattttttttttttaacttaagaaaaaaaaaaagatttgttttttagtagagacaaggtttcaccatgttggccaggctggtctcaaactcctgacctcagcttatctgcctgtctcggcctcccaaaatactgggattaaaggtgtgagccacagcgcccagccagttatattttatttctatcatgactttttttttttttttaaaggagtctcgctctgtcacccagaatggagtgcagtggcacaatctcggctcactgcagcctccgcctcccagttcagcctcccgagtagttgggattacaggcatctgccatcatgtctggctaatttttgtaagtttactagagacgaggttttgccatgttggctaggctggtctcgagctcctgacctcaagtgacccacccgccgcagcctcccaaagtgctgggattacaggcatgagccaccgtgctcggcctatcacgacctttaaagactacattttagtcatttctcagtcctaaattgtgtattattttatacttaggctacggctatgtattaattgcttatctgccatatttacccaacatatagaggcaagatatttccaaaacaagcagaggtatttttctggtttatatataaagaaagcttagagaaattttgaacatgaaagtaggtgatactattttcttattctaatcatgttgtgttccccatggttttcaacagtaaattcaatcctcctacacccatctttctacattatttccacagaagtcaccaagcctctgcatacttattttcttcagcctagtggaagtagcttccaataccaaccttttggtattcttttcctattcttaaatctacagcttctacaagcatgtcatacatatataaatttgcctttctttgggaggccaaggcggatcacctgaggtcaggagttagagaccagcctgaccaatatgatgaaaccccgcctctactaaaaatacaaaaattagccaggcatggtggcatgcgcctgtaatcccagctacgcaggaggctgagacagaagaatcacttgaacctgggaggcagaggttgcagtgagctgcgatcgtgccattgcactccagcctgggcaacaagagtgaaactccatctcaaaagaaaaaaaaaattgcttttccaaaacaaccatcctattatttcagtgaacggcctctttttcaaaactggaaagggagtttcatgacctgcagctccagaaggtaaataaaacatttagaaactattctaatgtgaatatagcatatagcatctatctacactgaatctcaaaaatcttgattgcccaagttcacctatagaaatttaaatcggctgcatcttgcttctgaggcaggattacgaaagatttgtttaaaataatagtattgagcttggtgtgccaaggttgtgaattttgggccattgaaaataatcaatctggtcaggcatggtggctcacacctgtaatcccagcactttaggcagaggcaggcagatcacctgaggtcaggagttcgagaccagcctggccaacacggtgaaacctcatctctactaaaaatacaaaaaattagaaaggcgtggtggcacacgcctataatcccagctactcgggaggctgaggcagaagaaacgctggaacccgggaggcagaggttgcagtgagccgagattgtgccactgcacaccagcctgggcgacagaatgagaatctatctcaaaaacaaaaaacaaacaaaacaaaatcaatctatggataactgcaaagacaatatattcaaacaactcaatgtaatgaaaatatatctctgtcacatgtggggcccttatggcttcatctaaaattggaaacactaggaaaatctgaaaacggtccatttttaccagtgcaacattctttcctccagttccttcaagagatcccggttgagctcatacagctgaggcaagtagtataggatctgatttagaatccggtcctcaatcactggtttcccaagttgcctggaagcatgagctactgcatcccggaaatcctattacagtccagagcaggaaaaacaatacacacacatgtaacttgataacaagcttttatcctcagtccccctcctccctaaaatgatacagattgcacagctgtatttctcatgcagaattacaaatctaaagtacccccttcctcctaccccactcacctagataggaaattaaaaataaaaaatagtgagacgattatttgattttcaaacatactatatgatatttatcttaaaccttttagtttgatctctaaacttagcaattatactaagcgagtgtctggaaattgtaatgcaattctaaatagtctttagaattattccaataccatcaatataaacacaatccatttattttaaaagttcccaggagatcttagctaattttattctggatttaagagtcccactgtccactttcagtcatcatttcccaacaactggagcatcctaggtgaggcatgtggagagaggcacgtgttgtgggtctccctctgtcatccaggatggagcgcagtggcccaatctcagctcatggcaacttcccgagtagctgggactacaggcgcgtgccaccatgccaggctcacttttgtatttttttttttttttttgagatggagtctcgcactgtcacccacgctagagtacagtggcgcgatcttggctcactgcaacctccgcctcccgggttcaagctattctcctgcctcagcctcccgagtagctgggattacaggtgcccaccaccacacccagctgattttttgtatgtttttagtagagacggcgtttcaccatgttggccaggctggtctcgaattcctgaccttctgattcgcccgcctcagcctcccaaagtgctgggattacaagtgtgacccactgcacccagcccatttttctattttttgtagagacaaggtttcaccttgttgcccaggctggtcttgaactcctgagctcaagaaatcctcccactagggcctcccaaagtgctgtgattataggcatgagccaccgtgcctggcaggcacatgcttgataatcagaatcctggatccaagcctttgctccttatttactgtgtttccttgggccagcctgatttccctcatctgctaaatgagtataatactagttatgagactttaattagatattgcacataaaactttttttgcaatgcagttggcacacagaatgaaacattttaactctggacctgaaattctcccctccctcttgtcaacctctcaataaattcaccagggtttacacttttcacaaataagaatctttctcttcacctattatttttcatttactgttctctagactatctgtaccatgttttaatataggtcaatatcaccgcaccctattactccagagcacttggaaagggtggggtaggagataagtatttgcctagatttcattgtcccctaagggtgggcctcaagatataagtaaaacagagtgaaatctgttccacagtcctgaggattcaaaaacaaagattttttcctttttagaaacagcagttttaattaaaatctgaaagcaaagtttgggtaaatgactaataggccttatcttcccttacctttatttccaactgctttcccttcagggatttaccgggcaaatgaaatcaaccaaaaaagtatactgttccttccaatgatcctttcaacacctgcccctaacatacatatattaaccatgaggtttgtttttttttgttttttttttttttaactctggacaaccaaaaacctcatagataacttaaagtatatgaaaggattctttttctaaaggatggctattttgaagaagtccagtcctcttatgcttaatcaatgctaaaaaacctttcacttaggactcagtacctgggactaagtttattgatcccacagtcacattagcccaaaggagccaactactcacaccagtaactaaaggactaacttgtatacctaattagtatcatataaaataagagcatttaattctcatagtattataagctctaatccagaaaaccactcagaacatctccagaaaccaaatggatatcagccatatttcacctcccaacagcttgcttcaatcagcactcacatttactaagagaaaatagagccacttaacacttttgaaaatcattaggctgtctgctatcatgcagggctatagaatacatttacacatcatgaataatgtattcaaagcagaatagttaaacatcctctatggttatcttttttgcttttgttttgaccagtttagtgattaatataatctggatgcaagagttccttgctcagcaaagcaataagcgccaccctttcttctggtggagtaagtaatggctatatttgtctcctggcagcaggataacttttgtttcccagttggaaggtatttcctctgccatgacagtgacagtgatgttagctgctaagtaacttaaggacccggtttgacacagcttttgccagaccctgcattccatatgtctgccaccattgccaaaaagggaacttgtttatttaagacgcatttaacagagaccagccaaatacaaactgaactgaccagtgagatggctgcctctaaatggaggcccttgtcacacaccaggcaaaactctgcttttcccagtactactggatgttttcaggtagctcggaatggactgatggcccacaatgttttcttttaaattaaaagcagtatgtcagaataaaatagaaatttaataattaaaatagcagaagtacacttaataaaggctataagaattttgagagtatatatccatgaaacccacagagttactttttttttttgagacagagtttcactctggttgcccaggctggagtgcaatggcgtgatctcagctcaccacaacctccgcttcccgggttcaagcaattctcctgcctcagcctcttgagtagctgggattacaggcatgtgccaccacacctggctaattttgtatttttagtagagacagggtttctccatgttggtcaggctgggctcgaactcccaacctcaggtgattcacctgcctcggcctcccaaagtgctgggattataggcatgagccacggcgcccagcttacttttttttttgagaaagagttttgctcttgttgcccaggctggagtgcagtggtgcaatctcagctcactgcaacctccacctcccgagttcaagtgatttctcctgcctcagcctcccaagtagctgggattacaggcgcttgccaccacgcctggctaatttttgtatttttagtagatacggggatttcaccatgttggccagctggtctcgaactcctgacctcaggtgatctacctgcctcagcctctgaaagtgctgggattacaggcgtgagccaccgcacccggccttttttttttttttttttgcgacagagtctcgctctgtcgtccaggctggagtgtagtggtgcgatctcagctcactgcaacctccgactcccaggttcaagccattctcttgcctcatctcctgagtagctgggattataggtgtgtgccaccacatttggctaactttttgtatttttagtagagatggggtttcaccatgttggccagactggttttgaactcctggcctcaagtgatcttcctgtctcagcttcccaaagtgttgggattacaggcgtgagccattgtgtccaaccagagaattacatattctaagtaagcactcggcaaagattctgtactggtcaggttcctgaatcttttcttaggcccatctgtgcactttcttgtaaaatccagttttagcaagaacctcccaccctttatattgttcgggttcttcatcctctaccattgcccaggtgatgtatgatcaccctggctggtccgtcttcagcaagaatcctcttaagttggtttagccagaatctcccctgctcctgaagtttcttgttagtaattttccatccactaacgcccactttgctcctccttggctataaattcccacttgcccgtaatatatttggagttgagcccaatctctctccactactgcaaaatcccattgcagtggtccctatgtctgttgttttttgtttttgagatggagttttgctctgtcgtccaggctggagtgtggtacgatctcggctcactgcaacctctgctcttgggttcaagcgattctactgcctcagcctctcgagtagctgagattacaggcatatgccaccacgcccagctaatttttatatttttagtagatatggggtttcaccaggttggccagactggtctcgaactcctgacctcaagtgaaccacccaccttggcctcccaaagtgctgggattataggcacgagccactgcgccaggccccctatgccattgtgatagtcctgaataaagcctgccatactgtgcttttgcttcaacaagtgtcactgaataattgggctccactcccaattttggcctccataaccacatgcagcagccctggccccagtctcattccctcacctcttgggccaccatttcctgacagctgtgtgctacagccccaatgccagatgtaactaattcacacaggaaccacacgcagaatctttaacttctcagctcttcacgaacctcagccattgtcaaaactggtgccactgggaggaggtgacatcttttttttataaaaggattattacaacatatgtctggttatttttctaaatgttaacaaccaggataatttgggaaagtgtgatgacacttaaaagccagaggcaaagctattttgaggcagaagaatctaaattcactaacacctccttgacaaaatcggtgaggatgcaagacagcaggattagctcttcaaaagttagatccagagtttaatttttcacactggaaaagctgggtaaataaaatattaaaatagtggggggaggagttaagagtgtgaaaatgttagttagctatagagtttgttagcatcaagtacctcgacttcatccttacaacaaaacctaccaaagattctgcatgcaaaattgaaccacctacactgtagtttctggtcataataaccaaatgcttgtttaatgtggaatttgtagagctagaaatgggcctctgaattatgaagcatatgataatattattcttactaattccccaaaacctacaaatcagaatcagattaactttaagttgatctttaattcttttgagatattaacataccagcttggccagctcgaatcacttagggaagacctaagcaaaaaatcaatgcaaataaaatcaagtatgagcatctgaggcaatgaagcacaaaacagatggccttgttcatggggtcaggttttatatctccagcaccaatgaggggtatgtgacttaattaccagctgtcctgacccagctgcctgacctcagggcattactgaactactatcatgacacaatgaattacaaagaccaaatgaacatatggacagacatggagccctacaaggttccctgtcctcatgaaggacaccaggaatcacttcactttaagcaaaagcaaagcagctgtggaggtcaaagtgctatgataaatatgcagaaatgagtgtgaaactatggagtaaaagtagaggtgggaaagtccccacattaaccatttgactttgtttttaaaataaaaatattttcccaatgaaattattcttccctctctatatgtagacccagtgatacggtatataatcatcagtggtgcataatcatcaatgcaaaactgtagaaaacataattgaaagcaatcttttatgtctagtttccaatctcctttaataacactaacaagtaatcatcataataactctaagtgaccaaaatctagcttcattgtcatctttagaagatgaaaaataagtttctctggtttccagggcaactaaaagaattctgaaagcaagctaatatatccaaagatacactatatcctatacagcatggtagagatttcaagtaataattttcaatcaattgctaaagaacaactaagtacaagggctcagacagaccagacttgaaagtctggttttcctattaagtagtgggttatttttgacagttagcttactttcttcattgaaaaaaataggaataacatctatttgacagggttgttacgaggattaaaacagataattgatgtaacatagcatgctgcaaggaacatagagagcacttaatagaacaccatttatttaactaaaggggatttggttaagttaaatgattagatgaacatcatttaagatccacaagtcaccttccctccctctctccacaagtccctgaaggcttggaaagacagctgtgaaacagaggcatctaaagagaaggaaataccaaaccaaggtagggaaaacacctcagcagcaaaacaaaggtactctgaacaatgagcttcattcagtgaagaacagttctcacatgaaagaagctgctccagagtgaaggtttggtagccatgtcaacagaagctagagaaagattctttacaactaaagaaaaaatgctgaaaatggttcacaagactcaaaagtcagggtgtattcagtgaaacagcatgaagtgattttaacatggaaaaaaaaatgagaactgagaaagtcttctattccttttacaatgcaaaaaaaaaaaaaaatctatttagtaacagacatctggatccaggcctagggtagccttgcctctggctctatggattttattgagtctctcaaattttcaaggaaatgtacgtctccacctaaagaaattagtgaagcaaagatgcttcattactaatactatatagccagtccatctttgtctaaaaaatcccttccaaatatatatataatataatatatagcatatattatattatatattatataatatatagcatatattatattatatattatatattatataatacatagcatatattatataatacatagcatgttatatatattatataatacatagcatatgttatattatatatattatatattatataatacatagcatatgttatattatatatattatatattatataatacatagcatatgttatattacatatattatatattatataatacatagcatatgttatattacatatattatatattatataatacatagcatatgttatattacatatattatatatattatataatatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatatatattatataagatatagcatatattatataatatatagcatatattatatattatataatatatagcatatataatattatatattatataatatatagcatatataatattatatattatataatatatagcatatatattatataatatatagcatatatattatatattatattacatatagcatatataatattatatataatatattatattatatagcatatattatataatatattatataatatatagcatatattatattatatatagcacatattttatatatatagcatatattacataatatatagcatactatataatatatagcatatattatatataatacatagtatattatacatcacatagtatatatcacatatattatacataatatatagtatattatatatagttttatatagtattatatatatataatatatatagtataatatgtataagaatcccttgagcctagaagttcaaaactgtagtgagctgattgcaccactgcactctagcatggatgacacagcaaacccttttttcaaaaaaaaaggacaatattttgtcaccctaacaaatttgttgagtgtcaagcttattgtcatttcatataaattatgtttgataaataagtgactatacatatagtattatatatagtatatatagtatattatatgatatataatactatataatagtaatcattatatataatatatagtacatatactatataaaatatgtataatatataatagattgctatactacatatcacatacactatactatataattatatatacaatacaaagtatattatatatactacatatcatactatatattatatagtatactatatatgctatatattacacacacacacacacacacacacacacacacacacacactttttttttttgagagggagtttcgctcttgttgcccaggctggagtgcaatggcacaatctcgactcaccgcaacctctgcctcctgggttcaagggattctcctgcctcagcctccagagtagctgggattacagacatgtgccaccacgcccggctaatttttgtatttttagtagagacggggtttctccatgttggtcaggctgtctcgaactcctgacctcatgtgatccgcctgccctggcctcccaaggtgctgggattacaggcatgagccaccgtacccggcccaaatatttttttaaatgcagactatttgtacgtttacataatatttttattgagatatttactaaggctagctcccatcagagagcaataagacaaccaaaaaccttcctattaacttgtacttaattatatcagatgtctacggtgtggtggggatgttcagggcagagcagcaaatatacaagaaattcattttgaaaagccacttatttattaaacatattataatttatatgaaatgacagtaagcttgccactcaataaatttgttagggtgacaaaacattgtccttttttttttggaaaaagggtttgctgtgtcatccatgctagagtgcagtggtgcaatcagctcactgcagttttgaactcctaggctcaagggattcttttggctcagcctcctgaataggtgggattataagtgtgtgctacccatgcctagctttgtcctatcattaaaaaaagaaaatctattacaaaagagaactggctgggcatagtggctcatgcctgtaattccagaactttgggaggctgaggtgggcagattgctcaggagttcgagaccagcctgggcaacatggctaaaacccatctccactaaaaatacaacaaattagcctggcgtggtggatggctgtggtcccagctactcaggaggctgagatgggaggatcgcttgagcccaggaggtagagcttgcagtgagtggaaatcatgccaccgcactccagcctgggtgacaaagtgagacactgagtcattaaaaaaaaggagagagagaggaagagagaacttatcaatattaccaatatagccaaaaatcaatgtgagaaactattcacagggaaatattttctcaaaacacattagcaatgttaagaatttttaaagaatttccaaagctacagatttttcacataggaatcaggcccctatttttgttttgttttgttttgagacagagtcttgatctgtcacccatgttggagtgcagtggtaccatcttggctcactgcaacctctgcctcctgggttcaagtgattctcctgcctcagcctcctgagtagctaggactacaggcatgccaccacacctggctaatttttgtattttagcggagatgggttttagccatgttggccaggctggtttcaaactcctgacctcaggtgatctacccgcttcagcctcccacagtgctgggattacagtcatgagccaccacaccatgccaggcccctgggtttctgttggaccaagtacagagcacaggtaatcatttagtgaatgtgaatcatgcctaagtgtaacttacttttcatgtttgtatgtatccattcaaagaaaacctgaaaataatgatactgtttgccaagacttaaatggatgtatatttggtgaacctttcatttctccacaattaagcctaatttatgatgttaataattacaccacataagtaaactgtcacttcaactccttttttcattttcatctaccttttccttttgttttacccctttcttaagtcttaatatcttgcctaaatataattgaaataaagtaaccctaaaagcactttaactgtcaatgcataatgaaacttgtgaaaacctgcaaggacaaaggagtgcatgagaaaaatgaatatgcaccctgacacatatcataattctttcctaacaagtctgttcaagttgacaattataggctggctgcagtggctcatgtcagtaatcccagcactttaggaggccaaggcgggttgatcacttgagcccatgagtttgagatcagcccgggtaacatgttgaaaccccatctctacaaaaaatacaaaatttagctgggcatggtggtgagtgcctgtagtcccagctgctcaggagcctgaggtaggagaattgcctgaacccaggaggttgaaaggctgcagtgagctaagatcgcaccactgcaccctagcctgggcaacagaataagatgctctctcaaatcaaaaaaacaaaaaaaagttgaccatttaaaaaacagaaaatagaactaaaacttagttgtaaaaatgtctatttctaatctctcctaaatggaggtagtaaaaggaaaaatagtaagaaaattgcctatttcaaatctgtttctgggagcttatttaggtaggagaaaaacacttttggacaatgataatgatgctcttcatgtattgctaatgcaaaactctaacagcaagtatcttcagcaaatgcctaagaaaatatattatcaccttcaaaactgttatgaagacataaagtttgaagactttggacatatagctactaagactctttcagaaatcatgttatctacatatatgaaatacatacattttagaaaatgtctatcattaagttagtaatgctgaaaacttctaggggtagggaaagtacaaaagggaatagtcttagacttcaagaaaatattagcagatacttacaatatgcaaaagttttaacacatccacaaacctgtaaaaaacaacaatgaaaaaaatgttttaaatgtgccaatggggggaaaacagtcttctgaattgtaaactagatacctacactttctctgagctcatgatctccttggcaatatgatgaactttacttttcattccattatcttcatcctgtggataagagcacatttaacatgaactcataaaagaataatgaagatcagctatgagctagtcagacacgaattttaactctgatacttgtaagtttcctcctagcacacagttcataccatataacatttcaaatggcaaacgtggagaattggatgagggataaaccatgtcacaggaatagctgagagcaatcagtaatcttcactgtcattagctggattgatgaactgccctgagtagctccagaaccttgctgggatgcaaccatcagtggttcaaaatggaagtcacaaactaaaaaggctacaggggaagtggccccttacagatagataccagaagaagactcctttgggtgtgtacaaataatttaagaatttggctgggtgcagtggctcacgcctgtaatcccaacactttgggaggccgaggcgggtggatcacctgaggttgggagttcaagaccagcctgaccaacatggagaaaccccgcctccactaaaaatacaaaattagctgggcatggtggctcatgcctgtaatcccagctgctcgggagtctgaggcaggagaattgcttgaactcagaaggcagaggttgcagtgagccgagatcgcgccattgcactatagcctgggcaacaagggtgaaactctgtctcaaaaacaaaaacaaacaaacaaacaaaaataattagttaatatccaataggaatgtagatgagaacttcaccataagtaaaggtattttaactcacaacttaaatatagtctgaacagggctcttcttcaatctataacaaatataagtcaaaattacagtcacaggctctccgaatttccttaaaatcccttttagatatatgcttagagagtcaaggcagttttatgctaaggagctgaaatgaaattcgtgtgtgtgtgtgtgtgtgtgtgtgtgtgtgtgtgagtgagagagagaagagacagagagagagagagacagagtctcgctctgctgcccaggctggagtgcagtggtgtgatctcagctcactgcaacctctgcctccggggttcgagagattctcctgcctcagcctcccgagtagctgggactacaggtgcgtgccatcacgcctggctaatttttttgtacttttagtagagacggggtttcaccatgttagccaggatggtctcgatctcctgaccttgtgatctgtccaccttggccttccaaagtgttgggattacaggtgtgagccactgtgcccggccatgaaattcttttattatggactactttgtataaaaactaaatgccctagcaggaacaaaaaaaatgtgcatctttaacaaaataataataaagatgactcaaaaagaggtctcagtatttaggtgaatttgttgttgttgttttcaataaaatatcgagagttggatttagttccagggaaatcagagaaaaggagagaagcttctctccatttatgttccagttcaagatcagaacactacagttccacagtaaagaccaaaaagagtaaataaggaacaagcaagtataaattttagatgttacacctaaggtgaaaatgatgactgctgacattaaaacgaaaatgcttggatgtttctttgaagaaacgtcagacctggttttagaaagaggtctctttgcattctcgtaggcactggcaacaccaggacacggttattttgtgctgaccagggtgcagctggacaaggcaatgacatgataaacattaaaaatgaccatgacagtccagcagtcattcattaatgaaatgccacaggaaaaaaaaatatggtagcaacttctctctaaagtagtcttctttttaacattggaatcatggatctagcagatctgtttccctgagactcactgtgatggatcacatgactatgttagttcttcatttgggaaaatttttttttcttttttctaagtttccacatacaacactgagggaaaaaacttttttcgactgcttccagaatttcagtgtcacaaccaaggtaaaaaaatagatgcaggtttaacaatgaaacccttctgaaaattacattttaataaattaaaaaaaatatgactatatatgttccatacatacactgaaacccttttatttgttactttattaaagcatgggtgatgttcaagtgaataaatgaggagaggattcctcaaggttttatagtatgttaaaatttagatttttaaaaactgtaatcaggccgggcgcactggctcacacctgtaattccagcactttggcaggccgaggcaggtgggtcacctgaggtcaggagttcgagaccagcctgactaacaaggggaaaccccatctctactaaaaatacaaaaaattagctgggtgtggtggcgcatgcctgtagtcccagctactcgggaggctgaggcaggagaatcgcttgaacctgggaggtggaggttgcagtgagccgagatggtgccactgcactctagcctgcgcaagaaaagtgaaactctgtctcaaaacaaaacaaaacaaaaaacaaaaaaaacctgcaatcacttctatgctcacaagaagtcagagaactataggggaaagttttatttttgcattcattctttttattatattgagaaccattagaatcataaatagtagtcagtcattagagtgaatgaagtcaaacacagggactacgtaaagtgagagttggaccaagagcacagtcccaaagaacacccacttaaaatagggatttgccaagactcaaagttgactatttgttgtgggaagtcaggaaccccaaatggagggactggctgaagccatggcagaagaacataaattgtgaagatttcacggacatttattagttccccaaaattaatacttttataatttcttatgcctgtctttactgcaatctctgaacataaattgtgaagatttcatggacacttatcacttccccagtcaatacccttgtgatttcctatgcctgtctttactttaatctcttaatcccgtcaccttcgtaagctgagggggatgtatgttgcctcaggaccctgtgatgattgtgttaactgcacaaattgtttgtagagcatgtgtgtttgaacaatataaaatctgggcaccttgaaaaaagaacagggtaacagcaatgttcagggaacaagagagataactttaaactctgactgccagtgagctgggaggaacagagccatatttctattctttcaaaagcaaatgggagaaatatcgctgaattctttttctcagcaaggaacatccctgagaaagagaatgcatccctgagggtgggcctctgaaatggctgcttcggggccggcagtcttttatggtcaagctgtagggatgaaataaaccccagtctcccatagcgctcccaggcttattaggacaaggaaattcccgcctaaaaaatttttggtcagaccggttgtctgctctcaaaccctgtctcctgataagatgttatcaatgacaatgtgtgcccgaaacttcattagcaattttaatttcgccccgtcctgtggtcctgtgatctcgccctgcctccatttgccttgtgatattctattaccttgtgaagcatgtgatctctgtgacccacaccctatttgtacactcccacccctgtagaaatcactaataaaaacttgctggttttacggctcagggggcatcacagaacctgccgacatgtgatgtctcccccggacactcagctttaaaatttcccacttctgtactctatccctttatttctcagaccagccaacatttagggaaaatgaaaacaacctacgtgaaatattgggggtgaattccgcccaatatctggctgaatttcccccaataactattagcacagttggaaaaagaacccagatttcccaatatttaacctacaaataattttattacaccttgaatctctcttcaatatctgccagtaatctcagcatatccttacaaataattactgctaaacctaatacccacacatccactctcccaccaagatttaacaaatccaaacattctgaaatacttgttttaaatctttctgtgaaacaaattgttaaattatgatattaaagttctcttcttcctctgacagaagtagccactaatcttacagtttgtgtatatttgtcccttcatgttttcttactttactacagaataatttatatgcaataccaagaaatcctgacccttccataagaatataaatactgggctgggtgcggtggctgacgcctgtaatcccagcactttgggaggctgaggtgggtggatcacctgaggtcaggagatagagaccagcttggccaacatggtgaaaccccgtctctactaagagtaccaaattaccctggcatggtggcagatgcctgtaatcccagccacttgggaggctgaggcaggagaatcacttgaacccaggaggcagaggttgcagtgagtcatgatcgtgccactgcactccagcctaggcgacaagagcaaaactctgtctcaaaaaaaaaaaaaaaaagaatataaatactgttatgcaaaaaatattcaaagaaggttgtgaaaccaactacttgtgaaaataatctttaaatggattactaattcagagtccagtctaatgagcctaggatacttttttcatgctactttaccttagctctcaaactctactgctaaaaggacaattagatagacagatgaatatgacctctattcctgttattattcctctttcctaatgatggagactaccaggttggatatgttttactcaactacattcactcactttttgttttgagacagagtctcgttctgtcgccaggctggagtgcagtggtgcaatctcagctcactgtaacctccacctcccgggttcaagcgattttcctgccttagcctcccgagtagctggaactacaggcatgcactactacactcagctaatttttgtatttttagtagagattgggtttgaccatgttggccagcatggtctcgatctcctgacctcgtgatccacctgtctcagcctcccaaagtgcttgctgggattacaggcatgagccaccgtgcctggccatacattcactcacttttttttttttttttttttttttaacacagggtctcactgttggtcaggctggagtgcagtggcgtgatcttggctcactgcaatctccgcctcttgggttcaagcgattctcctgcctcagcctcctgagtagctgggactacaggtgtgtgccaccatgcacggctaattttttttttttttgtatttttagtagagacggggtttcaccgtgttagccaggatggtctcgatctcctggccttctgatctgcctgcctcagcctcccaaagtgctgggattagaggcatgatcactcaccttttaaactacacatagctatattcctcaggaagactgcagtcttaagcacagtctgaccttgacctggcagaccacatatcaggcactaaataatcatgattacataagtgtctacacacacatacacacacacacacggataactgttattttgaaaacatattttagcaagtccaaacttttctatcacaatggggttctccatataatctgtagatagaaaagtttaatgtttacaaaatacagtgtataaattttaaattagaaatgggcttggcatggtggttcatgtctgtaatcccagcactttgagaggccaaggtgggaggattgcttgagcccaggagtttgagaccagtctgggcaacataatgagaccatgtcgttagtaaaaataataataataataataataacataaataaaattaaaattacaaatgcattataagtgagaaaaacagaaaccaaaaccattcagggaactgaagccctgactcttcatttccaaataatgtgacatcccttaaaggtcaagagcggatcttatcagtagctttaaagaaatgcaggcacactatagatgtggaagcatttgactactggagtcagctaaaatgtgcacgagctcgacacaaaaatttcaagtagctgttaatttatttttggcacctaccctttgtttcctctcctctttttatcactctccttttgttaggtctctactctgtaacttttttttctctccttctcaggaccttgctctgccagggcctgcattacacagacttgtgtagaggaggctactccatacaaaaattaactaaaaatgtgaaaactgtaaaacttctagaagaaaacattttaaaaaatccttatgatcttgaattaggcagagttattagatatgacaccaaaagcataactcatgaaagaaaaaaactgataaatggaacttcataaattgttcatgcttcaaaagacatcattaagaagataaaaagataaaccatagactggagaaaatattcgcaaatcatgattctgagagagaattcgtagctagaatacattaagaactctgatagggctgggagtgttggctcatgcctgcaatctcatattttgggaggccaaggcaggcagattgcttgaacacaggagttcgagacctgggcaacagggtaaaaccctctctctacagacaatacaaaaattagctgggcatggtggtgcacacatgtagtcccagctactcaggaggctgaggtaagaggatcactgaacccaggaggttgaggctgtggtgagccatgattgagccactgcactccagccttggcaacatagcaagaccctgtctttacaaaataaaaaaataaaaaacaattagccaggcataatggcacacacctgtagtcccagctacttgggaggctgaggtaggaggatcacttgagcccaggagtttgaggctgcagtgagctatcatcacaatattgcactctagtttgggtgacagggtgagaacctgtctcttaaaaaaaaaaaaacaaaaccaaactctgataactcaatataactcaaacaaaaaggctgtgtgcggtggctcacgcttgtaaccctagcaatttgggaggctgaggtgggaggatcacttgagcacaggagtttgagaccagcctgggtaacaaagcaagacctcatttctattttttttttaattaaaaaaagagataaaagatgtgaatatgtgaagaaacatttcacagaagaagatataagaatgggcaataagtatataaaaacttgttcaacatagttattagggaaatgtaaattaaaaccacaatgatatacttcacacccacacaatggctataataaaaaaacaaacaaacagtaaatacctagtgttggtgaggatgtggaccaactggaacctttatatattgttggtgggcatggtagcccctactcatacggtgtgaaaaatgaaaaatagctcagagcaaactgagctatgtgaggtatgcaaaatttatcaggcccagagaaacatgggtatgagacttcagtgatggcccaacccccatgcccaggtgcaactgtttgaaggcatttttgtccctgaccagctgcctccacccatagtctccatgttcctagaatttgtgaaacaaagaacaatgtaaagtcaatcaaacagcttatgatattttaatataaattactgacaaacaacttaggaattgcctcttcttttcctttaaaaaacccacctgtgtgggaggctgaggcaggagaatcgcttgaacccaggaggcagaggttgctgtgagccaagatcatgccattgcactccagcctgggtgacgagagcaaaactctgtctcaaaaaaacaaaacaaacaaacaaagaacccacttgtggccaggcatggtggctcatgcctgtaatctcagcacttttggccaaggcagccggatcacttgaggtcaggagttcaagaccaggctggccaacatggtgaaaccccgtctccaccaaaaatacaaaaattagctgggcatggtggcacacacccgtaatcccagctacttgggaggctgagacaggagaattgcttaaaccaaggagatggaggatgcagtgagccaaaattgcatcactgcactccagcctggatgacacattgaaacttcatctcaaaaacaaaaacaaaaacaaaaacacccacttgtggctgggccaagtggctcacacctgtaatcccagcactttgggaggccaaggtgagcggatcacttgaggtcaggaatttgagaccagcctggccaacatggtaaaaccccgtctccactaaaaatacaaaaattagccaggcgtagtggcaagtgcctgtaatcccagctactaggtagcctaaggcaggagaatcactagaacccaggaggcagaggttgcagtgagccgagatcacaccactgtactccagcctgggcaaaagagcaagactctgtctcaaaaacaaaacaaaacaaaaaacccacttgtaactgctcctaacaggagtcttggatctatgctccaggcttgtagtcctcaaatttgacccaaataaactctctacttacattaagtttgctcattttttttcccattaggtcgacagggttttcttctgtctcctaatgtcactgagcacagaattcatatttcttctccttgttattctgagatcattttcaagagaaagatgtcagtaccatctttacactttcattttaaaatctgaagttagtaactgactttctgtcatttgatagcaaagttaataagaaaaaactgttctaccacccgcccattcactgctctacatataaatttgaaaacattagtgatcattagaatcacaggcagatcttaaatttcagattcccaggtactgtcttagaaattctgattgtgtaggtctaaaatggagcattaaaagtaggtgttagaagaaggaattacacagggcaccatggttcacatttgtaatctcaacattttgggaggcaggaggatcacttgaggccaggaattcaaggccagcaaggacaacatagtgacacctgaaaaatacaaaaaaaaaaaaaaaaaaagccaggcatggtggcatgtgcctgtagttcctaatcacttgagagactgaggtaggaggatcacatgagcccaggagttcaaggctgcaggggactatgataaataagaatagccccagttggccaggtgcggtggctcacacctgtaatcccagcactttgggaggctgagacaggtggatcacttgaggccaggagttcaagaccaacctggccaacatggtgtaaccctgtctctactgaaaatacaaaaactagctgggcgccgacagtggtgcatacctgtagtcccagctacttgggaggctgaagcatgagagtcacttaaacctgagaggcggaggctgcagtaagtcaagattgcgccactgtactctccagcctgggtgacagagtgagattctgtctaaaaattgaatgaataaataaataaatagccccagccttcaagaagtgaacaatggaaacgaactgaacatacaaataactacatataagcacaactatgaaaagtgctgccaccttgaagaagagaaagaccataatcaggcagaggtgtgtcaatcaggaaaggcttcacaaagaataaagcatttgatgactccaaatcaccgtttaaacacaatccatcagctactcctatactagctactgtagataccaactcattaatgccagaaacctggactcttcttttttgtccccatagtcaccttttattattacaactgagtcaagtcctatcaatgtgtcccgaagatttaaagcttaaatgatcctttcctctcctttgatgttgcctccttacctcttgccctcactattacagcaacctaaaaggtttccttggctctgtgtttaccccactgcaaccccttctgtacactgccactagaatatttctaaaatgcaaatataaccaggttagttctcaggctaaatgttagcagctccctatcacagatggataacaaagattcaagtttctttcgccaagggtattaggcatttctcaacatgtccactcaccttcaccaggcttctccctcctcctccacactgtgtactctctaacccaccacgctgcaactccagccatgctctccccttctgtgtctgtccctttgcgcatatacctttccttttgccttgacttgcttccccagcacttctccttctccctgaagatttctgcctttcatattccaaacgtcctttaagacaacactccaactttttttttatgatggctcccttgacattctttccctcctactatcaaaggacaagataattttcttattcatgtaatatttataggacttaacccagtagactgtgtttacttgctgaaatgtctgaattccctctagtctccgatctaattcaccctgtatccttctgcacatagcacgctgcttggtccactgtgcaattaatatttacgaataagcaaatgtgtataaggatggctgccaccttctcagaatctgagacagagcatattgcttttgaagatgtgttgcataacacaaaaatgcaaactcgaatgaactaaaagctttaatcacataaaagagtaggaggttggactaaatgattaaggtcttttccaattctaaggttctaggagtctatatattccattgtccattttaccttctaaaccaggaaagctacagagctaaataaagaggtataaaaattattagaaataagtcaatggattataatcatcttcaaagtggacagaaagtcaaatataaattaaaaaaaaattaaaagctctatattatctccaacttgtaagaacaatgactgattgtgacccaagtcaaacagcgatggaaaaacacacaccccatggcatctcaacttttcagctaatgaaaatcctcacttaaattacattgcatttcaaagcagttccctgttaaataacagcgtctcccaaaagtacactgttgtggaagttgaaacatgagccacaaatgaaataactttgtcaaggtcataaaataagtcaaacaaattccaaaacagaacctttgatctgaaatctagttttatgttccaatctcttgacgctagcccagctttgtaaattctttttttttttttccttcctttttttttttttgagacggagtctcgctctgtcacccaggctggagtgcagtggcacgatctcggctcacggcaagctccgcctccctggttcacgccattctcctgcctcagcagctttgtaaattcttaattgtgttcttatcatatgtgttcactacaagtgacattcagtgaaatttatccattccttttttttttgagacagagtcttgctctatcacccaggctggactgcagtggcgggaatctcagctcactgcaacctccacctcccgggttcaagcaattctcctgcttcagtctcccgagcagctgggactacaggtacacactgctgtgcctagctaatttttgtatttttagtagagatggagtttcaccatgttggccaggctggtctcgaacttctgacctcaagtgatccacccacctggacctcccatagtgctgggattacaggcaggaggcaccatgcccagcctatccattactttttaatagaattattaaaaggcctcttctatcctactctagagttctaataaaaaacaaaaaatgttaacatccagactgcctgagaaacatctctttatcattaagttatttcaaaaatgaggtgacatcatgattaatctctaaacaatgctctcttaggttttcgccctttctttatgaaagtatgtatcatatgagctactttacaaagattttttaaaaaaacaaggaaatcaatatataagaaagatgaagacgatgaatattctaaccacaaacaagtagaataaatacatcttactttttaaacaagcatttaagccctgaaaggaaagaccaaaaactataaaaataaaaatttagaaaagggaacaggacagatcagcatggctaggtatttcacctcaacatgtttcattgacatcattcagcttccatggctgtaccaagttgttagtagagacagattgggttaaaaaccccaacttggggttccaaggcaagttacttaacttgtataagactccttttcttcatgcaacatgaagaaaaacagtacctatgtcagatgtgtatcaattttctttttttcttttttttttttttgagacagtgtttcactcttgtagcccaggctggagagcaatggtgcgatctcggctcactgcaacctccgcctcctgggttcaagggattctactacctcagcctcctgagtagctgggattacaggcatgcaccaccacgcctggctaattttttttatttttagtagagacaggttggtttctccatggtggtcaggctggtctcgaactcccgacctcaggtgatccgccagcctcagcctcccaaagtgctaagattacaggcatgagccaccgcgcccggccaattttgttttttcctaagtgagatgaggcctccctgttgcccaggctggaatgctgtggcatgacctccactcactgcaacctccatttcctaggttcaagtgatccttccactttagcctcctgagtagctgggactacaggcatgaaccaccatacctggctaattttttgtgtctgttttttttttgtaggcatggggttttgccatgttgtccagattggtctcgaactcctgggctcaagagatctgtccacctcagcctcccaaagtcctgagattacaggtgtgagccaccatgcctggcttgttttttctttttctgttttttttttttttttcaatagggtcttgctctgttgctcaggctggagtgcagactggagtgcagtggcctgaatatagctcactgtagcttcaacttcccaggggcttgccccaccacacctggctaatcttgtttattttttgtagagacaaggtctcactatgttgcccagcctggtctcaagctatcctccttccttggcctcccaaagtgctaggattataggcatgagccaccatacccagcctgatatcaccgacttttcctgagttgctagaaagccaaatttgtggcccatcctcagctaatgaataggactacatgatatacattactctgtacaaatcttccattagcactattgtttttccttcagcaaggtttattttataacagctttgttgagatataattcatatactacaaaataggtttttacccttttaaagcatacaattcaggccaggtgcagtggcccatgcctataatcccaacactttgggaggccaaggcaggaggattgcttgaagccaggagttggatgccagcctgggcaacatggcaagaccatgtctttaaaaaaaaaaattagccgggcatggttgtgtatacctgtaatcctagctactaaggaggaagggacgagagatcacttgagtcaaggaggttgaagctgcagtgagccatgatctcactactgcactccagcctgggtgacagagcgagaccccatctcaaaaaaaataaataaataaataaaaagaaactccatgcccattatcagtcattcctcattcctattttatggctgaatagtattccattgtaggaatataaagcatttagtttatccactcatcatttgattagtatttgggttctttctacttttttttttttttttttttgagtcagagtctcactctgttggccaggatggagtacagtggcatgaccttggcttgctgcaacctctacctcccgggttcaagcaattctcctgcctcagcctcccaagtagctggaattacagatgtgcaccaccacacctggctaatttatgtacttttagtagagacgggatttcaccatgttggtcaagctgctcccgaactcctgacctagtgatctgcccaccttggcctcgcaaagtgctgggattacaggcatgagccactgcacctggccctttctacttttttgactattatgaataatgctgttatgaacattcctctacaagtttttgtgtggacatatgctttcatatctcttgggtggatacctaagagtagcattgctaggtcatatggtaactctacatttaaacttttcagagctgccagactgttttccaaagtggctgcaccattttagatcctataaggactcccatttctccacatcctgactagcagttgttactgtacatcttcttgattatggctaccctagtgggtgtgcagtggtacctcactgaagcattgctttgtatttctttaacggcttatgatgttgaacacctttttacatctttattggccactgtatatcttctttagtctattcagattcttaagcctgggtgattgatctttttactgtttgaggtttttttttttttttgagatggagtctagctctgtcacccaggttggactgcaatggtgtgatctcggctcactgcaacctccgcaacccgggttcaagcaattctcctgcctcagcctcctgagtagctaggattacaggcatgcaccaacacacagggctaatttttgtatttttagtagagatgggatttcaccatgttggccagactggtatcgaactcctgacctcaagtgatctgcccgcctcgacctcccaaagtgctgggattacaggtgtgagcccccgcgcccagccaaaccaccgcactgggcctgagttgttacatttaggtctataatccattttgagttagtttttgtgtatgttgaaaggaagggggtccaatgtcatccttttgcaggtggatatccagtgattccagcaccatttatatgttgacaacctgatttctttaaaaaaaacattttgactttttgtattacacacattttttttaagtcacctgaagtcaattgtgaagtgatactcgtgtaaataaactgactttaaaaaattactcgaccaaggtcatacagttagtaagtgacaaatctaagactaaaacccaggtcttaggatgccaaatttcaagttttcccattaaacaaaatactaccttacatgtaaataagtttcatatttactcatcaaagataagaaaagccaagccagaaacaatatatttattggtaagattacagaaagcttgatttgagatgtttaagatttggcttgcttattttcataaaaatcgttaatagcagccaggcgcggtggatcacgcctgtaatcccggcactttgggaggccaatgtgggcagataacctgaggtcaggagtttgagaccagcgtgaccaacatggagaaactccgtctctactaaaaatacaaaatcagctgggtgtagtggcgcatgcctgtaatcccagctactcaggaggctcaggcaagagaatcacttgaaccctggaagcagaggttgcagtgagccgagatcacaccactgcactccagcctgggagacaagagtgaaacttcatcttaaaaaaaaaaaaaatcaataataggtaaaaatctactaagcattcactttgtgttaagctctgttctaaacagtgtataatcacttaataatcacaacaatcttagaaaataaagtcaagtgtccactttttttcctcttctttttacagatggggaaactaaggcaaagtaaaattaagtaagttgttcaagatcacagagctagtaagtggtgggaacccaggcaatctgactccaaagaccgtgttctaacaactatgaaagcaaattacttaagagaagggcattcaccaggctgtggccagatggattaacaagtgtctggaaagaaagagactattctattagtgctattgttgtctcagatgaagagacagaaagagaaaattcattagcgtggctgagaattctaaaggagggaaattattagtactagtggcatcaggtaaaaaatgttcaatgtccataattaggggtggagggtattgggaatatttaatgggtacaaaaacacagttagatagaatgaacaaaatctagtatttgatagcacaacagagttattacagtcaacaatttattgtatattttaaaataagagtataatgggaatgtctgtaacacaatcacataaaggcttggtaaatgcttgagatgatgaaaaaaataaatgtactctgttgcactaaaaacaatgtccatgattaactaaagaaatagtcctttaaaaaaaaaaaggataaaaatttaacagggctactgcaatatagcacaactaataacataaaacagtaatataaatacaggaagggaaaggaaaggcaggcacaaacgcagaggaaggaaccctgggagtctccactgcccacagaatgagtgagtcaaccaggcggtgttatcacaggatgtgttggaaacagacataacactgctgggttaaagattaatccttcctttatacgatgtatcagtgagatccctgatagaatgtggaaaccaattttggtcagtgctccaagaagtatggaaagaaatgggaaaagattcacgcaaaacaaacaactagaccaaaacaatagaaaagagtgtctgctaggaaaagaaaaaacttgggagttgcttttcaaagagagtcaggattgatttaattatggccctcaagaagacaatttgaggccaggcgtggtggctcacacctgtaatcccagcactttgggaggctgaggcgggtggatcacctgaggtcagtagtttaagaccagcctggccaacatggtgaaactccttctctattaaaaatacaaaaattagccaggtatggtggtgggtgcccataatcccagctactcgggaggctgaggcaggagaatcgcttgaacctggaaggtggaggttgcagtgagccgagatagtgccactgcactccagcctgggagacagagcaagactccgtctcaaaaaaaaagaagacaatttgaatgttcttcctcaaattcttcacaggctttggttctttccagtcatttaaatcccaggcaaatatcattttctaagaggctttttcccaaagtaccttcctgggtttgtagcacatcactctgatttgtttccttcatagcttgtaacactctgaagttcttcctgattatgattaagcacagtaggttcctcttatcctgttagaacataggctaggccgggcagggtggctcatgcctgtagtgttagcactttgggaggcccgaggtgtgtggattacctgaggtcaggagttcgagaccagcctggccaacatagtgaaaccccgtctctactaaaaatacaaaaattagctgggtatggtgatgggtgcctgtaattccagctcctcaggaggctgaggcaggaggatcacttgaacccgggaggcagaggttgcagtgagccgagatcgcgccattgtactccagcctgggcaacaagagcgaaactccttctcaaaagaaaagaacgttggctacatagaagcttagaacctgagtactgcttatctctagtaaataccagtggtacctggaacatagtgcaaattctataaacatttgtagaatctatgtccatgaagctgcaacatggaaaacgagctttcaaattaaagcaagacagacaccagtaagacacaaaaggaattacttgatagtcaaagtaaaatctatacattgctgagtgctgtgggtctttaagaagagagtcactcatctgtcttaggggttttacaaattcactagcctaagtaatttatagtggttattcccaacaccatgatttaatacttcacagcatagaaatgaagtctggctagttataaataaatgatcactgagctattatgtgccgatcaatattctaatgctttccatgtatcagattatttaatcttcacaattctatgagtactattcttttttttatctataaaatggtactctttagtcccaaaaggttaaataattggcccaaagttgaccagatcatagctggtggatctgggacttaaattcagactgctgcacgtgggccattcatttaagcctgaagataaatttaaacagggcaaaaatattaaacaggaagaacaatagattgataaaattatggcacaggaattaggcgaaattatggcacatgaattttctccatggcttgctatgctatgtggatcttttcaaattccatattgctgtaacattcctggggatattgttgatgtactaactttttccctttaataatgtctcttaaaaaatgtggtttcaaatgaaagagataaatatattcatgccaaactagagagacattataatgaacccctgcatcatgcatcttttttgagacggagtctcactctgtcacccaggctggagtgcagtggcgtgatctcggctcactgcaagctccgcctcccgggttcacgccattctcccgcctcagcctcctgagtggctgggactacaggtgcccaccaccatggtcggctaattttttgtatttttagtagagatggggtttcactgcattagccaggatggtcttgatctcctgacctcatgatccacccccctcggtctcccaaagtgctgggattataggtgtgaaccaccgtgcccagccctcatgcatcttaaacaactctgaacacatagacaatcttcatgtatgctgtgctccccccaaactcatacacacactggattatttcaaagcaaatgatgatgtactattaacagccatctttattctttcccaaaataatttgagtctaaaatgcatataatttctttatttcaaaaaaatctacaaaaaattggtagcagtacagggaacaattctaagggggggggggttgttatcaaaaagcaagccattggacattaggaaaaagaatttctttgcctggcaccatggctcacgcctgtaatcccagcactttgggaggctgaggcgggtggatcacttgaggtcaggagtttgaggccagcctggccaacatagtgaaaccccgtctctactaaaaacacaaaaattagccaggcgtggtggcaggtgtctgtaatgccaggcacttgggatgctgaggcaggaggatggcttgaacccgggaggtaaaggttgcagtgagctgagatggcgccattgcactccagcctgggcaacagagcaagactctgtctcaaaataataatttctcaaaaatcactaagtaatctctaagtgatacatacttggtaacatgagaatattttaggtgccacattatagcaggaattaaatttaaattttgaaagtgttttataagttttaagaaaactcacaagggtttctgtgcctattatgcagacaaatatcattcccaagcatagggagaggtcaagaagcaattaagtaccaaagtatacctgtttatcttccagtgggtcaggctctcctttacttgactcagagctgacatcatcttcatcagaactgttgatgatttcctcctcatcagagggaaggtcaccaagaccaagatcattctgttcctcctgggatgctcctgaactgcattcaacagaaagcaggtattagtcaccttcaataataagaagtgctagcaaaacaaaaaccaaatcaacatcttatcttcataatgcaaacaagatatatctaagggatgtggaagaatgaaaagacccagatcagccaactttcccttccttcaccctgtctcagctgccaaaaactcaaattaattttttgaatttttaatgttaagaaggtgggtgggaagcaagtttcccagctgctcccatcctatgcttctatatatccctcccaaagaagatcaggtctctactcctagaataaactaagaagctttacagaaagtgagctggtttaccataaaaggctgccaggtataccagaagaattgctgtttccttgggccttggtgtttaaaacaacaacaaaaaacaagtaacaaatctatgaggactcgggggtaataatggtgacgacaatcaacagtgcaggtgcaactgtgaacatgtaccctgctctatggttatcactgttctgttcacaagacatggggaggaagaggaaatgttacaaattctcagattatgctcaagacctgctgcattagaactacgaggggcccagggcccagcaatttgcccagcaattacaactacctggggcacagggcctagcaaataataagtaagcttgtttaatgctttccaggtgattctgatacaagctgaacttggaaaaccacagagccaggccatttaccaattcctccttgccagcctgatatcatcaaggttcctccgtttgttttaatatagatctcatgaatctaaaagccactgttgcaatccaatctgtggggggaattccataggaaagttccctaagaagagatgaaaataattccttctagcattggctggaaagattcaggagccaattgcctgtagcaactgcttttctgtcgtaagtctacaagaatatctgcagaatagaagagtataggtggggtcagtaaaagatccacaatcatcaggaaaaacactcaagcagaataaggagacagttgcattccactctggcaggctctttcagcaggtcacaggcaggtcactcaacagccaaggttacaagttacgagaatctctaatgggaatcttaaaagctaaagataaattttctgccagttcctgattacacatggtaggatacagacttgcctcagaagccattcctggagcccaactgttacacaaaccagctggctggaggcacagtgccaaaaggaacacctctcactgctaaagacggggttttccattactcaatggctggggcctctgggagtcatatcatagcctcgtaaggtgggtgcatactttatcacagctccccaagacatgcaggagactcactccccgggggtaagtggtggatagaggatagcaactttctggttagatcactggcaggattcactgtctctgggtgcagggataagagccaaccccgccggatagttaattgttgactgagattagcgagagcaaatgagagttaacagggtggacagactataggatccaaccatatagctagaagaaaaggtaccccaccacttgtttttatcgtaattccttatctctttatatcttctaaaaccctgttaacacaacacatgttcaatttccaatcggcagcagcatcacctggaagctcctcagaaaacacacgctcaggccacccacaacccaccgaatcaggatccgtgctgtaacaaaatcccagtctatgtgtgagaagctctgctctaaaaggctttttgatccagcccatctgggtactgttttagactcctaagtataatagattcagatagttagtaatagggctgtggcacctatgaagaaattaggtttatttggccaggcgcggtggctcacgcctgtaatcccagcactttgggaagctgaggcgggtggatcacgaggtcaggagatcgagaccatcctggctaacacggtgaaaccccgtctctactaaaaatacaaaatattagccaggcatggtggagggcgcctgtagtcccagctactcgggaggctgaggcagagaatggcgtgaacccgggaggcggagcttgcagtgagccgaggctgcaccactgcactccagcctgggcgacagagtgagactccatctccaaaaaaaaaaaaaaaaaaaagaaattaggtttattttgtctgaagagaggggtgaaaggtgtttcttggtcaaacatcatttggaaggctattattaagaatatagtaactaggtgttgccacatccattagggatacaagagggattaaagtacaaagtgaacatctgaaaacaagaaaaaagctttaaatattaaaactacatgaatcaaaacacaatgccatgaaacaaggagagattttggtgtctcttctgaatcctttaactatctcactaaactgcacttggtggtagacttgtttccctcattaaaatgtaaatttccaaagacaaggaaattgaaattgtgttttccagctgaatcctcaccatacagcccaacacacaagagaccctcaagaatttttcaccaaataaatgaaaatgatatcagaaagcaacaggtgttgaattttaatggtgcaggtggcctgaaccagggtggctacatcaggaattgagagaaagggatggatgtaagaggaagaaaaatcagggccgggtatggtggctcacacctgtaatcccagcactttgggaggccaaagtgggtggatggcttgagcccaggagtttgagacaagcctggccaacagagctaaacctgtctctactaaaaatacaaaatttagccgggtgcagtggcatgtgcctgtaatcccagctactagagagactgaggcagaagaatcactggaactcaagaggcagaggttgcagtactcaggaggctgaggtaggagaatcgcttgaaccagggaggtggaggttgcagtgagccaagactatgtcactgcactccagcctgggtaacagagtgagactctgtctcaaaaaaaaaaaaaaaaaaaagaaaaaaaaaaagaaaaatcaccaggacttagggtaaaggggtgaggaggaaaaacttatggaagacatcaaggtgtcaagtccaagtcacaagcagaatgagggtgacatgaactgaaacaaatgttaaaacaagggagcagattttaaaggaaagataatggtttagcagcaaaatctaggatccacattttacatgttcatttctaaaacaattactctattttcccaaacaactgttgtcagcttctgaatctacctagataattttagatttctatttttatttttttgaaaaaatagacaagggtcttgctgtgttgcccaggctgatctcaaactcccaggctcaagcaatcctcccacctcagtcttgccaaagtgctgggattacaggcatgagccaccatatgcagccaattttagatttctgataatgaaacaaggactccttactaatgccaattgtatagtttggagttctgtttatttccttcccactgtccgaatgataacatcctaagactgtctgctttgtggggtaaaggaacaggacatagggcttcctccacgtctttctgcctagttagttcataatttgatatctgaagtaaaaggaaagtaagctccaacagcaaccagaacaaagagtgggctctacttccccaagcaccctaagtcagatttgcttctgcaagaagccacagtttctagaaaatcagtttgtttccagtgcactggaattaagacaaacaagtaaagccagacttaaattcctactgatgggtaactgtttccttcaattccacatgctaacatctacacatctgaagtgaagactacatgatgccatcactttttaaaagttatttttttctatatgctagtttctatatatttacagcacacctccactggaagtatatcaaatttttctttcaggtaataagtcacaactaaagtgaagtccttctcttttagaaggaattatcttttaaaattttaatttattttattattattttttgagatggagtctcactctgtcacccaggctggagtgcagtggtgtgatctcagctcactgcaacctcgcctccctagttcaagcgattctcccatctcagcctcctgagtagctgagactataggtgtacgccaccatgcccagctaatttttgtatttttagtagagacggggtttcaccatgttggccaggctggtcttgaactcctggcctcaggtgatctgcctgcctcagcctcccaaaatgctgggattacaggcatgagccaccatgcccagtggaattatcttttttaaaaatactaaatccatttcctctaagagtttttaggaacagaaaacctgtacaatgataagccagcatagcaactgccaggttcaccaaaaaacatccttctgagcccctactaaattaaaaattccagcaaggagaagggataagggatcggatggccgagagaaggaaaggaaaagctgagttaagaatggcttctctgttgttgacaaattccagctatctttttcttcttttgcctgtggttttattctgagcccctttaccaaggaatgtttcatgtaattcctcccaagcttgaagaaagaagttctttccaattccctcaccttcagaagtttctttcttatttccaagtcaccacatgtaaatctcaacttctgtggtctttctcttcctcttctttctactcctggcccaaactgaacagaaacctgcttgtcctcaggatgttgtgataattttttttcaaatgctgtctcattatgacttggtgattatgtgtttcctttggcacatttcatatttatcacagaatgaggggaaaaaaactaccattatgggctttaaattagcaaaataaatttcaagttatttagtagttattatagcacactaactataaaattggtatacaattttcaccaaaaaattatttctattttgttttaccaggaaacatttccttctgttacttcagttcccttataggactgcagattccactgtcacagtaaaaccatgaatcaaatcaattttaaacaacaatttatttatttatttatttatttatttatttattggtacagacagggtctctccctacattgcccaggctgctcttgaactcctggcctcaaatgaacctcctgccttggcctcccaaagtgctgggatgacagcatgagccaccgtgcctaaaaaaaactatttaaaaaatccttcttactctccttttcaggtcttctcaattacacagcaattctagaattttctccatcccttactcaagtaatgttcttgaggtctaccaccaaaatgagtttggaaacatggcacgacttgtgaaataggcatagttggccatttgcatcctccaaaaagcaaccgtcacgtatgcacatcatgtttttaggtttttcaaacacaagatggtgcacaattattttaagtatgtgcagagccaggtgacaggactgaacaaatatcaagttcaaccagtgtgactcctgagtgctggtaggtaaagtaggtaaactaggtaaaccagatcaactagtaggtctttctccactcctaactgctttcacaaaaaagaaacatcaatgcttcagtaatacgtaaggctatggatgctgatgttcttattgaataagtataatagcagaaatccttccccctgaaagaaaaggacatctatcaatttttttatgtccttgcattataaaggtatcaaatatattgatttttaatcttctcttcgagaggttgcttgattaaaggttaagacaaattttaatttaaaaattaatgattttattatctcaatttcagtttttaaaatcctataatgtatatatgtagtgtataaactttttgagttaaattctttagtattcacaaaataaaaataaataaaatcactaaaatacttaaagggacagtaccacagaattttgttacttaaagatagaaaaaatgaataaacaaagaaacttacaacataaaatgtacacgatcagtgttttattttttcattcttaagttttagaggttttaacaactgagcctttcaaactagcaagctagggttctatggcttcaaaaaaaaagaaatcacacaaaaatatccagcttccctgaaatataaaccagaaactgtttaaaactgtctctgggtgactctgttagggtaaaatgccaggcttcaaatgatggatattttttaaaaacaggcttgcttcattttccagaagcaacctccacctttgcgaataccattactatcaccttcccccaagtaattacgaggattcttagaattgtatgctactgactaaagacataatcagagccggggtggtgactgatgtctgtaatcccagcactctgggaggctgtggggggtgggggtgattgcttgggcctaggagttcgagaccggcctgggcaacacagggagagaccccatttctatgaaaaaaaaaaaaaattgcatggtggtatgtgcctgtggtcctagctacctagctacttgggaggctgaggtgggaggatcacttgagcccaagaggtcgaggctgccttgagccacaattatgaccttgcactccagcaggtgagggaccaagaccttgtctcataaataaataaataagaccaaaatcataatcagtaccttgaggctgctatttaaaatacagtcctcacaagacaactctgaaaattgtttaaaaaacaaatagaatgcaaaattctttaaaatagaagagtacctacccatatgcttgcaacttttatatgtaattggctttaaagtcattcattaagatttaacataaagaagcagtcttaaagggatcttccttcaatagccattaaaaaaagaccggttaaataaattggggttatacattcatataatgaattactaaacagttatttaatttgtttagtaattactaaacagttatttaacaggctaaggcaggtggatcaccttaggtaggaaatttgagaccagcctgaccaacatggagaaaccccatctctactaaaaatacaaaattagccaggcgtggtggcacatacctgtaatcccagctacacgggaggctgaggcaggagaactgcttgaacctgggaggccaaggttgcggtcagctgagatcctgccattgcactccagcctgggcaataagagcgaaactctgcctccaaaaaaaaaaaaaaggaggtagatctatgcacagtggcatagatcattctccaggaaatattgttaggttaaaaagaaatcaaggcacagagtgtgctcctatttgtgtagagaagcaaaaagaagagtacatatacacaaaaccatgtaaaaagtgtgtatatttgtgtgtgtgtgtgtgcacaaacatgctgacatataccaggctgtccccgaacacattcagaaaaactgataaatatagttgaagtacagttgcctctgggactaaagtcctgagaataaaagacagatttttttttttttttttttttgagacaggggcttgctctgtcacccaggctggagtgcacacccaggttagagtgcagtggtgtgatcacagctcaccgtaacttctgtctcccagactcagtgatcctccagcctcaggctcccaggcacttgggacaacaggtgcgtgccaccacacctggctaattttcgtattttttcttttgtagagactgggttttgccatgttgccaaggatgggctcaaactcctaggctcaagtgatctgcctgcctcagcctcccaaagtgctaggtgtgagccaccactcctggctgagagattttattatttgcccttcagtacatttttaaaagttgttatcacgtgcatttttactttttcaaagttgaccacccccccgacacacacagagtctgaaaagcttcataaaaggtggttcaaagcatatatgtatttatacatatatacacatatttttatatgtatataaactctttagggatagtttattttcttcccaggatgatgagattaaagatattttctcctgttctttccctttctcccccaacccccagacttggaggtctgtgtaaacattttcaggattgccgtttcaaaaaaaaaagaaaaaatctcttttaactattgcttaagttgttaagatatataaattacggctttcccttactgccgagaggggtttgtttgggagaaccttaagtctaagtctctaaataataggtaggaaggggagatctggctagccagttgatagctttaaaaaagaaaaaaagaagtcagtagagggatgttcaacagcctgcagggcccacagagtaaccacacaacttgttgactacgtcacagtgaacagcaacataataatagggtccgtctcccatagttctccatttggttgtgggagagcttcctgacctgcaagtaaagatgatcatgtgcttcagggttcctggtcctatcttaatgacacaggaggagccccatggtgacaagagtccaacagacactcttggccatctagcttagctgggaggcatccaggtcaaacttagctagaaggaatccaggtctagctagaaaggaataaattgttacaaaaatgtctcctgaaacaagcactacataaaataaatctgcaacatttaattaccatcaattttgctttcttagaattgggattcacatcacgaaatgtggacaactttcttgttaatacaaatagaaaagcattctgagcttgaggttgcctccaataaaatatggcaagttccagttgggcacagtggctcacgcctgtaatcccaacactttgggaggctgaggcaggcagatcacaaggtcaggagatcaagaccatcctggctaatgcagtgaaactccatctctactaaaaatacaaaaaaattagctgggcgtggtggcgggcgcctgtagtcccagctactcaggaggctgaggcaggagaatggcgaggcagagcttgcagtgagctgagatcacgccactgcactccagcctgagagacacagcgagattctctcaaaaaaaaaaaaaaaacaaaggcaagttcccaatccaattccatcattgcaccaaagatgatgtttctcttattgaaaacgaaaaagttttaagacaaagttagagttgacttagtatcatttctccccttcacatcctcattatgtaatatactgtctgttcctacttgatgccagaaaaaataaaggccattagaaataaataatgaggttgggatggctacaagagaatacttcacagttgcatacacatatttacacatatatatgtatacatactttttttttttttttttggagatggaagctggagtgtagtggcatgatcttggctcactgcaacctctgccacccaggttcaagtgattttcctgcctcaggctccagagtagctgggactacaggtgccccaccacgcccggctaatttttgtatttttagtagagactgggtttcactatgctggccaggctggtgtcggactcctgacctcaggtgatccacctgccttggcctcccaaagtgctgggattacaggtgtgagccaccttgcccagcctatacatacatttttaaaaatacttttgtaatacttagaatatataaaaatggtgatgccatttatttcagtaaacatttatcgagggcctactatgtttcatttactattttaggaggcagatgaagataatattgaattagttacaatgttcaaactacaaattctattgactgcttctctttattttcctactgagaccttcttaaacagatgaaggcagaagggattgagataaccacagtaatttaagacaaaggaaagaaccactttctaaaaagagacaacttggctgggcacagtggctcacgcctgtaatcccaactactcgagaggggcaagactggttagtaagttagtagaaaaaacagctcatcctttgactaccttctctaacagggtgaccactttgtcctggtgtcagctgtacacacccctttgcttcctctaaggtcttgtcatcataatcctaacagccactgaaaaggtggcgagccttttggaaaatatgactactccgcctggccacgctatgctcttgattgtgagtcagcacaaaaccattgcggtgcaaggctgaaaattaaggcccaatattatgctctgccttgacatctggggaaaatcagaagggctccaaatggtctcactacacactgcccttcccactatgcttctgctgataaagtcccctggccaccctcttagtcacaaggaccaggtgcagtgtctgcctagccctgagaagtgggttttagttccctgccagtcagcagagagtcatttaaacaagccaatcacatcctctcatgggaaccaggagtgacccccaccctcttgtatacagcctgcctcccgcaacccctagttgttcctgagtacaggcctgggtggccaggtgtggcatgctgtgccctcctctaggctgggactacatgtgaatgagaaactgctgttgatctcacccgtccagtgtcgagcatcaggattcagccattcccgtaaccctaagcagaaatccctccctcactaacggggtgaagaggaggtaattcaaacaacctccaaggccaggagcggtggttcccagcaatttaggaggccaaggcaggaggatcatttgaacccaggagtttgagatcagcctaggcaacacatggagatcccatctctacaaaacataaaaaattagccaagtatgggggtgaacacctgtggtcccagctacctgggaggatgagatgggaggatggcttgaacccacaagtttgaagctgcagagagcagtgattgtgccactgcactcaggctgggtgacagagcaagaacctgtctcaaacaacaaaaacaacaacaaaacaacctccaaaaaaggtgccattgtctgggatcgcgaggtacaaagcaggtgcactggcagattttaataagattatcctgagaaattacattgagaggtgtacaaagtcagctttgtgtttacctaagtatattttgcatatacatctagactctgccatgatacactcaagcaattttcaagttaaaggcattaacttacatgttccagaaatgtggcatattccatgttacagaatgctaaatgttacattatatacagaccccactataatgaaagggtaggggaattacaaggaaaccaatagccaaaaccaaaggacttctgcaatcattcccagatgttattttatctaaacctatttaagtgtatcagtttccaataggaactacaatcatatctgggatttcccactaacatgggggaaaaggatcaaaggcttcttgggagcccatgaggagccacagagggggaggttagtcattgctcaagaataaatctgtctacttccttatttaaaactatatacaagtaagcctatttgccatctttcttcttcagattctattcacacaaatgatatgtcttcaaggtctactctagaccagttataaaccatcaataaccccccaaaaccataaggaacccacatctttctgagacagcaccctggggaagctgtagagggtgtcaggaaaagacatggatttcttcctgcacgttttttttttttttttgagatggagtcttgctctgtcgcccaggctgtagtgcagtggtgcgcgatcttggctcactgcaacctccgcctcccaggttcaagcgattctcgcgcctcagcctcctgagtagctgggattacaggtgtccaccaccaagcccaactaattttttatatttttagtggagatggggtttcgccatgttggccaagctggtctcaaactcctgacctcaagtgatttgcccgccttggcctcccaaagtgctgggattacaggcaggagccaccacactcagcctttttttttgagacggagtctcactctgtcatccagactggagtgcagtggtgcgatcttggcttactgcaacctccgcctcccaggttcaagcaattcacttgcctcagcctcacaaggagctgggatgacaggcgccagccaccatgcccagctaatttttgtatttttagtagagacagggtttcaccatgttggccaggctggtcttgaactcctgacctcaagtgatctgcctgcctcggcctcccaaagtgctgggattataggtgtgagcacccgggcccttcttccactcttaatcccacgcatcagtgagtccttacaccagttacattgctgactagttctgtgtttatttttagcttctttgattgggaaaccaaaaaaaatcactacttttctatcaaactcagattacatcttcgaaagcgagagtcagggaaaatggaagggaagtgaaaataaacgtgtattcaagtaaaataaacattcgcttctgacaggatcacaaacatttatcacagtttcatacatttctacgagggaaggaaaggcagcagagaagaaaaaaaaaatgctctttcagcctaagagacctgcatttgaaggcagggtccaccactcatggctgtgtgtaactggctagttaattggactaagtttacatttccctatactataaaattgagataataggccgggcgcagtggcttacgcctgtaatcccagcattttgggaggctgaggcaggaggatcatgaggtcaggagttcgagaccagcctggtcaacatggcgaaacctcgtctcttctaaaaatacaaaaattagccaggcatggtggtgcgcacctgtaatcccggctactcaggaggctgaggcagaagaattgcttgaacctgggaggcagaggttgcagttagctgagattgcaccattgcactccagcctgggcaacagcgcaagactccatctcaaaaataaaaataaaaattgagataacataccacctgcaatgaagattaaatgagataatgtgaatatatctgttatatgcaatggacaggaaataaagacagctttttaaaaagcaggcatgagaaaggggacaacatcatagttcatccagtaagcagaatggcaagaggaactgaaagttgttcttgttccccctagaaatcccaaaatgtagtataatacctttcttgcatgaatgtattaacaaatgaatggattccatcctaatatctcacacatacatagtatagtatgattaggcaaatctaacctgctgcctgtttttgtaaggtctatgagctaagaatgcttcttatattcttcttcttttttttttttttttttttttttttttttttttttttgagacggagtcttgctgggtcacccaggctggagtgtagtggcacaatctcggcttactgcaacctctgcctcctgggttcaagcaattctcctgcctcagccttccaagcagtagagatggggttttgctatcttggccagtctgatcttgaactcctgaccttaagtgatcctcctgcctcagcctcccaaagtgctgggattataggcatgagccactgtgcccagcctggctcttatattcttaaatcatgaaaaaaaaaaaaaaagaacaatattttgtgacacatgaaaatgattttcatgtccataatgaagttttattggaaaacatccatgctcatttgtttctgtactatctgtcactgcttttgcactacattggcagagctgaagagatgcaacagagacctatggcctgcaaagtctaaaatatttatcatctggccctttacggaaaacgtttgctgatccttggtacagcagattacccaaaagaagcagtatatttcctttggggcaaaactgcctgtgttcgaatccgagttctgccacatactaagtaggtgaaattgagtcagtttttaacctctccgtgcctcagtttttcctccataaaatgaggatcataatattgcctacctgacagaattttgtggggattaaacaaattaatacaagcaatgcactaacaatgcctggtacacagaaagctcgtttgctcactcactgtttctcttgtatatacttaaaagtctagaactgtataaaaagtgacttcaggccgggcatagtggctcatgcctgtaatcccagaactttgggatgccgaggcgggcagatcatgaggttaggagatcgagaccatcctggctaatacggtgaaaccccatctctactaaaaatataaaaaattagctggtcgtggtggcaggcgcctgtagtcccaactactcggaaggctgaggcaggagaatggcatgaacccaggaggcggagcttgcagtgagccgagatcgtgccactgcactccagcctgggagacagtgcaagactccatttcaaaaaaaaaaaaaacaagttacttcaggctgggcgtggtggctcatgcctgtaatcccaacactttgggaggccgaggcgggcagatcatgaggtgggcagatcatgaggtcagcagatcgagaccagcatggccaatatggtgaaaccccgtctctactaaaaatacaaagattagccaggcatggtggcatgcatctgtaatcccagctacttgggaggctgaggcaggagaatcacttgaacctgggaggcggaggttccagtgagccaagattgcgccactcactccagcctgggtgactgagcgaggctgcgtccccaaaaaaaaaacaaaaaaaaaaaagtgacttcagagaggagcttctgcattatcaatcatgtgaaacagctcatcaccagcttaaaggtctgagtcaagaactcctacagtgaggtcatgtgagccacggttttgcagcaggttactcctagagctcattttccatgtttaatttcactacttatttttggtagcttactacttgtacagtaatatcctgaagctcagaataactacagtttcatgcatatctcaatattctttcttatttctaaaacaattttagtcacatataatgacgaattcacaggtattccactagatctcaaagtaccttttcaagtatgttttgaaaagctggctttgtccctctttgcttaataatgatcacattgatgcgacaaaggccaaggtggccgatgaatgacactgataagcatacctcacgtatgcaataaagttgctgatttctctagtaatgtaaacttcattttgcaatataaagcaaagagtcctatttcttttctaaatggaaattttcatattgcactgaactagaaaaagcccagtagaatgcaatttcaaaacagtgatcacttgctctgagctactagctgaaggcacagaaaaaaaatggggagaagagggaagcagaagaaatgaagaaaccagaaaacagtaagtaaggcaaggtaaaggagagaaataagcagatgggcaaagcaccatccgtgtgtgtgtgtgtgtagaggacatgttaccacagacacaggagaaggaagacaaggttcctgccctggggaaaatggagctgtcagcctttgtctttctcatgtacctcaaagataacaataacctcatagggacagagtttactcctaaactttccacttattctaaaactttccatgtgaaaaatcaaaacaaacaaaacccccaaaaccttatctctccagtggaacggaggtggataaagagaagaaaaggagggaggattttacttttcacttcatgtacatttaactttttttaagacaacaattttatataacttttataactaaacaaatacgtaaagaactgaaaatccccattctctcttctccaagtttactaatctcagttatttcaagtattccttaaaaacaactttttttttttttaatacttggtaaggaaaggtcaaaggtaaagcaggcagagaggatgaattagagaaagctatccccatctgctcttcccacaaaatgcaaagaaagaaaagaaaaaaatctggacatgttgacatgtggattacagcaatagtttttggtctacttcatgtagataatctcaaaatgaattctctaattccctagaccactccccgctctgaaaataataaattccctgtactttgtaaggtaaacccagtgaacaaagaatattttcaccctgggcatcaggaaattatgtatagcaaaatggaagcttctatacacccccacacccgtgttcacagtcacagattttacttaacagaacccatccacagggtattagctgcatagccagcacagatatttactggggccaagatttcaaagaccaggcagagaagacattaatttgtagagtacaaaagagcacacaaaaaatgtttttgcttcttaacactgtgagggctcaataagaattaaagctgcttagaatcactgctatcaagagtcaatctagctgggtgcagtggctcacgtctgtaatcccagcactttgggaagccgatgagggaggatcgcttgagcccagagttcgagaccagccttggcaacatggtgaagccccatctctgcaaacaaatacaaaaattagctgggtgtggtgccgtgggcctgtagtcccagctacttgggaagatgaagtgggaggatcacctaagtctgggaggttgaggctgcagtgagctgtgatcttgccactgcactccaacctgggttgacagagcgagaccctgtttcataggaaaaaaaaaaaaaaaaaaagaatctagtaaggtcatattcaagaaaaggagaagcatcaacagttaatcaagtaaccactgggtataaaaacatacttaaactaattttaccatcaaaaaaacctcctaacctagctagagctaatatatttgcttattttcacagtatttaagttttgccctacagaaagatttcacagagtattttaaaaagacaaaatggatttccttaatagtaatagaaaactttcacctttcagatctttaatattcttcgcttgttagtactaactttcattgtaaaagttccttttatattcaaatatggtgctccacacacagtgaatgtgcagtaagtacctgttaactagaaagagtatttaatacattgagaaaagatgtactatattaaatagttttcagtttgtctttacaaatcctttaagcattttacctgccttctaacagctaagacatgggattttatctgttgtacagtaggaataaaaagataagatgttttcttttgtttttgaaatggagtcttgctctgtcgctcaggctggagtgcaatggcacaatctcggctcactgcaacctccgcctccagggttcaagtgattatcctgcttcagcctcccgagtagctgagattacaggcggccaccactgcgcccggctactttttatatttttagtagggacaggatttcgtcatgttggctaggctggtttcgaactcctgacctcaggtgatctgcctgcctcggcctcccaaagtgctgggattataggtgtgagccactgcacctggccaagatgttttcttaaattaatatttttctaaaagattttatagctcttaggtaatactcttaaatcttttccatatcgatatctaattagtccattccagggctcggaaaaaactgtattttatttaggccgtacccatatgttacatggagacaagacagcagagtctaaaatactatattttggccaaaaaatatatgttgaaatcctgaactatatggattattcatcctgtaagagaaaacatgccttccatagccaaatcattctgatatttccccacatatgtaaaaattttgggcgaggcatggtggctcacacctgtaaccccagcactttgcgaggccaaagcaggaggattgcttgaggccaggagtttgagaccagcctgggcaacatagtaaaattctgtctctatattttaaaaaaaagttaaaaattaaaaaatacattaaaatgtcactagacccttcaccagaacattttagtaaatttttgctaactccaaagctacctacagactgcctagattttttcagtttcagtcttactacatgtaagactacagggacagttctttcatttacagttccatcaaactagatttttttaagtgatacatcttctttgcattttctgagtagcacatttagatatggtaagacctgtactaaccaagaaactgtcaaaactgcttttgattggcatgggaatttagactccatgctttctttctgcaggtttggtgagaggactggtggaatggagtgcttcttgcataaccatcccacaatacggaaggatgctcaccatgtatctaataaagacagatgcatgtgaggtcttttaattcaatttctcttctccaagggagctttgttttagcaaatagcagtaattctccacaccagtgtaattgctttccaaaattaacagatgtttcctgtacattctggaagcctggtcagtgggacactggtttactcaaaatgcagctggattctgacttcacacaagcaaaagcagtgtttaacctgaccactgtttgctcagatgtgactacttaatttgtgccaggtatctgctggggccaaggatacaaaggtgttgtaatctctcacaatatttattcttacatagttgtccctgggtatctgtgggggattggtttcaggaccccccacagagaccaaactccatggatgctcaagtcccttatataaaatggtatggtacttgcatataaactacatatatcctcctgtatactttatttattattattttgagacagtttcgttcttgttgcccaggctggagtgcaatagcacggtctcagctcactgcaaccccacctccaggttcaagcaattctcctgcctcagcctcccaagtagctgggattataggcacccgccaccacgcctggctaatttttttgtatttttagtacagatggggtttcaccatattggccaggctggtctcgaactcctgacctcaggtgatccacctcccaaaatgctaggattacaggcatgagccaccactcgcggctcctcctgtatactttaaatcactgttagactaattataaccaactaatataaatgctacacaaatagttgttatattatttagggaataatgacaagaactaaaagtctaaaagtctgtacatgttcaatacagatgcaaccatccattttcccccaaaattttttcaataagcagcttagtgaatccatgggtgtgcaactgatgaatacaaagagcagaatgtacatgtattttttaggggggaagcagagggaggttaacaaaatgttatgatagaatgatgagttggtgctgtgcaacagtagaagaccaaggaaaggggtccattgtactgtttgatatgtagttaaaatcaatatagtaaatgttagctatttttattataccataaacaggatatgccaggcaatatgctagagaagggagtggaggcacaatgtacaaaaattcacttcctcattcattctttcaataaatatttactaagcacctatgtgtcaggcactgttctgggcactgaggacaaggcagtgtaacaaaatttaggatcccccatccatgcaggctgttttctagtaggagagacacataagcaaacaagtagataatatactgacaagaagaggcagtgttagaaaggaagaacgagatgagtggatggagaacaatggggaagattgggaggggagtgtattttgttacctttcctacattggaaggggaggatttccacaaaaggtagcatgtgaattaggtctagaaagatgaaaaattctctgtctgggaaaagggttttttaggtagtggaacaaagccatgagagaagagcatgttttggaatgtagaatgtggtcaattttgtgtagatgggcaataagatgatcagactgggaaggcagactgccataatgtgatattactgcacacctgtcagcattgctaaaataaaaaacagtgacaactaccaactaccaagtgctggtgaggtgtgcagacactgggtcactcatacatcgctggtaggaaagcaaaatggtatacctactctggaaaacagtttggcagcttcttataaaactaaacatgcaattcccacacaacccctaattgcacttttgggcatttattccagagaaatgaaaatatattcacacaaaaacctgaatatgaatgttcatgacagatttatttgtaaaagccaaacagtggaaatggcccagatgtcctttaagtgaaatactactaatatttagcaatacttagcattaaaaaagaaaaagctattggcatacgcaacaacttggatggctctacagaaaatcatgctgaatttttttttttttttgaggcggaatttcgctttcatcacccaggctggagtgcaacagcatgatctcagctcactgcaacctctgcctcctgggttcaagcaattctcctgcctcagcctcctgagtagctggaattacagatgcccaccaccacacctggttaattcttgttttttttttttttttgagacggtgtctcactctgttgcccaggctggagtgtagtggcgtgatcttggctcactgcaacttctgcctcctgggttcaagcgattctcttgcctcagcctcccaagtagctgggactacaagcatgcaccaccacacccagctaattttcatattttcagtagagacagggtttcaccatgttggccaggctggtctcaaactcctgaccccaggtgatccgcctgcctcggcctcccaaagtgttgggattataggcatgagccaccatgcctggcccatgctgaatttttttaaaatgccaattccaaaaggccacatgctatatgattctatatttttattattttgttacattttattttctactttattattttatattttatttttatttttttggagacagggtctcactctgtcacccacgctagaatgcagtggcgtgattacagctcactggagccttgacctcctgggctccagtgatcttcctgcctcagactcccaagtagctaggactacgggcatgtaccatcacgtttttaaattttttgtagagatggagtctcgccaagttgcccaggttggttttgaactcctgggctcaaatgatgttccttccttggcctcccaaagtgctggggttataggcatgagccactgtgcctggctgtgattccattttatataacttttttttgagacggagtttcactcttgttgcccaggctggagtgcagtggcatgacctcagctcaccacaacctccacctcccaggttcaagcgattctcctgccccagcctcctgaatagctcagattacaggcatgaaccactatgcctggctaattttgtattttcagtagagtcggggtttctacatgttggtcaggctggtctcgaactcccaacctcaggtgatctgcccacctcagcttcccaaagtgctgggattacaggcgtgagccaccacgcctggccttatataacatttttaaacaacaaaacaatctgaaatagactagtggttgccaggggttgacgggaagaggtgggaggggggtgggtgtgggtataaaaggacaagaggggtcttggtggtgatggaatggtgaagatggagatgcaaacctacacatctaataaaattatatagaattaaatacacatgtgagtacaagtaaaaacggggggaatctaaagatcagtgtggattctgtcaatgttaatatactagttgtgattctttactatagttctataaaatgttaccattaagggaaactagctgaagcagactagtttctctctctattgtttctttgccacatgtgaatctacagttatatcgataaacatttcaattaaaaacagtaataaaccacattgcaaattcctcctgggtaagaactatccttaatttctatgctgttttttcacttccacttccaaatgccgagagcagcctcagataaggacataatcggaggtaatttatttgtttcctggttttcctgaggggacatgaagtttactgacttctataaaagtaaaatctattattttgctataaattttatatttaaaatgccatataaattctatgaaataaaatctaacaatccaaatctctctgaagcacctgattagctacaacggactaaaatcacctgacaacatcccctccagcaggtaaaatgtcactatgtttacataagaatcagagatctctgaaatcaactgtcatcaggtaggaatctctgccaaagaatactggcagattgaggccacaggacttcaccaggttctataacaaaagccttcagagcagcatcacaccactgtcccttggccatcctctgttttgtttttagcataaaacagggaaaggcaggaaacaagcgatgaaaggcagtgaaatggacacgtacctacacctgtagactaaaaactgaaagcctatacttatatgccctttgataacgaaatgtcctggcaaccaggccaactgtgtcgctatttgtgggtagattttaatttaatttgagaggaaaaaaaattacaaattcattaaaaagtcagaattataggatattttaaataaaatacagtttgaaagggccgggcatggtggctcacgcctggccttatataacatttttaaacaacaaaacaatctgaaatagactagtggttgccaggggttgacgggaagaggtgggaggggggtgggtgtgggtataaaaggacaagaggggtcttggtggtgatggaatggtgaagatggagatgcaaacctacacatctaataaaattatatagaattaaatacacatgtgagtacaagtaaaaccgggggaatctaaagatcagtgtggccaaacatggccaaaccccgtttctactaaatatataaaaattaggcaggtgtggtggcgcacgtctctaatcagctacttgggaggctgaagcaggataatcgcttgaaaccgggaggcggaggttgcagcgagcttgagatcacgctgctgcactccagcctgggtgacagagctagactctgtctacaaaacaaaacaaaacaaaacaaaaaaacattttgagtaatttcgtatttttaaatatacctttaacagccaagtacagtttttcaaatcagtttggctctacagaagcctgttacataattagcacagtaacagcaggttgtgcatagaaggaagttattatttatttatttagaaacaaggtcttgctacgttgcccaggctggtcttgaactcctggactccagtgattctcctaccatggcctcccaaagtgctggaggccacgcccagctaattttttgtctttttagtagagacggggtttcactatgttggccaggctggtctcaaactcctgacctcgtgatccacccaccttagcctcccaaagtgctgggattacaggcgtgagccactgcacctggtcagaaggaatttaaatatgctttctatactatgactatggcatttattcacttaaaacaagacaaaccaagttcagttcagcatagacagtattaataaacatgccaatttttttctttttttttttttgaaacagggtcttgctctgtcatccaggctggagtgcagtggtgcaatctcagctcactgcaacttctgcctcccagactcaggtgatcttcccacctcagcctcccaagtagctgggactataggtacatgccaccatgcctggctaatttttaaattttttgtagagacaaggtctcactatattgcccaggctggtctcaaactcctgcctcaagtgatcctcctgctttggcctcccaaagtgctgggattacaggcataagccaccagagccagccagatgacaaattaaaaagtcacaaagaggcatctcaatccgttttaccttggaagtagattcagcaagccttttgggagacagggtcagtgactataacctgtgttccagtaatgctagcagtggtttgcctaagaacttctctcaacttatagccagactgaacatgctccctcatccagtatccaggtcctactctctcacaattcaatatgctcaggccaggcacggtggctcatgcctgtaatcccagcacttcaggaggccgaagtgggtggatcacttgaggtcaggagtttgagaccagcctggccaacatggtgaactccgtctctactaaaaatacaaaaattagcccagtgtggtggtgtgcacctgtaatcccagctactcaggaggctgaggcagaagaatcgcttgaacctgggaggtggaggctgaagtgagatcacgccactgcactacagcctgggcaacagagcaagactctgtctctaaaaaataaaaacaaacaaacaaaaagaaccccaaaaggctccataaagtcttccttctctaagaaatcttcaactaattagagggaacatatcacctgcgtcttttgggggactatacccctaccattcatttaaatctattttttccctaagttaataagggtattatcttattacaaaaagtattttagccttacaaaatatttactttggggacccataaataacattattaaataaaagtgctttagacgtcagaatgtacttgacagagagaacaaaatgagaaacagggataaactggttaaaaaaagcagctctcatgtaaatcagtggggaaatatgagacatgcataatcctttccatgccattaatgtccacatgcaactagtaaatgacaggaatcatatttaacttgctttgaatagcagccaccacctaccggactaaatgcaaatatgacataatgaattcagtttccaacctttgaaacacctattacctaaccacaagagctttccaatcaatgaactcttcctgcatgaaaaatctggggtctctacaaatgctcattaatttctattcctatcactgcaggtgtctctgtgttttccctctaaatagtgaacaaattaaagacagaaatagtttgtcccttgtggtcccttgggtagaagattcacagacctctaccaatattaataataaaaaataaaataatagtgaaaccatggctcacagcaaagcacaacatcaacatgttctgattaaatgtcagtctgtctcaggatcagaaaacttggttccatacttcagtttatctacaagttagctctgtgcccttgagcaagttattcaaccccattaagtcttagtctcctcatctgttaaagaaaacaataatatctatcttaaaggacaaaagggacgaaatggtacacgcaagagctcctagcataatgctggcatatcggaaatcttgagtaaatccaagcgattactatttttttttctgttttttgagacaagagtctcgctctgtcacccaggctggattgcagtggcgctatctctgctcactggaagctccgcctcccaggttcacgcccttctcctgcctcagcctcccgagtagctaggactacaggggcccgccaccacgcccggctaattttttgtatttttagtagagatggggtttcaccgtgttagccaggatgttctcgatctgacctcgagatccaccagccttggcctcccaaagtgctggggttacaggcgtgagccactgtgcccgtccacgattactattaagcctaaaactcatgctatttatgtgaatggcacttctaatccttcctcttgtctggttcatagacttttggtgaggtggagtaaaaactggattgatggggagtcagtttgggggaagaaagttttgttaacgtgtattagtagcatcagattatttgtttgctgaaagtttctgcctggtttgaatattcaccttgctgaaatcaccattttaaaaacagccatataattctgtgttcatatgcatctgtgtgtggggcctccttcctcacagcggtaacaacactgttacaaaaggagaaaaaagtgcaatgatgcaagtaaacctgaacctttgtgcaacaactaagatcactttcgtcttctaaattttgctcactttctctataaggctttccaccccagcattagaagctccaggctggagctctggttttggaatttcccatttctgtggtgtgggcaaagtcgacaagtcttcacgggctttggttgcatcagtgagtgaagagactttactgcatgatttataatgattcctttagttctaaactttaatgatcctaagactatatttaacctaaaatcattaacagacatatgttaatttctcacttttttcaaaccacttgattacacaacaaaaaaaaatccttatttatttttttcttacccccagacttctaaaagactaagatttcagaaacttttgttatcaagcaaatcatacctggacttgtaaacgatttcattatctatccctgccttcctccccagtaagaagggcagtagagatggactgtgctttatctgcatgtttttagtggagctatggaaagaaaaattaagtagtggaaaagctaccttttttttttttttttttgagatggagtcttgctcttttgcccaggctggctcaatcttagctcactgcagcctctgtttcccatgttcaagcaattctcctgcctcagcctcctgagtagctgggactacaggcacgtgccacaacacccagctaatttttgtatttttagtagagacggggtttcaccacattggccaggctagtctcgaactcctgatctcaagtaatatgcctgcctgggcctctcaaagttctgggattacaaaaagctacatttctacactgaaatccctttcttcttgggactgtgggatacatcaaaagaccaaaagaaagttagggaaggtggggataagctacaaattattccttctttatacattttgtcgacttaaaactacagttgcccaacaattcaaaatcagaactgcttttcagatataaaacaaaacaaaacaggctattctaagtttattaaaaaccatatctactctttaatttctaatgtttcatacgatactaacatatgccaaagtatgtcaactgttataaatgttatcaaaaaaaactgacttcaaaaaataaatgatctaagtaaaacatgaagttttcgactgaatccacaggagctaaaagaacaagcagttacaccatttcaaacataaaaagcctaaatgtgtttgttttccttttaatttttatggaaacatcagggggaaactggttttctttgttcagtgtttattatttcacctttcctgcatcagaaaccaaaatactttgataaatgggagagtctggtaaacagacccttgaagatgagggctcagaaccactaatccatcgcatttccatcactgttcatttttcatgaaatcacttaaccaccataactcaatttctttgcatataaaagggtaacacagcaaccttactccaattcatgcttatatagaaccaaaagggggcctataataaatgcaaacaagaagggctgagaaacctgggaaagaaaactgaaagaagacagctgttcttcccagaaatacaatcatcatatttactccactgacagtctatttggccactcctatttttattgctccaatcatagattatctctgcctgctgtcaaaactacttacaaatacagtttttgctccagagatccacgaacacaattaccagaagcaggctaagccaccgaagtagtttttccataccacccagaagaaagtaggcagttccattcctgaacttaagacactcagcattaaaaaaaggccagtacttctttgtagctacccacacccaaatgtgctataacacgaactgttctttgtacctaacatagtttcaagaaagtattaaaataaataggctgatataaacatgtctagtctgcttttttttttttaatccaaaagggcttccctaaagaccaaatttatctatgcgattccaggaatagataatgaatttttaaaaaatgtctagaagaacataaaaagctatcaaatgtaatatacaagcacaggcattacttatgaatatgtgaaatatgaatactcattcccttccataaagacacacgcccagatctggaattcccctgaaccacctggaagatcagggagataaaagttcatctccacctcttcatcctgttcccttcccccttgctatttccctcctcaacacactaacctttcccttcttgaaggcaccatcattcaagagtcacaaaagccatttatttaacttcactgctgttttattactgccatagtctcatttcctattactttctatcacatttttcatatattagaagctaaatatgttcttgtgggcgggctgggaaagcaacccccactcagttatgactactgcaaaaatgcattccgatttccaaacaccctactgctaggttttatccattccttgactgaaggatgattgtctgattacctttatatatcaggtcattacaagaagtgcaaatacttaggagaacatagtgggccctccttgtcaccctccccacttctgcccttcccaaaagacttacactggggacatttctctaggacctaggtcagaaattcactttacaaagcaatgtttgtctcactgattaactcaaattttataaaaacaaaataatcatatccttggctaaatttaagatttttagatctttattattcaagaacttgatgaaaacacagcaatggaaaactagttagctctaaaaataataatgcaatcttttattctcccaaagtgtgcaaatttcagctatctcaaaaaaatgttttactaagcaggacagaatacacacacacacacacacacacacacacacacacacacacacacatcttcttcttccatacatttttgtagtctatatttttttcttctatctctaaaaatatgtctctaaaagtgtagagtgacagtctaccacacaaaaacatacatatgggctggccgcggtgagtcatgcctgtaatcccaacactttgggaggccgaggtgggctgacttgaggtcaggagttcaataccagcctggccaacatggtgaaaccccatctctattaaaagtacaaaaaattagctgggcatagtggcagtgcctgtaatcccagctactcaggaggctgaggcaggagaatctcttcaacccaggaggtggaggttgcaataagccaagattgcaccactgcacaccagcctgggcgacacagtgagactccatttcccaaaaaataaaataaaataaaataaaataaaataaaataaaatatcatttatctgctttggcaggaaatgagaccaaagtaacacagctggacaaaatactgcaatttaattcctaatatttaattgatactcttcataatacttattcctaattcctttaaaaaaaatttgtttctcctttttttcatagagatagggtctcaccatgttgcccaggctggtctcgaactcctgggctcgagcaatcctcctgcctcggcctcccaaagtgctgagattacaggtatgagccaccatgcctggcccctaattccttattaaaaggaaaaaagaacagctttattgccaagaaagaaaacccaatgcttctgctgcaatttcaaatgcagggtaagtatgcaaacaaacagatttgccagaactgtgtggctacaattctaacacgagaaacacaaagttaaagaggcatacagattttttacatttcctgagctgtctctgaaaataacttacaggaaagggctgctgttgaatatcagtcccaacccccaccttctaactgtgcataatcttaactgtgctacgacaacatggaaatgttcataggctgttaatgtatactctaatccttacattgaaatccaacaataccatgaggtggtaaatgtaaccaaagagagaggtcttctagactaggtttcctgatttacaatgaaaatcccataataggacttgcagtgtcattcagcagctcttcaagaccagtctcaaatttaaaatggggagaaacaaaaacttagtactttctttcatcagagatgagggtatactgattcatttaaaagaaataattttgaagttcaatttatgttgaattctggtgcttgaagaccaaaagataaatccaaacctgtcaaatgacaggcacttctgggcaaagtttcaagggacaacaatccacatttctgattccacttcctctcttctcagtcccagtttgcaatctggctccttctccaacagtaccactaaaactgctctcaccaacattaaaaaacaacctcctaaacaccagatctaatcacgcccatttaaaaaagacttggttcaagtgttgccatgtaggtgatgttttctttaataccctattcagggtacaactaagaaaaagacaactaattagtaaaaccatgtattataaatttctgtcacctcaatgggcagaagttccttgggagtaggcatcacttttcacctttgaaagtacaatgcttgacatatggtcagtatctgtgaaataaataaatcgagggtttgctaagttgcctaggaaaacccaattatcatactttttctttgaaatatttataataagaacaaattgaaacaacacaggaaaaacttggaatgtttccagggacagttttctttatagaatcaagaaatctgcctcaatttcaaaaaggaaattccaacatttggacactattattttgctgatttgtctatagcccttgaataagggttacagacaaaggctcaaaggctcaaattttaggaacttctctctgaacatcaaacttcttaaataaaaatagtagtaaatgggtacccatcacctgaatatcaataagatagaaagatcctttgcctgctggctattttatgtttattatatctgaaacatttcaaggaagaggtctcataactatactcccaaaatgtcagaataatccagagtggctcacagttgcactaccaacaaaactgcctctgagaacccggagcggtgactaaatgatgacctatctggaacacctaaagctatggtttctccagccatgggaacttcccttccagtctccttcatcttcaggtttggctgttcgtcctttctcctctggggtttctcagtgccactccttacaccctcatccagtctcctcctctggtttcttctactcactctgccaggcatcagaaactcaattagccgaatgatgcagttagcaaaggagaacggggagggaaagagagaagggattggaataagaagaaaaggaggtagagaaactcactgcctactaattcccagccactaccctacccttcccccttatcactcctgacgactttcagtcttccacacagctcacccagcccccagtttcctcattcttccttagtcatctcatccttcccacaaaccctggggccccaggccttgtagatttgctcctctgagatcccaggtgcttaaccccaccctggctaccgcctcagccccagcttgcatcacagggacacacgtgcatgcacgcgcacacacacacacacatacacagtcagagataattcacctcccttgggctggggtagggagaggagtggaggggaagacagggcagtaatggttaatataacctgcggactaaactgaggacttcaccaccatttcaaagctgtttctttgggaaatacactctgagttccaaattaccatgaacttttagaacacaatccttttaggaattggggactgcctacaactactttctgataaattgtaaacatgttgttataaatttgtaaatgtaggctaggcatggtggctgacgcctataattccagcactttgggaggctaaggcaggaggatgtcttgagaccaggagttcgagactagcctgggcaacaaggtgaaaccccatctctacaaaaaatacaaaaattagatgggtgtggtggcacatgcctgtggtaccagctacctgggaggctgagatgggaggatcacttaaccccaggaggtcaaggctacagtgagcagtgatggtgccactgtactccagcctgggcaacacagcatgactctgtctcaaaaaaaaaaaaagtaaatggtaagcaatggatttatgaaacatctatattctaaagaataagaccatatgggctacacccaagcttgtcaaaagtctgtttactaaccagaatttggttggtcacatgtgtagactctgtaaaatacatgattcagtgaattagagccctgacccagactttcttccctgaaggttgagaaactaagacacccttgtgatgaccccagcagaaaaatcttaaacagagttcattttcactttttcttatcattttagaaccccagtcagtgtactggattttgaattaagtattctaaggcacaggtctgtattttcaacagcgagattaccaaacaggaccctttgagctcacctgaaatgtatgcctcactgttcatttatttgatctcagggtgtcaaggtgtcctcctcaggaagacttgaatttcttttctcctctattcaatgttgtttacaagaggaacaacctcccaggcaatactgtgattctgaccctatgactcagggcttttgattcctctggcacattttagtagtctcaagcctgttgcaggctccctgctgcaggcctaaacaaaagtctccttggaaagcgaaattcaaaagcaaagctcacccagcttttaccaggctgccctacttgacagcctataacctgtccaaagccgccctggtttcctgtggcctccagaaagaactctccttatgccactggctggctgcgtccattaaccccttctcaccagcttccacccagtcgagtagcaggccctaacaaactaagcagcataacagataaaaaacaagctccaggattggcagagataatggtaagcccttagggtttaagcctgatggccaacagaaaacacaccccaatggccaaacctccaatttcaagaaaaaattgtactcattcacaaataaagtgattaaaaaaaaaatttatcttaggcaaggatagtagtacattgtgaagaagccaaccaaacttattacacacaaaaaaatatgcaaaagcatgtttaaaaaaaaaaaggatagtaccaataaaatggttctgcagagaagagcaatcctgaaaacagacaatttgaaatatttatgccaagaaccggtagtggtggctcatgcctgtaatcccagcactttgggaggctgagatgggaggatcacttgagcacaggaatttgagaccagcctaggcaatacagggagaccctatctctacaaaaaataaaaaataaaaatcagctgggtgtggtggtatgcccctgtggtcccagctacttgggaggctgaaggtgggtggggatcacttgagcccaggagttacaggctgcggtaagccttgactatacaactgtactccaccctgggagacagagaggggaccctgtctccaaagaaaaaaaaaaaaaaaaagaaaaagaagtacttatgccaaggaaggagctttttgcctaggtactaatattcaggaagcagaaatatgaaaacagaatgcagctggctgtgagaaaaattagacaagggaggaaagtagccatttttaggcaaaaggaggaagggcaggaaagactgactacgagtaaagagaaatgctatgagaatacctgacagttaaaggaacttaaaataatttactttacttggtacgctgacttgctcgacaattttatttattcaattcacccaacaatgcttttttttttttttggagcccccaagatatgctttggctgtgcccccacccaaatttcaccttgaattgtagtccccataatccctacatgtcgtgggagggacccggtgggaggtaatttaatcacgggggcggttttcccccaagctgctgttctagagatagtgagtgggttctcacaagatctgatggttctataatgggcttttcaatctttcggtctgcacttctccttgctgcccccatgtaaagaaggatgtgtttgcttcctcttccgccatgattgtaagtttcctgaggcctccccagccatgctgaactgtgagtcaattaaacatctttcctttataaattacccagtcttgagtatgtttttattagtagcgtgagaacggactaatacaccccactatgtgccaagtattttctagaaaagtcacatttcaagacttgaatttcaaagacctgaagttagtggactaagaacaatctaaagatttccaaaagggtccatgtgcttttttgttaaacacaaacaaacattagaaatacaatggaaaagctacctatgcgactatggagagaaggaagccgctgcagtggttgctctcttggcctattttcattcattctctcttagacccaatcaacatctactgattctactaggcctcttgcttggctttatccagggcaaagagatgactagaactcttcatggagcttaaaaccaaatacagaacatcagacatgccaataaatagttatacattaagacagcctgagatgaaaggatatcacagcataactgggtggtcagaataggaagtaaacacttctgactaggtaattgtagaagcttaatgaagccaaagactgagggggtggattattgaggatgggcacgattttaataagagagatggagtaggtattccacaggtaggaagtgcacacacaaaagtgagaaataggcccagtgtagtgactcatgcctgtaatcccaaccctttgggaggcaaaggcaggagcagtgcttgagcccaggagttcaagaccagcctgggcatgatggcaaaaccctgtctctacaaaaaatacaaaaattatctaggcatggtggcatgcacctatagtcccagctactcaaggaggctgagatgggaggactccttgagcctggggagtcgaggctgcagtaagccatgatcataccactgcactccagcctgggtgacagagtaagacctcatctcaaaaaaaaaatttttttttaattaaattattttaaaagtgagaaataaagagtagttacgtgtttcctgcatttttcctatatccacttgaggtcagcaattagccatcaacaggtaaaatgaccaatcttcaaagagtggtgaacttctaaaaatgtggaggttccacctgataagcgcaccacacgtaaatgcctacatatttcagtaacttcagacttcttatacctagcaaataaatgtcattgaattggccaatttcctgccccaggtttcctgatatgacttctgagctggtgtctggaggcccaggacctctctgttccacgccttccttgcagcagcacctacattgccactggttcaaattctttgaatcggttactaaaataaattaactacttcaagcttgtattgcaaatacccattccaactgtatgctaaaaggaggctgcacttgagaataattacacattttctaaactattccttcaaccacgtgttttttttccccctgcattcctaactcaccaggctgttgaaggttaattgcaatgatgcatgcaaaagtgtctgtctggcacctgttacctggaatgctgatgtctgggtccaagctgcagctggccatctggagcttcatacggctcttctacctcatacacatttgcatcagcgtcctccatgctgctggaattctgccattccaactcttgagttttccgtatagccataataaatggcaagttctcgtactctggtatttcctcataatggcgtatattttcatactccggtgcacagaggcttgtaacagacttgtaaggtgcctgagatgatgactcccgggagagcatttggtcatccaaagactcagctctcagaccattagctgcactggtctggccccgagacttcttcctcttcttttgagattccaggctatagttttctgtggaatatgccttgatgggtttacttctcttctcctctcctaccaacaagccttgccaatcactttcaatccccttctgctccccactggagaggtggcctgtggtggtgtctccgagttggctactcttggaccaaaatttttgaaagtcactcttcatgaaacagatggacagtttcatgctgagcaactttttaaaagagtttttctttgtagagtctttgcaaggcttagtgcacttttccacatccatagcagataacgattttgctctgggcttggttagggctgttgaaggctcactgtttgacgatacggtgacagactttaagaattctgggttccctgaaaagggtaaaataggatgaggtaacttccacactggcttttctgaagcccgtttaggcatatcaaaggaggatgacacaccacggttttgggcacacaaatgctgaaggtgatttctttctagactcttctctgaacttttttcttcacttgaaggataagaacttttttccaaaagctcctcggaggcagcctttttaagcactcctgtagcaggcaagctatgtctttgaggttttttggggacaattcgtagagaattttcctcttttataacagattccttttgcatttgaggggcagaaactcccaggtttctcccagattgcaaatgttcattgcaagttaatttgagctgcttaggcaggctcatagatacagtacatcttataaaaccggtcccttcgtccacagcaagcgacatactagaaccatctacagttgtgctgtcagaactcaaattagagtctttatcaaaagaaggtgccattttttcaaaggaagttgtttcattacacatggctttctgtgaattgactaagtcctgtgcatcactgttggattccatattcaattcacttttatttcctagcttcattttatccacctgttcctgcttacacaaaacattctgatgcagaacactgattttattgattttcaaactattttcagtaagacaggaagagctactgtctgaattccccggttcttcagtgctttcactaggagtatctacacacttttggcgtaacagacgagcagttcgtgtctttctgggcttgggagttggaaattttggggtatatggtactaaatgaatttctaagggaccaaggtctttgacttctgatttcttactaactccatctgaagatattaaagtactccttttcccattttccagagcctctagttcagatgactgaaagcaattattgcttttttcactgtcatcctggcaagtttcaaaatgttcacattcatcactaggaagctgtaagtggcaactgtgatgatcaggaactttttcaaagctggatggggaaggtgacaaatccgcaaattcaattctgaattgtccatttgaattacagccaccattcatttctgggctgtctgtgggcctgtgcttctgtgcagaaataaaaggtggcatttggtgtattaaggcatctttgagctcctcttctaaaacgcttgcctttaaaacaaccccaccctggttcttggctttttcaccatacaaatcacatttactcctagtttttatagtcaaagtctcatcaattttactgttttctaaattttcattcatttccaggggctctaaaacaagctgctttacacacaaattctctctatggcccagcttatggatacactcagaactgcaggaacacattggtgaaatataatcattgctctgattgccttcatatttacaattaaagttgtcagtgctttcagctaattcctgtttatgcccttccaggttcaacatgattttccttgatggcgactgcccaatctctcgaacaggtgaggtcttcaggacttttggttttggggctattgctggtttcattttctttgtcgactgtggaacactagaaatcacaatgtcgggtttaggtgcaataggaggtggggctggcttattatttgccacaacaaacttgggcttgggggccactggtggcttctttatctctagaaaggaaaaaataataatttgatgtcaaaacaaccaaagcacaaaatgatacatgattaaatctgatagcattttttatttttaacaatatgaccttgccttttactgagtatgttacattatatagtatcaatattactcctgaaaattccttaaattgtctttcaattccatacatagctttgggtctattgtacatttttaaataaatccaatacagtttgtttctccagctttggaactgttaccatatctttttttctttttcttctttttttttttttgtgagacggagtcttgccctgtcgcccaggctggagtgcagtgacatgatctcggctcactgcaacctctgcttccagggttcaagtatttctcctgcctcagcctcctgagtagctgggattacaagtgcgcaccaccacatccggctaagttttgtatttttagtagagatggggtttcaccatgttgatcaggctggtctcaaactcctgacctcgtgatccacccacctcagcctcccaaagtgctgggattataggcgtgagccaccgcgcccagcccatcatatctttcattgacaaaaaatgagataattgacttcagtttgggacccacatagttgttcttcaattcatttgccaagtgctgaaagttgaatttgcctaagttaaatgtaggatgcagctctttaaacttcagatcaatgatcaatgatctgtctacctcgatagatagaaccccaaaacaatattaaaaaaggaagacagaaatcagaaattttctaaatttaaaaactgaaaattaattctttggtattatttaaggctcataataaacctggtatttctttctccaagagttattggttgggaattttcattatattccttcacggagctctattttttaaaaagtcacatgtctaggtcctaccctagagtgaactagttagtttctggggatagatcctggacatctgtacatcttttaagttccacaggttatgttgtttatccctcattaacatccactgttctactacatttaaaagataactacaatttctagtgtagcaattcttcctaaacattatatataaggtatttaactaacacctattatacaatgctgcatcggtacagatctgctcctatactataggaacctaataaaagctttacacaacagacctataaagcgaaaagataaataaagcctgtatatctgtaagttcctttatgttcttccacctacactgtcatattattgaccacatttccccaaggagacatgtcataaaaaatattttatcttttacatttatatttgttcgtttgacaggatctaacacttaataaaaacttaatttactgaaaaaacttttcaaaatatctgctgcaaaggactgctggacgttgtttaattacttgaatagacaggggctctgatatttcatttggtgatgacttacttttgaacaaaggaaattagtcacgacacttgggaagctattacacggaactgagtttttttaaaaaaaagaggagtagggtgctctacttccttttaccaaccaaggaagaattccctaaatctctacttctatgtgtgcaataaagattatatgatgtatatgatgatacatgtcctctcactcaatttctaggtataatgtcatcatcaataaaaaattattttcaaaataatgcaaattcctatactacataatttcagttagctgttcaatcatcatagttaattttgtctgagttttttttaggcagaaaataactgaaaaacccttcaaatcctagtgagaaacctagttgtaaatgtctattaaatcaaaccctccatttagtaagtcaagtcttaagagaaagtatgaatgccttaggcctcttcccaacggcccatcttactcagtacgactgtcaagttgattttatttctgtaaccattatcaaaacatcctacctctgggatttttcaaagaattttttaaaaattagttttggcagcctggcatagtggctcatgcctgtaatcccagcaccttgggagggcaaggtgggaggattgcttgagctcaggaattggagaccagcctgggcaacacagtaagactccgtctccatgaaaacaaaaaaaatagtttcgtaaaatgaagagttcttgagattggatgtaccatgtgaatgtacttaacacttctgaactatacacttaaaaatgagtaagacggtaaatttatcttatgtgctattttaccacagttggaagaaaacttcatctctcatcaaattaatcttttactttccgtatcttagaaccttgtcagaagctttagggtcatttaaatatcatttttaaaaaatccctggtaccaattttactctttttaaaaaatgcgttttgtacacaaatctgcttccaagagatataaattcctgttctagtgtcacagaaattcaattaactacgtatgtgctggagttgattcccaataaatatagcaaagtcctattacgtacataaaaccctcaacgcatactcactgaattcaattaataactgtgaacttgggcttgccattgttagttaactgtgtattgaaggaagtcacagacataactcagggagctggctaacctaattgtgggccttgtacagacctggctgcctcactttccttccttataaatgggggagttgaacaggcctctaaagcccataggaatctgagatgataacttctgagacactcatttcagaagaacctcatgtactgtggcctctgtctcctgcgttgatgttttttcagttcacctttgtctgtgttcagcataagacacaagctccagaagggcaggcactttgtctcattcactgatgtatcccagtgctaacaacagggcctgggaataatcacagctgccacatacacatactctttaatatgtctccataacagaaaatttcttctttaaaaataatcacattcaaaaatgtacatccattttaatgtagaataatattttgaaaagttagcaggaatcaatttcaatacgattattgaaaaattccttaattattaataggaacaagtgttcaactaagtcactggtagagcaatatccaaaatccttcattatttttttttcatggctctattttggaagaaacacaactcaaaaaataataagccattatattatggtctactccaatgtgaaataagtgcatgacatttggcaataaatctagcacctttggatcttaatactgcatcaacagtcagacccaaagcttcttagagcaaagcagcaaatcttttatttacacagctgtttggctccagggaaatataaggtaagaaagtaaagcactagtaccattttactaactattacaaacatactcgtcatctgttacacacagatggctgtggttcacgtgtacactctctggctactggaccagccaaaacgcaaagcacagacaatgaagacagtgacctgtacatgttcaaaaggacacaaaatatatacctatatatacctataattctctctccttttttctttttttttttttttttttgagatggagtcttgctctgtcacccaggctagagtgcagtggctcgatctcggctcaccacaacctccgcctcgctggctcaagcaattttcatatcagcctcccgaatagctgggactacaggcgcaccccaccacacctggctaatttttgtatttttagtagagacagggttttgccatgttggccaggctggtctcaaactcctgacctcaagtgatccacccgccttggcctcccaaagtgatggaattacaggcttgagccactgcgcccagcctctcctttttcatatacagcttaaaataattctgaaatctccactaagggcagattattttatagatgtagaaaaacaaagcaagcttttctgctggatacatataacctagatgttctacaacattccttttattttcttaaattaaaccaacccttccaaataccacagattagattcaaaagcaaaaatcccctcccttaacttcaagtaactttcctaaacgtttcaatgaatttgactattgttcccaaaaagcaccataatcagcttgtaagaactatgtatacatataagaatgggtagaaataaaaccccagttctcttccatattccccatctagacaccagaaagaattatgataaatccaacagatgggtgagcaaaaaagtagttgatgcttctcagccagcaatgctaaaaaccaaccaactcggctagacacaggaagtgtcccactttaaacaccacaaaaatttctgtggatttctttaattgtaaagttgataaaatacaaaaatagcttgcattattttaggataattcaaatgcaagaatcatgaacttccagtctgggccctagaaattgggtttacataaatgtgaaattacatgcttctgtgcctgttccttataaactgttaagactggaattgaaaactgatacatataagacacggttattttaaatacatttgacacctccaaaaaggaaagagctaaaactggctggaaggattttaaaatttccaaccacttttaatttaaatcaatttcttgaacgaaggtaaggcacagaaatgtaggatgaaaataatttaccttatgtaagtataaagcctccctttggcaaagaaaagagagtttataaagatatctcatataagtgcatataacatcaaaaaggaaagacccacacaacacccacttcttgctttcttttcctattggctaacttcttgtttcgtttgttgtaatctgatcacagggagcaatgcaacactacaatatatctaggctttagaaataatacaaatcagaacatttgagtgctgttggacagtttcaagttgcaagaattttaaacaaatgccaagaaaagcaatgaaaatttaatctgatacttaagtgctgattctggaagtaaccttgagaagaagctttaaactatttcactataaaatttctaatgaaagtttcaacgtggacaaaaacgtaaaataacccataacactctacttaatacataagttctggtttaaaaattaacctatgtacttacgaagtgaacgtaacaccactttggtaattattttgtaaaacagaaattgttccttaagaatgttcagaaacacaacgtctagaattgctgaaaatccacacaaagatagaggctttgtcatttggatgaaggggaaagaactatgggaggcagacagaaaataaagctttgtttaccctaatcaggtagaaacaaacaaaataattgtaattgggtgcagacaagcaaaaaaaaaaaaaaaaaaaaaacctcaacaatctcaactcctctgcttctcaggtaacagaggtaaaaccaccaggacatgacaatgtctacgcctctttaaaatgggtaaaaggtttaccagcagatacaaggttgaaagcgactcacttagtggccaaattgaacacgctgagaacactgcctttacctataataactgatctattaacttgggaatctacactattttcacatgcaaaggcgaagtcctcgcactgctggagagatgagcgaacgcccttcacacatcgcatttcacctggtgcagagcccccagcacagtcccccttggaagggagatcccgagaaatcccgggtttccaaacagcccctctgggcaggaaaagacgagaaagccggcagcgaatcccattagctccgcgcttgccgaggtgctcggcaaaggtacggggcacacaactcgcccaccccggcgaagaaagttgctcgcgagcccaagcctagcagcgctcgccacaaactttcccgcggcagcgcgagcgccgtcacttaccggctgcagaagtcatgattccccggtgcagctcgcttccccgctcggcccctcaatccatcttcccctttcagtccattgttcccacagttcgggtaggagagaaaagcccccgcagcgcccacattccgtcccgccgccccgcggcgcagcctgagcgccacacaaaggacgcggccgactctagcgaccctgcggcgctcccgggcgcgagccgccggggtcgggcgggcgagcactagcaccgccccgcagagcggcaggctgacagccaggcgcgggcacgagcagtgctctcttcggctccgctggcgcgtgcccttctcgggctccaaaaatcagcagtgctccgggcgccccctgctagtcgcggccgtaaaaggcagacaaaagccctagcctcctccaatcggagggctcgagcttcagctcgctcccgcctctctcgcttacacgctcactctcttctccaataagcgggctcgaaaagggggcgtgagcggcgaggcatattgggaattgtagttttctggacccacgggacgggcaggagctggagctccgtgccgcctgtactcccgccttcatttcccatcgtgctgaggcgggtggcatggcggagaaggatgacaccggagtttgacgaagaggtggtttttgaggtaagaggaaaatggcggtgggtgtggattgcctttgtttgagaaggacgagacggaaatcgaggaagcaaggcgttcccggggcgagggatcgggtgacgcgctccagctggcctcgaccaccgaaccccagcgatttcagggcctagagtccgtcgtcgcctgacaggtgtagccagaggcgccctggccgtggccggcctctatctcgggcccgcccagaattcccagacggtgcccggttgccaggctctgggctggagcggtgtctcttccttcctgggaatggatgtgcggcgggggggactgcgcccggctggggcggggccgaatcgtgccttttagatagtcacaacttagcctcctccttttccatccgcgatttttttgggtcagtatccagagtgcttcaggtcactgttcaccgtcaaggcgtggccctcggaatgaaggcagcaggtgcccgttttctaacacggtttaaagtctatttgtgggacctactgtgggtagttagggccagggcatctcagcatctagattcgattcttttgtcctttgctgttgcgctaggtgtagccagttcttctgactcggggctctagatgtgagtgcttttgtgtgggactattttaagacgttctctgccatcttgaatgaaaaaaatcgggcgagtgtttttgatgccatttttttccatcagacacaggtcaaaactcgcacccctgtacgtatgtgtattgcatgtatacgctttactttcatttatccaactagattttaagaaaatttaaaaatgaagtggcccatgccatacagcgagagagcgaggcacagacaggacagaatgctaaatgttgaaatatgtacaaactgtcattgaaggattaatttctgttcttgcggcctcccagaggctacacccagtacgcgatatccgaggtgaatctttaactatgaattggattagaaaaaccggcaggagaaaatgtattacagggaaagagaactgattatgccaagcttgggaagtgtgaaagtacctggtgtgcatttttagggggcggggtgtggagggtggctatgtaaagtggcttgatgtggctgcaatgaagaagcagtggaaaatgtggccattttaccgaagtgaagagtctagatatgaggcgttcattagggaagacaagggcctgagatgaaatgagagacgtaatggaataatggcttggacagacacttgtaagttaaaatcgaggcaatgtttatagattgaatgtggtagctgaaggagagagaaatattttctagagtaagggtaactgatgggtgtattttttttacccattatttttgatttctgaatataatagtaatatatgctcaaggaacattttattgtagaaaataagcccccaagttaaaatcatccattatcccaccacccaaagatggtaactattaacagtacggtatgtgttcttatagactttatttctatgtaaatgtgtgtttatgtgtgtgtaattttttagcctctatattaagacacaatgtgtgtgtgatattttttaaaacaaaaggtataccacgtagaattttgtatatatttttcacttgactttatcgtgaatcttttcccattcatcattctctgaaaacattaatattataatatcccctcacgtgtatcataatataacctttttttaaaaaaataccattgtaatcaacagtgatataagcctatttttaactacaactctgattttcctcagaataatttttagaagtagaactagtgggtgaaagaatatgaacatttaagacttacgcagaaaggttataccaattccggtttccattaagaataagagagtattggtttcaccaaatcctcaacaacagccttaacagtttcctttaatctttgctaatttgataggcaaaaataacattccattgttttaatttacattttatgcatttatacatttattagctatttttatttctttgaacatttctcttcatatttgttgctcattttcttattagatgctagctttaaaaaaattgacttgcgtgagttcttcatatattactaagcctttgtcatacttgcagaaaaatttccagtttgctgtttgtttgctctttgatatacacaatttttattgcagtataatttacataaggacagggcacagatcacaagtgtgtggatggttatattttcacatgttgagcacacccatgtaaccagcacccagatcaagaaacgggacagatggggcatggtggctcacacctgtaatctcagcactttgggaggctgaggcagatggatcccttgaacccaggagtttgagattagcctggacaacatggtgaaaccctatctctacaaaaaagacaaaaattatttgggcgtggtggcacatgcctatagtcccagctactcgggaggctgaggtgggagaatcacttgagcctgggtaggtcaaggctgcagtgagccatgatcgcaccgctgtactccagcctggatgacagagccagactctgccccaaaaaaataaaaaatgaaaaaagaaacaacatcaccagcacaccagaagctccctcctggtcctttccatcactactccctaccccaaaatgatcactatttaaacataataacctagattaattttgtctatttttattgtttagacactgtgcatttccatttatatactctcttatttctgacttttttttttcctctctggctttatttgtgagattcgtccatattgttaacatgagaatttttattttggcatagtattccatgtgaatatatgatcatttttaaattcattcttctattaatggtcattgagtagttcccaggtttaaactagtgctactgtgaacctttttgtatgtgtttggttaaacatatttctggtggatatatatgtaggaatggaattgctgggtcatagcaaatacctagatatttctgtagatattgccaaactttattccaaagtggttgtaccagtttattctccagccaggaatgtatgagaggtcccattgccccacatcctcatcaacccttgctaattttagtgtttttctttttatgattctaggggctatgtcctggtatctccttgtggttttaatttgtattttcttgataaagatgttaagatttttaatgtgtttattagccaattgtatatccattttgtgaagccacgtcaaatttcttgcatatttttctattgggttgtttctttttcttgctgatttgaaggaattatttacatacactggatacaagtcctttgttagagatgcagttggccctccttagctgagagttccacatctgcagattggaccaaccgtggctcacgcctataatcctagcactttggaaagctaagccaggcagatcacttgaggctaggagtttgagaccagcctggccaacatggcgaaacccagtctctactaaaaaatacaaaaactagctgggcatggtggcatgcacctgtagtcccagctactccagaggctgaggcatgagaatcgcttgaacccaggaggcggaggttgctctgggtgacagagtaagattccatctcaaaaaaaaaaaataaaggaaatactctggcccagtgaggtggctcatgcctgtaatcccagcactttgggaggctaaggtaggaatattgcttgaagccaggagtttaagaccagcctggtcaacattaacaaaaccctgcatattaaaaaaaaaaaagaaaaaaattaaccaggtgtggtgatgcatgtctgtaatgccagctactccacagcctgaggcagaagattgcttgagcccaggaatttgaggctgcagtgagctacaattccagcctgggtgacagagtgagaccatatctctaaataaataaataaatactcaaaaatattcaaaaaataatacaaataaaaaaactatacaggataacaactatttacatagtgttcacattgtattaggtattacaaataatctagagatgatttaaaatatgtgggagactgtgtgtatgttatatgcaaatactatgccattttatataagggacttgagcatccatggactgggtatttgccctagtcctgtgaccaattccccatgaataaagagacaactgtatatacctcatatatcttaccttgggctatatgtggcctctgcactcttttaatcgtgtctttcaatgaacagaagctccttattataatccaattaaaccttattcttttgtgattagtgctgttaaaaaaatatttgcctactctaaggtcacaaagatattttctttaaaagctttatttgacattttcccatttagatctgtcatccatctggtactgatttttgtatggtaacaagtgaagatcaacatttttttttccccgtatggatgtccagttgacctggcaccatttactgaacagatcattttttccccactgaactgtagtgttgcctttgtcataaatcagggaatcttttatgtgtagatctctttctggacactgtcttctttgccattgatcattttgtctattcgtgtgttaataccacattattttaattactataatttaaaaaataggttttaatatctgatagcataagacccttcagctgtatttttcttcaggattgcctttggctattcttggcccattatatttccatataaattttagaatcagcctgtcagtttttgtaaaaaaataaaaaataaaaataaaaaaaccctactgagactttgattgaaattgctttgaagctataaattaatctggggaaacttaacatctttacaatcaatattgaatcttccaatccgtgaacatttattgcttgccttctaaatgaatcaagcaacttctcatctcgttctgtgctctaggactgattttacaaaatgagaattatctgtttcttcagagtatagctaaattggcctttcctggggaaaagagactgaatgttgtctatcagctcaatttcttttatggttattgctcaggtacaattttctattttgataacttttttattctgaaaggcagtgtaatatagttaaagatatgggctctggagctggataacctaagaaatcctaggtcagctatttattagttatattagttaatgtgactttgagcaggttacttaacttgtctaagcttcagttttctccatattaaataaaaataacagtaactatctcgtaaggtagttatgagtactaaatgatttaatataagtgaattacttagatgagtacctgacacattgtaaacactcagtaaatgttaccttttattaaatttttccaacaaattgctttttatctaggttttcaaaattattgatatattcttagtagtctctttagtttcatttatagcacaaattagatctgattgttgttatgtttttctttttgttttgcatagatgtgctggagtttcaacttaccagatagacttttcttttttttgagacagagttccactctgttagccttgtcgcccaggctggagtgcaatggcaggatcttggcttgctgcaacctctgcctcctgggttcaagcaattctcctgcctcagcctcccgagtagctgggattacaggcacccatcaccatgcccagctaatttttgtatttctagtagagatggggtttcaccatgttggccaggctggtcttgaactcctgacctcgggtgatccacccacctcggcctaccaaagtgctgggattacagatgtgagccaccgtgcctggcctcaggtagacttttcaaaaaactagttggttttgtttggtcagttctattgaatttgtttgtggttttaaatttttttaaaatttctacttttatctatttccattcatctatttgtgtttattttgctatttttgttctgttttttttagcttcttgagttaaaaacctaaatgcccaaaataacttgtaaggctataaatttccctgagtattgcttcagttgtatcacgaaagttttgaaatgtagtttgtctcatggttgtataagttccatttttatttcttatttaatacccaagtatatagttgagggattgatgttatcattggtgattatttttctccctgtgtccctcagacccataattccaccctgatcattatggactgcatcactgcattcccttgtcctctgggttccatttaggttcggccagtgggaaggacctgcagatcagaggatggaggaaagagcgccagagaggtttgggtgtttcttgtctgaattctttccctctacggctactatttgttagtgattgcattcctgtacctaaagccacaactttttttttttttttgacagggtcttgcactgttgcctaggctggaatgcagtgttaaccatcataactcactgcagcctccaactcctggctcaggtgatcctaccacttcagcctctcaagtagctgggactacaggcaggtgccaccatgtccagctaacctgtaactcttatcacgggattcttcttgggaaaggctaggagcagccatcttatttcctgtgtttgggctttaccacctatgagacctgtaaccccctctacccctattaccactttcattcaacttagatctcaggccactgactgagaaaggccttcttttgaagagctgaaagcttgtaaggcatgttttcttgccatctaccacttgattactcagccagtggaacatatttcaggttctgctgagtcagccctacttctagatactaagtactgtgtcacccatacatcctaatgcacagtgactggtttttggcaccagggacttgtttcgtggaagacagtttttccagatggaggatggtttcaggatgaaactgttccacctgagatcatcaggcattagttagattctcataaggagctcacaacctagatctctcacatgcacatttcacaatagggttcctgctcctatgagaatctaatgctgccactgatctgacaggaggcggagctctgatagtaacgcttgctcacccactggcccaccatcctgctggcctcgggctgtattcctaacaggccatggaccggtaccagtgctgtgcaggcctgggggttgaggacccctgttaatgcagtaaacaggaacctgtctatgtgccataagcagaaaggaatttaacatagggaattaatggttagattatcatcggaaggcctacaggatcaagctctatcaaagttgctatatgctcatgaagacaagagcacgtgatcatgatcatagttacaatccaggaattagaagccatcaccactttgggagtccgaggcgggcggatcaccaggtcaggagattgagaccttcctggctaatgctgtgaaaccccatctctagtaaaaatacaaaaagaaattagccgggcttggtggcgggcgcctgtagtcccagctactcgggaggctgaggcaggagaatggcgtaaacccaggaggctgagcttgcagtgagccaagatcgcgccactgcactccagcgtgggcgatagagcaagactctgtctcaaacaaaacaaaacaaaacaaaacaaaacaaaagccatcaccacatctgcctctcaataacctaacaaagtgataccttggtattggaacttggagtctctccactgtctctaccacacctgcagctgtgttatcaagaagctggagaatccatattggaatactgctatagaaacattttgcctccacagctttgtttcatagcaaaaaaaaaaaaaaaaaaaaaaaaaaaaaaaagagagagaaggatggagggaagagaaggaatgagagaacagacaaatgaaagaacaaggccagcagtggggggatcacttgaggccagcagtttgagaccagcttgggcaatatagagagaccttgtttctacaaaaaattattttaaagaattagctgggcatggtggcatgcatctctagccctagctactcaggaggctgacgcaggaggattgcttaaacccaggagttcaaggctgtgatgagctttgatgaggccactgcactctgccttggtgacagattgagactttgcctttatttaaaaaaaaaaaaaaaaaagaacagttgaaacaaaagccaaagaagcaaaaagtggacttctgctcttcttccaccttccaaatctcttacaccatacacctacttggggaaaccctgatttatatctagaatcctagctgcaagataatttgggaaatttcagatgtagctttcctgcctctgtaacacaagagatacattggaagaaggattatagaatagagattgaacaagccaagccaatttaccatatctatcttagggctgaacctctcttcccctaagaaaatttaactgtgatttttttttttttggtatatttgttgtaatactgttattttaatgatcttcagatagaaatcagagtcattcatgtattgagacttacctagagaattacatgctgcatgaaagttaaaaacttaaatcatgcagagttttggataatattccaacaacatcccttcccttaaaacaaactctttgaggtatcttgttttaatttctgtttcttggattatttgtaaattttactgtactatattttgggtcatttgtatttctccttccagtgatcactttgagtcctcttagtctgagaggactagatgtgcactgaaagatgataatataagagaaggactaagggaggaaagaaagagtgaagtgcccaggcccaattcccatttcttgccctagaatctgattacccattttatcagagctagattccgtatgtactttcaatgttaattccattatattggagcctgactcctcctcctataagatcatttgttttaattagaatcttctaccatcattctactctaagaggctgaattgagaaggacagtataacctcagtcttggacctctcaggctaaacagcaacagaacaaagtttagaaaatgatggatactatgtctaatgtgaatattaacaaaataagcatgaaataccaagattgttgttttactctgttatcgtcatcattaattacagtgttttgagagtaagaattctccaattactttagaaaggtattaaagttctgatgttgctttcttaactgttttttagacagggtctcactctgtcaccaggctggcctccaatagaacaatcactgttcactgcagcctccacttcccaggctcaggtgattatctcatctcagcctcccaagtagctgggactacaggcatgtgccatcatgccctactaattttttcttttttttttttttttttgagatggaattttgttttgctcttgtcgcccaggctggagtgcaatggcgtgatctcgggtcactgcaacctccacctcccgggttcaagcgattctcctgcctcagcctcccaagtagctgggattacaggtgcatgccaccacaccctgctaatttttgtatttttagtagagatggggtttcgccatgttggccaggcttgtctcgaactcctgacctcaggtgatccatccgcctcggcttcccaaagtgctgggattataggcatgagccaccatgcccggccaattttttgtattttttgcagagagtgggttttgacatgttgcccaggttcaagtgattgttctgcctcggcctcccaaagtgctgggattacagacatgaacgactgcaccgggccttaaattttaattgcagaaacttcaggtcatctgtcttaaaccttgctattcctagagggaagagtgcctggaaataagactttttaaatctgaaagactaatttttctgcctctttgcatcatttgaagttcatttaaaccattcctttgtaactttcttctagtagggacaatgttgtattaaagggatcttttactcaaatctcttgccttggtaaccttatcctctgtaggtgaactcgttactgtttttggtgtttgtttaaattccttcttcctcttttcttttcttcctggctgagaaagataatttttgcccattttgtcatgatttctttttctcctacttctttcatacttctgtgtaagttattaaatgttaaccctttgttggcagtatgttcagctttcgcccttttctcccatagcatttaatcagttaaatgaaaggaaatgactctcacaaaacctttcacatttaaaaggaagttttaaaaaatttctctcttcctcgagagattcccttttctttgtatttttaaaagttattatgcatctctgaggaacatgaaggtactttttccctaagtaataattgtagattctttcttacttgtattattgatttgaccaatggaagaatattgtttttgtctgtgaacatatacatggacagtatttgctattttgataatggagcttcctgtctagaataattatacatataaaatttaaggtattattatatcatttaattttttttaatatatcctgagtttcagtttgtcaaacataaagccctaaattgtattatttaaaataatcttgttccaagtagtagctgagattagaagtatagcaaaattcatgctatcactatctataataggaataatatttattaatagtgctattaaatcacaactctattgacatcaaagattgaccattaagaccaagtctagccagatatggtagttcacacctgtaatcccaacaatttaggaggctgcggttagaagatcacatgaactcaggagttcaaaaccagcctgggcaacatagtgagaccctgtctctacagaaaatgtaaaaattggccagtgtggtggcatgtacctgcagtgcaacctgcttcggggctgaggtgggaggattgcttgagcccaggaggttgaggctgcagtgagctgtgatttcagcactgcactccagcctgggcattgaaataagaccctttctcaaaacaaaaacaaaaacaaaacaccaactctggtttataaccaagatatgcaagaagaaattccatgtttaatatgaattataaaaattattcttggggaacaagtctgcttttttttctgcttatgttgtgtcatttcttctgttttggcttcttcacagatccttggggctccagtttagattaaaattttgtttctgttttatgtctaaacattcaagaaaagtaggtagttctctcttttatgtattttttattgcatttattaaaatgtaagtccatttgtctcaagctatgacacacacagtgcctacattattttttttagttaccttggtattttatgtgcagctatattgaaggttttcatttttttaaaagcattgtggaaagaggaccagacgaggagtcaagagactgactgacataaattagcaatgaaattctgaataaatcacttaatttctctagagcttgtttcccaggatcatcctttataccatatcatcctttggtatgaaatttttcttaaatccattctaggggatcggaaactatctagtgggttgagtaaatgagagtaggcccttagaggcttccattaattaggaaatacaggaaaagaatctattcatttccagtctctttttatattagaaatcctgactcaattttagttttccctggttctgtaccaggtgttctctgagttcctagaagcaaatcatgccttaaggatttaggagaaaaggcccaaagctcagtgtactcgacaggggcacagtgttagaaagtgtactaacttcgaccagatgtggtggctcatgcctgtaatcccagcactttcagagggtgaggcaggcggatcgcctggggtcaggagttcgagatcagcctggccaacatggtgaaaccccatctctactaaaaatgcaaaaattagcaggctgttacaaatgcaaaaattacagctggtgcctgtaatcccagctactcgggaggctgacgtaggagaattgcttgaacccaggagatggaggttgcagcgagctgagatcacaccactgcactccagcctgggcaacagagagagattccgtctcaaaaaaaaaaaaaaaaaaacgaagtgtactaacttcattgcctctggattttttgagtattgcttatagtatacattgagacttcctgttgttattattcccactataggaaatcagtgtgcccattactttttatttgaaacaatatatttgaggacatcatttattttaaaatctgcattgtaatttatgtagttgacagaatatagcctcctatctcttattgttgaggtttttgctgattaagccacaacttttaatattatctcattaagatctttattaaaatggatttttttttcttttttctttttctttcttttttttttttgagacagtctcactctgtcaacccaggctggagtgcaagtattgcaatcatagctcactgcagccttgaactcctaggctccagctatcctctcctctcacctcatcctgtgtgagccattgtgtccagttatctctccttttttttttttttttatttattttgggataagaagcaaaggaaataaagttggatgttatctcttaatatccaaacattatattaaagtttactgcatgctctcctcacatccaacattttgccaattgtgtttgatcttctggcctttgtcttaaagcagttgaaaatgaagttttgcttcctctccttgcttctgctctgcattcatttaagtgaccgatgtgtgccagttaattagctagatttcaaataatatttaaagtagcatcagaaccaaggggatatcaatctaccattgctgacttctctccatttagttaagacaatccactgctgtccttgctttttagtcaatagagtataaaagctgtgtaagtcagttttctcccattgcatctcttagtcttctgatgggtatgtttgatttttatttagattttggacgtaggtagtattgcacttgagtatctttgtactgttgtataaaaaatcttaaggttactctttttaaaaatgtttgctatttattacatctcatatcagaatcattggataggatttcagcggaaaatattagaagcctgcagccagacaaacttcttaatatatgtgtcttactttttcttggtttatttaaaaacttttaaataaacactaatactaaaaacatcctttgaaggcgtttttaaaactccagtattcctattacctttgtctgtagttgctgagtaataacagcactgaagaaataatgttcagattttttttcagagggctgcttctgataggaaaatgcttagtaatgacagaggcacgccctccaattcagtggccattttgtactgtggttcttctggagaaacaagtgggaatcatcaaagaaagaaatgtatggataaaaaagaatatggacaagaggcagtaaatttttcatttaggtcaactggagaaattagaaccatgctatctgtgagtagtttaattagttggaccaattttaatggacccttttagcttaatctctttaaattctatgattagattttactttgctgattaattaattaatgcttgaatttggggctttggtatattaatttagatattatgttgaaatgtgtaagctccgaaaagcatttcctattattttatatctttaatatcctatgatattatctaaggtttaagggagataaaggcacgaagtagttaatttcagattatattttgtgattgcgtactgaattaaagataagtgaaaaggctatatagaaatttactacattggcaatacaattatggggaaatttattttccatgatggggttttgttaattttgacagagatttagccttttaagtagattcctcattaaaaattgagaaaaatcactgccttttataatttgttaatagtcttactcatcactttattttgtgatactctgcagctagcctggaaaaacatggaaatcatagcaattaacaacaggagtttaatcctttttagtggtattttccaaaaacaatatattgttgttctatatgtgatagtcacatttagacctatagctttaagctatattcaaagataaaaggtttttttaaatgctttaaaataacacataattttcaggcagatattttcccatcaaatccctttagttgcagataccttttccctagagattttattttgaattaaagatcttttagaggttctgttggcatggtagaaactttaaaaaatatgtaatttacatggtagtatgtagagaacactttttttccagagaaattacaagttggtacaaacttgaggaaaagttacgtataacttggtgaattctgtaacttgggaatggaaatcaaaggctttttgatcctttgaaccagaataagcacagattcatataggtgggaagtctgtgttaacaaaattacttctcaaacattacacagtttcgggcttttgtgccaatgctttgtgcctcatactctcttctctgttagtagctagtgtgcctgtgttttcttgttgctttttgtgtttaatatggactgcatggcccaaatgacatctgacatctgacaatagttagcattttgccaaacctgatagtgtggtttagatatcatactgacattttaaataaaggaatgtataatagttgaagtagagcattagtttttgggttggtttggtttgggtttttttgttcgtttgttttgttttttgggttttttgagacagagtctcactctgtcgcccaggctggagtgcagtgacgcaatctcggctcactgcatcctctacttcccaagctcaagcggtcctcctgcctcagcctcctgagttgctaagagcacaggtgtgtaccaccatgtttgactaatttttgtattttttgtggagacagggttttgccatgttgctcagactggtctcaaattccttggctcaagtgatctgcatggcttgacctcccaaagtgctgggattataggggtgagccactgcatccaccccattgttagtttttatatgggaaagtgtattggctcattttattcatttactaaattctcatgtaattaggtaccttcttttttctttttcttttttttttcttagcagaccttaactatgtttttccacacagataacacatgaatatgttctcattgtaaaacattcacataatacagggaaaggatcagctctcccttaatcccccttttcctttgcaggtccacctttctccacagaagtaccactgtaatcactttcgtatattttcttttttaaattattttttatttttattttttatgttttttgagacagagtctcactctcttgccgaggctggagtgcagtggcacaatcttggctcactgcaacctccgcctcccaggttcaagtgattctcccacctcagcctcccaagtagctgggactacaggtgtgtgccaccacgcctggctaatttttttgtatttttagtacacacaaggtttcaccatgttggccaggctggtctcaaactcctggcctcaagtgatccccccacctcggcctcccaaagtgctgagattataggtgtgagccactgtgcctggccaatgttggtatattttctttcagattattctcagcgcaattacattcatctatatgtgtatgtgtatatatatatatgtgtgtgacatacataaatatattgtataattccattttgtgggttttttaaaacacaaatggggtttttaaatggctagtactagtcgatattcttgtatgtatatttggcatacttttataattgtattcatagactggaagcttagtggtaaaattgctaggtcaacggatatttgcatttatatttttatacctatactcccactaatagtgtatgatgtatctgtattccaacgttgccaaaactgagtattctcagacttcttaattattgccaactaataggtaaaaattgtgtctttgtttcaatttgcatttcttcaaaggtgaagtttaacatgttttcattcatattgacccatttgtatttttttctttgaactgcttctttatatcctttacccatttctacaatttaaaaaaatattattactggtttatgtggccttattgtaaattaaaaaactgttgcatcatgttagccaaattttctatcaataatcttttttttttttttttttttgagacagagtttcgctcttggcccccaggctagagtgcaatggcgcgatctgggctcaccgcaacctccccgccggccgggttcaagcgattctcctgcctcagcctgccgagtagctgggattacaggcatgcgccaccacccccggctaatttttttgtatttttttagtagaggcagggtttctccatggtggtcaggctgggtcttgaacacctaaccccaggtgatttgcccgcctcagcctccgaaagtgctgggattacagacatgagccaccgcgccaggcttccattttcagtgagttgtttttaaaacacattaagctagttttgaaagtagttttgttttttttgttttttatttatttatttatttattttttaattgatcattcttgggtgtgatttggcagggtcacaggacagtagtggagggaaggtcagcagataaacaagtgaacaaaggtctctggttttcctaggcagaggaccctgcggccttccgcagtgtttgtgtccctgggtgcttgagattagggagtggtaatgactcttaaggagcatgctgccttcaagcatctgtttaacaaagcacatcttgcaccgcccttaatccattcaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccgttctcaacgagctgttgggtacacctcccagacggggtggtggccgggcagaggggctcctcacttcccagtaggggcggccgggcagaggcgcccctcacctcccggacagggcggctggccgggcgggggctgacccccacccacctccctcccggacggggcggctggccgggcagaggggctcctcacttcccagtaggggcggccgggcagaggcgcccctcacctcccggacggggcggctggctgggcgggaggctgacctccccacctccctcccggacggggcggctggccgggcagaggggctcctcacttcccagtaggggcggccgggcagaggcgcccctcacctcccggacggggcagctggccgggcggggggctgaccccccgacctccctcccggacggggcggctggccgggcagaggggctcctcacttcccagtagggccggccgggcagaggcacccctcacctcccggatggggcggctggccgggcggggggctgacccccacctccctcccggacggggcggctggccgggcggggggctgacccccacctccctcccggacggggtggttgccggccggagacgctcctcacttcccagacggggtggctgccgggcagaggggctcctcacttctcagacggggcggctgccgggcagagacgctcctcacatcccagacggggtggcagggcagaggcgctccccacatctcagacgatgggcagccgggcagagacgctcctcacttcctagatgggatggcggccgggaagaggcgctcctcacttcctagatgggatggcagccgggcagagacgctcctcacttcccagacggggtggcggctgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcacggcaccttgggaggccgaggctggcggatcactcgcggttaggagctggagaccagcccggccaacacagcgaaaccccgtctccacccaaaaaatacgaaaaccagtcaggcgtggcggcgcgcgcctgtaatcgcaggcactgggcaggctgaggcaggagaatcaggcagggaggttgcagtgagccgagatggcagcagtacagtccagcttcggctcggcatcagagggagaccgtggaaagagagggagagggagactgtgggaaagggagactgtgggagaggggagaggggaaagtagtttttaagactagagtaccattgtttctgtagtccccaagaatctttgcagccagtttctaaccttgtgtaacgtgaggcaaatgctcttactgaattctttttttttttttttctgagagggagtctctgttgcgcaggctggagtgcagtgtcatgattttggctcactgcaccctccacctcctgggttcaggtgattctcctgcttcagcctctccagtagctgggattacaataagcccacattacagtctcctgccaccacgcccggctaatttttgtatttttagtagagacggggtttcactacattggccaagctggtctcaaactcctgaccttgagtgatccatccatgttggtcccccaaagtgctaggattacaggcatcagccatggtgcttggctcttactgaattcttacatgtgaactatagctcatctgaagcaaaaataaggcaattgggaataaatgtagatattatcaggagaataatgctagcctattttgagttttctaacttaatctgctaaatagatttaaaattacaagtttagtttctagttaaataaaacaactatacacagtactacattagaccaaattaatgaacttgtttactcaaaattatttgcaatatgatggggtaggtaacagcactgaatctgtcaggtttttccaactcagaaaaatccctcttctgttgtttactactatctgtccttgtgaccttgggcaagttcccttggtctctctgtgccttagtttcctcatatctaaaatgagccatgcctcataaggttattgcaaagatgagacaggcttgtacataaaaaaaaaatacttagattaattcctggccctgtctgggtactcaataaatgtttagtactgctgttgtttgtggggagatgggtggaaaagaaatcaaccaaccagataggaactacactggatcatcctcctgtgagaaaattgtgcatctgggtagtatcaagcagaattatcagcctccactgatatcaccaaaccagaggttaaacttgctgtaacctcagaaatgggcagtgggagaagatcaagggccattaccaaacactcaccacgtatagcccccatagccttgggaaaacacagcactggaatattattttgttttgttttgtttttattatcttgttcatgttggtgtctgttgtggctctgtttcccttggaaactaaatttctaaattggtaatccattgcctcttgattatttctcttctctgagtttataccttaaaatttcttgacttcttgccatttgctactttatattagccttaggctaataagtatagagctctccctgaaggatgaataaaagtcatggagcctgtagatcataataacaccaattttatatgagcattttctaaaatgttctcacgagaaaaaagtctgtattggtatgttcccagattctgtagcttctatgaaacttaaagccaccaatggaaggggacaatttaagatgaagttagcttgaagagagacaaaaatatgattgaattaaaaattatgccttgcagggttgagcattttgaaccttatagaatatatcatatgatacatatggtgaacttgagagaggttgtttcttttacatctcaatttttctcaaagagacaattttatattatagtttaaaagtatgggctttggaatcagactaactgggtttatattctgatgggtgactttaagcaagttataacctctttatgactcagtttcctcatctgtaaaatgagggtaataataaaaatacctctttatagagttgttagaattaaatgaggtattataaaacgtgcttaactcaatgcctagtaaataagcaactcagcaaatgtcaactatttttagtgttactacattgtttttcaggcttggctctactgttttctaaaatatatatagtaactctgttagggccttcctgtcttctcttgccattatctctagttgatcttccagactacatatgtttctatactggtatgtcatatgagtttgccaccatatttatatgctaaaaacttgaatgtatacattcagtaggctactttcctgacctccagacattttaggtctaagccattcacatttgactatctcataggcacttctaatacatcaccttcctcctcagatttgttgctacgccactgtttcatatttcattaaatagcaccacctgattcttcaaatcagaaatcttaatcttgatccctccattgccaaccatttcaatcagtaatcaagttattttgattttaatacttaaacacatttattaaatgttttcattttttatacttcttgtagtcccagttatccaacaataagagactggataaataaatcatgatagattcatagaattgaaatgctataaggacactaaaaaggaataaggtacaatatatgtcctaatatggaaaggtctctaaaatacattcgatgaagcaagtgcagagaaaagtatatagtatatttccatttgtatagaaattttgaaggctattcatacatatataagtggatactaaattttgggggaaggattcatgagctaaatatttattaccttttgggtgagagactaggggactagggtaggaaaaacaaagttatttctcattttatatctttttgtattttttaaatttttagtataaaagtagcaaggcagtaaaaaacaaaaaaacaaactgaggttgagcagttgagcttagtgtccttttacagatgaaataagttaacttttcttgtatatccccagagagaagttaatggcagagaactgctaaagtaactagtgcctgacacagagtaggtgctcaataaatatttggctagtgataaaggagtaaatgatgattgtcccttttctatccagatgatctttaccctggaatgctgttagcactcagtcattgccatctgcaagagagaatagatagtgtgagggatcagaatcagaatttggccactagttagtgcagactacaaattgcttttctgaaagggtatatggctctgagatcagctcttctgataaagggaaggagagagtctcaagggtgcatcagggctagtgtgaagagctcggagggttcagacagacagaataagtgacataaggcccagcacggtagctcacacctgtaatcccagcactttaggaggccaaggagggcagatcacttgaggtcaggagtttgagaccagcctggccaccatggtgaaacaccatctctactaaaaatacaaaaattagccaggtgtggtggcacatgcctttaatcccagctactcgggaagctgaggcaggaaaatcacttgaacctgagaggtggaagttgcagtgagctgagattgtgccactgccctccagcctgagcaacagagggagactcgaaagagagagagagagagagagagagagagagagaggagagagagagaggagacagagagagaaagagagaaagaaaggaaggaaggaaggaaggaaggaaggaaggaaggaaggaaggaaggaaggaagaaaagaaagaggaaaacagaaacattgcaacaatgactactgagttggaagatagacaatcattgactgttcttagcccagtagatgtgctggattgtggacctgtagtattgatattaatagtgtgtcaatatccaaaagaaaccattcagtaaagtgccatttgtggaagaggctaggtttattgagatatctaactttcctagttaatatctatggcccagatagtcagatttgcacttcttttcttatgttgacaccccaacataattttttaaataaggaaaattttttattggaagactgaagttcagttagatgagcatgaagtttatgtagaaataatctcccaacagcttagctcagctattcttaaagtttttaaaatttaaggctctactggagtaaaacgatgttatatagaaaattattttcttcagatatttttaatactgtaataacatttcttagcctatttaaaggttcatattgattatcacaatacttagtgtaaccaagtgctataattattttggttttatattagtagctgattaaaatttcaatgcataaattctaatgcagttatttcgaaggtaactcatttcactcttagaaagcctgtttttgcaacaggctgttgagcattgcaagtcatggaaaaacagctaattttccattttggtcattgcttttcaaatcagtcatcgtcccaaaataaaaagtaaataatgaaagcagctgctaggctacatatttttttgtgattttttcaatctttgattccttatactcaaaaacaggttctcagccttagaactattgatgctttgggccagataactctttgtgagggttgtcctgtgcaatataggatgttgagcagcatcccgatctctacacactagataccagtagcgctgctcacatccaccccacagttttttggggatttttttgttttgtttttgttttttaagacggagtcttgctgtgttgcccaggctggagtgcagtggcgctatctcagctgcagcctccgcctcccgggttcaagtgattctcctgcctcaggcctcccaagtagttgggactacagatgtgcaccaccacgcccggctaatttttgtatttttttttagtagagacaaggtttcaccatgttggccaggctggtttcaaactcctgacctcaagtgacccacccatcttggcctcccagagtgctgggattacaggtgtgagccaccgtgccttgccaacaggttttgtttgtttgttttgagacgagtcttgcatggcttactgcagccttgactccaggctcaagcaatccttcactttcagcctcccaagtagctgggaccagaggcgcacaccaccatttctggctaatttttttatttttagtagagacaaggtcttgctttatattacctaggatagtctcaaacgcctggcctcaagcaattcctcctgccttggcctcccaaagtactgggattaaaggagtgagctaccctgcctagcacacccctcagttttaacaatgaaaaatgtctccagaaattgccaaatgtggggagggggagttgtgcagtgatgatttactttgagaaccactgctttataagaacatagtagtttttttgtttctactttttgtttttaactgtcttgtttaatggtgattttaaaacatggctcagaaaaatcacataattgagaatagtttattccatgaactttacattagtttgtggaaagaaaatgtgaataattcaaattgacaggtaagtagacacttatttgtgcctccactgagactagcaacttgaaatcatgttgctagaggatacctttgatatttgttgaccttggcgaaaatattaaaaagcgtagacattgttgcaggaagtttgcaagtccaaatacttgctcatcattttctgaattttttaaaaataaacacaaaaaatagcacatgtacaagttacactagttgatacacatgtgattaactcataaatttattttagatcttatctatattaacatttgctttttgtcgtattctctttcaatagacattaaaactaccactactatggaagtaccactactagatggaagtttgacctggacatggtggctcacacttgtaatcccagcactttgagaggccaaggtgggaggatcgcttgaggccaggagttcaagatcagcctgggcagcatagtgagaccccatctctaaaaaaaataaaaataaaaataaaatcacctgagactattagatagaagtttgtaagactctaatgggttttttctggtttttattttgttttgttttcttttcttttttagagacaggattttgctatgttgcctaggctggagtgcagtagctattcacaagtgtgatcataggccctacggcctcaaactcctgggctcaagcaggcatcctcagtagctgggactacgtgtggagtgttttaaaatctaataaaatgggccgggcgtggtggctcacgcctgtaatcccagtactttgggaggctgaggcaggcagatcacctgaggtcaggagttcgagaccagactggccaacctggtaaaaccctgtatttgtaaaaatacaaaagtcagctgggcgtggtggctggctcctgtaatcccagctacttgggaggctaaggcaggagaatcacttgaacctgggaggcggaggttgcagtgagccgagatggtgccattgcactccagcctgggtgacaagagcataactccatctcaccaaaaaaaaaaaaaaaaaaaatcagtaaaatgatattttccccagattataataataagttgaattttttcaagtttacatttttgttccatagtattttcttaagccttttataccagactttaggaaaacctagcatctgatttttaaaagacttttattatagaccttaaaaatgtattttaagggagagaatactacaatgaaaactccatggccaggcctggtggcttatgcctgtaattcctgcactttgggaggtttgaggtgggcagatcacttgagctcaggagttccagaccagcctgggcaacctggtgaaaccccatcactaccaaaaatacaaaaagtgagctgagggtggtggtgcatgcctgtggtcccagctacttgggagacagagatgggaggatcacttggaggttgccgtgagcagagatagtgtcactgcactccaacctgggtgacagagtgagacaccatctcaaaaaaaaaaaaaaaaaaagctccatttacccatcactcagcttcagcttcagcttcagcagctgttaacattttaccaaactgtctcatctattcctctcaccctcccccatcttttttcttggtgtattttaaagcaaataccatgtgactcccatttggcctgttataaataaataaataaaaataaagcaaatatcagacattacctaatttcacctgtaaatgtatcagtatgtatctctaacagacaagtacttgctgtgatttaggtgtggtttgtccctgccaaaactcatgttgaaatttaattgccatgctacgatgttgggaggtagaacctttaagaggtaggacctaatgggaggcatttaggtcacgaggctccactttcatggatggcttggtgccattctcacaatagtgagtgagttcttgctctctcaaaactgaattagttctcttgggaactgattaattcctgaaagagcaggttgttataaagtaaggactttcttagggcttggcccctttgcacatacccactcccgctttgaccttctaccatattatatctaggcagcagagcccttgctagaagccagtggcatgctcttgaacttcccagcctgcagaactatgagctaagtaagcttctttctttataaaatatgcagtgtcaagtattctgttatagcaacacaaaacagactaaaaactcttttttttttttcctttttcaagataactctggccaggcacagtgccttacacctataatcccagtgctttgggccgaggtgggaggatcacatgagcccaggggttggagaccagcctgggcaacatagtgagaccctgtctctaaaataaaaaacaattagccggacataatggcacatacctgtagtaccagctacacaggaggttgaggtgggaggattcctcgagcccaggagtttgaggctgcagtgagctatgcacaccactgcatgggtgacagaacgagaccctgtttctaaataaataaataatgataaccccaatataattatctcatctgacaaaattaataataatttcctaatatctaatacctagtctgtgtttgggcttccttaaattctcaaaaatgccttcttacagttgttccaagcagaatccaaaacaagtccctacgttgcatttgggtgatacgtcactttagtctttccccaccctcttgcctctttttttttttttctgagacaagatctggccctgtcatccaggctggtgtgcaatggtgtgatctcagttcactgtaacctctgcctcccaggtttaaaccatcctccctcccacctcagtctcctgcctctcacctttttaaaagtcatttatttgttgaagaaatttggtaattttttttggtgtgttttttttttttaaagacaaatgcatttcattatttatttagatatgtccttgagtcatagaaactaaataatttgatctacaggatttccatactctgtatttagcttattttgtagcataagatgacatttggtttagcacaaaattctgtattttaaaataccacttttggccaggcaaggtggctcatgcctgtaatcccagcactttgggagtctgagatgggcggatcatttgaggtcaggagttcaagaccagcctggccaacatggtgaaaccccatatctactaaaaatacaaaaaattagctgggtgtagtagcgcatgcctgtaatcccagctacttgggaggctgaagcaggagaatcacttgaacccgggaggtggaggttgcagtgagccaagatcgtgccactgcactccagcctgggtgaaagggggactctgtctcaaaaaataaaaaataaaaataccaccttttatcttgtttctcagagtgtcgtgagttttgttttactacctgaacaagtttaagagtcccatagcattcttactttgtacttaaggaagctgaaacagggagaggatttttctggaaacagagcatacctagaaagtaccagagcactcaatatttccttgataatgttgaaagcttgatgaaccgtggttttatcagaagtattacaagataaaactcttttgggaaaaactgttcctgttttgttttatcccctgtgcctacatgttgcctgacatggaagatgttcagtaagtatttattattgaatcagttgcctaattctgccatctttggcccattcttctctggcccaagacctgaaagcttacaacttgttctatctataagagtttaaagcagtttaaaagagtgaagctaataataaaagcactgtagccaggtagaactgctcatgcttataatcccagtgactcaggaggctgaggcaggaggatcccttgaggccaggagttggagaccagccagagaaacatagcaagaccccatctctacaataaatttaaaaattatctgagtatggtagcttgcacctgtagtcccagccactcagaggctgaggtgggaagattgcttgatctccagaggttgaggctatagtaagctatgatcgtgccattgcactccagcctgggtgacagagaaagaccctgtctcaaataaaagctaaccagcaatgatgtagtaatgacactggcacttgtacagaatacatcatgaatcatgtagaaaacaagcactgccataagtgaatggttggactttatacatctgggagatctgatatcttttcttttttttctttttctttttttttttgagacggagtctcgctctgttgcccaggctggagtgcagtggcgggatctcagctcactgcgacctccacctcctgggttcaagggattctcctgcttcagtctcccgagtagctgagattacagacatgtgccaccatgcctggctaatttctgtgtttttagtagagacggggtttcaccatgttggccaaactggtctcgaactcctgacctcaagtgatccacccgccttggcctcccaaagtgctgggattacaggcgtgagccaccgcacccacccagatctgatatctttatgtggggcctgcagggagcagggctggcaagaagtgtcagtagtgtaggacttggatgagacattttcttaaagagctttcttcagcaaaaatgtgggattttcctgtctatttttgtttatttttattgcaaaaatgtttcggccaccagaacaatcttagcacaaccaaaggttcttggctgtttttcatttagcaaaattctttctggtgttatgatatgtgttttctgtcagctaaaacttacaggaatagtgaaccacaaagatttcctgaggagctcccacatgctgtgtctgaggtttctcatatttcttttggcatcagtaacattctccaatacttcgaaattatagtttgaatccagtgttaatgatttctcttcaaaaaaacaacttaaataaaacatttgcggttttattttgcttgaaccaaggaaaagtcataatagagacaactacctactctgccttaccctctgcacaaaaacacccctttctaaagctaccatctaatactttatgaaaaataaatatttccctgtatttattagtgtataagcctaatatcccaaaacctctaaaatatagtggtcagaacagttgcaatagggagcctccccttgctgtaaaagaaaaaaagtcaaaataaattatgttgagtgatcaggttttaatactaagacattatttgcctttgtcactgtcattctcatgtgtgtatacagagtacaaaaagctcatcagatggttgcatattctacgttaacatttagctatttgaaactattacttgtttcggtacggctattcttctttgatactacaatgatcagaaaagactattaaaatacttctggctttccaactatattatttgtgtaagcctttatttttctgtatacttcacccaaaacaatacattgcaacacattgaatgcagaagcagatataagtatccggcaattttctattaagccaaacaataaagagatttgcaaaaagtgtaaaacaatctgttcttctcaataaatttttttcattttggagaattttttcattaacatatgttgtttaacattgtaacaggtttattgctattttcaagtaaaataataagttttttttaaattttagttttgagttctaatatgatgtcattagacgtccatgtaaacaaaagctctttggggctctccataatttttaagattataaggagagctgagaccaaataatttgagaactactggttaggatatggttttctgagatctattaaataatatacaagttatttgacagtttcggagaaaaagtgatagcaattttattcctaaacattttaaaagaattaatgtaagcataatgaatagaacttgagtgttcacagtgttcatacagtatctgggtttacatgtgttaggaagtaatatgatttgcactaacagccaaaaatagaaaaatgcaaatatgaaatataatagtagataactagaaattacattttattaaacctgcaatacattcacctcagtctccaaaggttgtcttctatgaaactttgacaaatgctttgttacatacagccatgaaacaaagtatggtgatcaccttggtaagccagatttttccagaactgtaaaacagtgctttctgggataaaactgatctgttactaatgatggggaagaaaccaaaactactgaggaatcactcatagttatatagcacaaatgggtgtgccacacctttaacaagaagcctgtgaaaccagccaaaaagttaatgagaaattgtatttgcagaaaaagcagaataaactactagtagaatttactgtatcacatgatactgttggatatgatctgtgatatataaagtgaatgattaatgtgctgtcattgtgaaatgtgaaatagcaagtgttccagattatggtgatccgaactgaatgtgtatatatgccctcagcttatatacagaacatatttgaagaaaaaagtattcttgtttctcttctggttatcattttttaaaaaacaatctatactacattttgttattttgtgatctgtgacataaagtggaaaaggaaaggacgttggggtcactgatgagagagcatctgctatctgtacagtaaaaaagggcattataatctcaataaaaagtttgtactcatcttgactctctaagtctcttgccagagaacagttagcagtcaagagtttgtctcctggttttgactgagtcttttattaggagaggagggcacgatggcttgcacctgtagtcccagctactcacgaggctgaagccagaggatagcttgagcccaggagttctaggccagcctggacaacacagtgagaccctatctcaaaaaaaaaaaaaaaaagaaagaaagaaaaagaaaaacagaaaacaaacaaaaagaacaggaatcagcaaattaaggtttttgggccggatttgccaccgtgacccgtacccccatttttggatggcaggtttttaaaatgtttttaaacagctggggaaaatatcagaatattttgtgacatatgaaaattacatgaagttcaaatttcagtgtctataaataaagttttattgggacatagccatactcattagtttatgtattggctgagtctgttttctcactacagcagcaaacttgattagttgtgacagagaccatatggcttgcagagtctgaaatatttacgatctggccttttaccgaaaaaggctgctgacccagagttagagtaacttccctttgatccatcttatttattgttcttccccatgggagttcatttgaagaaagggttctactgccttaaaaacaatgtttttttttaaagtatgtaaggtcggcccaaacaaatgaactggcattcttgttcttttgcccccactggggcaagagcagggtggggttcacagttcactttgaaaatgcagattcactaattcaaggcaatatttgaatatacattatgggtgatatcaagattaaccatttgtgctgccagaaattttaaatctggtagagggatatattacttttttaaaaaatatttttcttaaaaaaagagattaaacatagcttaaaagaaaggcatttgactcaattcctgttctctcaaattgatattccacaaattgctaccagtccagcagattcccactcttccttattcttctgaatgcaagaatatattccctaaatgtcttggtctatcttaggtatctctcctgtttccatagtatccaaatactttcctgacattgttaacttgcttggtgtgtttgtactaaactataagtaactttttggtgtcttccttaatagacatggaagggactgtttcttattttaggtaatagagtataatcctgctttttctaactgagtgaacccgtttcctcatctatggaattggaataaaaataataatgataatgatgataataataacttttattgttgtgaaccttaactgagaagatgaaagtaaaatacttagttaagattttgccacatagtactttaactgtgttgctcttttttttttctgttgttttatctctaaaacctaattatagtcttttttttttaattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccacctaattgtagtctttttggagatttaaatatttcattgaatggaatcaagatttattatttttttttttaattttttaatttttttttttttttgtgagacaaagtcttgctctgtcacccaggctggaatgtaatggcataatcccggctcactgcaacctccacttcccaggttcaagccattctcccgcctcagcctcctgagtagctgagattacaggcacctgccatcatgcccggctgatttttatatttttagtagagacagggtttcaccatgttggccaggctggtcttgaactcctgacctcagatgatctgcctgcctcagcctcccaaagtgttgggattacaggcgtgagccaccgcccccagccaagatttatttttaaacatgtcaccaactgtatgctttagagaaggttgaaagttaaaatttaagcttgctgttcagaaatagttgtccagtagattttcatccagtagtgacattgatatttctgtttgatggggttggggtgatttttttttttttttggtctgttctgaaaatctgtgctgtttccacatagcttatatatagttaaaagtataaatggagtgcttactatgtggcaaggactgtcccagatgctttatattaatttaattttcataagaactctatgaactaagtgctattactgctatttttagatgagacagctgatgcacaaaaggattataaatttcctggttacttagctagtaagaggcagagtcgggatttgaatctgtagattggtttttgtttgtttgttttgagatggagttttgctcttgtcgcccaggctggagtgcagtggcgtgatctcggctcactgcaacctttgcctcctgggttcaagcgattctcctgcctcagcctcccgagtagatgggattacaggcacaagccttcatgcctggctaatttttatatttttagtagagtcagcatttcaccatgttggccaggctggtctgaaactcctcacctcagatgatccacccaccttgtcctcccaaagtgctgggattacaggcatgagccactgtgcccagcagattgtattcttaacctctgtgttctaatgcttttgttagccatactgtgttctatttgtcatatgctcgtatgtaagatatagcttatctaaggtaacattattgaagagttttaagtttgttcacagtgctgagcatatggtagataatacgtatttgtgcttgaatgaattaaggaatatgatgagatgataaaaatattataattcatacaatataatcattgtttaattattcttggctttgagtaataacattgtcgtttgagttatctataacattggctattttgaagcaatctaagactataaaatttgggacagtgaaattgcttaacaatctatttatattcctaaattcattttttcttgctggtactcactcaaaaaaaaaatctgtgtgttttatttagagtttttccttttttgggttcctctgttgaattgtttgttgatttgtttgtgttaaatggcattgtattataacagataattcagttcttatagaagaagccttaaagaatttggacatactggtcacaatagtgaagtctggtattaagtttggcccccgaaacttttgaagtagtaatgatcttgaaatttgctttattttgtgtctttttcagaattctccactttaccaatacttacaggatctgggacacacagactttgaaatatgttcttctttgtcaccaaaaacagaaaaatgcacaacagagggacaacaaaagcctcctacaagagtcctaccaaaagtaagaacgcatgctcattctttctggccgaatcttttgcactttaccttactggctattcagatacttcttaagcacttccatatcctccctcacactggtaagactatttatttcatcaatagtacaaaactttctgttagataaacatgaatccttactgctttggaatactttgtaggtaatttatatccagtgaggaaataatttggtagagaattaaaatacattacttatttaaatattgatgctatccaaacagaatcgaaaaaaatatactaaaactttaatgagagcacaactaataggaatcctctactaactggatttttctctttaaatcttttttttaaaaaacagcatgaatgacaagaacgcaaattgatatttcttaaacacagtttcaggtgtagataatggagtgagcataacttctggtgacttttttatctatagaattaaatacttttatacattaaatatctcatagtcgatgtccagcattgaggccgagatactagaaaaatctccattaattatgttctacaaaatgcattttctggattcatttatgtcctgctagccatgtttactaaaataagaaatttatgggccaggcgcggtggctcacgcctgtaatcccagcactttgggaggccaaggcgagtggatcacctgaggtcaggagttcgagaccagcctggccaacatggtgaaaccctgtctctactaaaaatggaaaaattagctgggcgtggtggcgggcgcctgtaatcccagctactcgggaggctgaggcaggagaatcgcttgaacctgagaggcggaggtggcagtgaaccaagattgtgccattgcactccagcctgggcaacaagagcaaaactgtgtctcaaagaaaaaaaaataaatttactctatttttagatgagacagctgaagcataggaggattataaattatcataggttacttagcttgtaagaggtagagttgggattagaacctgtactttactccgagtttatgttcttaacctctgtctacatgtctagtatattttagttttaaccaaaggaattgtaatttaatagaaaaaacataaccaaatttcctcattccttgagcattctagtttaatcagtgttttatcactattgagaggagcatttaaaactttcaattagtcatttacagggaaagtatggattggcagaaggatcctttccccaatcttcttacaaagacacctaaaatgtgaggtaaccaagctggcccatttgtaatagtctagtaaacactagagaattttttgactaacacccagaaggtgagagttaggagagttagagctcacatggatcagaaccagttttcctagtcctccatttataccatttcttccctgtgccccttttaagagtgaatgttcctgggaagtggtttgtatataataggctatttaataagcttggatttgaggttacttggcaacacaaaacaaagaatggccaggggatagtcttagagcagcagatggtcattgacctctaattttttgttttgttttgttttgatacaaacttgggttttataggtattattgtcatttatgacaagtatttttatatatagaaatgttgttgctagtttataaataagtcaagtgagagtttaaaattgaatcccctcagaaactgaggaacaataaaaagcatagccagaggttgttttaaaaaattaccaggctgggcacaatggctcatgtctataatcccggcactttgggaggctgaggcagaaggaccacttgagcccaagtgttggagaccagctggggcaacatagcaagaccccatctcaaaaaaattatcatatgtctagaaagtttgttttgtcttcattttatttatttatttatttatttgagatagggtcttcccctgtcacccaggctggaatgcagtggtgtgattacaattcactgcagcattcacttcctgggcccaagtgatcctcccacctctgcctcccaagtacctgggaccacggacatgtgccaccatgcccagctaattttcttctttattttttgtaaagatttaaaaattaccactcactatgttgcccaggttggtctcaaactcctgacttcaagcagtcctcctaccttggccttacagatgtgagccaccacacccagccatattgcacatttctaagacaagtttttaactgtaggatctatatttttctaaaacgaagttctttttttttttttttttttttttttgagacggagtctcactctgtcgcccaggttggagggcagtgacgcaatattggttcactgcaacctccatctcccaggttcaagcaattctcctgcctcagcttcccaagtagctgggattacaggcacaggccaccacgcccagccaagttttgtatttttagtagagatggggttttaccttgttggccaggctggtcttaaactcctgacctcaagtgatccgcctaccttggcctaaactgctgagattacaggcatgagccaccatgcccgaccaatttttttcctaatttggggagagctaaattttagaaaacttgttgtattgtttagctcattgtcagggaatgtatgtttagaattgctcccaaaattctgttcaaggaatgaagtatcaattatttcctctgaaaagctgtttttctatgagttcttaatgaaaccatccttagcattaattgctctctcttttttaactttatttttgcatatgcttgttagtagttgttaagtagtctgccctgatattcttactatgaatattcattctgtctctttttctggtttcttttcctgtgattattcttaaattcattccatagagttttagcagcaggcttctcgttggcttgatatcttctctggggatctcatctactttcttgccacttatgtccattctccaggctttgctgagttccaggtgcttgttagacattttcttctacatgtgccccacaaagctcagattcaacttgtctaaaataggacttcctcagacacccccaaaacaaacaaacaaaaaatgttccttttaatagtcccaaatcactaccccctcagacacccccaaaacaaacaaacaaaaagtgttctttttaatagtcccaaatcaccaccctctcagttaccataccatttccaatcgcgctgacatagccttggtcatcaagtgatacatcaagtcagcttctgtgtctcttaaatctaactcttattcatgatcttttttgtactcattacctaacttaaaggcctttattgttatttagctgagtgattaattttcttttctcttttttgagatggagtctcgcgctgtcgcccagccttgagtgcagtggtgcgatctcagctcgctgcaacctccacctcccgggtgcaagcgattctcctgcctcagcctcctgagtagctgggattataggtgcccaccaccacgcccggctaattttttgtatttttagtagagacggggtttcactatgttggccaggctgatctcgaactcctgaccttgtgatccacccacctcggcctcccaaagtgctgggattacaggcgggagccaccgcccccggccttgaatatccttttaatcatgcttcttgtctacaatcataccctgccagtttagcccctgcactattgccaattatttttctttattgtttcgcttccttgcataaaaatctttggtagctcctcacaccctacaggataatgttcatactattatggtgtgtaagtctaagatcctttaaaacctatctcagtgtacctttttaacttccttactaatcccttcttctcttgggtcataactgtcctggagtgcgccaccatccccatgacatgtgctttaatggctctttccttcatcctcttcccttgactgaagtgatcttctcttttttttttgagatgcagtttcgctcttgtcacccaggctggagtgcaatggcgcgatctcggctcaccacaacctctgcctcccgggttcaagtgattcgcctgcctcagcctcccgagtagctgggattacaggcatgcaccactatgcctggctaattttgtatttttcgtagagacggggtttctccatgttggtcaggctggtctcaaacccctgacctcaggtgctccgccctcctcggcctcccaaagtgctggggttacaggcatgagccaccgtgcccaactcgttcttcccttctttgttaaattcctactcatccgttaggactgaactccagtgttagctcctctctgacctcctcttttccaatactttttcagactttacattgattgtaattctttatattgtctcttcttctatactaagttcttgaaaacaatagttacatgtatttatcttttttcccatgaccctttgcagtacctgggatatagtaatcactcaatgaatataaactgcacttactggcatgctcaaggaatgggctattaaggtaaattgaatttttggttgattcagtagtaaagcttttttatcaatatatgacagtttttctaaaatggtcaaagtatctttttgacttagtattgtggaatgaaatggtcttaatatttgagaacttgtaaccaccctatgatttttctttctgaaataaatactatcatcatgttgacatagtacatagtctccccaggataaatgggctgcttcagaatgacttctgcctgctctttaaaaatcggattttcaggcctcattccaaatgtattgaatcagaatctttagtttgggggcccaagaatatgtttctaactaaaatctccaggtgatcctgatatgcaacaaaatttaggaactaataaggaggctgagatgtactgacaaggtatataacctggacaatttttttcttccttttctgatataaattctcattgattggaggtaagtactttgaagtttttctgctgtttgggtatgcttttaataatcctatacaatgtcattcatttccttcagcaaggtatcctgttaaaagtggctgaaaccatcaaaagttggatttttttttctcagtgcaataagaaagatgacttacttcacaagttggtaagtggtcacttctttttgccacttttcagggttctaggttattagtgaaataattggtgaatcagaatttgttttgctatcaatttggccagcaattgatttttactagagattctgcagtaactcaggatcttttaatttgggcttactggtattgtttatagcttttaaagaggttattagccactcagaatggaatactctgatagttattgaaacgttatttgttagattgctaatttactattgccctcttcctccattgacaggtatccctctctataggtaaaggaatatgtcattagtgggatcaattcaatctgttaaatcacagaatttcccaaagactcgaaacagtcaacctgaaaggtctttgtgatttttgtgaggctttgtttttttctactctctgctgtaacagaactccaggggggaaatacttcaaccttctgacgtcctaacaatacaaaatccagggagtatagcctaaaaattcaagttatgtggttctcatggctcccagaaggagtaatgtagttacaagtaagcaggtttcaggatctctgctggcctgtaaccttaagaattatcattcctgtaaattaacatttgtaaggagattgtttacaaagtgctttcacattttgatttggtaatctaaacaacactataagatttagtctgcttcagtaacgagaaaaccaaggttcagacaatcagtttgttttaataacttactgagtgaattgtctaaaaatgttcagctagaaagtgatagagccagaatttgaacccaggtctcttggttccaaagccatgctctttctgctatagcatacgacctctctagctcaagtattattattttttggctgactaaaattacttttttagcaatccaaattgtcaagttctttgttcagggtttcatctttgttgaaggtgtattgagaaggtcaatgaagtgtcttatcgtctacatataatgccatttttatccaggtggagccatctcattcttcagtgatactaggactgtggtaaggtatatggatccatatacatttttctgtgatttagtcatagtctgcctaggcctggtcttttcattcttgattctgtgtcactggccacatgtttcatgtgatgtttcactatacagtgccagcttctgtatgcatcccttttgtgcctatattatggagaactataagaatacatacctaaggattagtttactagtaatggaacaagaaattgccaaggtggcttttggcgtgagattgcttgactttttccccttgattgtgacgtatttaaaatgttgttagctatacagatattgaagcaggccctcatttcttttgtaagaatattggcaattgctctgtgatatctgaacattttactaatgttcatttttatagtacttttcttaaaaattaaaaaaatcctttatagcaaccatgatgggtagtggtaatggcactttttaagtgccttttagcttataaagtgctttcacacgtgttatcttatttgatccttgtataaaaagccccatgatatccaaagtgattaagatctttgaagaatactgacaaatgaataagttctcttcttcatccctaaggaaaaagaaatcaaaatctcttaattttttatctgtgccttctcataacctttcatttcatccatgcagaaaggaattcctaagtactttctcatgccacttccctatttagatcctggaaagatctttatcaatcaaatcaagtccaaatttgtcacgtcagcactaaagagtctgcataatttggccctaacctacctttccagctttgtccaccagtatttgtatcaatgaacccagtcttcattttcctttattccgtacttattctgtatgtctatgtttgtgctcttatactgtgatggaatactttctgttttttttttcttgatccattagaatcttttcaataagcactcctagctttttctcaaagctttcccgaaacttcagcctattgtgtctcttattttctgcatcaacctagtaataattactttgtgttctataagtttttgtattgtaatatatccaacgtgtgcttttctttattgtttcagttattgcatagatagtgacaacagtaatagctaacatacagtgcttactatgagccactcttcttggtattttatagatactgacttatttaatcctcataacaaccctgtgaagtagctactgttattatcccacttttgccaaagaggaaactggcacagagagcttattaacatgcttaagttgtggagcaaggatataaagctagacactaagtcctggcactcagacttgttgaaaatgtgccaaagtttacatagtacacatcccaggagcatagagcctccagccatgcaggtgatacctgctaatatttaaatcgatcagaattagcaccttttcagtttcttcatttgtttgagacctggatctgggcttcccagtccaaatagtactgtcatgacatgtttcttaatttgcaggtgtcagtttttctggtagtttgattgttaccttgtaacacagttaacatgttttctgcagttcttatttttataatcaaagagtaatatctaattttacattttatccttaagaaagaaacttaattcattaatctgattcaatttaaaccgttataataatcagtatatagttcaagtttttcctctacgtgaggcaatctaatcactaagataacattgttttagttatttggagtgtcttggtgcctttcaagtttatttgtattcatagatgattgtaggttgttggttgatcactttttttttttttttttttttttttgagacagagtctccttctatttttcaggctgcagtacagtggcaccatctcggctcactgcaacctctgcctcccaggctcaagcaattcttgtgcctcagcctcacaagtagctgggactacaggtgcacgccaccaaacctggctaatatctgtatttttagtagagatgaggtttcactctgttggccatgctggtcttgaactcttggcctcaagtgatctgcccgccttagcctcccaaagtgctgggattacaggggtgaaccacagtgcccagtgggtttgtcacattcttaaatcagatattcctaatgctattaatacttcctctaagcacgttggttttggggaggtgttatcccagttttacacataagtctgatgccagggaatggtgttaaagaaagtgagtaactgattaagtagaatatctgtgaagagagagcactgccattgaatattactggcttttccactctctgtcagctttagccttcaactcgttaggcttcttcaaacttaccttatataggtacatagaagtctcataaaaggtatggtctaaagcttttgtagcaaaagtttgatttttaatacttgcattgaatatggctgtgtctaattggggaaccaaatagtaagatcaatttcagagattactcaaaaagctaccatgcccctgcgctccttttttctcccctctgaacaatagtataaagtgagttgtgttgctctgtttttatgaaagtggggtgggatgtcaaattaagtggttcctaatgttagaatcagaattgtgggaagagagaagaggcagttgttcaaatatgaaacataaaagtgctgcagaggtacatgcagagtgtgtcagtagatggtaaaaaaaaaaaaaaaagccatatcaggctaaaagaaagatcaacattccattgagaagatgctctctttttggactgaagataaataaaatatatctaaatgcacctaatattaaaaatcttcttctctaaaagtggcatataaccctgatcaagaggtcatgggctcagtttgatatatggttcacctcattcttactgaagtcctcattatgatcagcgaggcctggaatgtgtggtgtggggatgattaaattaactaagaagagcaaacctgttgccttcacaccctagacctaacaggttttactttaattgttaatggccttgtccatcattctctttattttgatcatatagtaggatcactctagtactaaatttgtttgtttggttttggtttattttttatttttattttttttgagacggaatcttgctctgttgtccaggttgtagtgcagtggcacaatctcggctcactgcaacctccgcctcctgggttcaagagattctcctgcctcagcttcccaagtagccaggattacaggcatgtgccaccatgcccagctaatttttgtatgttagtagagatggggtttcaccatattggccaggctggtctcgaaatcctgacctcaggtgatccgcccaccttggcctaccaaagtgctgggactacaggcgtgagccactgcacccggcctctatttgtttaaatttaatacaaaatacaactttaaattttcttttgaggcagactatatgcagggaaacacagctaccaaacgcttaggatttgaaatcaaaattctggaaagttacttaatctctttgggctttggtgttctcccctacataatggagaggaggatgataaggtacatcacagggttactgtgagaattcacctatctgccctaacagtgctacctcatctctcacctctctaccatgtgcactctgtgcacaatctattaataatatcatctaatatcgacgactcacacttccccaaattagaaaggcttttatcctgtaccatcccacttctccaactcctttgtctggtcaatttttgttcatcctttaaaacttagctcaggcttcacctcttttactttctctgacttcattacaggcttggtccctctatgccattttcatagtactctaggtgtatttcatcacactcctttgcatgttatattgcaactgtttactttttgggtcacttcattaaactacgaactctttaagaatagagacttgtatatctttttcattttgtgtcttcagtgtcaagcctgatgcctggcttatagaagatattccttgatagatgaatagaaagaagagaaggagaaataaatgagctcgtatatgtgaaggcattttgtaaactataaagtgctatgcaaatgttagtgtgattttacattgcattccttaatagtgtatttttaaatatctgaatatccatttttaggaggccttgatcctgctaataaaattcttaaatattggctatattgttacagcttcagggacagcatcttttatgttataggattatattttccatgtcgtgccctagcaatttaatcaattaggcttaactagacaagtttgttaatctgtaattactttacatcttgttattaaaaatttatcttttacatctgatggctcaataatgtctatctcaacctttactgtttcacatttacagtgaaaataaaacccagctatcatactgaaggtagattggactgttgtttcttcttgaagtatcttctgaaaataaacaccaccaaattttattagtacattaggagcttagcgtttaatgcaatattatatatgtgttaatacctctcttctggtattttaatggcaaggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttggtactgtccagaaaacacctattctttgactgcttacatacagagtattagcagaggaaacccatcattgtgctctccattgtaaaggcataaacattccatacatttagcagtacaattaaagtaacaatatggggggaaaaagtgcctttctaaagtaaatactatttaaagtgaagctagggaaaaaaatccaatttggttattatatacttccaactcattaaaattagttctgtgctcagcaacctagcaaatgggtataacaagtgccaaaaagttactctgccaggtgcagtggctcatgcctgtaatcccaacactttgggaggctgaggtggtaggattgcttaaggccaagagtttgagaccagcctgggcaacgtagcaaaatcccatctctacaaaacatgaaaaaatgagttcaggtatgttggcatatgtctgtagacctagctccttgggagactgatatgggaggattgcttgagcccagcagttgcagagtgcagtgagccgtgatcacaccactgcactccagcctgagcaacaaagcgagaccctgtctctaaggggaaaaaaaaaagaatttattttacccatacacctattcacatgtgtgcatgcaaacctaaccttctttgtgtttctttataattaataggttttatcgtaactatattgtagagacaccaagaataggatgggacatggaggtaggcagttgattctggctgtgttggctgagaaaagatcacagggaatgtgatttgatgattcattcagaccatcctaaaacttttcaacctcttgaactatttgggtctagagcagaagtcccaagcaataatctgttaaaagaaaaaaaaagaatgtgtagcaaaaagcgattatatataaaaaattattgatgtcttcttcctgttaaagtactttattaaatttgacatagaagggaggaatgaatcaagaagtacactaaatcactattcaaactgttcaagttatataggcagttacattcattggcctcaaggttctgtatttatgtcttccctgtcacactgacaaatgcttcattctgcagtcactcagatatgatcatgaagaagtaaagcttcttatccttcaaaaatacaagaatttaaggagctgatagaaggaaccataggttttaagaatttactactttactaactttcctttacccacaaatataatcaagcaactatgagacctataaatgattttagagtttactattaacatacaaaagtatatgatgagattttgctttatggtattgccagtattatctgaaaagtaaaggattctaaaggaaattagggcaaatatttatttatttacttattttttgagacagggtctctgttgctcaggctggagtacagtggtgtgacctcagctcactgcagcctcagcctcctagactcaagtgatcctcctgccctagcctcccaaatacctgggactataggagcatgccaccatacctggctaatttttgtatttttttcagagacagggttttgccatgttgcccaggctggtcttgaattcctgaactcaagtgatctgcctgcctcagcctcccaaagtgctgggattacaggcacgagcccctgcacctggccagggcaaatatttaataagaaattgcatgtgattttctttgcaatatgattattataactctttccaaatattgctgtttttcagctattctcagacacatcccccttatactcccctctttcttttcttttctttttttttttttttttttttgagacaaggtcctgctttgccacccaggctggagtgcagtggcatgatctcggcttactgcagcctgctcaagtgatccctccgcctcagcctccgaatagcagggactacggatgcatgcaaccacacccagctaatttttaaattttttgtagagaaggggtcctactgtgttgcccagtctggtctcgaactcctgggctcaagtggtcctcccacctgtgcctctcaaagtgctgagattacaggcgtgggccactgtgcctggccccctctttcttatatatacacattttcaccaaagcattcattgctttaaagatgtattttagtctgttagacttgcaattgatatgaattttaaaatgtgtacatatttttgtttcaattaaagtagtataaaagtacaaaccttgtccatatcatggtctgtggtaagtatgtatattccaaattgatgatgattatttaaaattagaggactttattcaaacaattactcatcaagtgtgtatcatttctaattggaaaaatgtgtacatattcttgatctagtatgtgtttctatgcaaataaagtttgattttaggaaaagggatttataatatctctgaaatagtatttttacttttaaatctataaaatcggattttaaaatctctaatttgctttttaggttaaggattccatatattttttatttttttaaaagtggtttcagaagatgcctattgttatatttattatcatttttattaatgtcataaagagaaatgtagcaatttctttggggtcacagaagaggggttggctaaaattagaagtaactatttcaagcttttggcaaaatcttcacagaagacttggtgtcagaggaaggtttgaacgcataggattttggtattaaatataagatgacaccaggcaaaaaggaaagagaaggaagagatgttctggtttacaatgcttggagttgagggctgggatgctgatctgactcaagacatgttctgggccaacttctgaaggattttgtagactgagctaatgaagtttgattttatcctgcaggcgatgggtggtatttctagctccagattctgtatatgtaggaaatgtagaggccttttgttggttctgcccagcattcagtcagcacctacagagaatttgagtttcttttgtgaaatcagctttacctgattccagaagatacctgttttcttacttaaatttatcagctcagatgttaatacctaagcactattgtctagttgcgaggtattttaaaaatctttcacatcaccttcttaaatgtcatatatttttaagttatgctttacaaagaagctagcattttatttatttagtaaacctaaatttaaattttgtttttactgattaaagtaattcatctttctttctctaatctgatgcatatcattttcttcctttcttgttcccagggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactgtgagttcattttttattttatttcttaaatgattattttctattccataaaggagaatatttattacctattttcatttctatgttgcatttataggaaaaaaaagtgcttttctctttagtacttactaaagtcaattaactgctaagtgaaggaataaatacattatgtgctagatttaatatgtagtatgattctgcctatctgctttgaggaactaaagtactttggagatcatgattatttctgtatgttaccatgtgattatatgagataatatatagagagtgtctgatactgaacctaacgtgcagtagttacccagtaaatgcttgctcccattactccctttcaaatgccttctttatgatagacgtatctgctataaatgcattttgaaaactcttgacatgtactaataactgttcaggtaaatattagcagatattatagcactgatactctcagaatatcatgcaaatagtgatgttttccattcttacaggaaattaaatattcaccagtctagctgtaagtatattaagctgtaggatatattgactacttaatctattattaaagggaaagttacatttattgagcaccaactatattccatatactatgctagtcacttttgcatacaactaaaggcatagaattataaatggtaaatattcatatccattccatctgattctaaacccggcttgcagtacactggacacctgccaaacactaacagatgacagttgtgtgctagtatatttaataatttatataacctatataacttttgcaatctataggtgggggaaagtaagcatatggtgaagaacattcatagctcttaattagtcgtatctagaaaatcatgaaaagagggagtgaagaacctctggtagccatcgcatccttcactctgttctgctctagaacattacacaatcttgagataaacactgtttctaaaaaatcatggaatagagaaatggaagaatcccagtagttatcttgttctttactctcttgtgttctacacacaatcccaagacataagatggattttataatttctctttcttctcaatcaaagtataaaagtcagccaggcacaatggctcacacccgtaatcccagcactttgggaggtcgaggcatgaggatcacttgagcccaggagttcaagactagcctaggcaatctagcaaaaccccatctctacaaataataaaaaattagccagacgtggtggcacacacctgtagtcccagctactcgggaggctgaggtgtgaggattgcttaaaccccaggaggttgaggctgtagtgagccaagattgtgccactgcactccagtttgggcaacagaactggagacaacagattctgtctaggttgggcaacagacttggtctcaaaaaaaaaagtataaaagttcttagcatctgttgatttttgtcgttgcattagttgaagtctacttcttattgacttaaaggatagcacgtttttaagttgtttaagtgtcaaattttaaaagtttaaaaaaatcatgcttaaaataagtaatatttccggccgggcacggtggcccacacctgtaatcccagcactttgggaggccgaggcgggcggatcacgaggtcaggagatcgtagctatcctggctaacacggtgaaaccccgtctctactaaaaatacaaaaagaaattagccgggcgtggtggcgggtgcctgtagacccagctacccgggaggctgaggcaggagaatggcatgaacccgggaggcagagcttgcagtgagccgagatcgcgctactgcactccagcctggacgacagagcgagactccgtttcaaaaacaaaaaaaaagtaatagttcctttttattttattgagaggacttactggttgaacaaagtggctttgttcaactaatggttaggcgtgtatagaggattctgtgccttgtgtcattttccaactttatctgtccccatggaatttgcacgaagaggtaaagtgggccagttagacatgatttaccttccagattatgacttctacccattcagatgacagacgaagagaagtattggaagaaattgtgcttcctttgtctctatctaactggataatgggttgaaaaatgaataataagtcttgaatcataattttttagacattttcaaaattagacagtttttaaaactgatttagtaaaatggagcacaagcagtagtgccatatattgaaatcatgaatgctgttttgtttctgactcaaattgtcctctctcacaaataattgaaaccttttttgccttcattcccttgtcttaacataagcctgtcagtcatcatcctctgctttttatagattttttaaaatttggtttttatagatttttaatacctgaatacattttagtatggtttaacatttttaaagttttgagttaggtgtgttgttttatagctttgtgttatagtataagcaatttacaaatgccaatattttgttttactgttgggaaagattactggttaggtgaaaaaatttatctgataaccaggtatttactcatatatactgtaagttatgaaatgtaatacattgtatgtcattgttacaaattaggtactccccattaatcttatgggaagtgccatgaaatgtgcttcctcttgaacagctttgagagtagctatgctactatgcagtaacccttactttgcctttctacttgtattcccctgttggccactggtcctgttatctttccacgtcccctacttcattttgagtaggtaagtgccagtggcagcaggtgggtaagtaattttaccctacttttatgaatgtacagaatgtatttctatacagtattttttctgtacaagtgaccaaaatatgatcagtgaacatatgtgatgaacgtatgtaaatgtatattaagaatttaaaagtgtttataattaaggtcttcatacttcctatggatataggttttgaaaactgaatataaagtagctcttctctaatatatgttagcaagcatagtgtctatgtaaaaaagatgtggattcttaataaatatttctacatttctgttatatctcagccagaatccattgtttccccacatcagaggaagcctttgctctttgagatgttaattttttgtcttttttttagtggttgtctatatatacatatatatatatatctagtcacagaaatgactattttatgagacctgagttgacatatgtataatcattttctagtgaagatcatgaaagaggaatttgttttctacatttaatagaattgtggatttaggaaacaaaaactttaggacacctgtacagttgtatcacattttacttttcaagtttgcttgacagggtcagtgctgcttgcccatttaataaagctggacagcatccaagtcagcatctcatcggtcttcggaaagctgtctaccgaactctaagagccaacttccaagcagcaaggctagctaccctatatatgctgaaaaaatatccttttctgtttatatatgaaactaagcaatgtttctggagtcctgaatatagatattatagttgtatcctgtgaaagtttactgtaaagtgagattgcctattttgaagctaatttccatcatcaattctatgttaaaactggaaatgcattcctgggggaatgacaataacagacaggaagaaagttctgttcttctgtgactgctttttaaacaaggaaaaaacttgaagtctcttcctttactcatccaaagaatgaagtcgaaagagtctggctttgctaggtctgacattttaaacaaatttctcaacatggcagatttgcatcatggcatgttaataaactggcaactggaaatccttcccttttcaaaaaaacaggttctaggagcagaatggctaagttcaaacactggctgtatcagttacttcctaagtgactttaagcaagtttcttaacctctctataccttgctttagtcgtgtttaaaatggcaataataacatcatcttccttattggatttttgttaggatcaaatgagttaatccatgtaaagtgatcagacatcatctagcatacagtaagcacccaaagactgcatgacaataagtctgtcacttaaatttattaaaataggaaattagttctattagccagaaaataaaggcatataagagctttattttagtaaagacatatagataagttaaatcctgactaagtagaaggtaaaaagacaactttgccacttcagaatgctgggtattgtagcactgataaatataatacttaaagtttacagggtgctttatgttctatcatatccttatacaaacctttgtagctagattttcttgtctccattttatgagaaaactgaaatagaggttaagtgacttgtgcagtatcatacaactactaatggatgaagttgtgtcttgactgtaggacttatgacttgaaaccatttttctctctctttctctctctttctatatatatatggaaatttcacatatatatgaaatggagagaaagcattttaatttttattaagaacttttccattttattccccattgcctaaatgccggtctgctatatgtcagccattcttccaggtgctaggaaaactgagtaaaaatatgtactacctacttctaaagacttttgaatgtgatcaatagagaaatcagtattcataatattatataagtgccgtgggtgccttccaacatagcagggcaacatacttggtttatggagtcagagaatgctttcagggaggtgacatctaagttgagcttcagagaatgaatagaagttggccatgaggataagagtctgcattccagatagaaggaagcaaaaacatatggaaagaaatagagatatgacagtgtggcatgtgaactgttggtcattcagtgaatatttatggagcacagactgccaggcaatatgctaatcactagacgtacagtggtaaacataatagacatgatccctgccttatggagcttgtagttcagtgtagggtagggagtgagagggttagcctatcaaagactacagactgtatgagttctttgtgccagtcatttttctagaaactggggacctggcagtgaacaagatagacaagatccttattctcgtggagcttaccttctagtagatgaaataatcaataaaatatgggcttggtgcagtggctcatgccagtaaccccagcactttcagaggctggcttgagcccaggagtttgagaccagcctgggcaatatagtgagaccttgtctcttaaaaaaaaaattcttttaaattagctgcatggtggcacacacccgcagtcccagctacttaggaggctgagacagcaggattccttgagcccaaaaggtcaaggcgcagtgagctgtgtttcagccactgcattccagcctgggcaacagagtgagagcctgtctcaaataaactaaaataaaataataaatggacagatgggattcttcagataaaatagttactatgaaggaaaaaaaaaacgggaataggatagagaatgatcggtggggtgctgctttttattagatggtaagagaaggcctctctgaggagctgacatttaaactgaggtttgcatgctgagaaagatctgggggaagagtatgctggttagatagaccagtgagtagaaagatcttgtggcaggaatgaatttagcatgattggagtatagaaagaagaccatcatgagttgagcacagtaagttggaggttagagtatgaaatgaaacagaggtggccaggggccagatcatattctccatataaaaaaccttaataaatttaactaaaaaagaatccaccaatcattttgagaagaccagtaagatatgtaaacccttatttgcctgatcaaagtaaagagcagaaatatacaagattagtaatgagaacacagtgataaccattgatatagaagacattaaaataactgtaaggggatagtatatgcagctgcacagcagcaactttgaacatgtaggggaaaatggttctttttgtttcttttgagacagtgtctcatctgtcacccagactggagtgtggtggcatgatcatggctcactgtagtctcattctcatgtgatcctcctgccttagccttccgagtagctggaaccaaggcacacagtaccacacctggctaatttttttgcattttgtagagacagggtttcaccattttgcccaggttggtctcgaacacctgggctcaagggatcccacattgctgggattgttataggcatgagccactgagcccagcctcatttcttatcaaaataaaaatctgcaaaactgacctaggaagaattttaaaacttgaagagattggacataggataaagaatactcaattttaaaaagaaaacacctggtttatatgtagacaatgcaaaatatgaaactatttttaaaaaacaatgatagagttcttagtgctctaatgtggatctccaagttatattaagtgaaaaaaaaacacaaagtgcacggattggtatttattgtatccttcaatttgtgcataaaagggactgtgtgtttatacagggataaatatgtatgtatgtatttatgtacatgcatgcatatatacctacgtatctccagatacacatttatatttgaatttgctcttatgtatgtatgcataaacaatcttagaaggtactggtaaatggaattgcctttgcatttggatagtggaactacatggctaaggaatagaggtggaaagtagtttttgctgtatcccttaatacctcatgaattttgaatcctgtgaatatactacctattcaaaaacaaagtgaatttaaaattttttaactaccagatccagatggttttatagttaaaaaaaatttcagactatagaaaaggttagaaagtttccctatatcattttatttatgaaaatactgtaatctcaataccaaaacatgttgtattacaaagaataaaaaccagttgtattacaaagaatatagacccatctcataagtggagaaacaaaatgtttaaatggaatatttataaatttaatattggattgtatcaaaagattattataatatgaccaaataggaatatgctagaaatgcaaagatggttcacgatcaataattatttagaaaaataattaaaaggaaaaatcattattgattttgatgtgtctgtaaggatgagggcagaggaaacctaacagtagtctatgtcaaacaagctagatagaacaggcctggtgccacttatatcagtctgtgtatttcagataacgttcaactaataatgtcctgcagtacgcagactgagaggaaaagaatatttactatagcatagtgagggccctgaaccatgacacagtaaagtgcacaatacagctacaaatggtaggtgtcaaaaataacggagctgagcgcagtgactcacacctgtaatcccagcactttgggaggctgaggcgggcagatcacttgaggccaggagttcaagaccagcctggacaacatggcaaaacatcatctctagaaaaaaatacaaaaatcagctgggtgtggtggcgcatgcctgtaatcccagctactcgagaggctgagacatgagaattgcttgaacctgaaaggccgaggttgcagtgagccgggttggtgccactgcactccagcctgggagacaaagcaagactccatctcaaaaaaataaataaataacgtatcactttaacccttttgaagacttgaactgttaattttttagacattaaaaattgtatccacaagtatccaagatatctgaggtattatgttaatatattagatacttaaaattaatttgtgtttaaaaactgctgtaaacctcctcatccaaaagttcagaataaagattagggaatgtgatataggacaatttcactgtatcttttatgctttcatgaaaaggctttgttgattgccttaacctaatttaacctaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggtaatccatttgtgtaagggaagggctgaagaaaaaatagatgcacttggattgtgtctatgctttctgaatgtaaatagtgcgtttgttccactcattgtttgctgcataccatcatcataaatgcacgggtgatgtttgtaactctgtctttaagagccgagagcataataaagattggaagaggagatccttagattttgacgtccaaatacttaaaatgcttaaagaaatgccttaaattagagtttggagataagtgaatttactttaattggaggccaacgtgagtgattttataactagccatttgtttcaacaaacatggataatgggttatctccaaaattcttaagtttttttttcatacatcaaaagccacatgaaaggatacatttagctacatagaaattaaacttttgggctggccgggtggctcacgcctgtaatcccagcactttgggaggccaaagcaggcagatcacctgtcacctgagctcaggagttcgagaccagcctgaccaacatggtgaaaccccacctctactaaaaatacaaaaattagctgggtgcagtgtcacatgcctatgggaggctgaggcaggagaacccggaaggcagagtttgcagtgagctgagaccatgccattgcactccagcctgggtgacaatagcaaaactccatctcaaaaaaaaaaaaagtaaacttttaacttcaaataatgcatacttcaaatgcaaacaagctcaagaaaaattacaatgatttataacaaagagttttaattttttttttttatgcagagcactctaaagtgtctaagatctatagaagataagttgggtgcatgaactgacagttcacaaaaaaagaaacacaggctagtcccagtgaggttgtattttacaacgaattgatcacaaccagttatagatttctttgttccttcttcactcccgctgcttcatttgactagcctaaaaagaaaaaacaagaaaagaagaaatacaaatggccaataaatatgataaaatttttcattttagtaatgaaagaacacaaataaaaataataagccgaccattttgccaagtatattgaaagttggtaatttcattatcactgaagattcagggagacctcacacaccaatggtgaaagtataaactggttcactttagcagtgaataccaatcttcatacaggtgtatgaagcaaaattgctttattctagcaattttaatttgcccttacagatttatctcagaaagtaaccaaagatatacccaaagtatgttcatgacattagtgtagcagccaacattggaaacaaattttttttgtttttctttttcttttaatttttttcttttttttttttttttttttttttgagacagagtctcactctgttgcccaggctggagtacagtgtggctcaatcacagctcactgcagcctcaacctccccaggcctcaggtgatcctcctacctcagcctcccgagtagctgggactacagttacatgcctccacacccggctaatttttgtattttttgtagagacagggtttcaccgtgttgcccaggctggtctaaaactcctgagctcaaactatttgcccacatcagcctcccaaagtgttgggataacaggcatgagccaccatgcccagcctccagtagtatttttaagacattgatccaaatgtcttaagttcctactaagtatttagtaagctctctttagatgtttctttgtttttagtttttaaaacttcccttgataccgtgaaaattagtgcaagtattgttgttagcatttatcaagatccattttgttttgagactgtattgacttccatatcttttacattttctaaatcaacataaatgttctaataatcttgtttgttttctttctttcctattacgtaaaatttgctttggcttattcctactccccttctaacccatctcaataaatggcaccacaaaaaacctggacaccatctttcttgtccctctttttgcccactcacatccagtctgttagcagattcttatgtcacttctaccttgaaaatgtattttaaacccatccacttttttctatatccacccccgcccccgcaccatcctagtcccagccaccatgctagtcccagccaccatcatttcatacttaggctgctgcagtactttcctcagttatctaaagttatttgtttcagaatgcaacttgacatgtaaagaacctttttaatgatttatcctttgaatttgtaattccccttctacaaactgcaggaaattatttaaaacatagttaaactttatataccaagctgcttattcactttgtgtttataatagtgcacaatggaacactgcctgaaagttcaaaaatagaggaatggctgtgtgagtcatgccagagccacatggtgaaccattgtgtagcagctacagcttgcccgtgaaaattctgtaaaaacttggagaaacatctgttgccagtgaaacaatcaggatacataagtgtatatgcaatatgtccacaaccctgtttaaaaaaaaaaatgaggagaaaataccaagatatatatagctactctttggggtggtgggactatagatactttcacaccctttcgaatttaatatcctaaccttgctttattctttaaggaaaataaagatttttttcaaagtacaatttaagagattcttaatgtggaaaatggagcagacctgtgtttatattttagccctgactgactagccatttgcctttgaataagttattctttgaacttatgtcacctgtgaaaaggagttaccatccctgccttataaggtattagattaaatgagaagacatattaaatacctagaacagggcttgacatataatgggtacccccaaatggtaatagctgttattctttaagaaggacttggagaaagaattatagtatttcatttccttttaaattactttttgttaactcatcaagatgccttggagatttatttctttatgctgttgatgtactgtttttaaaagcttattaaatcctgaattgtactctagcttaagtataggcagcaaagagaagttgtggaccctgtggagtcagattttccaggtttcactctagctccgttatttgactactgtgtggtcctgagcaaatcattgtttctgtgtttattaaaatgggataattgcaatgcttgcctccaaaggattagatgtttgtcagttcagtgcctggtgtagagtaagcaattaatgaatgttagctgatttttaaaattctatctgatatggcctgctctgaaatgtgagacttgttctctgttgctgtatccccatcctaccttccaacaatggtgattatagctagattccttttgctcactcacagtgttttacaaatcaaactataatagtatttttatatttcttttatttttacatataactaacctgtaaccaaactcaatgattgtgttacagttaccacatttatcaggctctgaaaggagccttatcttgaggagctctatagactttgcaaactgttgaaaacccctgtaatgttcaaagactgtgtattacccccttctgtagttaccactgtatcgttattcagataagaaatttaaaaatagattttgtaagttaaatttttaaaagtgtgttgccccctctaaagaaaatacattttggatttattttttattgttcccgtatcttccctcaggaaagtttagtgatagtaagtattgcacctttagaaagaaaagcaacctccaaattgtagcctgaggagacataaataaaatacaggttgaatatttcttatccaggcgtgagtcttatccaggcctggcaccgtggctcacgcctgtaatcccagcactctgggaggccaaggcgggcggatcaactgaggttgggagtttgcaaccagcctgaccaacatggagataccccgtctctactaaaaatacaaaaaattagccaggtgtggtggtgcatgcctgtaatcccagctactcgggaggctgaggcaggagaatcgcttgaacccaggaggcggaagttgtggtgagccaagatcgtgccattgcactccagcctgggcaacaagagcgaaactccgtctcaacataaataaataaattaattgattaattaatttcttatccaaaatgcttgagactagaagtgttttggattttggattttttcagattttggaatatttgcattacacattgaggttgagcatccctaatccaaaaatttgaaatttgaaatgttccagtgagcatttcctttgactgccatgttggtgctcaaaaagtttcaaattttggagcatttgggatttcatttcaaggttttggattagggatactcaatcagtccctagaacacagtccttatccctctcttttcctttaagtttttaactagttttttaaatttatgaagtcatctgtttcctgctctagaaaaaataaatgcacacattgtgaaatgctttaaatcaaaattttctgtttacctatcagctatggttatctccttatccagaggagctttccttatccaaagaacaaacaggaaaaaagaaatacatatttctgagttctggtttaagtgggtaatgtgacagtgattggatgacaaattagtctttagagacaaggtcttgctcagtcacacagctggtgtgcagtggtgcaatcgtggctcactgtaaccctgaactcctgggctcaagcgatcctcccaccctagcctcccaagtagctggaacaacagttatgtgccaccatgcctgactaatttttaagaaaatattttgtagaggcaggggtctcactgtgtttcccaggctggtctcccaactactggcctcaagtgagcctcccaaagtgctgggattacaggtgggagccactgcgcctggcctttagtcttttcaaaagccgcagtaaactgtaccaacttgattcttgcagttatcttgacccaacatgctggaatcatccttgttaactctttttctctcaataccaatcagtcaagagattgtgttagttctgctttcacaatgtatccagagtccatctgctgctcaccttccaccactaaccaccgtggtctcattaatgcttacctggaatattgcagtaacttccttactggtttctccacttctactctcattttcctataatctctcaactcagcagacagtatgggcctgttaacgcataaatcagattatgtcatgcttctgctcagaacccttcagtggctccccattgcttacctggccccagccgtactgagcttcttgctgttccatagatctaccctgtgtgctcccacaacagtactttgcatttgacttcctgctccctagaactctcttccttgatgattatctcatggctcacttccttcaggtgacacttttagagacctccccagccagccccttctcctctctccttcgcgctttctgtctctctccccccctttcatatgtgtacacacacatacacacacacacacacacacactattccccccctttcatatgtgtacacacacacacacacacacacacacacactattcctcttctttgctgtgtttttcccatcaaccaagaaacactatctttctttttcttcctcgacaatcattactgcaaaagggaaatagtatcttttacttgtaaattattatctgtgcccctctacttgaatataagctccatcagagtggggactcttcatttttgctcactgctgtttatctgcacctagaacagtgcctggcacatcatgggtgctcaagaaatcatttctgaatgaacgaacaaaagaataaaaatcattgtaatcataaaatttaacagttgaataagaaggcttgcaagtaaacttgcaagtcaagaatccctagatatcacatctgtagcaactaggaaattaggccttggtcactttaaaaaaaaaataagttaatggtaaaatagatatacatgaaataatcttaattcattattggcataattttaaaattcatttactaaaaccatctaaatactgtctattttcatggttgtgaataattggaatctaaattacccaaagtggtttcatcctctttttattccctgctacctcttgtttcatactacattgtttcctcatgcatttgtttcggagatattgtcctcatcttgaataggactatatctggagaaatattttgctgccaggattcaggatgtatctcaggaacgggcctatgaacatattcagactgcattttaaaaaaaagaagaagaatgggatttatcctggcaacatactgagaccccatctctaaaacttaaatattagctgagtatggtggtacatgcctgtgtttcccgctactcaggaggctgaagtaggaggatcacttgagcccaggagtttgaggttgcagtaagctatgatagtgccattgcactctagcctgggcaacagagcaagactctatcacaaaaattaattaattaattaattaaaataatgggttttgcaatttctcatgtcagacattcctggagtattgattttttttttttttggatggagtcttgctgtgtcacccaggctggagtgcagtggcgccatctcagctcactgtaacgtctgcctcccaagttcaaatgattttcctgcctcggcctccgaagtagctgagactacaagcacataccaccatgtctggctaaattttgtatttttagtagagacgaggtttcaccatgttggccaggctggtctcaaactcctgacctcaagtgatccatccgccttcacctcccaaagtgagccactgcgcctagccctggactgatttttatgttaatttcttagctaattcctagggcaaggtaatagtcttattttgaaacccaagcttttgatccatgtgactcatttctttggagagaaaaaaatatatatatatatgtatatatatccactagtcctactatcttcttttctcctatgtgaaaattttttttaaataatgagtgaagattcacttttactaaattatctcattccatcaacacttcccatctagggcagaactgtagtaaattatatattgatgttacctgctgtattggaatcagaggttcccacacacataatttgaaatcatattcttggctaatcttaaggtagtttaagttcggctatatttattatttaggataaagtgcaaaatttaaaccagaagttaagataaacaaatttatagtttgttttgaacactgaccaatatttttattgatctagttcttttttcttttttctttaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgagtaagtttagaaattataccaagaaaggtctcggtaattagcaagcttcattcgtgtaccattgtggttgttggcttgtgtcctacctagaaaaaagaaacaaaactgaggcatgagcatgaagggtgatttatagctataaatatagcaaaaaaaaaaaataatttataagtactataacttgagggagttattatttatagtttttacttttccttagttcaacagaaaacttggaaaagtaggctaaaagcaggtgttgttcattctctttgagagctgaaatggagatggttataaagaatgagtttcttttaactgtcttaaggtagtgctcttaaactggaacctgcagtccaatagaaatatctaccagtactggaacagtatatatgttatatatagtggaagagtaacatattgctatttttctaaataaattacagcagatctgaaaatttttttgtatcacaggacaagctttgtggtcccagttgaagagcaaaatgtagagtctagagtttatatttgttcatttcctaccttgcatgaaattgttggtatactaccttaattcctaaatttttatgtcccactttggtatacctttatcagctgaaaatactattttcacatatttgtacatggaagttttcaagtttaaaaattgaatcaaggcatttaattgaatacagtcatttccagtgaaatttttctctaacagttaaatactcatcgtgtaggactggatcaaatgaatggttgggttcaaattgtgttggtaatcaggaaggtcctaggaatttaaagagctgacaagattgtagttgatgtacttgaccctgggatacaaggcaagaagtggaatggggaaggcagtatttgattatgtaaataagaatgggtcaaaaggacttgatacatcagcaaaatcaaaaggctaaatcagcaaatcaaaatcactggaattagggaggataagagatacaaggataggaacttaaagtcagaaagatatttttagaagctaagtttttacccatcagttcaaggcctgagttgggcttgatataaggcttgatataaggctgatataaagattatggcataggaaaaatgaagacactatgaactcagggtattccagtggtctatatctgctgttctaagaaagcaggtaaatgctaacgaggctcttagccctgccttctacagggaactgggcgataaggccatctccacttgagtgggtggcaaaggttggattgtcctcaaaggaaaataagatttcagtggacaggttgtaggcaaagccagagcctccgaagaagtaagttttggcaatagaatcagaaatatacggcgcatattagaatgcatttgagtgagggaagatggctcagggaagaaagagtgctacacaaggtagacatgaacacaaaaaagaggagctttgtaccatgagcaggaattgtggattatgcataggaagtttttgtcctgttttaaagtgtaatattctatacatgctaatgtctctcacctttctaagtattttcactagaaagtacaccagtcacaaaccatcatatccaatttgctctgtagtgctgctacatacaactttttgaattgttaactaaataattgttttgtgtttcatattttagaatgctctttttgtgtctcactcctctcccccttgtgttctttgctgttcccactctcagtgcctcatgtggaaccatattgtctcttccctacactagggcattaatttctaactgttctccccacctccagggtgtgtatggccagattagtgttactgaggcatatatttgctttctcacttcactgaaaatcttgactggtttcggagtcatagcagctcaaactaaagtccttacaaaacatactatagaagggtttgtcataacctgactacagtctgtttctatctttaattctcattcctttccttcagtccagccaaactgtataaatgccttttcccatggtccttctataagttggtgcaaaagtaattgcagcttttgccattaaaagtaagggcgggccaggcgaggtagctcacgcctgtaatcccagcactttgggatatgatggtttgtgactggtgtactttctagtgaaaatacttaagaaaggtgagagacattagcatgtacacaatattccactttaaaggctgaggatcacgaggtcaggagatcgagaccatcctggctaacatggtgaaaccccatctctactaaaaatacaaaaaaattagctaggcatggtggcaggcgcctgtagtcccagttactcgggaggctgaggcaggagaatggtgtgaacccggcaggtggagctttcagtgagccaagatcgcaccactgcactccagcctgggtgacagagcaagactctgtctcaaaaaaaaaaaaaaaaaaaaaaagtaatggcaacaacctcaattacttttgtatcaacctaatagaacaagcttccggccaggcgcaatggctaacacctgtaatcctgatactttgggaggccaactagagcagattgctggagcccaggagctgagaccagcctaagcaacatgggaaacccttatctctacaaaaaaatacaaaaattagccagtcatggtggtacacgcctgtagtcccagctgcttgggaggctgaggtgggaggatcacctgacccctggaggttgaggttgcagtgagccgaaatcacaccactgcactctagcctgggtgacagagtgagaccctgtctcaaaaaataaaaataaaaaataaaaagaacaaccttcctcaccttttgtatatgggcccaaattttatccatccttcaatgctacctcaaaaatacctcttccttagttgttccccatctgtccttgcagttggtagtaattttcccttcttctgatttctcataacactgtctctctgtggtattatccttttgtgcctgtattcagcccagttttacatcttactagctttgtgactctaggcaagtttccccgactctctgggcctaattccttattatctgtaaaatggaaataaaatggtagttctaattatttatgatattgtagtctttttcttttctgataaagaaagcaactacagaaagcttgtatttatttattcaaagtaaccagtgctattgatgcaaaaaagaaaaacccaacaattcttccaacactgctttcaaaatgagcatataaaacttgattttcattagagtgtagttattttgtcatactagtaaataaaaaaccaagacgctccccccgaccccttcttttttttttttttttttttttttttgagatagagtctgtcactctgttgcccaggctggagtgcagtggcatgatctcggctcactgcaacctctgcctcccacattcaagcgattctcctaccttgacctcctgagtagctgggatcacaggcacctgccaccatgcccagctaatttttatacttttgtagagacggagtttcaccatgttggccaggctggtctcgaactcctgacctcaggtgatccacccgccttggcctcccaaagtgctgggattacaggtgtgagccaccgtgcctgaccgcaaattttacatgtatgtatgtatgtaacaagaataccaagttagtctttcttcataaaaagcaatttcaatttgaggatacttcatatttgccttttgtgccagcaccaagtctgcctcatctgaatccttccatttcatgagcaacatcaattcttcactgccatctgtggcaccaattattctttcaggatcaagacctctggcaattcctcttggtttgtcaacagcatctcttctttgatttgctgtcatcagattcactgccagataaaggttttctttttgtaccatctttttcttcaccagctttttgagaattaagaaatgcttcaattaactctggacaatctaaattttcttcaggttccaaagtattgtcagcatctgtaaattccttcaggaaatattccactttcccattccctgcgtgtctatctagtacattttccaccacaaattcttcaggctctgcctcttcaacttttttacttttccattctgtttctttcccatgttttgcaatgtggttttgttggaggccattttttattgcagacctgaagagctattattcactgcctccaagctgctctgggtcatgggtctgtggtgtctccagtcttgcatgtcaccagctcgagccacatccaagtggggagggagccagggagctgttgttggcaggggaagtgggggtggggtggggtagggaggggcggtggatattatattttgcttacatatatgtgtaatatcacttgttatttcttatgaatagcagatgagtttaatttttctttttggcccataaaatgcctagtatgtatgcaagaaatatttgttgaataaatatgtaatactctttataagctttttaaaaaattgtgtcaaagaatacataacaaaaattatcatttaatcattataaaatgtacagttcagtggcattaagtgtatacacattgttgtgtagccattaccactgtccaactccagaacttttttcatcttataagccttttttcttttttttcttttaattgagatgggatttcactctgtcccccaggctgaagtgcagtggcgctattgtggctcactgcaacctctacctcccaggctcaagcagtcctcccacctcagccttaggcacatgctaccatgctcggctaattttttgtatttttggtgaaaaaggggtttcaccatgttgcccaagctggttttgaactcctgagctcaagccattcacctgccttggcctcccaaagtgctgagatttaagcttattttaaaataagcctcgtaaattataaatttttcatttcatattatagaaatctgtttctgtttttctttatgactcagggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggtacctgtgagagatttctttgccatatgcttatcagacatgcttattccactctggtaggattttattaggtagacttcttgtctttatgatgaaactagcttcaaaatttcttagtttacttttttttaatgttgaatttatatgtacaaagtgacactgaatacaattcttggctctcattttgtaaattaaaaatgaatatgatttgaaagttcagtgaatcatatctcttttttaaaaagactgaaatgagagaataaattttgatagcatttttctattattagaacttccagaaactctttttcagttaggataataaaagaatgagtttgatagtctggggctaggaacttgagtttttcttttaagataaaatacttaactttagtcattcaaaaataatatacaaatgatataattagtggcactgcatatttagtactaagatctaaagacattgtgtcattatttaataatatatcagattgctttgtgctactaggtaaaaaaatatatatatagtcttgagatttttccaccaagctgcttttatgtgactccgattttatgcttgtttttacctcactgatttcatttttcaatgtttggcatatcaatttttaaaaactgtgctgcaaatcagtaccatatttatctcttggatgtttattgtgaggttactcagacttaggcatagaatttgcattgttgctaaagataattaatgctttaccatcctgttatttttgtgtttacagctagatttgtaataatttctttaatgtcttaaacaagcttgaacaaatccttagataggaaaagtattcactttttccaaaggaaatattaacatgctaattactgatatattacccgtaggttttcttaatatctcaaatgtaaactgtgaataattttttctccaaaggataaatctaccaagaaactctgatatatgcaaatacttatgcatattaaactttctgatatgacatctagagcttttgtgtacattttctacaaatagaaacactcagaagacctttggttgttaaaagatgcatcctggccaggcacggtgatgggagtagctgttacccagcttctcaggaggctgaggcaggaggattgcttaagcccaagagtttgaggctgcagtgagctatgatcgtgccactgctgcactccagcctgggcaacagagcgagactccgtctcaaaaaaaaaaataaataaataaataaataaataaataaataaataaataaaaaaggccaggctcagtggctcacgcctgtaatcccagcactttgggaggctgaggtgggcagatcatgaggtcaggagatcgagaccatcctggctaacacaatgaaaccctgtctctactaaaaatacaaaaaattagccgggcatggtggcgggcacctgtagtcacagctactcgggaggctgaggtaggagaatggcgtgaacccaggaggcggagcttgcagtgagctgagatcgtaccactgcactccagcctgggcaacagagcaagactcttgtctcaaaaaaaaaaaaaaaaaaaaaaaaagaaagatgcatcccattcatccctcctttagcacactatgagatgttgaatcttagtctatcgcttatccactattgttaaccattactgtgaaaactttctccacctcattgggtaggtaattaagataagccattttctaattattttctgtatgtgtggcttttgcttatagataataatgatatggattaagacacaaatagttcacaaacttttttcactaaaaaattcacagtggccatgactacacaggtttaaatttaaaaaatgttcatttgaatattttaagaagcaggtactttagttagccatatctttttttaaaaaggtcttattttgaaatcatttcaaacttacagaaaagttgcaatagttgaaagtctccttcatcaatattccctagttgttgacattctgtcacaattgccttatctatgtatgtatctgtatgtgtgtgtaattcttttgatggtggtgttactctgagccatttgagagtaagttgtagacttgaagccccattacccctaaatatttctgtatgcatttttgtaaaacaggaacattctcctgtgtacccacagtataccatcaaaatcagaaaatgaacaccaaccatgatattgtcattttatccacagaacccattcaaatttccctgattgtcccaatattttttatatgtctagacctagattgtgcatggtgttcagttgtcatgctctttattctccttttccttaaagtctttcatgataaatattttgtaaagaaatactctgaggttttataaatatgctttcttcatcaaaattttaaccactatgaatgcatataccatatgacccagtagtatcattcctacgtatttaaccaagaaatataaaaacttagtgttcacacaaaagcctatacataaatattttgtttataaactaaaactagaagcagctaggctttgggaggtgactaagctgttacatccatccatacagtgaaatactactcggcaacaaaaaaagtgaactaccaatgcatacaacacgatgaatgaatctcaatacattatgccaagtgaaagacatcacattcaaaccactacatactatgttattccacttatgaggtactcttaagttggcaaaggaacagaaaacagatcagtagttgcaaggaattggagatggagggaggaatggcttgtaaaatcttttaatggcaatggcatttagaaaccaagattagggtacttggctttggcggcacatgtattgaaattagaatgatacagagaaaattaacatgtcctttgtgtaaggatgatgtacaaattcatgaatcattccatattttatatagaatttatataaatatgtatgtatacacatatacatatatatacacatatatatctacatatatattgtggtaagctcaggaaatcattgagaataggttataactttggcattactcgaggattaccatagaaaagaatctccagttaataaagtttcccattgttaaaaatatcacaggccaggtgcggtggctcatgcctataatctcagcactttgggagcccaaggagggaggatcacttgaaaccagtagtttgagaccagcttgggcaatatggcaaaaccccatctctaccaaaaaaaacaaaaagttacttgggaggctgaggtggaaagattgtttgagcccaggaggtcgaggcttcagtgagccatgattgcacaactgcactccatccttggtgacacagtgagaccctgtctcaaaaatatatgtgtgtgcgcatgtgtatgtgtgtgtgtcacattattttaaaacgcttcatatttattacctctagggccttgttattcagagtggtccccagactagcatataagcatcacatgagagcttgttacaaatgcacccctgactttaaatccacctgtattttaataagatctggtagttgcatccacgttaaagtgtgagaaatttgagaagcattgctctgggataaaggtctgcaatttttttcctctaaagattttctgccttgcaggccatatggtgtctgttacaactactttactctgctgttgtaatgtgaaagcacccatagactatacttaaatgagtgtggctgtgttctaggaaaaatgtatttacaagaacaggcagtggggcagatttggcaagcccctgctttcagacagtagaattgagggataaggtcttcagggagcttttttcactttataaccttctgtgctgtttgtaaaagctattactgcaagcatgtaattaaaaatctggtgggtttttaaaatttttttaggctttttgtgtttgtttgtttttgagacagagtctcactgtgttgtgcaggctggagtgtggagtgcattggcgcaatttcagctcactgcaagctgtgcgtcccaggttcaaatgatcctcctgcctcagcctctcgaatagctggaactacagccatgcaccaccatgcccagctagtttttgtgttttttggtagagatgggttttcgtcatgttggccaggctggtctccaactcctaacctcaagtgatcagcccatatcagcctcccaaagtgctgagattacaggcttgagccaccacatccggcctcttgctagatttttgttaaatggattgcatgctggagctagctctccaaagattgttaaatattcagaaatttgtgagtcagtttaacatcattggtagcttaaaattggtcacagtgggtgcatttacaccatgggaactggaaatcaggaagtgctgcaaattgggtgttttgttttgtttagagctggattgccagcacactgtttaatgtacctgtttattgctattaataatagtcttatggatttatttggttttttttcttttcattcaaagaactcgatatatggtgtcaccattgatgtaatgaaatctgtgttctgctaattaggcaataatggcagtttttgagcatgtaatctgtagcaggcacttttcatgtattcttttttaatcttacaagatagtactattattttcaccactgttctacagataactgtaattttttttttttttttttgagacaaagtcgcactctgtcgcccaggctggagtgcagtggcgcgatctcgcctcactgcaacctccgcctcccaagttcaagcaattctcctgcctcagcctcccaaatagctgggactacaggcgcatgccaccatacccagctaatttttgtgtttttattagagatggggtttcaccatattagccaggctggtctcaaactcttgacctcgtgatccacccaccttagcctcccaaagtgctggaattacaggtgtgagccactgtacctggccctttttttttttttttttttttgagacagagtcttgctctgttgcccaggctggagtgtaatgatgcaatcttggctcactgcaacctccatctcccgggttcaaacgattcttctgcctcagcctcctgagtagctgggattacaggtacataccaccatgcctggctaatttttctatttttagtagagatgggggtttcaccatgttggtcaggctggtctcaaactcctgacctcatgatcctcctgccttggcctcccaaagtgctaggattacaggcgtgagccactgtgcccagccagttaactataatttaaactagaaagcagcaagagctgggatgtaacccaggtgtgactaactctacagctcttagccactgtgctattctgtctctcattagtgcttcctattaatttattcatcgttctgccatcttgcctacaaactaatcagtcattttttgtaacatttcccaaatacttctttattttaaccatttaactattgttacttttgaaaattaaaaatcaacaagtttaaaccatacttcttttttttaagtagaaagataatgattaatgatagccacctggatatgagactaagtaaccctgtcattaaataccaaacataaattttaagaattaatcaaagttaaactcacttgggtgatctttaaaagatatttccttgtgaattcatttccaattccaacctctgagtgttaaaatagcctcagggtaagtttgaagtttgtattttgtgaagaagagtgatggtctgtcttaagactgttcctatgctgtgaatgataatattttgttcaacaagtacttacagagtacctggtgtgtaccagatactgtgaagaggtgaagagagaagggcaggtcctcttctccaagagtttaaagacttaaagttaagttgtaaatctactaatttattgtttttcactttaatatctttatgtttttataaatacaaagttattagaacaagttggactatgaaattgacaaagtattagtaccaaggatttttttggttgggggagacaggatctagctctgttgcccaggctggagtgcagtggtgtgatcactgctcactgtagtcttgatctccccagctcaagcgatccttccacctcagcctcccaagtagctgggattacaggtgtgcaccaccatgcccagccaatttttatttcagtttttgtagcgacagagtctttgtttccaggctggtgttgaactcctgggctcaagcgatcctcctgcctcagcctcccgaagtgctgggattacaggcatgagccaccacacctggccccaagggtgtttttaattagatgttcactcatttctgtgtggtctgtttcttatctttattcccatctattcccgttttttaaaggcaagcctgaaatagcatgtgaaaacccacattgtacagtagtacctttgaagcagcctactctacacattgcagacaaagatccaatcccagaggagcaggtaagggtgaaaattactgttctttcccttgttggatttctgtttctaatgagcttcaaaattacaacataatatattgaatttatatcagatcattagttcttagtgcttaactctgaattcattgaatctgcctgcagacttttttttgattgttatttatatctaattgtctatatctgagtggctttcaaaagtgattaaacacattgaaaattagtacattggcaaagctaccttttgggatgctggaaatgtgtttatcttgatctgagtagcagttactggtatgtgtacatatgtaaaaatcctgtgcacttgactgcatgtactatgatatacctcacttttaaaaacaattttttaatgatcgcattggatattgacaaaggttacttttgttcattgtaaggaaaacctcttttccttaggtcatattatctattcagtattttttttccgtgtatattgcataacaagttactattcagtattcttaattgcaaatggaaaccaaccctagttagtttaacagacagatactttatttaaacttttaggtagcttacagaatatttcagagagctagataagcaggcttgaatgatgctagggtaaacagccaaatcactcaaaagaactgttgcaatggaactatcattgctaagttaatgggtggagacattgccccttgcttcgtcaatgctgaatagtaaaacttaacctccagaagtgctacttcaagaaacatatctgcaacatcctgccagaatagattttccaaagtgcttggttcttttttatatgagaccgagtctcactctgtggcccaggctggagtgcaggggcgcgatctcggctcactgcaacctctgttgcccgtgttcaagcgattctcctgcctcagcctcctgagtagctgggattacaggtgcctgccaccgcgcctggctaatttttgtagtttttagtagagacagggtttcaccatcttggccaggctggtcttgaactcctgacctcgtgatccgcctgcctcagcctcccaaagtgctgggattacaggcatgagccaccgcgcccggctggtgcctgcttcttttatctcagacttctaagtccgatctgatgcaggtacgtcgattagagaatcccaggtcatttacctgagcctatactgtaaggatactgcttgggtaagcaagcatcctaccctctctgtcttagagatagggagaaccataaggtggggtgttccctaatcctaggaagaatgttcaaacttcctgggaaatctgaaagaaccacaagaaaacaaacatgcctgaccacctccccaaagtgccagcccttctaattttgattggttttgatatagctaatggctgtaacactaagtgtatggtatgttaccagagtagaaaaataactactgaagttgttaaactttttttatccacaatgctttttagtatcaactgttaggttgtttttgaagatttcaatttatccataggtatatatttgcttttttcttttcctagctctgctttaatgacctgtgccaaatgcaagtcctttttttttaatctcagagataagtaagtgcaagtaaatgaatgcttactagagaattgtttgcttcaagtaaagtgctttttcttctattcattttcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatggtaagcactgactttaaagtaacaggttatttcaatgtaggggattctttctttcttgaaccatgaatgttattttagctgaagaattcttggggttttataagggtccaccagtatgcatagtactttttcttctagatgctaaatcaatttgattaataaaagagtaggaatgtaaccacattggaaatatgaagtcatacttttttatgagttatttaattttttagtaaatttgttttagaatgggcagtgagttgaataatttgggatattttaaatgttattttcaaatttagtgaatttgagattctcaactctgttgtccatatgttaaaatatttaaaaatacctcagtgaagcacaaaattaataactgtgctcacattgaaaaaaatggcccaggcgcagcggcacatgcttgtaatatcagcacgttgggaagctgaggcgggtggatcatttgaggtcaggagttcaagaccagcctggccaacatggcgaaaccccatctctactaaaaatacaaaaattaacaaggcatggtggcgcgtgcctgtagtcccagctactcgagaggctgaggcaggagaatcacttgaacccgggaggcggaggtttcagtgagccaagatcacgccactgcactccagcctgggcaacagagggagactccatctcaaaaagaaaaaaagaaagaaaagaaaagaaaagaaaaaaaaggaattaaaacctagaccagtgagccacatcattagcattatttaagtggtttgagcactttagtagatgggaggggagcagggtgcctgtgggcgtactccccatactctgatttcagcagagtggggtagctggtaatacaaaagccttacattcctttctgtttctcacccttcttttcttaagtcaaacttcatgggagacagggaaggaatcaggggaagcttaatacttgacagtatcaacctagctaattcttagttgaattaatgcctatggatttctaagtaggtagagtgtggattctcttccattttacagtatctgtgtggaccctcgaaatcaactgccctgcttttccctcctcactagaagtacatagattacctatacttctggaaagttcctccagttctctttttttttttcccctcaggagccctatgttttctcctgtccagatctgcatttcttggttttatcattcctctttcttcccattggccccctttatagcccaggtcctcagtagattatccttgtacattaaaataccttcttagctgacttccattttcagtacttttttcttctaagctatcttgcaaactctttgcagatttttctccaacactgcattgatgatggctctctatcttaaaacctatagtggtttctccctttcttattgtgttgaatctaaactctttttcctgttttcaagtctcttcatcataagaattcatctatccaattatattttctactgtttttactatagatatcttcttatgtttatcgaattaaactacagttcacaaatgtgttatttttattcatgaaaaaaattcatgctggccaagcacagtggctcacgcctctaattccaacactttgggaggccaaggcaggtggatcacttgaggtcaggagttcaagaccagcctggccaacatggcgaaaccccctctctactaaaaatacaaaaattagccaggtgtgatggcgcacacctataatcccagctgctctggaggctgaggcaggagaatcgcttgaacctgggaggtggaggttgcagtgagccgacatcgcaccactgcactccagcctgggtgacagagtgagactctctctcaaaaaataataataataataataataataataattcatgcttacccctttaccaagaattctgccttctccaccaagctgtcctctctactagtctctccttctccatgaatccttctctgagtgctccagctctgccgcctctcctaacactacagaccctcacactagaggaacattgtgataaaatataaaggaagtcttgaaccccaaagcatatagcagagaagggaaatgattaacagattgatttcctgcaatctgttcattcatatactgggcctacatacatcagagattaattttaggcactgttgttttctatatgttcagggttttgttttgttttgttttgtttgtctctgtaacaaaattacagtcttcttaaataggggccttattatcccacagcattcattcagcaaattactcattcaacaagtagttattaggtacttgttatatgtcaggcactgtttactgctgtatccctagcgcaaagatcaagagacaaaatgtaaagcctcctacctgcctcaaggcttaaattctaacacactcgtcaattgatcctctcattactcagattatatccaccccatttaattagtaataattgtgaactatcaaccaacttctaatatatgttgcttcctttaagagctaacagatttataaactaagaatgtacatatattgaaaatagcattgtatataaacttatatccttttttattgtttagtgtttcttcatatagctttaaaattatgctattgacattatgggaaagatttatcaatgagagaaatgtgtctctttttcaggtatgtgcttttgatatagtttacattggaaagggtcataatgctgttttagtttgtgaaaataagtaaaaagctgctgataccatagaatgcttttcccatgaaaaatttcagtacatcttccagagctgttttcatctctgcctacaggggtaaagtccgcatggaattagagggggaaagtctgcactggaacctgctgtggccattttttttctgttgttgctgcttctctagtggagttactgcagcttagggatggttcctggaagtggacacattttacaaaaacgttttttaaatacacgccagctcttcgagaagcacttttttccttccgtcatgcttcatactatattgtattgtactaacccctcatgctgggatgagcgactgcctagcaagcaacccactgcctactaacatcaagaggggctaaataaaactgcattttccttgcaaggacaacttctaccgtatgaatatatattatatttatgtattatattttgtacaatagttgatcttgaatgcagacttcatttgtatttttcgtggtactacaaaatgtgtagaagttatggcttttctttcattagggtcttgttaggtggttggcaagtaagttaaattgtatgttgcatttttttccatgctgttttaacttgtaaatatatatgtatacatatggaagatattattattatctagattactttaagccttttatctgatgtattatcagtgaaaaccatgctgcttattccctaatacaatggttctcaaactttagtgtgtatcagaatcaagatgagggcttgtaaaatatagctggtccctactcccagagtttccatttcaggaggtctgggatcaggcccaagaatttgcatttttaacaaattcctaggtgataactgataatgttggttcagggaacacactttcagaaccactgctttaatattttaaataagataatatgtgaggtgtcataaaaaccttcatcaaatccctatctcatttcatttcttaggcattttctctcttataaagtttcctggatttataaattttcattgattttactagaaagttttatttagcttttatttatttattgttctttttaagaaaaaaactgagagtttgaattaaaagtttaaatcattgctaggtccttagttattttttttcttttttctttttttttatttgaagccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatatacagttttgaaacctgtagctcctatgcaataacatagttctatagacattatttgggggaaatgtagtaataactcaatctatgttgctgtcctagaaaggaaattgcatgatgaatctagattgtctttagagtaaagaaacacattcaaattcctgtaacttatcactttcagtgagtaaatttacttataccaaaggggattttttttctttcaggaatctaaggaaatttactttttaacctgagaaaaaaacttggttctgctttatataaacagtagagattattgtactataagtgattttgcctttttgccaaaatcctggaactcatctataattaacctcttcggagcaataccttaggttgggccttgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgcaaattttagaccatactcccagtgattcttagttggtctttttggaatgagccataggtaatgtttatgtccaataaaatctaggaacctctgtctggaactttgctcttcttgccatgaataccttaggaagtattaaaaaacaggccaatgtaatatgagtaggttttcttgtttgttacttttctaagaatattttacttcccttagcaggcttttggctagctttcaaagctgccaccctggccaggtgcggtggctcacgcctgtaatcccagcactttgggaggccgaggcaggcagattgcctaagctcaggagttcgaaaccagcctgggcaacatggtgaaaccccgtctctactaaaaatacaaaaaattagctgggcatggtggtgggtgcctatagtcccagctactcgggaggctgaggcaggagaatggcgtgaacctgggaggcagagcttgcagtgagccgagatcgtgccactgcactccagcctgggcgacagagcgagactccgtctcaaaaaaaaagctgctaccctatatacagaagaagccctctggggaaaaaaataaaacactgcagggaaaacttataattgtgctttttaagttttacaatatgatttttaacagtatgattcttgttaggagtatcatcctgacagtttttaatacagatatttctgtagtttgttttaccaggacaaacctagtacttaatggaagaatgcatgtgagagtctatttaggtcactcttgaagacagaatttgtaccctttgtctacctccaggtaggaaagtccatttaaaactcaattttcttaatagtaatattctgatttacgtaagaaaagttataaagcttttagtgttaaagcattaaaaaaatcaagtcctgatacattccacaaaattgtaagtcagtggagtgtttacagatcatttcactctggtgactaactcttcacttcctatcagtaatgtaaaatatgaaaaagttcaactgatttggtttaatcatagtatattgttcctatacccaaaacaaacaaagaaacagactaaatactataagagtgtattatagctcagctaaatcattgtttgaactaaagtagatattatgctaagaatgacaaccagacaaggcataaaggttggtttatttttccaattctacttacaagaaaatagttatgcagttcacaattagaaaataaagctacaaatattttagaagagaaaatatagaaaaaaaatgcagtaaccatttatctgtcatcatagacaggtgattaatttgcctaagttaacttctcagctaactaaaacaaatccattttaataatttaataactaaatgcactacttctctactttgtctagagtatatagaatataatttaactttttctgtcatctttaggaatatcagtttctatcatggggtgataaacagaaactcatcctcaggggctactgagatatatgtcaggtacccctttacaacatgacctcacactggtgtgcttttttcagttatgtctgtttttcacagtttctctatcttcccttataatcagctgtcacttttgccgccgtcttgtgtgcctgcctcctgcaataggtccctaatttgctgcttctaatctgctgtggactgagaaaccagattgccaagcttgctagaattgtgtctaaaataagagtaagtagactgaaagagagctaaggggcttttctgtcagtaaagtgcatggactttgtgatacctgcttgactgcttagcattgttttgtttgcctcttagttctttactaaaaacttgctaaaacaaatacttggttgaatatgtgattgccatatatttgaagttctaattcagtttttatataatgatgtttctaggacttccattaatgaattcaactataagagaaatttgactatcatttttgaataaataattgtgtatatttcagaaaaatgttaaacgtattgttatcattaattgttcttagtacagtacacagatttaaaacttatggcactataaatgtaacttcaactctgttcatcaagacttatgttctagaaatattgttatgagactaaagatggctaatttagtaagaactgggtaacttgaatatttggggaatgagtcattctagatatcccagtttcctgcagagcttgaacctctttcagccctaaaattttttggaataatctctgaaggaaatcttcataaaattgatatgcattactgtcttaaataatatatgaatgtattttaatttgtttggtatcaaaatgatcagcattaacatcacttattataatctgatagactaatcagacattgagagctgtttgtccctgtactaaatggctccattctgctgtactcgttttagttttcatgtctttaacagtcgttctgattcttccatttctattactgcttgcttaagtgtgcctgtagcagtagcccttctccaccttcataatgtgccttctgatctgctttcattttggagaccagacaaactaagtttattagacttctgtgtaaagtaagaataaataaactcaaagtgaagacttgaggaagtggattatgcttaaatgcatggattttgtgacatctgttactttactacctgtttcattgctatcgttaaaataagtgaagctaccgaattagatacctgctctcaaaatagaaaagttgttatggtacaaaaggaactattttgtttacatactttactttctctaaagttagttctatactagaattatttggcgctgattaaaactggtccactcaagttagcattttctatagtattttctatttgaattggagactacatgctgttaagaatttctttggctttttttttgttgttgttttgttttgtttgagacagagtctcactctgttgccgaggctggagtgcagtggtgcaatctcggctcactgcaaggtccgcctcccaagttcacgccattcttctgcctcagcctccggagtagctgggactacaggcgcccgccaccactccggctatttttttgtatttttagtagagatgggttttcaccgtgttagccaggatggtctcgatctcctgaccttgtgatctgccgtccttggcctcccaaagtgctgggattacaggcatgagccacagcgcccagccggctttttttttttttttttttttttttttaagagagaaatgtatcttcatttccaagacatgaaaatagattaagccctgaaaaataagaaaacattcactattaatgtcacagagacctgagaagtaataaaatttatagactataggcaattataccacaaagaatttattttttgattatgctagttttaaaaacagggtctttatttttattcagctatagtaagcggacgttaaaagcttaccaaaagttatcagtgttagatctaatgatattggcagatatttgaatgactaaattcccactgtcattctgtactgggcatgattaaattgtaatttaatatttaataattaagcaggatcacttttctctcttgaatgaaaaataaaatttgcacactataatatttacaagtaaaagtcaaatctgtatagaaatggatatcctagcatcaaacaacttatttttagcaacatgctgattattttagtaaccatatattgactcatgttttcattacaaagtaactgtcaaatcagtctgtttattttatgaccatgcctcatagtcggcattcagttatccatgctaatggaagggatctgtggtataataatcataaaagataagtggtccaggctgggcgcggtggctcacgcctgtaatcccagcactttgggaggccgaggcaggtggatcacgaggtcaggagttcgagaccagcctgaccaacatggtgaaaccccgtctctactaaaaatacaaaaattagccgggcgtggtggtggtacctgcctataattctagctactcagtaggctgaggcaggagaatcacttgaacccgggaggcggaggttacagtgagccgagattgcgccattgcactccagcctgggtgacagagtaagacttcatctcaaaaaaaaaaaaaaaagataggtggtccaaaccagtttcttgagttgagactgccattatagaagagatagtcaagataccaaagccaggtcagtgataaaagaagaaaacttctgagtgtagttgtgagaggaaagtgattctattcagtgtaattgctgtaaaccaaaaagaggattaattgattcaaggattcacacatgtaaaagtttagcatgaataaggaggaactgattttatagatattctaaaatgtgtgataagctaggacgtagtggctcacacctacaatcctagcactttgagaggctgaggcaggaggatctcttgaggccaggagttcaagaccagcttaggcaagaaacagcaagacttggtctctacagaaaaacttaaaaattagctggatgtggtggcacacacctgtagtcccagctgctcagtaggctgaggcaggaggatcacttgagcccaggaggccacagctgcagtgagccatgattgcaccactgcactccagcctgggcaacagaacgagagaccttgtctcaaaaataaataaatgaaaatgggctgggcgtggtggttcacacctgtaatcccagcagtttgggaggcccaggtgggcggatcacctgaggtcgggagttcaagaaccgcctgaccaacatggagaaaccccgtctctactaaaaatacaaaattagccggatatggtggttcatgcctgtaatcccagctactcaggaggctgaggcaggagaatcgcttgaacctgggagtcggaggttttggtgagccgagattgtgccaatgcactccagcctgggcaacaagagtgaaactctgtctcaaaaaaaaaaaaaaaaaaaaaaagaaggaaaatgaaatgtgtgataaattaaagtgcatatagtattttttatggtatatattttaatgtattttagcttgtcagcaatgaaattagttttatctctatgtattgaacttcatttagcaacatattattgcaatagtacagtatttaagctgcatattctcttgactgcattatcctttaaaatcagtatattctgtgagatatggctatggatatatatatttcctctcctatttatatcctaagattttcttaaaggataattttactgttttaggctttatgtttttcagttttatatcatttcctaaagcttagctacctacaaatgaatattattgaagaatttttctaaaactaaagcatgtcttttataagtttactcttttataatatcctaaacaaagcatatccttttccccttccttaagtaaattcttaaggaaattaacttcatttctaaatcaaagtattttctgcacttttattgcaccaatctgttaccttctgttcataccatgacttaaataatgcttactcaggcacagtactatcagctgacaacgtacagaaggctccagaaatgtcactcccatcccttaaaggttggtatatggtcctggtacagtcgtggaggtccatatgggtgaaaagcccagaagtctacctgagctgaaagcactcccaaggagtttggttttgtttgggtttgttctaggtatggtcccagggatcccagatcaaaccaggcccctgggcctatcctagaaccaacctaagctcgcgcatcattcctggaacatcaagagtgtgaagactgaagataacctgaggcctaccagacatcctatattcaccaagattcacattttttggtatgtgtgcctacattttagcaaaaattggttggttaatccttctaaaattagagggatgacattgggtaacaaagtcttcccagcctttggcattatagtaatttctcgcaatagaaattccatacagatattattgccagtgaagagagctattcttgtttattatcagttctatatttttagctgaagcaacttagccctaaaaaaccccaaaatcaacttcttcctccaaattaaactctcccccaaatttaatggtttctgttttcttaaatgtttttctacttgacactgttatgtcagtctcatgtaactgaataattgttcataatttctgaagagcatttagtctttgccatctggcttcagtgccaaatgattttcaattcttgtttttggagactaatgactttttccttaatttattatcaaatttgccacattttagagctcacttttagaagttctgctatggttaatgaaaacaagctagaatgacacagtagaaattggttaatacgtcacattttacatcactattttgtagaagatttttagtaagtttctctatttttattccttgccactctggattttacaaatattctgacctagttgatccatcacatggtctcatatcacaactgttgcatcgctatattcacatagatgtttttctgtttaatttagaagacagtatttctgaaaaagtatgaaacgaccccaaatccaaaagttatggtgcacaatgaaaatgtatgcttttaataatgctggcttctgcagtaggtgtagaccatgtttcaaataaccacagactaatcagaaactccacctgtgaaaggaacttgaaattgtgctattcctccaagcttataacaccagcaaattgggtcaataggttattcctttaaaataggactatgagcctacagaggctcactctgaagaactcagccgtggagttagttctgtactatatccatcacaacagacatgcttcatcccatagacttcttgacatagcttgaaatgagtgaacccatccttgatttatatacatatatgttctcagtattttgggagcctttccacttttttaaaccttgttcattatgaacactgaaaataggaatttgtgaagagttaaaaagttatagcttgtttacgtagtaagtttttgaagtctacattcaatccagacacttagttgagtgttaaactgtgatttttaaaaaatatcatttgagaatattctttcagaggtattttcatttttactttttgattaattgtgttttatatattagggtagtacatttcctaccctacctgaagacttgagattatagtctttggggggatgggcaaagtactctctttttttgcatcttttaaattgtgatttttaaaaacacatataaattttactatcttaaccatttttatgtgtatagttcaatgagattaagtccagtcacattggtgtgaaacagatcttcagaattttttcatcttgcaaatctgggactctatacccattaaacaactcccattttccccttccccacagccttggcaaccatcattctacttttctctatgaatttcactactttagatacctcatataaatggaatcatacaggatttgtccttttgtagctgacatatttcacttaacataatgtcctcaaggttcatccatattgtagaatgtgataggatttcctgccattttaaggctgaataatattccactgcatgtatttaccacatttttttatccattcatctgttggtggacgtttgggttgcctccatctcttggctattgtgaataatgctgctgtaaacatgagtgtgcaaatatctataattttttaacacagtactttattttcggtatttaatcatatggaatttttgtcaattatgttaaaggattttacaacaacccaactatagatttatatatatatgtattattgttgttccttctaagcttaagaagtctctaataaaatccatacttccttatatctttttgtgtgtgtaccttttttattctgctctttgccatatggattaataccaaaaggtaaaaatcccttttccttcctatctgtttttcttccattatagtatttttcagaatttgttaatatgccaaaagatggcagttgtctgggaaagccattgattcattactccaagttttgtttgttcatttaagtgcctcatatgataatttatcacagtgaaaacagcagtgtaaattttaaagttccatttttgccattcccagtgattgttagccactgaatacattctgggcatgttatatttattgacttatataacctccttgacagaaaagacactgacaccaagaaggtcatgaacacccgatgaagcatactttgacaagttggttgaattaatgttactggtttgaacctttctaggcttacctacactcttaggaacattcatgggaactccaaaatggttctgtatactaaaagctagttaaagagaaagtggcctcccttgaaccggacttttaaataataagccatttctttccagaaaagatttaaagcaaggaataaatatctataaaggcaatttttgaaacttgacccttgtttggaattttctaattgaaagtatgagataaggtagaatatgtgtaattactggattctgaagtcattgagtaggaaatatcccatatagtagtccttccttgtcttcacaatttgcttttgaaggtctttagcagatgtgctatagccattgaaaattaagttggcaaatggtaattttgcctgaatgtacatctgtaaaaatgaacattttcagaatctgatcattaaaaagtagtcccatttaaaagatctccaaatgtgtctttatgagaaaatgttcatggtatacacataaaatagtcatcatacatgttcctagaaatatattcctagaagatattgtttaaagataagaaaacaggctcagtagttttctcactcagtcacacacacaaagtgtcagaaccagtatcctaattagataattagatcctaagagataccaacatctgctcttcatcgttatgataaactgcctatgtatatacatttcattttacagctaatctctaggagacggtacagagaccttgattttggttttttgttgttcttcttctttttctaaaaagagacagggtctcactgtgttgtccaggctggtctcaaactgttaggctcaagtgatccccttgcctcagcctcgggaatagccaggattacaagtgcgagccactgtgccaggcaaagagcccttaaatttggaagtcattagacttgaattctggattaaaaactacttctctaaaactcaggcaaatcacttaaccatattaagccacagtttcttctgtaaaaacaacaaacagcattaattatgatttataaatgggactagacctctgaaagcctcttccatttttaaaactctgttcctctattattaataaaaagatacaactctactaggtaaagccaagtttgtccttctgtgcaagagagttgcaagagagagcttatttttaggcacagtaaataacttgagaatattcaactgttagaggttggacagaaagaataagaggggacttcagaggccaaagcaggcggatcacttaaggtcaggagttcgagaccagcctggccaacatgatgaaaccctgtctctactaaaaatacaaaaattagctgggtgtggtggcacgtgcctgtaatcccaactacttgggagacagacaggagaatctcttgaacctgggaggaggaggttgcagtgagctgagatcgcagtaagctgagatcgcaccactgcactccagcctgggagacagactgagactcggtaagaaaaggtggcaggggaaggagaccctagtttaaaaaaaaaaaaaaaatgtagctagttccagcacagaacttaatactgctgagggcaaagtatacccttatattttcaagcaatccaacgcaagtacttgaaagttaaagtgtacacattcaaaaggaacaatagctccctgtgattacttgttattcctttctccttagatagcataatcttttcattatgaagggatgtcctattgcaaggttttctttgtgggtatacaagtttctggcttatcttcatttctgaaacaaaagaatctttcttatttcatgtctagaaccatctatgaagccattgttggctgtaattgagttctgtgtggttccttaatctaaaatggtttgtctctgttctttagcacccatgcctggctattagccatcaagccatttatcttgcttgaacttagaagattaagctatgatacatgggtcatgatagccaatgacaagattacaataaaaaatacatacgtgaatattttataagatctgaagaacttaatgattctttctaaacagtgacataaggatgatttttagccagtttttttttcccccaaaatgaacatgaaatacttgtatcattggagggggggaagatgaaattttaaaaattgataaggaccaggtgcggtggctcaagtctttaatcccagcacttagggaggctgagatgggaggatcacttgagcacaggagtttgagaacagcctgggcaacattgtgaaactccatctctatgaaaaataaaaaattagcctggcatggtggcacatgcctgtagtctcagctacttgggaggctgaggtggaaggactgcttgagcccaagaggttgaggctgcagtgagccatgattgtgccactgtactccagcctgggtgacatagcaagacgctgtctcaaaaaaatttgttttcaatatgttgataatgtttcattcttatttggggcttatattcacacataagaaagtttaccgttctgtatatattcaagctatcacctcataggcctaacctggcgcctagagaaaccggggcagggctgtgtgttcagttcttgcaggaatagcttagtctgatgatgttttattgagttttaattttagtagaacttcaaaacctggaataatctaacctagaggttctcagcattttaacaaccaagaacccatgatactcaccatgggtgtcatgttttgaaggttttcaccacaaaatctacattcattaaaagccctataatttgtgcacacacacatacacacacacacccttttcaacattaaccaaagccagcctggcatggcagcttacacctgtaatcccagcactttgggaggccaaggcaggcagatcacttgagcccagaagttcaagaccagcctggacaatatggcaaaagcccatctctacaaaaaaataccaaaaaaaaaaatcagtcacgtgtgatggcacatacctgtagtcccagctacctgggaaactgagatgggaagatcaccggagcccagaggtcaaggctgcagtgagccttgattgcacgccactgcactccagtctgagcaacagagtgagaccctatatcgaaaaaaacaaaaattaaccaaagccataatggccactcagagtgtttggtgctaaggacagagcagggaacaaggtttctgccctcattgaatactagaggggaaagttagacaataaatatatattgggaggcaggtgatggtaaatgctgtatagaaaataaagctgaacatgagggctatgtgggaatggagaatacttttttatacaaggtggtcagacatgaaaggagtgagggaaccatccccgcaaataccacagagagaagagtttcccaaaagtagtgagaggtaagtggctaaagccctgtaagaacagggctaggaaggtcaaggagcaccttgtaatgaatggaatatggttttactcttaatgagataggaagccactgaagggttgtaagcagtggagttgacatgatttcacttaggtttgaaaagcattattaagtttaaaaagcattctttttcatggaagtctgacagggatggggagaagggagacctgttggttattgcagtgatctatgtgagggaggatggttggtggtgaaggttgtgaggagggtcaaattctggatatatggtgaaggtaaggccaagagggtttgctgatgtaatgaatctagtctgagaaaggggaagtctaaataattctaaggtgtttggtctaagaatctggaagaacagaggtccttttctgagatgggacaggcagctggttttggataggttcagtacgaaatagctattaatcaacaggtggaaatgttgaataggcagtttgatataagagcccaagttcggccaggcgcggtggctcacgcctgtaataccagcactttgggaggctgaggtgggtggatcatttgaggtcaggagttcgaaatcagcctggccaacatggtgaaaccccacctctactaaaaattacaaaaattagccaggtgtggtggtgcatgcctgtaatcccagctactcaggaggctgaggcaggagaatcgtttgaacctgggaggatgaggttgcagtgagctgagattgcgccactgcactccagccagagcgacagagcaagactctttctcaaaataataataatggtaataccaaagtcatgaacataggttggagtactgtgtcagaactctgacatccttggggaatctacatttcagaggttaggagacaaaaaggaacttgcaaaggagactgaaaaggagcagttggtgacagaagtggtggcctagaagctgaataacattttgttataaaagaggccatgactaacatgtcaaaagctgccataacatcaagaaaggtggggccatttgtatatcttttttgaataaatgtctgttcaggtcctttgcttgtttttgaattcagttgtttatttttcttgttgttgagttgtatagttctttacatattctggatattaatctcttatcagattttgcaaattctcccattctgtaggttgtgtttccactatcttgacagtattctttgatgcacaaatgtttttaattttgcggaagtccaatttatttttcttttgttgctgagtttccttatctttttcaaacaggacaataatgctatctgattcataggcttgttatgttgattaaataaattaatacatgttaatacagataaagggattgagacagagcctcccacataagaagaactccataaatgttagctatcatccaggctaaacttacagtataaaacccagtggtcagcagtataaaattaggacatgtgacacagaagccagaggaggaaggggtttaaagaagcacatgatcaacagcacaaatcttgcaaagatgataaaaacaagcaaacaagcaaacttagacatgacacctaaaagtcagacagtggtgttcaggtcagacgccaaattatactggatgaagaaatgttgctagaccctttctgatctccagagccagatctcctgctgtttcagctcttagggtgctacaaaatgagacaatctgttggactttgctgagacatagcagagagaacactagatttaactgggttaaagtgtctggtcttttaccacttgatctctgtggtcacctcccatagctccagttctctcacttattgagaacaattattcctatttcacaagggcattgacaggttacagtgaagagtaagcataatagtaagtcattaattattaagatcagtacatggctcctttctgactgcatgccttgttctgttattccaacactgttggaatgaacactgttgttcttccagcacaccaggtcccaccagccacaggcacctgtgaggtgggacattcccattttacagatacttggcttataggtttgcaataataaaatgagattaatacacatcaaatgctggcaacaatattggcggcagttttattctcatggaaagttcttgcctgatttttagtagtgcttttctcttcaggtccaatttctgggccactgtattcctcatagcttgcgatgttcaccaacttacccaacctcagtgttgccataagaagcaagtgcttatatattatcattgaacgtatcaatggagctttttgttccctctgctttggttgcagatatgagaacgcacattaagtgggttatgagtgttctgtttgaggatttcatctactggtgaataaacaaaacatggtgctcttgctgggttcctacagctaccaaagcaaagatgtcttcggtagagtaactatgtccggtcctgatcactttcgcccttgcaagccacatttcagagcaggatgtaagtcatgtttatttagtctggtttttaccctgttgtctggttcctgtttattctttttttaaggtttacatttattttctctttcttttcctttttttttttttttttttacaaagtctcactgtcacttagcctggagtgcagtggcacaatctcagttcactgcagcctcaaccttcctgggctcaggtgatcctcccacctcagcctcccaagtaactgggaccacagtcatgtgccaccaggccctgctaatttttgtatttttttgtagagatggggtttcgccatattgcccaggctggtctcaaactcctgggctcaagcgatttgcctaccgcagtctcccaaaatgccaggattacagacatgagccaccgcacctggcctatatttgtttttgatttattacatattctaagataccttaggaatgaatagattttgaaaatagagtaggaaattctatagagaatacctgaatggtttagaaaagccaaaagcgctattatgattttataatattttgtttattaataatgtatggtaacaaatagaatatttaattcaacatgcatttatggaatgaccttccttgtactagacatacattcacagacatgctcacatacatgcatgggaatcctaattaccacttcaggcaacataacaattcccctgttcacatttagtttaatcacaggacccctaaaagaagttaatcaaggccgggcatggtagctgagacctgtaatcccagcactttaggaggctgaggcgggcagatcacttgaggccaggagttcgagactagcctggccaacatggtgaaaccctgtctctactaaaaatacaaaagtcagccagccatggtggcgggcgcctgtaatcccagctactcaggaagctgaggcaggagaatctcttgaacccagtaggcagaggttgcagtgagccgagattgcaccactgcactccagcctgggtgacagagtgagactccatctcaaaaaaacaagaagttaatcaagtgggcaatttatttctctgtgttgttcccttacatattaaaactattcagctcatttctttggaatcactcccccatgccgccatcctcaatgtttaaattccttattactcatcaggttaatgtgagaatcctattgcaaaagcactgtgtaaactgaaaaggttttctttttatctggttgggggatccagtctggcctactttatctagttgactgcagtgagaggttaaatgtttaaaccctaccagttacaccattgttccaggaattgaattgaatggaattaaaagacttttccaaacaactcaaaccaagcaaacactccctgatttgttctctcaaacaaaatatattagcctgtggcgactaaatattgacctaatgactaaatgaaagcaaacagattctataatgctctgaagtactcaccactcaacctcagtgaaactcaatgaaacttcccaagaagcttccagagagcaactctttcagttaagtagggactggaaaaggtgcatgtctttaagtagagagagtagagacctcgaaaacactcccccctgagaatcctaaaagtctcatttatataaaaacaaacaggagacaactccccaccctatctacctgtgtgatatcctattttaaaaaatagaccaggggctcaacattgctaatggacccatttaaccccccatttctacacacacacgcacacacacacacacacacacacacacaccatcctcactacatttaccaccatcatcactagtcaaagtcgtaaagattgagctccatatgtgagtgtgacgcccattccctcaaaatactatcagcccttagtatctaaggttccacattcatggattcaacaaactgcagatggaaaatatttggaaaaaaaagaacaatcaataataagtaataatacaaataaaaatgcaatacaactatttacatgacatttacattgtgttaggtattataagtaatctagagattatttaaagtatatgggagaatgtgtgtaggcatatgcaaatactatgccattttatatcagagacttgagcatcctcagattttagtattcttgggggtttctggaagcccagactacaccactatgcaatataggtatgcaagaaatatgcacttgtgcaccctaaatatacaaaaatttttaaaaattaaaaatggctactaaactaggttaacttttaaagcacagagccattacagctgtcacataaaggataaggaacagctgtgcactgggaattcctgatcttaaaataactatcatggccacccccagtggctcatgcctgtaatcccagcactttgggaggcagatgtgggcagatcgcctgaggtcaggagttcaagaccaacctggccaacatggtgaaaccccgtctgtactaaaatataaaaattagctgggcgtggtggtgcatgcctgcaatcccagctactcgggagcctgaagcaggagaatcgcttgaacctgggaggcagcagttgcagtaacccaagatcatgctgctgcactccagcctgggtgacagagctagactctgtctcaaaaaaaaaaaaaaaactatcacgacatcaatgtcaatcagattttcatacttccttggtaggtactggtttttctctcagtctacgaaaagctttttcttaaggctccaagtagaagacatgtaagcctctgttcaaacatgcctctaaaagcagaaactggaaatgggactacagggtgactggctgctcacataccatgtttggctggtgggatttggtgagggaagttactaagtatatccacattaagagaggacttccatttcccttctctctgtgaccatccagcccccctttaacactgtgaccattccccaaagctcagcatgatgaaatctctgtttcttaccaataactgacccctaagttcttaaacttgttttgataaccacatccctgttgacttgccatacagtcacagaaaaacctctcaatgcagctttataagataggcctccttgccaaggagaacctgcattctaattcctcagattcaaaccagacatgcccaaaccacctgcttctagatatttgtactggtctccatggtaccagactcacatacttagagtgaactttgaagagttcaaagccacactgaaggaggtactagacttggaaagaaaacagaatgaaaaattcaattatttgtaattgtctaattattagttggttttcttcagattaattctttttgttttgttttgttttgttttgttttgttttgtttacaaactctgttttttgagacagagtcttgctctgttgccaggctggagtgcagtggcatgatcttggctcactgtaacctctgcttcccgggttcaagaaattctcctgcctcagcctcccgagtagctgggattacaggcatgcaacaccacgcccagctaatttttgtatttttagtgtagatggggtttcaccttgttggccaggatggtctccatctcctgacctcatgatccgcccgccttggcctcccaaagtgctgggattacaggcgtgagccaccacgcctgaacagattaattcttttcttaaactccatgcagtatttattttgttttttagaggagaactaggggcccataaaaatagctataagtatttatgtttctgtggcccatcttgtacggctctcactgggtaaggtgttaaaagtgaaactgctgtttagctttcaagcatattctgtttgtgtgaattctccctgtcctaagcttcaattacttgatttttctttgagacagagtctctgttgcccaggctggagtgcagtggcacgatcttggttcactgcaacctccgccccctgcattcaagcgattctcctgcctcagcctcctgagtagctgggactacaggcgcatgccaccatgccctgctgattttttagtagaggcagggtttcaccatgttagccagaatggtcttgatctcctgacttcatgatctgcctgcctctgcctcccaaagtgctgggattacagatgtgagccaacgcgcctggccacatttccttgatttttctagccactctctctgttatcatgcaggaaaaagtggagaaaaggtaatttacttagaagaataaagagcaatcaatttcactctcaatactttcccctgtaaaagccctaatggaagtgtcacccaaccttcctaactagcagtgttatattaggttgccgcaaaagtaattgcagtttttaccattaaaagtatgcaattactttgcaccaacctaataggaagcaaactttcaaagtcattgatctctcaacagctatgcctttctattcatgttacactatggaattaggataggcacctatgaagacttttccaaactagagctcatggctaaacacgtgattttgcatgtgattgcacaggtgagtcaaatcaggctcacattatatctcactttatcagtgaggccaatcagactttatctcttatgggctgcatctgaagcagaaactttccaagatagacaacatgaaaagttgatgccatctggaagcagcgccctggaaagaagggtgcagagtgtctgctgctgagattattgaggctgccctggctcccgcctctcccagggttttaccaaggagctgatgaaggctgtctttgactctgtaaattgccctaaatcctttaaaccaacaccccacttaggttaatcagaattggttcctgttgcttgcaactaaagatctttggttgattaagaaacaaaacacagacctgcatgcctgttaagtggagtggaggataacactaggaggaagaatgtcaattttttttgtcactacctcttccttgttgttcaatgtatttataattagaaggtacatttagaaattcaaaaaggaaggaaacctttgagctttgatacagaataatttattcgggaacatttgctggctgagccaaacagatttctagtttgtgtgctatttgtacagctccatgaaaatcagttcacttcctctacagcaaaaataatttttatgacactcttaaccttgatgtctgactacatccttcttgttattttttttttttttttttgagggagcattggggatgaggtccttttttttcaaccttttaaaaattcaaattcagtggtttttactatattcacaaggttgtacaaccattactactatctacttcaagaacattctcatccccctaaaataaaccccatatccactaggagtcacttcccattttcccctcactccagcatctggaagccactaatctagtgtcagtccctatagatttgcctattctgaacatttcatatacatgaaatcatacaatttgtggccttttgcgtctgttttcactttgcatgatgttttcaagattcttcaagagggcttttaaaaatatagcccttaggccgggggcagtgactcatgcctataatccaagcactttgggaggtctaggcgggtggatcacccgaggtcaagagtttgagaacatcctggccaacatggcaaaaccctatctctagtaaaaagacaaaaattagctgagtgtggtggtgtgcatctgtaatcccagctacttgggaggctgaggcaggagaatcatttgaacccaggagacggaggttgcagtgagccgagattgcgccacagcactccagcctgggcgacacagcgagatgcagtctcaatatatatatatatatatataccccttagtcaggctctcatcaaatacaaaattcatctcaataactttctctgtatatatgtagagacactcctggaatcattttccctttaagatcttatgaagatttatgattttgaactctaatgacttgtggatatattcatgaggacggaaggaagggtttttccctttaagatcttatgagaatttatgattttgaaatctaatgacttgtggatatattcatgagaaaggaaggaagggaggaaggaaggaaggaagggaaggagggaggaaggaaaggaagaaagaaaggaaagaaggaagaaggatggaagcaaaaaaaagaaaaatttttataggataaaaacaaggcctagaaccttctaaggaacaccttggggtcacccttttctgctgcccctctttctcactatccctctttttccttatctttatttttattagaccattgatcactcccaacatagtatttattcagatatgttgactcaagtccttggaacacctccaagtggaacagtccagtatgcctttgggtatatgggcccaaggcacagggggatgtctgagctggtggtggacatttgggtgtcaccagcataaagaactagtcactgaagctgcaggaaactgtggacagtttgaagaggactcatggcaggcaggacactgaggcatgtgacatccaggaggggcattcctcaaccaggaatgctctcttaaatatcttgaccccttcatgatccagatcaaaagaattagttttcccatttgcaattcatccttcctttttctggtttttggaggacacaacattctaagccctgtgttctttaatttaacactgactataaattattattgaagcaagccacagcagtttaacagcagacctgagtatttatcaagacaaatactcaacaacccaatacatcttagacagatttaagaaaaaggatgataagtgttacatataagctaccataaagtgtacacttattctgtagcttgtcagtttaaaggtgtctttctcagattgtttgctaaggagggcaaagaactttctgatgatatagaaagatttgttgtaatggttccaagtcaacaagatggttgacttctatccacgagaccataaatatttgtaattagaaactgcatttgttaagatgatatttgtttacttaaagttataaactatatttgcataagaggttgatttttacccaccaagcttgaaataattaacttcatcgactttattctgtagcttctctagactctagagaagcctaggggatgtgggggggagaaaaaataaacaaactggtgcctaaggtttttttccaaccagaaagcatctagatattttgtctggatttcttcctacaggcttgtattttaataagcctggcaactctagcactctagcaattatttctggaatattatttctggaaataattgcgtcagtttttcttcatcacttgcctaagaaacgtgtcttttttttttttcttgagatggagtctcactctgtcgcctaggctggagtgcagtggtgcaatcttggctcaatgccacctccgcctcctgagttgaagcgaagttctcctgccttagcctcctgagtagctgggactactggtgcctgccaccacacctggctaatatttgtattttcagtagagacagggttttgccatgttggccaggctgatcttgaactcctgatctcaagtgatccgcccacctcggcctcccaaagtgctaggattacaggcacaagtcaccacgcctgaccaagaaatgtatcttttccaaagtgttcaaccagcaactgggagctcagtagtaatcccctgatatggctgcagctctgcccttagaaaaggcatttttctgattgactgttagaattagggggatacctagagatcatttaatccaggctcccttgatttacagataaagagactaaggaccagaaaggtaaagtatctgtggtctcccaacaagtcagaggttgaccaggactaggatcaaggtttgctgcttttcctacactgcctctcttttctattgtttttgaaatctttctatattgtgatgaatatatgtatcataaaattgaccattttagccatttttaactgtacagttcagtgacattaagtacattcacattgttgtacaaccatcggcaccatccaccttcagaactttttcattattctaaactcccagagtcactgtttaataactccccgtgctccctcccctatccctgggaaccactgttttgttttttgtgactattctaggtaccttatgtaagtggaatcatataatatttgtccttttgtgtgtctcatttcacttagcattgtcttcaaggtttatctgtgttgttgaatgtgtcagaggttcattcccttttaaaactgaacaatattccactgtctacatacacacacacacacccacccacacacacacacacaccacatttgtttatcccttcatctgttaatggaaacttcagttgtttccacctcttggctgtgtgaatgatgctgctatgaaataattatctgtttgggtatataaccatatgtggaattgccagatcattgaggaaatgccatactgttttccataggggctgtaccattttacattcctgctccttgttattactattattattttgtggagacggaatcttgctatgttgctgggcttgaaatcctaggctcaagtgattctctcacttcggcctcccaaagctctgggattacaggcgtaaaccactgcaccaggcctactcattctttatttatttatttatttatttatttatttatttatttatttgatgtgcagtaacatttagaaagaggattggattgaaatttgtcaaccccaacctcaggactgattagctatataatcttgggtaagccaattcactcctcagactcaacctccccagtcaggacgagagaaatgctttgctgacctcacaaaactgttataaatgtgatatacatacaagatgaaatacaccaaatgctttataaattaaaacaggttctttgatgtaaattattattagccatttatactaaattcaagtcaaatccaactctaaaggagaaaactctgaggtattaggaaggaaagagctctttattagtaaggagagaaacgtattgtccggcaaagatttttttttttttttttttttttatacagagtttcactctgttgcccaggctggagtacagtggtgagatctctgctcactgcaatctccacctcctgggttcaagcgattctcctgcctcagcctcccgagtagctgggattataggcacatgccaccacgcccagctaatttttgtatttttaagagacggggttttgccatgctggccaggcttgtctcgaactcctaacctcaggtaatcctcctgcctcggcctcccaaagtgttgggattacaggcgtgagccactgtgcccagcccaagactttgaactaaaggtctttttttctaaaacctaggcagttggaccttaaataaagaatgctgttcctaagcacaagcactaagttacagtcagcttgggggaggttgagaaaagggcaaaatggcacatttgaaagcagcagtggctggggtctgccagctgcttcagcctgaagctctgtaattcagtgttttatcagaaacatttagaactgtgttcacaatcctctataaacacgtcatccctatgacaatgtggcttatccctttgattgatgataacagttgctgaaatatgtccaacaaatttcttcatctgaacttaaattacaggcttagttttacttctgtagattaaacagtagcctctcaaataggaaataaaaactccatgctcacttttgaaaaaagttagggatacctgttttattaaattcattcttcatcacaaagcaactagacaaatattgattttgtagttactgtaaaggattgaacaaaaatatgaagagcagagtttctactcaaatgtgatcaaagtcaacactgaggatctcacgagattaaaacaatgctactaacctggataaggtggcatcccccgaaagactattttcttacccttttttgtttgtttgacagagtcttgctctatcactcggctggagtgcagggatgcaatcacagctcactgcagcctcaaactcctgggctcatttttttcttacctcacatgcacttatatttcttcaggcaactcttttctgcatctatcctaagtagtatccctgcccttttttttttcttttttttttgatacagagtctcactctgtcgcccaggctggagtgccgtggcaccatcttgattcactgcaacctctgcctcccaagttcaaaagattctcctacctcagcctcctgcgtagctgagattacaggtgtgcgctaccacgcctggctaattttttgtatttttagtagagatgaggtttcaccatgttggccaggctggtctcgaacttctgacctcaggtgatccgcctgcctcgacctcccaaagtgctgggatgacaggcgtgagccaccacgccctgccagtagtatcccatttttaaagacaccaaaggcctatggtgtttttatgacgtgatgctgagctccttaactattaaacaaaaaaggctattggacctagagagtgtgtatatggtcttattggccaggaaagcgactttcttcctaggctccaaaactctatggtagggacagcgaagcaaaatcagtgttttgtgcatctggtactaaggaggggaaaggagatgttcaggatcataaggtcaaggggagactgaagaataggggaagagggtgaaccctgggaagaaaagtaattgccaagaaaaaaggggcccagagaatagaaggaaggcaccccctcagggtaggaatttcttctgcgatatctcctttaaaaattatattctagcctctggaaaaaagagctcactgctttataaggctattcattccaacatttggacaactctaattttttaaacattcttctttaaaatattttaccagcttgggcaacacagcaagaccccatctctaggctgggcacagtggttcacgcctgtaatccagcactttgggaggccgaggtgggcagatcacaaggtcaggaaatcgagaccatcctggctaacatggtgaaactccatctctactaaaaatacaaaaaattagctgggcaatggcacacgcctgtagtcccagctactcaggaggctgaggcaggagaatggcgtgaacccaggaggcggagcttgcagtgagccgagatcgtaccactgcactccagcctgggcgacagagcgagactccatctcaaaaaaaaaaaaaaaaaaaaaaaaaaagacccctctctacaaaaaatgaaaacattagccgagcatagtggcatgtgcctgctgtcccagctacttgagaggttgaggtgggaggatcacttcagcccaggaggtcaaagctgcagtgtgccatgctcacgccactgcactccagtctggtgacagagtgagactttatctttaaaaataaataaataaataagtaatttaatatccagcaacacatgatgtgttaaataataaattatgggatatccacataatggaatattatgcagcccacacaattgatgctactatgaaagaatgtagtaacaatacttagtgatataaggacttccctataatatgcttataatatgttgttctatgtactccagaatcctaatttggcatgtgtatatgtgtatgtgtgtgtgtctataaatattgggaggttctacaagcaccacctcagagatactgcaggtttggttctagaccactgcaataaagcaaatatcacaataaaatgagtcacagatttttcttggttttccagtgaatataaaagttatgctaatactatattgtaggctataaagagtgcaataatagcattgtctaaaaaaggtacataccttaaataaaaaatactttattgctaaaaagtgctaaggatcatctgagctttcagtgagtcataatctctttgctggtggagggtcttgccttgatgttgatggctgctgactaatcagggtggtggttgctgaaggctgtgactgtggcaatttttaaaaataagacaacaatgaagtttactgcattgattgactcttcctttcatgaaagatttttctgtggcctgcaatgctgtttgatagcattttccttagagtataccttctttcaaaatcagagtcaattggctaggtgcagtggctcatgcctgtaattccactgctttgggaggccgaggtgggcagaccacctgagatcaggagttcaagaccagcctggacaacatggtgaaacttaaaaaaaaaaaaaaggtgtaatagaaacccatctctactaaaaatacaaaaattagccaggcgtgatggcacacaactatagttccagctactcagaaggccgaggcatgagaatcatttaagcccaggaggtggaggttgcggtgagccaagatcgtgccactggccgggcatggtggctcatacctgtaatcccagcactttgggaggccgaggtgggtggatcacgaggtcaggagttcgagaccagcctaaccaacatggtgaaaccccgtctctactaaaaatacaaaaattagccaggcgtggttgtgtgcgcctataatctcagctacttgggaggctgaggcaggagcattgcttgaacctgggaggcggaggttgtggtgagctgagattgtgccattgcactccagcctgggcagtaagagcaaaactctgtctcaaaaaaaaaaaaaaaaaaaaaaaaaaaaaaaaagatcgtcccactgccctccagtctgggtgagtgagtgagactctgtgcccccaccaaaaaaaggagtcaatcctgtccaaccctgctgctgctttatcaactaaggttatataaaatgccaatcctttgtgtcatttcagcaatgttcacagcatcttcaccagaagtagattccatctcaagaaaccactttctttgctgatttataagaagcaactcctcatccattcaagttttatgagattgcagcaatgcacatctttaggctccatttctttctttttttctttttctttttttttttttttttttttgagacagtgttttgctcttgttgcacaggctagagtgcaaaggtatgatctcagctcactgcaacctccacctcctgggttcaagcgatcctcctgcctcagcctctcaagtagctgggattaaaggcatgcaccaacacgcccagctaattttatatttttagtagagacagggtttctccatgttggtcaggctggtctcgaactccccacttcaggtgatctgcccgcctcagcctcccaaagtgctgggattacaggcatgagccaccgcgcctggctaggctccacttctaaatcaagtgtcacttctaaatctaggtctcaactgtgagtttaaaatatttagtaaaccatggtagaaacagatgtgctgtcatctaggctttgttgttctatatagagcgcaggcagagtagatttagcataattctaaagggctctagaatttttggaatggtaaatgagcactggcttcaacttaaagtccctagctgcactagcccttaacaatagagtcagcctgtcttttgaagcttagaagccaagcattgacttctctacagctacaaaagtcctagctggcatcttcttccaatacaaggctgtttctgtacaggattcctaacgtatggtaagtaaagatgtcactttctaacaggcccagaagccccaagctatcttgggacctcaagaggagaggaatttactcaactcctaggtatttgaggatacaaacccatggctgggctcagctttaaaaaggtcttatctgagattccttatggaacagagttccatcaacgccaactttaaaatcctatatgaaaaaaaaattattcttgctgtactttatacaaataatcaggccaagtataataaagcaaatcagtcttaccatgatttgtctttagtaaaaatgggagactggagagagaaaaaattaatgtttcaagaactatggtacacctgatattagattctagtctcattggttgtttttgaggggttttttccactgcaatttaggctaactttgcttattcctgtgaaccaatcagtgatctccaactgcagctcagaagaaaccagagggatgggtagtataaaaaatctagatcaatattctaattctgggcacatactggaatcaactagcgaccccatatcagcttggttccagcagttgcccagttcatagaaagccttcttatttagtttactcaggataattttacttattttgctttactcttgtggaatatattgctattgtactctttgtataggaatgaggaataaacttactcaacgtttacctaaattgaacatttattaatcttccagatatcacgtttggtcagaactcaaagttatgaatggacctcaacatactaatgcttttgactgagctcctctctaccctgaatgcaagagacccagtagttaggcaggaatatcattgcgcctattcagcttgaataagttatagaagatggatcttcatccctctgcaacccttaggattaaagtttctcttataaaagagaggggggaaatgtcagaggcatttgaactggagcgactccatcttggatagagactaagtaaaataaagctgagacctcctgggtggcattcccagacggttaggcattctaagtcacaggatgagttaaaaggtaggcacaagatataggtcataaagaccttgctgataaaacgggttgcagtaaagaagtcagccaaaaccaaggtggcgacgagagtaacttctggtcatcctcactgctacactcccaccagcgccatgacagtttacaagtgccatggcaatgtcaggaagttgccctatatggtctagaaaggggaggcatgaataatctacccctcatttagcatataatcaagaaataatcataaaaatgggcaaccagcaacccctggggcttctttgtctgtagagtagccattctttattcttttactttcttaataaacttgctttcacttaaaaagaaaaaaatatatatatggctgtttcatcgatgttaaaaatctgttatttagtgtagccaccttcaccaatgatcttagttagatctagagaacttactgcagcttctatatttaggacttgctgctttaccttgcacctttatattacagagaccacttctttccttaaacctcaggaaccaacatctgctagcttcaactttttctcctgcaccttcctcatctctctcagccttcatacaattgaagagagttagggccttgctctggattaggctttggcttaagggaatgttgtggctgatttgatcttctatccagatgactaaaattttctccctgtcagtagtaaggctgttttgctttattatcatttgtgtattcactggagtagcattttcatttccttctagaacttttcctttgcattcacaactcgactaaactgaatggtgaaaggcagccttgctctcggcctatgtcagctttcaacatgcccttctcactaagcttaatcattgctaaatcatagcttttgatttaaagtgagagttgggcaagtcttcctttcacttgaatacttaaaggccactgtagccctaatttcaatattgttgtgtctcagggaatagggaggctagaggagagggaaagagattgggaaaatagccagtcagcagagcagtcaaaatacacgcaacattgatcaaaattaagccattttatatgggcttggtttgtggtgcctgaaaacagttacaatagtaacatcaaagatcattgatctcagatcactctaagaaatataataataatgaaaagtttgaggccaggcgctgtggctcatgcctttaatcctaatacttcaggaggccaaagtggacagatcgcttgagcctgagagttcaaggccagcttgggcaacatggcgagaccccatagctaataaaaatacaaaaaattagctgggtgtcggggtgcgcgcctgtacatccagccactcgagaggctgaggtgggagctcaggaaatggaggctgcagtgagttaagatcacaccactgcattccagcctgggtgacgggagggagaccctgtccttaaaaaaaaaaaaagtttgaaatgttgctacaattacgaaaatgtgacccagagacatgtggtgagctcatgctgttggaaaaatggtgctgatagacttgcaggacacagggttgtcaaaaatcttcagtttgtaaaaatcacgatatttgtgaaatgcaataactacaaagcacagtagaatgaggtgtgctcatacacctaaccattagcagtgcttagttctgggtagcagaagtgtgaatgcttttaatttctttctttatgcttttctgcattttcaaaaatcaaagtataccagaggaccctccctgcaaataatctgtggtgctgacttctcacaaagcagtcatataagcctccaaagaccttcaggatcggaatactaagaaggtaaaataaattggaagatgtggcctgggtgcagtggctcacgcctgtaatcccaccactctgggaggcctaggcggtggatcacctgaggtcaggagtttgagaccagcctggccaacatagcgaaaccctgtctctactaaaaatacaaaaattagcccggcctggtggaaggcacctgttaattccagcttctcgggaggccgaggcaggagaatcgcttgaacccaggaggtggaggttgcagtgagccgagattgtgccactggactccagcctgggtgacagagcaagactgtctcaaagaaaagaaaagaaataggaagatgagtagatgtgtgcacatctctgcagggacagaaagatatgggtgttcctggagctgcttactgctctgttctggtaagtcccagaaagttctcaatctctgctgcccaaggcctcctctcataaatccttttaccctctctgctgatcatgtggttggtccctgcagggtagaggctaccaaaactctgataaaatatccttaatatatactgaataggatacaaaaatgcatgtggagtggagcacggtggctcatgcctgtaatcccagcactttgggaggccgaggcaggtggatcacctgaggtcaggaatttgagatcagcctggccaacacggtgaaacctcatctctactaaaaatacaaaaattagccaggcatggtggcacacacctgtaatcccagctactcaggaggctgaggcaggagaatcgcttgaatccaggaggcggaggttgcagtgagccaagatcatgccactgcactccagcctgggcaacaagagtgagactccctttcaaaaaaaaaaaaaaaatgcgtgtggttgcagtttgccctaagagggcccatgctgtctgggtgttcggtagctaaagttagaaaaggctttgaagtgtctgaagaggagagacagggaagtgactcacagctcaacagcttcaccctctggctttgatggtccttggctccgtgatgctcagtgtctgtgtgagtctcagagagcaaaagcccaatccacagcccacctgtttgtattcttcaccctcatttgagattctcagaactcaaggagagctcctttagaaaatatgactgcagttgtagtgtagttgaaatatcaaaaacctttgttattaaaaaacccaaacctttattatgtcacttgtaataaaatataaatgtgctaaattggctcaaataagttggatcaaataatattaaataaaacaaaggtgaaaaaagaaacttaaaaataatttttttttgatgggatctcactatgttgcccaggctggtcttgaatgcctggtctcaagcaatcttcctgtctagcttccaaaagtgctgagattacaggcctgagctactatgcccagccaagaaactatttaagtactataagttttgttgtgctcgcttcggcagcacatatactaagtactaaaagttttgtgatataatttcttaagttgataattctattttagtctttcaacctgattataagaatttgggacaaaggctcacgtaaacatgactttggctcggggcagtggctcatgcctgtaatccccccattttgggaagatgaggcaggaggatctatcacttaaggccaggagtttgatgccagtctgggcaacatagtgagacctcaaatctacaaaaaataaaattagtcatgtgtgatggtgtgtgcctgccgtcctagctacttaggaagctgaggcgggaggatcccttgagcccaggagtcaaggctgcagtgagctataattgtgtcactgcactccggtctaggtgacagactctgtctcgcttaaaaaaaaattaacatggcttcattcctcataaaacattgtgatgaagagtcacaatgttttgagtcactattctctttactccatctttggagaggtacggtggaggagaacaaaaaatggcccaaaccaagccttttaaagcctcctgaagcactcaattcattttctgtcttgtccctttaaaggagagacatggctggttccatcattctctctcctctactgcggtgtcactacacacttccaccatttccactggtcacctggaattgtaactacagactacagtatttgttcctgtttttgttgtttttcgaaatggagtctcactctgtcacccaggctggagtgattctcctgcctcagcctcccaagtagctggaattataggcacacgccaccatgcctggctaatttttgtgtttttattagagacggggtttcaccacgttgaccaggctggtcctgaactcctggcctcaggtgatcctcccacctcagcctcccagggaagtgctaggattataggcatgagccactgcagctggcctgttcctgtatttgcatctgaacagtatttgtatctggacaggaactctcttccctcttgaagtcaaggatcacgtcagaacagatagaataatgtaaatatgtgagctggcaatttggaaataatattccacagagacaatcttgtcccaccccagagccctggatgcacatgtgtataaaaaagaacacctcagttaaagaatccttccagccccatgcatccgaacaaacagctgaaatgaattttcagctgagttttcacaacgctcattgcaagctctttgccctcattaaattatcaggaaaatgcaagtaatttattatgtgtaatcacatcattcgcggtagcacttcgcccagagaaacctagcccaatatggtaacatcagaacaatgcttcacctcacatcttcctttgaaagataaagaaaacacagaatcattctgcttctctccgggaaggaaggcaaagcgtttccccaggccctcagaacaccatctggctgcagtctttccttttagggacctggtattttctggcccagggacaaagcgcatttatttcagatggatcaacactgtcacccagcgggcagacagctgggcaggctgaggccttagccttgctcttggcttgacagccagatactgacagccagtatttgaataggaacctgtttgtttcgggtgatcaggattaattgttaatattctcttggagggaactgggacaacctcagctgacaagcctttgatttggatgtcatgggtgagtgcaacttaagaaagacatatattttcatcgtgctgatgcttttttttttttttaagccactagtgaatttataagaagcacaggctgtaaaccaaccaagcatgtctaccaagactcccagaatcaaataggtttgcaggagcagggtgatatttggtcacctgtcaggtactctgggaagactcctctaccacaaaataagactagttgttcattgttcgtagtgacagtgatgaatattttgaaaactgaaaatagatgtgtgtgtgtgtgtgtgtgtggtgtgtgtgtgtgtgtatctgtgtattgaaatgtcaggaaataatctgcattactacggtgaaatcagtggatgagttagtctttgtttctctattttgtatatatctcagaagacatgcacgggatgcaacctctgtcccatctcatttgtactgagtccttttctcttgtctaaactgtcacttgacacttgaaacaagctggattcctttgcatattgaggtaggctctgtgccttcttgctaaatgtacggttgaattatttcttctccccagctggaactcatcaacaagctgaaagcattcatctgggaacactttacacttcttacgagcatgtccgaggaagtgggggctgagacttcaccttgtagaaactcttgcagaattttgattaaaagcagtctctgttcatagtgagaaaatctggatttgaattctgatcccaccacatgcgagctccttgaccttagataagttaacctgtgtctcagtttccacctctgttatcagggataaaattagtacctaccccctggattgctgtgaggatttagataagaaaatacacatgaataacttagcacagtgcctgggcacatagttaaagatcaataaacattagtattaccattgtcataattattataatgatatctatcatatatattattcccaaaatgcaactttcataaagtgcctctaggctagcagatgaaatcatggcatctttttagctggaagggtcctgaaagatcatccagtcattgcttctcattaaaatcacccagagaaacttttaaaacaaacgctaatacctcattgtagccagacaaaataatacttactgtatgaatcctttttttttttttttgagatggagtcttggactgtcacccaggctggagtgcagtgccatgatctccgctcaccgcaacctctgcctcctgggttcaagtgattctcctgcctcagcctcccaagtagctgggattacaggcacctgctaccacgcccggctaattttctgtatttttagtagagatggggtttcactatgttggccaggctggtcttgaactccctacctcgtgatccacctgcctcagcctctgaaagtgctgggattacaggcatatgaatccttttagatgaaattctagaagggacaaacctaatctatagtgacagaacactgatcagtggtgatctggggatgatgttggaaggactggcagctaatgggccaaaggaaacttttagggtgatggcagtgttttctatcttgactgtggaagtgattacatgggtacatacgtttgtcaaactcattggcgcttaaaatattcacttgaacgcattacgttgtatgtaaactatattgtaataaagagaatactgatgctgggtctcatccacagacattctgatttaattgttcgagggtgaagcccagaagtcatttttttttcatgtatccaaagcatcagctgtgattgagagccactgatctaactcagtcttctttttttccagatgacatgaacccaaacaaatacagctggttaaaggggaaggtcttagactaaaattcaggtcacctggtttcttgtgcgccaaaccttatctttacttacaacatgtcctctgcctggaacctctttctcttccttcttctcatctctctgacaaaatcctacctacccttaggggctagtatacagttggctttaaccaatagtatgagcaatagcataccgcataacttttgaggctggagtgcagtggtgtaatcacagctccttgcagccttgacttccaggctcaagtgatcctcttgcctcagcctcctgagtagctagggctacaggcatacactaccaagcccagctaatttttttaattttgtagagacagggtctcactatgttgcccaggctggttttgaactcctgggctcaaacaatcctcccacctcggcctcccaaagtgctgggattactggcatgagccactatgctcggccaggaacattccttcttcaaaccagcaccatgttgtgaggaaacccaactggctatgaggaaacccaagtggctatgcacatatgacacttctcaggaagcctcaggctgtggctcaccccactggactaggagctccttggcagaaggaactgtggctcattttattgactgagtgagtgggtgagtgtatcttcagtattcagtacttgtgtttggcacagagcagacagtcaataaacatttgttgaactgaaaaaccagtggaagggaattagcattcattgcctatgatgtgccaggaattgaaacaagcactttgtgcacattatctcactgaatttttacaataattttatgagttggttattatttctcccttttgaaagggaggatacaagctcagagaagcttagtaatttaccaaaggtcacacagcaagcaaatagtagaatcaaggtttgaactcaagtgtgtttgttttcaaagttcatgctttttctctaccacaccaggctgtcttgcttatggtagttattctactaggtcttacactatggatttttatgtagccatatctcctcaactaggttataagcttcataaaggtgggaattaaattttagcacttaatttttatatgaactcatgaggcgaatgatatggccacctcagttttttttttttttttttttttttttttttttttttgagaaggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatcctcccgcctcggcctcccaaagtgctgggattacaggcgtgcgccaccgcgcccggccggccacctcagttttaacagagtattcaatttttaaattcattagagtaacagtaaagataatgcaacagtgttaaatctgcagttataagaagacctgaagtcaagggttatcccaaggttgtgatttaagctgagctattttggtagccttctgttgaccctatgaataatccccaagtcatgcaaacatcatacacaacagcccagtcaaaagagtcattatatctcaaagcacataccaaaaaaattcctgggattatattgtgcctttgaaccagaagaggacaattgttgcccatgaatttagaagcagatacaatgttatatttgagcaaccgaaaggaatccgaatgactctaaaagaacaaagagttgtaaagatattaaattccaggcaacaaatcttttgcttcattcagcaatatttgcatccttgaacaaaaaatttaaaactctatcctcattcctacattagaaatgccttcataagctcaccaaagacctctgtattgccaagaccagtcgacattttcatgtttctaatattacttgacctatttatttatttagatagagtctcactctgtcgcccaggctggagtgcagtggtgcaatgacggctcactgtagccttgccctactggggctcgggtgattctcccatctcagcctccctagtagctagtgccataggcacacatcaccacacatggctaaattttgtattttttgtagagacaggatttcgccatgttgcctaggctggtctggaactcctgggctcaagtgatccacctgccttcgcctcccaaagtgctgagattaaggcgtgagccactgcacctggcctacttgacctctttatgacatttgaaattattgaacagtgtctcctccaactctctgctgggcttctatggccactttctcttctgtcttctttctgtttctctaggtcttgcttcctagtcttcatttcatgaagactttttctctacttgacctctaaatatctattgtactaaaagcttgcatcttgtctcctgccattcactctcttcacacactctttggataacgcataattctaactactatttatgtctaccaagtgaccaaatgtctatcaaagctagtgctctcctctgatcaccagacctgtgcgctgacttgcctacttcttgatgtctctacattgatgtcactcaggtacctcaaactcaacatgtcccacctgaaattttcatctttttcttcaaatgttcttatggtggattgaaaatggctgtgtattctttgccactctacccatcaagagatggaaggctatttctgttcccattgaatctgggctggcctgtgacaggctttgaaaaatggcagactgtgtaacttttgaggccaggcattaagagatgtatagtttccatcttcacctcttggagtcttccttcttcaaacagatgccacgttgtggggaaacccgagcagctatgtggagaggccttcataaggagaatggggcccactggctaacagtcataactcagctcccaatggcagtggcactgcctgccagccctgtgaaggaggatatttttcagctgtactcaaactgtcccagccagtgctacatgaaagagtcaggccatccctgcagggtcataaataaatataggttgttgtttttaagcttccaagtttgtttgtttgtttgtttgttttttgttttttgcttttttttatagagacagggtctcgctatgttgcccaagctaatcttgagctcctgggctcaagcaatcctcccaccttggcctcccaaagtgctggcattataggcctgggccaccatacccagcctggggtggcttgttgtgcagtaatagataacaagacatttcttctcctcctcctcctgaattctctatctcaaaaaatagtgctactgttctaagtgcccaggtgagaagctggagataccttaaattcttccttcactgacatatcagatcttatagagtctcatttctaactgttactcatacccagcatccttttccattcccacccactgttactgcctaatcatttccctcctagttaaaagcttaacaggtctctctgtcacttggaccctttccataccattcttccaaaataaacaaaataaactttctaaaatacaaaaaaaacctctgcatgtcacttgtctgtttaaggtcctttaatgatgctgggtgtggtggctcacgccttaatcccagcactttgggaggctgaggcaggcggatcatttgaggccagaagttcaagaccagcctggacaacatggtgaaaacctgtctctactagaaatacaaaaattagctgggcgtgatggtgggcgcctgtaatcccagctactcgggaggctgaggcaggagaactgcttgaaccgggaggcagaggttgcagtgagcggagatcgtgccactgcattccagcctgggtgacagagcaagactccatctcaaaaaaaaaaaaaaaaaaaaaaaagaagggggtacatggggtacataaataagaccctctctacatccaaagatatcgtgggatttgatgcaccttgttgtcccaatgagaagtctgacccctcttacctgtgattctaccctcccatccacccagtttctctgtatctgcaggtgaaccagcttctttgtatctgcaggtgaaacctagctcagcaggttacaagcccatagtcctagaaacacctgcaatgagaccaagaaagaattagcagtgaccatggccatcagactgagagaccattcactcattcattggttcattgattcattcagcaaatatgttttcaatgtttaccatgagctgggcccagggatagggactggggctacaatggtgaacatgacacagtcttaccatcaagaagcttccagcctaggggcagaggaagccaacttcaaagcaggctgggaaggtaaggctgtcctccctatactcccagaacccacgacacactctctgtggctcaggccacccttgtaagagctctgtctacaccctgatgcttccaccagagtatctactgctgttcaccttccaggtacagctcaatcatttcactatcatgcaggacttgtggttccctggttaggtggaatgaaagagaattaagagatagctaaggccctcatccagccacgcaactcttttggaggacactagaggtctttgctaagttttctgtgttttataaccttcttcattcttatttgtattctctttaggttctctggtcacgggattattcccttcctcttgctgacctaaaaaataatcaactttctggaaatttaggggactcagccaatgctgttgtgattctccttctttagctttcagttacagaatgacatgtgacctccttgcaaggttgctatcagccccgttgtacaaaataatatgtccttggtcaaaatttacattttgtgcctcttattaaagatctgtctgtttgcctgcgtcatctctaaaggcctagcccatctgcaatgccacctcctgaatgggacacagctgtttaactgaactgatttattcttaggactaagagactgattcaagaagacacggaatgatatatttaaatttgcccgtttttgcttatcccaatttgtttttttccactcctttgcctatctttatctctgcagcctatcacccaaatctctgcaaagctatcaatttagcttttcagatgtgaaactttttcaagtttcaaagtgaggactgaaggaaataaaaatatttcaccccgaaatatacttctttggcatattttgaggtggctgttcagagagccaatgaatagaagtcaccctgcagaactgtcttttgtgggggagatttgcatctgcagagaatctgcactgatgcaggcagaagagggctttctctgaggccttctcttgtccgattgaggaaagattaactgagactctgacattttaaagatctgaaagaaatatttgccatctacaggcagggctgagagagccccagtgggagtgggccctccatgtcagactaaggaacttggacttggcctaaagggaagtccttagagacttataagcagaagaatgatgcagacatgttcggatattaaaaagaacacctggctgggcacggtggctcacgcctgtaatcccagcactttgggaggccgaggcgggtggatcacaaggtcaggcattcgagaccagcttggccaacatagtgaaatcctgtctctactaaaaatacaaaaaattaacgggctgtgatggcaggtgcctgtaatcccagctacttgggaggctgaggtaggagaatcacttgaatctgggaggcagaggttgcagtgagctgagattgcaccactgcactccagcccgagtgacagtgtgagactccgtctcaaaacaaacaaacaaaaaaggccaggcgccgctcacgcctgtaatcccagcactttgggaggccgaggtgggcaggtcacaaggtcaggagatcgagatcatcctggctaacatggtgaaaccccgtctctactaaaaatacaaaaaattagccgggtgtggtggtgggtgcctgtagtcccagctactcgggaggctgagacaggagaatggcgtgaacctgggaggcggagcttgcagtgagctgagatcgcgccactgcactccagtctgggcgacagagcgagacccccatctcaaaaaaaaaaaaaaaaaaaaaaaaaacaccctgaaatgggtaggaaatattagaggtctcaagactaaaagcaagaactagttagagcattggagaaaatcagttcgggagtgatgaaggcctgaagtaggcagaagcagtgggattggaaagaagggacagtcaggaaatgaaagtcgtggtgatagattccaaactcagtttcataagtggcctctgagatcagtctgtggtggctatttggtgtgcaatcagcaaaaaagagtttagggcccagtctaggctcagttgaaaagaatgatgggctgagcatggtggctcacgcctgtaatcccagcactttgggaggccaaggtgggcgcagatgacttgaggtcagaagtttgagaccagcctggctagcaccgtgaaaccccatctctactaaaaatacaaaaaaaaaaaaaaaaaaaattagccaaacgtggttggtgcttgccagctactccggaggctgaggcatgagaatcacttgaacccagaaggtggaggctgcagtgagctgagatcacacaactgcactccagcctgggcaacagaacaagactctgtctcaaacaaacaaacaaaaaaagaatgatggattagtgatgtctgctatagacacagaatgggggaatattggctcatgactggtatttactattcccattctctggtagaagaagcattaaaatgaactgtgtatcaacaagtgcatactgtgtgagtccatgaagatctagaacagatgaaagtaattcatgctgatagaaggcagaatagtggtttcctgggggtgggcaggtgggtaggttactcaatgagaaggagtaggagagagatttttcaagcctggaagaattctgtatttgatctgggtggtgattacacaggtgtgtatatacataaaaattcattatggtatatacccttaagatttgtgatctttattatacgaatgtcatatctcagttaaaaaaaaaagtgtgttgagaagccaacagaaaaaaaaaaagtatatagctccctatatactttggccacttctttgatagtcttgtccttttgcttgaaggagaagacatagactatgatgacctggtccgcagaggacatctggctgcttctaaggtgatcatactccaggtctgtcactttcaggatgctgtgagagctacattggcacgtgtgccctgtgtccctgcacagtgttctccttaggaccatgggacaaaccagctgggaagcaaaccaggtatccttgctttcaatgggaaaaggaaccctagaaatataatggttagaaatcacattaaagaaatgaaaggacagaaaggacacccctgatatacaagcgattactttagtaaagcattgacatttaattctggacaggattttatttaccaacatgttaaaatatttgtcaatacactaaaagagttaaacataagccttttcagctatacaggcaccgatggctctgaaagaaacataaaatacgtgttcagaggaccaatgaatccaaatgattgcaaataattgaccagcaattactagaatgttaattgcactgtaacatacctaagaagaatgcatacaaggctggtctgtaagttacttacttttattcccttacagatgagaaaactgaggctctggaaattcagtaattataccaaaaacacacaagcagtaaatgacagctgtgatttgaacacatgcatatattttttctattgtaatactgctatcttgctggatcctgaaatatctgtaaggtgtttatgagttggttttattgcctctactaaataagctatgtagcccaacagctagaatggaaatcagaaagctaaatttggattcataatctgtcacttactcttttttttttttttttttttagacagaatttttgctctgttgcccaggctgctggagtgcacaatctcggctcactgcaacctccgccacctgggttcaagagattctcccgcctcagcctcccaagtagctgggattataggcacccaccatcatgccgagttaatttttgtgtttttgtagagatgaggcttcaccatgttggctaggctggccttgaactcctgaccacaagtaatccacccgtctaggcctcccaaagtgctgggattacaggtgtgagccaccgtacctggcctgtcactcactcttaatgtgattgcaaatcttctcatttctttgtgcttcagtattaacatctattatgtaggggtaagtttgtgtttccacaaaacttccaggggggttatgaagcatataaaaccaacctttcatgaattttaattagcttaaagaattttatgagacgctgaaatttgtttaaaaatatagtattttaattaggttattttaaactggcattcctgggtagctagaagagtacatcttatttatttttattttttaatacagagatggggtcttgctgtgttgcccgggctgggctcaaatttcacctcaagcagtcctcccaccttggccttccaaagtgctgggattataggcatgagccactgtgcctggccaggagtacattttattatcattaaaatattcactgttgatttcagtgtcctttttttttttttttttttttttaatgagacagagtctctgtctgtcacccaagctggagtgcagtggcgcgatactggctcactgcaacctccacctcccgggtttaaacgattctcctgcctcagcctcccgagttgctgggactacaggcacccgccaccatgtctggctaactttttgtatttttagtagagacagggtttcaccatgttggtcaggctggtctcaaactcctgatcttgtgatctgcctgcctcccaaagttctgggattataggcgtgagccaccgtgccaggccttttttttttttttttttttttttgagacagagtcttgctcttgtcacccaggctggaatgcagtggagcgatcttggctcactgcaacccccacctcctgggttcaagcgattctcctgcctcagcctcccttgtagctgagattacaggcgtgtggcaccatgcccgactaattttagtatttttagaagagacgggatttcattatgttggccaggctggcctcgaactgctgacctcaagtgatccgcctgcctcagccttccaaagtgctgggtgttttcagtttctttacccttaacctgagtgctgtggactcaatgtgtccccccaaaatttgtatgttgacgctccaaacctcaatgtatttggagatagaggctttatggaggtaattaaggttaaatgatgttataagggtgggatcctgatctgataagattagtgtccttataagaagaggacaccagagagctgacttttgctgcctgccacgtgaggacacagcaataaggtggccatccataagccgggaagagagccttcatcagatactgatgctacggaccttgatcatggacttccagcttccagaactgtgagaaaattaatttctgtcatgtcagtcccttgggctctggtagtttgttaaagcaactgaagcaaacaaatgcactaagcaacttagtgtgatgaatgatcagctatgtttgttgaagccatgctttttgaaatgtcttgatgcctttcctcagtagaaacgcatttctacaaaatgatggtgatttacggtatctgcttggcttaagaaaacccatgcatgcaaatataatacattatttcagcatttgccttaatgccccaccagacctattttcaatatattttttcctttttcagcataatgtttattagtgaatttagatgcaggctaacttagagatggatcttctttcatggaaagacaaacacataatatcagcagaatattgtttctttgaaatgttcagaatagtacattttgaattatagtaaaagtttacatatgtgtgttggtgtgtgcatataatggagtagttaatatattcataaaaatatgaagataatataacacccccatgcacaccaccgagctttattgtattaatatcaaatattaatacaaattaatgctttactccatttgctatatatgtttatattttttccattgttacaatttgagacacaactgaaagtccctgaggactcctgcctgatttcactcaacgttttatcctaattttggtgtatgtcattctcatgtatgtcatataagtatgtaataacccataatctgttaggatgagggtttttatttgcaagcaacagaaacaaactggttaatttaagcaaacaaacaaaaaggaatgtattcaataacttggaagacctttgcaagagtggaagacttgggtttggaggctccactgccagggaaaatgtccctaatcatgctgtagaatgtgtccaatagcaacaccacaacaacggctgctggacagaccctacggcttgcactgttggtcctcctgacccaaaacacagctgcaggaaccacagccattacagccactagaagccaagcggaaccactgctcttcctcccagaaagtccgggcagcccctgcagctgcatgaaagtctggggcaggcgcatctgatctttggagcctgggtcatgtgcctgggccctagctgcaggagaaactgggaaatcaagaagatgggactgggtgtggtggctcatgcccgtaatgccagcactttgggaggctgaggtgggcggatcacttgaggtcgggaattcaagaccagcctggccaacatggtgaaaccccatctctattaaaaatgcaaagaaattagccaggcatggtggtgcatgcctgttgtcccagctactcgggaggctgaggcagaattgcttgaacccgggaggtaggggttgcaatgaaccaagattgcgccactgcactccagcctgggtgacagagggaggctgtctcagggaaaaaaaaaaaaaaaaaagtggtatttttggcttttattgtgggaggggactctgcctcagcaggtaggggagtccccaaacttaggagggaggtatagatgctgcatgataagagccaatggcagttgtccacaacaaacaactgatacattctcttgttgatggacatttacataatttccaattttttactacagagaactgctgcaatgaaatttttgcacatttcctacggtatagaatttctctggattattcgtgccttcaattttactagacattgccatattgttcagcaaagggtctatttgccaatcatatattttgctaacatttgtctccatctgtggcttgtcttttccttctgcttatggtgtcctttttatatggaagatttttattttaatatagttaaactaattaatcctatcccttatgtttgtgattttttggtgtgcatttggtttaagaatttattttcagccaggcgaggtggcttatgcctgtaatcccagcactttgggaggccgaggcgggcgggtcaggagtttgaggccagcctggccgacagggtgaaaccccgtttctactaaaaatacaaaaattagccgggtgtggtggtgtgtacctgtaatctgtaatcccagctacttgggaggctgaggcaggacaattgcttgaatctgggaggtggaggttgcagtgagcagatcacgccactgaactgcagcctggttgacagagcaagactgtctcaaaaaaaaaacaaaacaattttctacctgaaggtgataagaaaaaattatcctgatgttttcttctaaatgttttattatttggcttttaatgattagctctttacctggagtttattatggaaaataggaatctaagatagataatcagttgtcccagcaccattgattgaataatccattcctcctggtttgtaattcgatctctgttgtaaatcaagtttccccatgttcctgggtcagtcaggtctttctatttctgttccattggtctatttaactagcctggtgccaatactacaatatcttagttactatcacgtcataaaaaccttaacatctgataaaatgagtcctccacttccccctcaccccaatgtattaatgctatttccagagtgagctattagctatcttatatcctgaagagcacaatgacaaaaaaaaaaaaaaaaaaagagaaaagaactttcagagtgtatggtttggtataaaatatgagtgggccataagaagtagcaagagaatcaacaacaccttcaccagtggctaggtgcctgcagagagctgagagccagaggcagggatttatatcaaagaaatcagatgcatttgaattaaagctctgatctccaccctgtaagaacaggcttctaagactcccagcttcagtgacactcttcttgttttccaatgaccactgactcctccatccccacctttcctttcctggggtttacggcaggtaaacacagcgtggcaacatcaggttcctggagtggcattctgagcatccctgaataattctgatgtgtcagctggtgtctgtggaatcactaaaagtcaagtttcaagctacaaccctctacctctgctcaaaaaggcattttaagtccttgctttgagcaaagcttccaacctcctgcctcaaacacatggcaatgagaggtaaaagagaaaaagaagcaatctaaaggacaaagctgcactccaaccaagatgaacaccctgtgcatggaagccaaatcaatagatttgcggggctgaagccacaggcttgcttggctctaggtctagaagcagcgaaagcagatatgaatttagctcttgtgggaaaacagaataaaataaaatgcccctctccaggctggagagcagggtgggggatgttgcctgttttgcttcttgaatccaagaaccagggtagggcttccactactccgcatgaggctagaatagctgctgtctactcctgcttggccacatgatggctcacaggatgcttcgtgcccaggcagatgagagaacatggccacggccgcccaaccaggactaagctaaactgcttgctggcctggagactggatctgcaatagttctaatattcatgaagtgagacatccaagccaccattattagacctggttcaaccactaaatgggaggaaaccttgctcatgcgcacacacacccgcacccacccatctgccccaacacacacacagagaaagagaaaggaaaaaccttccactcaagatgagcccagaatccaaaattccaaaacatacagagaaagctaattctatttttttatacgaagtctcactctgttgcccaggctggagtgcagtggcacgatctcagctcactgcaacctctacttcctgggttcaagcgattctcctgcctcagcctcccaagtagctgggattacaggcacacgccaccacacctggctaatttttgtatgtttagtagagacaaggtttgccatgttggccaggctgatctcaaacgcctgacctcaggtgatccatgtgcctcagcttcccaaagtgctgggattacagccacctgccaccatgccagctaatttttgtatgtttagtagagacagggtttcgccatgttggccaggctggtctcaaactcctgacctcaagtcatggtgccatcttagctcactgcaacttctacctcctgggtttaagcaattatcctgcctcagcctcctgagtagctaagattacaggcatgcactaccacgctgtctaatttttgtatttttggtaaagacggggtttcgccatgttggccaggctggtctcaaactcctgacctcatgatctgcccacttcagcctcccagagtgctgggattacagatgtgagccaccatgcctggccttaaaagttattttaaaaatgtatgtttagaatcctaaacataaaaaatgacggaataaataactgaaaaaaaggattaaaagacttttagttaccataggatgaattgaacactcaggtttactttaactccttgctaatatcttaccacagagactattaaagggtaataaaggtaaaaacctagaggcctattgtatcacgtgttatatcagtaaggatgcctttctttggctgcaagtaatgcagctcaaactggcttactaaggacacttacgggctcccacaattggaagtctagaggcagggctttgcaggtggcactgcccagtggctccagatctatccccctcgtcttctgtgtcagcttcttctgcaggaaggtaacagatggccaaccagctccaggtctcacacctactcagaacaaccattacagaggagagtgggcttctgatgccagcattccaaaccaaaagcctgggactcactatgtcttgtgtcacatgctcacccccaaccccaccgaccaatgactgttgccagatacatgaaaattctcaattgccttaaatcccaaggctcatccttggagctttggctgtggtcaactgcccccgatgcatctgggtgattgagggaatgggcagacactaaataaacccagggttctatgaggaaggatgaagacagaaatgactccaggtgttcaattaaaaatattcactcagtgctgtatgtggaaactttttttaaaatgttggctaggcatggtggtttatgcctataatcacagcactttgggaggctgaggtgggaggatcacttgagaccaagagttcaaaaccagcctggataacatagcaagaccctgtctctacaaaaaataaaaaaattagccaggcctggtggtgcatacctgtagtcccagctacttggaaggttgaggtgggaggatctcttgagcccaggagtttgaggatgcagcgagctatgattgtgccactgtactctggcctgggtgacagagtgagaccccatctctaaaagaaaaacaaatatttaccaatatcaccacaaatatttggtgcaccacttaaaatgtgcactttctgaaaaaattagaaacaaagcataaaaagttagggaaagggatatgttaatactcgttcactggtaaattgttatttgtatagaccgtgatagcagataaaactctctgataccctgcttatgcgttgcctcacactatgagtgactatattccttttgtcaaatagcacttatatagacagtgctcaaagtaagttatctgactgaatatcacttttaatttatagtctgctctagccttgtcaaaaaacctgcacactgttgcatagacatcctttttcttttttatcagtagtaaatgggctttaaaaataattctgtccttattctcagaagcatgttgcatactgggatggatggttctggaaatgaagggatgtttacccttgccactgtatttcaataccataaatggtgactgtgaatcattacaaaaaatgtggcaacttgcttgtgtctaaaaggagcaactggaactagaaagtgtgattacatagggaccttgtaggtttgttaattgatctgcagctaaaccttaatgtgtttgtgtgtctgctcattgccctcagcatttcaagacatctaaatactaccataaaaccagcattttcctgtgcattgacttctcatgtgaaaacagttactgaagttggcaaaaaataaattttaaagtttggatgaaggtatttttggtctgtttagtgctcttctcaggtttttcaataaacttgcattttgagggttgtatcggcaacttcagctttcaatgtgcatcatggtggaaggtgctgagtttattggaagggaatggaaagacaaagttaccatgaggaggatccgcagaccacgtcctaaaaagaaattggctcagccctccacgaattgggtctttgggctacttaaaatagaagtaaacatttttttaaagttagggaaattaacaagcctctccgtatacccatagatatagggaatctcactgagtttctcagacacatgataaaacagcatacatctctcacttacaggtggaatataacattaaccatcttgcactgaggagttacagattggtagacacagtgccaaaaacttgataagcttgtctcatttcatccttacacaaccttgtgaagtaggtattattattgtgctttttacacataaggaaacagaagcttattctgcaattacagaggaagtaaaaagcaaaagaaagaaacagaagctgggcgcgatggctcacgcctgtaatcccagcactttgggaggctgaggcaggcagatcacctgaggtcaggagtttgagacaagcctagccagcatggtaaaatgctgtctctactaaaaatacaaaaatttagctgggcacggtggctcacgcctgtaatcccagctactcaggaggttgaggcagaagaatcacttgaacccgggaagtgaaggttttggtgagctgagattgtgccactgcactccagcctgggtgacagagcgagatttcatttcaaaaataaaataaaataaaataaaatatagccgggtgcggaaggaagaaagagaaagaagatagaaaggaaagaaagaagaaagagagaaagaaagaaaagagagaaagaaaaagaaagagaaagaaagaaagaaagaaaggagggagggagggagggaaggagggagggaggaaggaaagaaggaaggaagagaggaagagaagcttagagaggcacatgattgcagaagttcacgtagcgaatacattctacttgtgtcgtatcaggacattatgctgttgtccctccaccaggtatcagcctatccatcgcaagtcaaacacaggatttggttggaaatggaactccagcatggaaaccatacagaggagtgatcacaggaaagatagatgttcttgcacatggtgcttatttttaattcataggttaggtgaagtctttatgttttttaattcaagatttagagtccagttgtggatttaaaagttgcagttaagtttttgcagaaataaataaagcccttattgaattggtattaatctcttcaaatgtcattgctatttgagtaactgagccataaaaataattttacagtgacatgtgaaatgattgggttttgacttcgtaaattcgaaagtctgaataaacattttggagctgccttgcacagtgcctgctcgcttcatcgttgcagattttaaaggattgggataattttgttatttgcacacagttctggcctgaggtcaaggggccatgatatggccccaaccctgcctatcattcgtgtcgccctaagacccagcaaaaccaaactgctcagcattcctacgatttgcctgcattgtccctcctacgtgactttgctccaacccctgtgttgctgctcactagctgtgtctttgggcaaattacctaacctctctgagcctcagttgctttagctctaaaatgggggctggggaggacagtgagggttataattataattaactaattataattaatcccttaggtgtgttgtgaacgttaaatgaaatcctgcaagtagagtgtttagcatggtgtctagtgtatggtaactggtcagcaaatgttaaccatccctaacattattagggtcattactatccttctcatcactcatctctccacctagaatacccaaccctccttacctgcctatcccaattctccccctcactcaagactctggtcaaaaatgcactataaaataatcctgtctttctggtcaggtgcgatggctcacgcctataatccctgcactttgggaggccaaggtgggcggatggcttgaggccaggagttcgagaccagactggccaacatggcaaaaccccatctctactaaaactacaaaaattagccggcgtggtggcaggtgcctgtggtcccgcctactcggcaggcgaggcaggagaatcactcgaacccaggaggtggaggttgcaatgagccgagactgcaccactgcaccagcctggtgaccgagtgagaccctgtctcaaaataaataaataaatgaaaataaataaataaataaccttttctttccaaaaatactctccctccccaaaacttctttagcgttctatctatacagctctgctagcagttccttccttatttatttattttttttgagatggagtctcgctctgtcacccaggctggagtgcagtggcgcgatctcggctcactgcaagctccgcctcccgggttcacgccattctcctgcctcagcctcccgagtagctgggactacaagcgcccgccaccgcgcccggctaattttttatatttttagtagagacggggtttcaccgtgttagccaggatggtctcgatctcctgaccttgtgatctgcccgcctcggcctcccaaagtgccgggattacaggcgtgagccaccgcgcccggcctccttccttatttttcatttattaatagtatacactatcttacgtcttcctgcagccttgaagccttgggaagactggggccaagtctttatgttgccccctgggcctagctcacacacctgtcagtagcggataacagccactggttgcatgaattcataccacggtcaggggtctgacagcactgcttgctttagtggcgttagtaaagtatcatggcaatacttcgaatacaggaaacattgccctcattgtatttacaacttttctttcaatgcacagtctgcaccaaatgttactgaagcgatattaggtttgggagctcgagggagtctcagctcctggggggtcttggaagatgtgtgctcagctaaattacagcatgtgtggtgttagggggcaaggcttcgcttaaggcttccaaaggctgccacgcagtagagagaccaagctgctcctgcagcaacccccttccctcccacatgctacctaaacctggagagagtgacacacggccttctctgcctgaggtaggaagcagccctgtttggtggctagtcctggagatacaaatgcagaaagaacagggcattttatgctggtgaagataataagggcacatttcccccaggagagttggtatgagaaggcaagagaagcaggaacttgtggcacttatatactatcaccaagtatagattaaggacttttcagcatagggccaggttttgaacaagcattcactaaagaaatgaaaacaaactgagtcatgatcccagattgatgtggctccactgctaaacaggaagcctcttagcaagcagactgaggagagctcaaaggcttgaatctgggcatgtgcatttgtcccagttttaggaaagattttcagttgattgcatgaaagtggccactccttaacccaaacatgagctgggctatgaattattaaggcaaaggaagctggttaccggaaggtctgattgccggctggggccttccggatgtgacaaagaggcaaaggcttcaagacacccttttgttctaggaaggtatttcggcattgaaggtactccttatcctcgcctttctcctttgcaccttgtttcagagaaacttttgctgatgaggcgttctctttcctgggtactatttgtggaaacttggttattttgcaaatgtgctgcggttccattcctgaaatgtaaacaaaatgtattcctcccagcagcctcagtagaccaaggcatctgtaggctgagctgtttgggttaagttggctgctatagtctggatgctccttcacccatttacagaagttccttctgttcgttcttcaattttaaatgcacctcttgttctactcagaggacacatggcatctatgtaataaagaaagtttccaggctatcaacaaatctaaaccgtaagagtttgattgcacttatcttgtaccgggaaatgagccaggcactttaaatacattatcccattgaaggaagtgcccccatgagttgaatactcttattttcatgatatcacagataagttcaagtcacttggctagacagaggcagaatcaggatttcgacaggcctatgtgattccagactgagcttttacttaccatgctctatagagaccagtgcttcccattttttttacatcacatggaaaagtgtaaattgtaaagcacatatacatatagatccttatcatagaaaatgtactattaagaaagaaggccaggtgcagtggctcatgcctgtaatcccagcactatgggaggcggttgtgagtggattgcttgagcccaggaatttgagaccagcctaggcaacatggtgaaaccactgtctctacaaaaaaaaaattagctgggcatggtagtgtacacctgcagtaccagctactgggaggctgaggtgggaggatcacttaagcccaggaggcggatgttgtagtgagctgacgtgctactgcactccagcctgggcatcagagccagatcatgtctaaaaaaacaagaaaaagaaaagaaaagatgatgtatttgtgtggcacactgggataaatttactaggctgcttgtgggtggaagcaactatcccagtggcttaatcaccccagcccagctgagtggccctgaaggctggtaatgtccacttttcagttcctgtgtacaacatctgaggcacaccctttgggaagctctactctataccacagtatacagcaaactacctccccaaatggagaagcttgcctttggatttagcatatagtcaacgtgcactattcacagattgtgtatcatgtctttgactgcttgctaaaatttatttgtaaacctcagtgtcagtattggtggcactcttgttgtcattcacagataggtgcagagcagtgaaaaatttgagttacctcttgtgaatgttcccagctgaggtcgaacaagcctacgctcttcttgtttcagggatactgtaaacgtgtctctttgtggtctgtttagtggcgtgtttcttgcatttctgtgctgttgttggtgatgctgtttaaaatgagctgcaagtgcaatactgatgtgttgtctagtgttctaagctcaagaagtctgtgatgtgccttacagaaaaaatacacgtggtaagtaaactttcagggtgagttaaagtgctgttggccataaagtcaatgttaatgtatcaacgatatctagtaaataaggtgtttttaaagagaaacacgtaaaatgaggttatgtattgatcaattgacgaaaatattgtgaccctgggagctacccctaccagcaatggttcagtatttgcttagtgtttgccaagactttacagaacctaatttccatgaataacgagaataaaccgtgttatatcatcagtcaagaactgaaactgtgataggctctgtagttaacaccaactacgagttaacattgcaacggcacactccactgtgggaacacaggcctcttctcaacacagcaggtgaaccaaagacatgggcaaggattgaggttttggtgggaacgctaagaggtgatggttgaggggtgagagcattttccaatccaaaaaatgagtatgaaagcacctctccttaagaaaacacagaagtggccagatatattcttttcttcaaaaagagaaaggaaataaaatcaagtttgcttctcttttcctgctacagtctatcacctgcatccatgacaagaatccttctgcatagggctttacagtttacaaactcaccacctcaggaaggagggaagaggtatttaaatgctggttctctggaagtctgaatgatgggaaccggctattatgaagcaacacaatggattccataactgacccaatgcaaatctgtactgattatagccagtgaatgaggatgtgccggacttttctctacagtcttcttagcttgatagctgtggcaatgtcacgcatggggcttatgtccactgctggatcaaatgtatctgtatccactgggtctgttaaacttgaaggcttcaaaacagaaagatgtgtgttccacacacacacacacacacacacacacacacacatatatatagagagagagtatttactatatacatgattagcaaacatcaattctgtcacttgttcattcattaggtaggtcattcaacaagtgtttatgccatttatgggccaggtacaaaaactaagactaaagacatatataaaaatccacattaccttgggaggccaaggctggcagatcacttgaggtcaggagtttgagaccagcctggccaacatggtgaaaccccgtctctactaaaaatacaaaactcagctggatgtggtggcacacgcctgtaatcccagctacttgggaggctgaggtaggagaatcacttgagcccgggaggtggaggttgcagtgagctgggatcatgccactacactccagcctgggagacagagcaagactccatctcaaaacaaaaaacaaaacaaaacaaaagatccacattcccttgtgaatatacttaatgccactgaattacaaacttaaaaatgttaagaaggtaaattttatgtcatgtatatctgactgcaataaaaagggggtaagaaaaagccatttccctccaccaaggagctcacagtcagtgaagaactggttgggttaacaattaccatacagtacaggggctgtgttagatggaagtagaatgttaccagagcataagtaggaaatttaatgtttgtaatattgactttctatttagcagaagtttctaagaagtacatcatgaagacattaaagtatattgttatagtgagtagtatgtgtgatcttttcaaaacatattgggtatatagttattttcatttggatgagctcatgtgactagaaaaattgttgataatttagtttttttgtggggtttttattttttattttttttgaggcagagtctcactcttgttgcccaggctggagtgcaatggcatgacctcggcttggacatttacatacttacatataaaattaggcatgattgtatacttaactcattatccaggtgtaatttgcataattttggcacgtcacagcagacccagaggaaagtgtgcagaaaccaggaagaatatgaagagaacacaggattcaacgacccatgaagagattattgaagtggataatagggagagttttggggaatttggtctacagaaatcaggcaataaaagttgagattttatcttgaatcccggaaaaatcaaccacatctgaagggcagggacttgaacttccttgtcataatgaattcaaaaaagactcagagaacccatttgtgggattgataaaaatcactaaaaaatgtgtatattagttcctgagtctcagcctccaaaatttggtgggtaaataaacttcagaaaagtttaaaatttaagtagagagataaattaatcccacaatattaaaactttaacgtatatgaataaattttgagttatgagataatcttgtgtatttattatgtttgaaatattaaagagatttcagccagttagagaatgtgagagatttcctttgggctttcaacttaaatttgagtaaactgattttagatttgtgattattaagtttataagtttaaggtagtttgactaagttcaaaaatataattggaatatttaagagaacttgagattcctccaaatttaatttatttgctttatcaaagttaagaacttgagaatgtttttcttgttagggttataaatacttaaaggggaagtacttaaaggggaacaaaatatattcaaaatataaatgcactttaaaatatatgaagggggccaggtgcagtggctcacacctgtaaccccagcacattgagaggccaaagtgagagggttgcttgagcccaataggtggaaaccaggttgggcgaggtggcttatgcctgtaatcccagcactttgggaggcagaggcgggctgatcacctgaggtcaggagttcaagaccaactggccaacatggtgaaaccctgtctctactaaaaatacaaaaattagtcaggccttgtggcaggtgcctgtattcccagctacttgaggggctgaggcaagagaatcacttgaaccagggaggccgaggttgcagtgagctgagattgtgccactgcactccagccctgggcaacagaatgagactccgtctccaaaaaaaaaaagaattgattggagaccagcctgggcaacacagtgagacctccatctacacatacacacacacacaagcactatatatatatatatatatatatatatatatatatatatatatatgtatatatgtgtatatatgtatatatgtgtatatatatgtgtatatatgtatatatgtgtgtatatatgtatatatgcgtgtatatgtgtatatatgtgtgtatatatgtatatatgtgtgtttatgtgtatatatgtgtatgtgtgtatatatatgtgtatatatgtgtatacgtgtgtatatatgtatatatgtgtatatatgtatatatgtgtatatatgtatatatgtgtatatatgtatatatgtgtatatatgtatacatgtgtatatatgtatatatgtgtgtatatatgtatacatatgtatatatgtatacatatgtatatatgtatatatatgtgtatatatgtatatatgtgtatatatatgtatatatatgtgtatatatgtatatatatgtgtatatatgtatatatgtttatatatgtatatatgtgtatatatgtatatatatgcgtatatatgtatatatatgtgtatatatgtatatatgtgtatatatgtatatatgtgtatatatgtatatatatgtgtatatatatacacacacacacatatatgaagggttgttattcattaaattgtatatgagtctaatttttatagaaagtttaatcagctcaatttgcgttaaacaaacatttatcaaggaaaaggtaaagacaattgttaccttagagtttacagataaaatagatagatttttaatggccttaaaacttagtgaagagagggtttttaatgggttgctaataaaatgaattttacttttaaaaccaaagtgattgcatttttctatgcacaaaaatatcttgaacatcaaaaccccacacattggcactgcattttttaaggcctctccctgttacatgtttactgaattggttaatcacaaccaaactgaatccttgagaggttttcttttaattttctgccaatttaaatagagtgaaattgacagaaaattttccctgcattgctgaaaaacacaattcgctatcaaagagagacaataaatggagttgacaagatatgatattttgcaggcatgaccactaatcgtgagaaataaatctttgaaaaatataaaggcaaaaggaccaagaaaaagctttcccccccaaatgattagtaaatgcaaatattaggtccaaaaaaataatatacgaaacccccaaattcctgaaacatgactatctccctccacaggtgcatgggccctgtaggaattgtttctttctttttttttttttgagacaaagtcttgctcttgtcacccaggctggagtgtaatggcatgatctcagctcactgcaactgccacctcccgggttcaagtgattctcctgcctcagcctctggagtagctgggattataggcacctgccatcacgcccgggtaatttttgtatttttagtagagacaggatttcaccatgttggccaggctggtctcaaactcctgaccttgtgatccacctgtgtcggcctcccaaagtgctgggattacagacgtgagccaccgcgcccggccagggattgtttctttgagtttatataattaacagactgagccagaaagataatgaggtagcagttataaaaagaatgaataaaataacagaaaacaactgcacttttttttgtctgaaccacttcaacaaataagaactcattatgatttggcaacatcccccagtactctctagtccatgtctcttcatatatacagcaaaatttcatttttcacattttttttcttattttggaggcagggtctcactctgtcccccaggctggagtgcagtggcacggtcttggctcactgcaacttccactgccccggctcaagcagtctgcccacctcagcctcccaagtaactggaagtacaggtgcttgccaccacacccacctaattttttttttttctggttgcagtctcattatgttaccaggctggtcccgaactcttgagctcaagcaatctgcctgccttggcctcccaaactgctgggattacaggcgtgagccactacacccagcttcatttttcatatctgatgctcaaagtgtgtctagtttacggatctcttcttctacttgacccttcactgaatctatactctttcctgaagtgttttttagtttatcaactttttggaggtataatttacatataaatgaccacaccttttaaagtgtgtcattcaggccaggcacagtggctcatgcctgtgatcacaacactttgggaggctgaggcaggaggatcacttgagcccaggagtttgagtctgcagtgagctatgatggcaccactgcattcctgcctgggtgacagaatgagaccccatctctaaatataacaaaataaaaaataatacagtgtatcatttggtgaaatattgatcccttgtaagcaccaccataatcaagtttgagagcccttccattagcctccaaactttcctccttcccctttgcaagaaactccgctttggcccccgagtcctttccagagtttcagataaccggaatcataccatacgttctcattcatgtctggcttcttttgttcagcatgtttttgaaattgatctgtttttgtgtagtggttcattcctttgtactgatgcatgatattccattgtatgcacgtattttgtgtacccatttaccagctgatggacacttggattgtttccagtttggggtattatgaacaaagctgctatcaatattcacgtagaagtctgtgaaaataggtgtccagctttgagtaaataaatacctaggattggaattgctgggtcacattgtaggtagaagtttaactttataaagtgccagaatgttattcatatcaccataacatgttctgttcccacaagcagtgtatgaaagttccagttgtttcacatctttgtcaacacttggtcttgttagtcttttacttacagccattctaattgaggtattaggtgatatctcactgtggttgtaatttgcatttctctcatgctgaacacgttgaaccttttttgtgtgttcgttggtgatatcgtcttttgtgaaatatgttcaaatcttttctgtatttttagtgggtcatttgatttattatagagttataaaaattcattgtatactctggacacaagttctttgtcagacatgtatattatgtatattttctgcctttctgtggcttgcctttccattttcttgctagtattttcaaggtttttttgttctgtttttgattttcagagtccaatttatcaagttcccttaagtttctttggaaatgaagtgtagttgctactctgggccaaagtactgatgacctttatattgctacagaatgatttaaatgggctaaagcctgagtacacatattttactggctttttattacattcactgtaaatttttacttttgatcttgtgcataggaatgtcatgctttccagggtatatgtttccttcttttttttttgagactgggtctcactctgttgctcagtctggagagcagtggcaggaacacagctcactgcagcctcctcttgggctcaagcaatcctcctgcctcagcctcccgggtagctgggactacaggcatgtgccaccaggcctggctcttttttttttttttttgtacagatggggtcttcctatgttgcccaggatggtcttgaactcctggggtcaagcagtcctcccacctctgcctcccaaagtgctgggatcacagacgtaagccgctgtgcttggcgatgtgtactttttaaatgaaatttaaagaatataggaaaaagaatattattaataaaagacatacccatgtacccactacctagcaaaataaagagaacattatcaatgccaataactttaaggcctcgatgcactcctcccaattcatattccctctctccccataagaaagtataggctgggcgtgagctaagctgtgaggacacaaaggcataagaatgatacaatagactttggggactcagggggaaaggatgggtgggggtagggataaaagactacacattgggtacagtgtgcactgctcagatgatgggtgcaccaaggtctcagaaacaccactaaagaacttattcatgtaaccaaacaccacctgtttcccaaaaaatattaaagtaaaaataaaattaaatttaaagaagaaagaaaatataggtcggttgtggtggctcatgtctgtaatcccagtaattcgggaggccgaggcaggtagatcacttgaggccaggagttcgagaccagcctgaccagcgtagcaaaaccccgtctctactaaaaacacaaaaaattagctggacatggtggcaggtgcctgtaatcccagctattcaggaggcagaggcacgagaatcgcttgagcccaggaggcaaaggttgcagtgaaccaagattgcaccaatgcactccagcctgggtgacagagtgagactctgtctcaaaaaaaaaattatttacaattttggttttagcggttttattctgtttttaccattattttatttcttatgtatgaattattaaacaataagactagtttccttactttcttgtaactcagtaatacatttaaaattttcttagttataatgtattcagtatccaggtgttttgcaataaaagggcttctcagaatctctcttcggctatataaatagaagcaaagctgtccaggccagattttttttttaaacagctttattgagatatcattcacattctagacaatttatttcatttcaaagtgtagaattcaattgtttttggtatattcatggagttgtgcaaccattgccacaatctaatttcaaaacatatttgacaccccccccaaaaaaatcctattccaattaccagtcaccccattctttcccaacccctaagccctaggcaaacactaacttactttgtgcctctagagatttgctagtgccagtcataatccctgaagacacaattccaaatgccataatcctgaacgttgcaagcctgaaacattaaaatccctagagtctaaaatatctaacatctaaaattccaaaaatcgtaatcctgaaagatcaaaatcctgaaattggaaatcttagaaagctgaattctagggaaggaattaatgcgttttgggttgtatttaggacagttgagtcatgttagttgcatcatgttatgcagaactattaccttctcattgtctttatttgcatttggtggaaaattcaggtgagtggattggccacattataatgcagtgatgaaaacttcagtttaaaaatgcatcattggctgggcacagcggttcatgcctgtaatcccaacactttgggaggccaaggcgggaggattgcttgagcccaggagttcgagtcctgggcaacatggcgagacctcaactctacaaaaaataaaggaaattagccaggtgtggtggcatatgcctgtagtcctacactcaggaggctgaggtgggaggatcacttgagactgggaagttgaggttgcactgaactgtgatcacatcactgcactccagcctgtgtgacagagtgagaccctgtctcaaaaaaaatgaaaaataaaaataaaaatgcatcctttgtctgcattggcagcccttccagctgatgaaattctaggaatttttaatgaattaaagccaaatttgcttgaagaagccagcaaagttactggctggttcaaaaataatcatgtgcacagtaggataaaagaatgcacaacgatgttggagttcaatcaacaacatggtttctgtgaaatttgtggtctccataaaagtgcttgtggagtggattactgtatacccaaaattacacagaagtatggcacaaaagatgtgaacattatacaggaatgttcatgttggtgtatcttaactcagaagaatttcaaaaagagcagtgccacgtagaaaagcaatgtgaatgtattctttgtaaatgtattcataccctaaaaggggaaaaagaaagcaggtattcatggacatgagaggcttcaaatatagttaatgattgtgaaagttggtcagctctatggacaacctctgtgcaattgcccataatcgatatactttttcacatgccgaattttcttcttaatttttttagttttttttttctttttttagtattttctccactattttatttaattaattaatttatttattgagatggagtctcactctgtctcccaggctggagtgctgtggtccaaacttggttcatggcaacctccgccttccagattcaagtgattctcctgcttcagcctcccaagtagctgggattataggtgcccgccaccatgtccggctaatttttgtgtttttagtagagacagggtttctccaggttggccaggctggtctcaaactcctgacctcaggttatccgcccacctcggcctcccaaagtgctgggattacaggcatgagccacggagtcccagcccttccccacaattttaaattgtcaacattatttttttgcaatttgctatgctatggatttcatctttgcattatttcaatactggaggtataaattgtgtaaagacttttagagttctaattcattttatgtattttgttttttacaaatttgacttcacaaaagtacattatcacattgactctgtgtgtaagcgtcacgtgtgtatgcaaaaatgttgaatcttcctcaatagatgaagagatgtcctttctgtgcacatgcatttgtgaaagagaaaacttctcgagatcttggctctttgggtggctgcatatgtggtgctgacccatcgtggtttttgatcagtctcatcaaaagacttagtttgccggtcacagtatttcagatgactgaggttataaagctgggtgcatgcaattaccaaccatagtgatgtatttattcattttgctttctgacctatttctttaataatacatttcatccacttgtaactgtactcttgcaactgtagttagtatacctagatgtttatgcttaaaaatatgtatattattattgtcttttattgtgtattctgttgtgtttctatgtttctcaaatgaatctcctttaaaaatgtaaataaatgtccttgtattttctaaaaattattttttccagaattcttttttttttttttttttgacatggagtctcactcatgttgcccaggctggagtgcagtggcacagtctcgtctcactgcaacctctgcctcccaggttcaagcaattctcctgcctcagcctcctgagtagctggaattacaggcatccaccaccacgcttggctaatttttgtatttttagtaaagacacggtttcaccatgttggccaggctggttttgaactcctgacctcaagtgatctgcctgccttgacctgccaacgtgctaggattacaggtgtgagccactgcgcccagcctattttttccagaattctaattttgagatattgatcttttgggattgtggtttttgggactttagactttagggattttgatcattccaggtcacagcactcaggattgtgccttttgggattatggcccaaacctgagatttgcccatcctgaacatttcatataaatggaatcattcaacctgtcatcttttttttactggcttctttcactttgcatgttttcaaggttcctccatgttgtagcatcgatcagtacttcatttatggctggataatcttctattgcacggatataccacattttgtttatccttttctaagttgatggacatttttgttgtttcccctttttgcctgttacgaataattctgctatgaacattcatatgcaaatttttgtgtggatgtatgttttcatttcttttgagtatataggagtagaattggtgttcatatggtaactccatgtttaatttttttagtaactgccagactgttttccaaagtggctaaacttatattcccactaatgaagaataagggctccaatttctccaaaccctcacaaaaactgcttgtctgggccgggcgtggtgactcatgcctgtaatccccagcactttgggaggccgaggcaggcagatcacgaggtcagaagttcgagaccagcctgaccaacgtggcaaaatctcgtctctactaaatatacaaaaattagttgggtgtggtggtgggcacctgtaatcccagctactcaggaggctgaggcaggagaatcacttgaacctaggaggcggaggttgcagtgagccgagatcacgccaccgcattccagcctgggtgacagagcaagattctgtctcaaaaaaataaaaaatgaaaataaaacaaataaataaaactagttgcccgtctttttaagtatagtaacttaaaatagtttagccattctagtgggtgtgaagtgatgtttcatggtggttttggtatgcatttccctgatgacaaatgatgttgagtatcttttcacaggcttattggctgcttatatgtctttggggaaatatctattcagatctttttcccactgaagaaactgggttatcttttcattgtggagttgtaagagttctttatatattcttgatacaagtccctcattagatatatgatttacaaataatttctcccattctttggattgtcttttcactttcttgattatattgtttgcaacacaaatgttttaaaattcattaagtctaattgatctactttatcttccctcacttgtgctattggcactgtgtctgggaaaccattgctgaatccaagattgtaaagatttatgcctgtgtttttcagacagggtctcactgtgtcacccaggctagagggcagtggtgcaatcatggctcactgcagcctcaacctcctgtcctcaagcaatctcctcctacctcagctcccccaagtagctgggactacaggcacatgcaccacgcccagctaatttttttatttttggtagagatggggtcccactatgctgcccaggctggtcttgaagtcctgggctcaagcaatcctcacacctctgcctctaaaagtgttggaatcacaggcatgagccactgttcctggccagttttcagctcttaagttgtcaaaagaacttggcactgttaaactggtgatcattttttaaaagatatttaatataaaccaatgtttagaaattatactttttaatgtttataaattgatgaaatatgcttatagtcacggtttctcagtgtgaggaatttgcttccttttcatatgtatggactttagcttctaaggaaagtagtatcacaaaggccctttgatgttcatagaacgttgttaagtgtggagaaaaaagtagatgtcaaggtagcatgtactatatgattccgtactgagtcaaagaaaaaatattcttatatgcatttatatagactgggaaaatgcatcattaattttttgtgttgaatacattacttttgaaatgagaaaagaagatacttgtgaaatgtgtaaggaaactcacaaacgtgaaaacgttatgggtaatattagcagagaaaccaaatcagaaaacaacattgtaattatcaaaggactgcagttctgaaggtttgagtggaacaatttatattcatttctgccatgaaattgaccattttccaaaggctgtgaatgcagacaccctctctatatgcatggaaatcttccttatgctattttcataataaatattgacatatttatttctcacattcaaaaatggcatgaaataatcatcagagtccctttttgtaacttccataaacaactcctacaatctgtaattttcccaggcatcccacccctcaaaaataaatgttcaagtttgcataacaagaatcaacttctcaaactgtgaaaatgtattcttttttcaaatctttttaaaatatgcgttatttttagatgttttatattatctttgtacagtatttccaaaggagaatgttaaggcatgacattttcaaggtagatttttgtttgtttaattttctcccagtagtgtgagctttcacatgaatatctgatgggctaactccagcataccaaaacactaacaattgtaacaagcataccactgagtcttctacttttggagccatacacataattcacagatagatgtctgacacttaggaaatggtttttcatgccaaacatttctttctttttttttttttgagacggagtcttgctttgtcgtccaggctgcagtgcaacagcgtgatcttggttcactgcaacctctgcctgccaggttcaagtgattctcttgcctcagcctcctgagtggctaggattacaggcatgtgccaccatgcccagcgaatttttgtatttttattatagatggggtttcaccatgttggccaggctggtctcgaactcctgacctcaagtgatcctcctgcctcggccccccaaagtgctgagattataggcatgagccattgcgtctggcccaaacatttctttcaacctactttctttgcagcccaatgtgaaaggcaagctactttccaaattcattacctttcacagacccctcattctacccaatatgtttgtaaattaagccaatcatgaagtccagaagggggttgggaaaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaaccaaacaccgcatattctcactcatagatgggaattgaacaatgagaacacatggatacaggaaggggaacatcacactctggggactgttgtggggtggggggaagggggagggatagcattaggagatatacctaatgctaaatgacgagttaatgggtgcagcacaccagcatggcacatgtatacatatgtaactaacctgcacattgtgcacatgtaccctaaaacttaaagtataataataataataataaaaaaagaagggggttgggaaagtatagtacagatcaagtaagtgataggaatacaactcaaaaaagcccagtgaaaaatgaaatgaaggccaggcatggtgcctcatgcctgtaatcccaacattttgggaggccaaggtgagtgcactgctcgagtccagaagctcgagaccagcctaggcaacatagttagatcccgtcactaaaaaaaattaaaaaaaaaaaaaaatagtcgggtgtgttggtgtgcacctgtagtcccagctacttgggaggctgaggtgggtgggaggctcgcttgagcccaggaagtggaggctgcagtgagccgagatcatgctactgtactctagcctgggcaacagagtgagtgagactccgtttcaaataaataaataaataaatgaagaatcatgatgactagaggctggaggaaggggaaaatggagagttagtgtttaatgaatgggcacagagtttcagttttacaagaggaaaaagttctagagattgatagtgatgttgcatgacaatgtgaatgtatgtaatactattgaattatacacttaaaaattgttacaatggttagtggggaaaagtgaaatatcaaaaacaaacaaacaaacaaacaaaaaccaaacaaacagaagtcagccaatgctcctttctgtgagtatatacatgggcctacctgtgttcaatagcttggctctttggctctcgaaaacaaatccagcttacattggaagagaaaaccatttctagagtaacatgaaaactacaaccctcctttgcctacagtatcaaaatatttcacatgttttagttctgtgttgtgaatctcagtcacttgtacttcattttataggccttgaacaactccctggcttctccggagatggaattgatatcagggaatgaatgagagagagtataaggtcttttcagatgacatcgttcataaaaacccagaggcaagacagcttgacataaagacgctaatcacggcaaaaagtatataacttcagcatattcaaaatcaccatagtaattctaaagagtaacacagttttgatgtcagtccctaaaaatacaaatctcatatgtgctcatattctttctgtattttgtgtcacattcacataaatgcactcaacatttgtaaaagtttcaaaagtttggccaggtgtggtcgctcatgcctgtaatcccaggacttcaggaggccgaggccagcggatcacccaaggtcaggagttcaagaccagcctggctaacagggtgacactccgtctctactaaaaatacaaaaaaaaagaaattagctgggcatggtggctcactcttctaatcccagctactcagaaggctgagacaggagaatcacctgaacccaggaggcgaaggttgcagtgaggcaagatcactccagtgcactccagcctgggtgacagaccgagactctgtctcaaaacaaaaaaaagtttcaaaagtttgatcaaaatcaatcaagctagctcactacttatctacatgaaagtagagatattcatgttaagtgtttcacctcttgacaaacaaaggttttagcctagacttcctcaacagaggtttagtgagtgtgaaatgattatttagagaagttattctgggccacaattttaacaatgctctaacatctccatgttttttggaatgttactaatgtcttaaaagagtaactttaaattgatttaatttcatctgacttataaaacaatatgtaagccctatgctgtttctatttttaagagataatagattatataatgcaaacaattcaaccaagtagcacagaagaaattaattctctcttttaaaaaattattactagctaatgtttactaagttcttgggtttttttattttgttttgtttttgagacaaggcctcactctgtcacccaggctggaatgcagtggtcctatcacaactcactgcagccttgacctccccaggctcaggtgatcctcccacctcagcctcccgaatagctgggactataggcgcaccaccatgcctggctaatttttgtatttttgtaatttttttttttttgagacagagtattgctctgttgcccaggctagagtgcagtggcgcgatctcagctcactgcaacctccacctcctagattcaagagattctcctgtctcagactcctgagtagctgggactacaggcatgcaccaccacgcccggctcattttttttttttttttttttgtatttttagtagagacagggtttcaccatgttggctaggctggtctccaactcctgactgcaggtgatccacccgcctcggcctcccaaaattctgggattacaggcgtgagccaccgcacccggccaatttttgtattttttgtagcgatgggatttcgccatgttgcccagtcggatccaaaactcctgaactcaagcaatccacccgcctcagcctttgaaagtgctgggattacaggcatgagccaccaagcccggccagaagattcctaacctttctctaaaagcttaggaatcacagccttagaataaactaggtattcattttttttcccaattctacctttaccttctaacctctcctctttctaaacttttagttgtttcacgagtaaggttcataaacagccctggtaggatttctaactaggcaagactccagcatccttattgtagaaattaccaggtgatactaaaagttaagaatatgacatcagtcaacattgctcccgctctgtccggccaaagtggtggcatgaagatgatcaagacatctctggacctaccactttgggtaggcatggagggaaaggctggcgttttacaggtgccaaagatagcttcaggctttgggaatgccacttgtagaccaaggtggtggcagaatgtccagaaatcttcacagtgatgaacctatttacctgggggtaacagaaaggagggtcatttcctgcgtggaatcctcattctcataattcagatggaaatcatgtatttgcatgacatgtggatggaaatttgggactgacattcacagacagctgcagtctcttgatttaatactattacatttttgagttttgggctttgtgctgcaatttcgtgtgttgttatgacttagggagggaaaaagacaagggaggagaaactattttgcaagtaatgtagtcatgtctggtaaagaacatcaggtccattttagattgaaaaaatgctaggtcaacctacaggcacttctgagccctaattctagcccctgagacatagtcagtctcacctgtaaaatccgattaacaacatctgactcccttggtgttgagaaaagtcaatggctgccaagtgcttagatgttttacaagccttaatcttcctgtgaaacccattaaagttggagagattttacaaaggacaagaatgggaaagtaacaataaacgaacaactttgaacatcggcagatttgtagagcatatttaaaaggctttcagtaaataaagcatcttaattaagtcagctgctctaagcaggcaaagactcttggtttggttatagtttacattcccttgcttcctgaaggctactagctgaagtaatctaagctaaataacctacttcattggtgatcctgattgttttttagatgataggtgaggaaattctgactttaaagtgtcaggaaatttgcatatagaatcctggtacagcctttttatctactctactttcctaagcctccagagttaaacagtacttctttaaaagttaccatctaaatagtccatgcagagcatgtggctaccacagatgattttgtaagtcgcttagaacagagacctagaggttattccctatccagtagcctataatggtgcagtccagtcaaaatagaatgcaagccacaaaggtaaggcaagtgagtaatttttaaccaaccttccttatttacttctttcctccctccctccctctctctctctttctttctttctttttctttttgagatggagtcttgctctgtcgcccaggctggagtgcaagctctgcctcccgggttcacgccattctcctgcctcagtagctgggactacaggcgcccgccaccacgcccggctaatttctttttgtatttttagtagagacggggtttcaccatgttagccaggatggtcttgatctcctgacctcgtgatccgcccgcctcggcctcccaaagcgctgggattacaactgtgaaccaccgcgcccggccctttattttttttaagagacaatgtctcactctgtcgcccagcctggagtgcagtggcacaatcatagctcaccacagccttgaactcctggcctaagtgatcctcccacttcagcctcccaagtagctgggactacagatgcacaccaccaagctcattttaaagttttttgtagagatggggtcttgctatgtttcccaggctgatctcaaactactgggcttaaatgcttctcccaccctggctttccaaagtgctgagattacaggtgtgagccaccatgtctggcctaattttaaattttctagtagacaggttagaataaaaagcaggtgaaatgaataactttgttttataaccaaatatctccaagtattagcattttgacatgtactacatataaaaattattaatatgatagtttctattctctttgtactaagtcttcgacatctggtgtgtattttatccttacagcacatttcaatgcttcaataaccatggatgcctagtggctgccatattggatagcatagctctctataaatggtgccgtgaaggttggttgtgcagtgaggcacctgcacatctgtatacagtgagcctggactaatgcatcccattttgtacatataaacatgcatgtgtgtgtgcgcacgtgcgcacacacacacaaacacacacttgaggtaactatatacaaaggagaaaatctagcgcagaggttttgagaggtgacagtgtgctggcagtcctcagagccctcgctggctctcggcacctcccctgcctgggctcccactttggtggcatttgaggagcccttcagccccccactgcactgtgggagcccctttctgggctggccaaggctggagcccactccctcagcttgcagggaggtgtgcagggagaggcgtgagcgggaaccggggctgcgtgcggcgcttgcgagccagctggagttccaggtgggcgtggtcttggcgggcccgcacttcgagcagccggccagccctgctggccccgggccagtggctgcggagtgtgtactgggtcccccagcagtgccagcccaccggcgctgcgctcgatttctcaccgggccttagctgccttcccgcggggcagggctcgggacctgcagcccgccatgcctgagcctcccacccactccatgggctcctgtgcggcccgagcctccccaacaagcaccaccccctgctccacggtgcccagtcccatcgaccacccaagggctgaggaatgcgagcgcaaggtgcgggactggcaggcagcttcacctgcagccccggtgcgggatccactaggtgaagccagctgggctcctgagtctggtggggacgtggagagtctttatatctagctcagggattgtaaatacaccaatcagcaccctgtgtttagctctgtatctagctgctctgctggggctgtggagaacctttatgtctagctcagggattgtaaatacaccaatcggcactctgtatctagctcaaggtttgtaaacacaccaatcagcactctgtgtttagctcaaggtttgtgaatgcaccaatcaacactctgtatctagctgctctggtggggccttggagaacctgtgtgtccaaactctgtatctaactaatctgatggggacctggagaaactttgtatctagctcagggattgtaaatgcaccaatcagcgccctgacaaaacaggccactcggctctaccaatcagcaggatgtggctggggccagataagagaataaaagcaggctgccctagccagcactggcaacctgctcgggtccccttccacagtgtggaagctttgttctttcgctctttgcaataaatgttgctactgctcactctttgggtccacgatgcttttatgagctgtaacactcaccgcgaagatctgcagcttcactcttgagcccagcgagaccacgagcccacccggaggaacaaacaaatccagacgcgctgccttaagagctgtaacactcaccgcgaaggtctacagcttcactcctgagccagcgagaccacgaacccaccagaaggaaaaaactccgaacacatctgaacatcagaagggacagactccagacgcaccaccttaagagctgtaacactcactgcgagggtccgcggcttcattcttgaagtcagtgagaccaagaatccaccaattccggacacagtttcagactggcagctcagaagtgtttgaattaatcctgtcaaagtttgaattaattgtcagcagttaaatttcaggatatttcacataaaagtctgaatttctagctggaaaaaaccgtaaaatgtagtaaccccaggcccgtattcccatgtggcaacaaccttctggccctgagtagaggctgtccccctcaggtgggacacttccagttcactgccgttcctacttggtagactcactcttatattatctcagtttggaatctttgatcctacagagatacataccaagctatgaatatggttgatttctgcagagtgaaattgaggaggaggagactttcactttgaacaccatactttcctattttagaaatgtttttacagtaggcatgaactgcttttctaataacaattttaaaaaattgctgtttaaagcaactgctgtttagcaaagataaatccattaagaaagggccaagtatagtttgccaagtgaaatgaagaactgaagtaaaaatgtatcacatccaggaactggttattatctgaaatgaaataagccaggcacaaaaagacaaatatcgcatgtcctcacttatatgtgggagctaaaaaatgggatcacatggaggtaaagagtggaaaatagagaacagagactgggaggggtggggcaggggtaaagggaggatgaagagaagcgggttaaagggtaaaaacacacagtaagaaggaatacataaaatgtttgacagcacagtagggtgactatacttaacaaaaatgttttgtacttgggctgggcatggtggtttatgcctgtaatcacagcactttgggagactaagtctggaggactgcttgagcccaggagtttgagaccagcctgggcaacatactgaaatcttgactctataaaaaaacaaagaaacagaaaaccccaaaactgttttttactcgggtgacagacaccccaaataccctgacttgaccactacatattatatacatgtaacaaagttgtacatgtaataaatatacatgtaataaatttgtacaaataaaaaaatttatagccagcaaattaattcagtcttctcaaccttgtttcctttaatagcatatatatttttttattttttattttgttgtttttttgagatggagtcttactctgttgtccagactggagtgcagtggtgcaatcttggctcactgccacctctgcctcctaggttcaagtgattcttctgccccagcctcccaagtagctgagattacaggcatgtgccaccatgcccagctaatttttgtacttttagtagagatggagtttcaccatgttggccaggctggtcttgaactcctgacctcaggtgatccacctgcctcagcctcccaaagtgctgggattacaggtgtgagccactgtgtctagtcccataatagtatattttagatacccaaagtaaattactgttgcaacataaaaataaccataagaatgctaattgtaaaataatacccaaatttccactggattatcaagttttccttttgaaggccaggtccattcccttatgatgtttccttttctgctgatcaccaggcctccttcctaattaaacatcactgctactgtttgtctacaaaaaagacagaaattgacccatttagaacaagaaaaattcatgcactcattgatttggctgaggtgatggaagtcaccaagatacagcttttaagagcatgggaatctctcctgtcacattcctggaggatagtcactctctctgcctgaatatctttctggaaggaagcttgatacatacctgctcagctgattagtgtcccttctctgagacatgccttctccctccccttgcatctatagggtcataggaatggatcctgccagccacaattatcataccatgtgggcctgctaccttggctatggctgattgaatcaggggtggacatttaaccacagctgtgttccaaatggatacacccagatgtgtcaaaggacttaggagaggaggtgggcatagtgcattcaaaggactgaaaggaagacagcatgactagggtcaagagtggcgtaaattagatgggagtgattggcaggcagtggtcagatatgcaggaatccttggccatagcatgagttttatcttaagggcaaaaaaccaggctgggtgcaatggctcatgcctgtaatcccaacacttcaggaggcctaggtgggaagactgcgtgaagccaggagttcaggaccagcctgggcaacaaagcaagacctcgtctctatttcaataataataataatgataaaaagaaaaaagagcaaaaaataatagaagggttttaacaactaagcaaggaggctacatgatcaagtggattagggagggaccacagtacatgctgggagaccagttaagaggtcatgactagctgagtggtccagggaagatggcagcttggatgcgagtacaggtgagaaagacggagacccaggtatggattcaagaaccatctagggtttggatggatgggatttgggtggtgaatgagaggaatgtgttgatgttatctccactatactctcttggtctgtgaatgcagccaagcattttattagtttcagatcagtagcatcacactatgagtccttgtccaaatcatctttgggccttctgtcttttgggcagagcccctggcacagagaagaagcttaaagaaagtctgttgaatcatgttgacaaaatggattgttaagccaatatattttgaataattattagacgcaggacactgtttaggcattccagggatgccctgattgcagttctctctctacacttaggacattttctgtcttgaggtaataattattttgatagacaacatttattatagcgcctactaagctctgagtgttgtatgagagccttaactacaggcttttagtaggtagtgttgcttaatggttccaaaccctatacggccagactggtatgatattgaatctggttcgtctgtgtgctattgttgaaggctgagtgagggttgtgatcaactcagtataccactggaggctgtatgagtaaacagcaaactgttctcatgaaagcaggatgttggcaaactgacaaactgcgtctgctgcccagaaggaacgctgagggcagtcaagccccaagcacagtgtttcttgtgattaggcgcatctgaagcctgttaccaataatgtgaacctgtgatcaattaagcagctgaccagtcgttacccgctcctccctgctcttgctacccaataaatacgaagggctgtagaaactcagggtggctgctgcctttgctcactagaagcagggagcccttttcttcttcccctggccccttcctttaaaacagtttcttttgtcttaagttttcatttctacgttcgtcccccttcgttcggtctcgtaatgatggtctcaagtagtaacagtagtaactgtcgtagtgatggtctcaagtagtaaccatggcagtctgccacatcctatttttgtagatttggatttccctccattctcttctcttctttctttctctttctttctttctctttttttctttttctttctttctttctttctttctttctttctttctttctttctttctttctttctttctctctctctctctttctttttctttctttctctttctttccctccttccttcctccctcctttccttccttccttttttttttttttcttgatctgttgcccaagctggagtgcagtggcatgatcaagctaaggtgaccctcctgcctcagcctcctgagtatttgggactacaggggcatgccaccatgcttggctaattttgtttattttttacagagacgctctcactatgtttcccaggctggtcttgaactcctggggtcaagtgatcctcctgcctcaccctcccgaagtgctaggattagaggcatgaaccactatgctcggcctgacttggacatatttctcaacctttctgtggctcagtttccttgccttaaaagtgatgataacaatagcacctacctcatagggctgttgtgagagctaaatgagttaatacgtgtaaaacacttcagagccaggcaccttgtaagttctataaaaatgttggctttcatgattaagtcctcacaatcccatctataggtattatgagtcccatttcatagacgagaaaacagaggctgagagaggttagttaataaactacctgcagcctaatataaagtttgataggctcaccctctaccagaaggatgagaatagttcatagtataaaaggagcactttgggcttaaccaaggagcctgcaagctgggctggaggagcaaagcgacctagccagtggaaaaaaaaaaagagcagaaacagcagtgccaagtcttggccacctagagtacattcctttcttgaacagcctaccctttcactcaccctgagcggtctagccttcagctgttctcgttcctgccagaagcctcaggaaagaccttacccatccaccgtgcatttcggtaggagctttggctaaagcagctgtcttcctgtccacacggtgtttccctatccgctgaatcccagtaacaggggtctcactccacacccctcttttattcctcttcctaactgcatgggctgctgagccttctcaccaagaccccctttggtgggagggcagatgcccaaaaggaggattcttttaaaagatcgttaatagtgaaatactgaaatccctttaaaggcagctttctttttgttttgccttgtctctttcagagtcttcagttctgctgaaagtagacattactctctgccaagaaatgggctatgaggctcggataacattacacaggggcaggacttagcgttttggcttagtgttttggacttgtgtgaagttcccaaaataccatcagcagatggtgttgcatttatctgcttagatgctattatcaaagaagacagggggaggatgaggaaggcaaccaccccggaggggcgagtggagaaaattttttcatctcctgtttatttcacagatataattctcatcttgggcatttaattttatgtgtcaaataaagggaacaatttcccagtgcaaatttaactgttgggaaaagtctgatcagggcactgaacattctagcttctgcctagaaagtgaagatttgtgatgtatttttatttccattttaacgttgttgacttctaattctctaagactgtcaattagtcataaaggacatctcaggaatcatgttgctcaactcttgcatcaaccactacctattaattttttcatgtatagcttttatttttaatttagtattcctggaatgataattcttttaaatttcataaaattggagtgaacaagaaataccaagtgcaggtccaattttcttattaggtgaaagggaaataatgacacctactttaatcatgcaatacaagacagcaaattatatattaatttattgagctgtgtctctctttattttttaaatacatttatttatatttatttatttatttattttttgagacggagttttgctcttgttgcccaggctggagtgcaatggtgtgatctcggttcactgcaacctccacttcccaggttcaagtgactctcttgcctcagcctcccatatagctgggattacaggcatgcaccaccatggccagctaattttgtgtttttagtagagatggggtttcaccatgtcggccagggtggtctctaactcctgacctcaggtgatccgcccacttcggcctcccaaagttctgggattacacgtgtgaacaacagtagtttttaaaaatacctcccttttttatataatagctttactgaaatatagttctcacatcatactagtcaccatttaaagtatagagttcaatggtttctagaatatttacagagttgtgcaacaatcatgataatcaattttagaacattttttatcaccccaaaaagaaaccatgtgtccactagcagtgacccgcatcgctccctctccttggcctctgggcagccactgatctatttgctttctgtacagatttgcttaatctagatatttcgtgcaaatggaatcatacaatatgtggtcttttgtgactatgcttttacttagcacaatgcattcaagattaatctacgttgtaacatgtatcaatacttcattctgtgttatgaatgaaataatatttccttgtatggctataccacattttagttatcagttatttgtcagttgagtgctccttttgaggatgtgttaatggtactgtaatgaaattatcatagggcctcacaaatggtgactctgtttttagctcagacttcaggacaagaagtactttttttcattgggaatttaaaagagagagaaaagtaagcaaacatatgcatatatagatgtgggtatgtggatataaactcaccgtatttttaagactatataaaatacttttttttttttgagacagagtcccactctgtcacccaggctggagtacactggcatgatcttggctcactgcaacctctgcctccggggttcaagtgattctcctgcctcagccttccaagtagctgggattacaggcacaggccaccatgcctggctaatttttgtatttttagtagagatggggtttcgccatgttggccaggctggtcccgatctcctgacctcaagtgatccacccaccttggcctcccaaagtgctgggattacaggcgtgagccatagtgcctggcccaaaatactctttgccatggatatatttgcagaatggctaagaggttgagaggaagagaaaattttaatttccaggtaatactctgtagtttaattttttaccacatgcatgaattacttttattaaaatacatgtatacaaaaatcaatataccttcacccctgtgtcagagtgggctttctcactgagaagttataaacagtaaattctctggttagagaagcagaaagctgtaggagcccttagtcagagccagcatttgcaacaggtcagaggaacgttgaggatcacacaggaatcaattcgtaaggactcaactttaataaatgatacttaagtgaagatttagacccaattataaggatggtgccacaagaagaggcatctcagcagagtctgattctccagagttgagtgtggtaggacacagtttgcactgaactcaggcttcagtcctgccagggagatgttttcaccttcttagctggattaagggaggagaccacccctcatattgtcttatgcccaatttctgcctccaaagaaagaagaagtaaaaactaaaaggcagaaatgaaatccacaagcagacagcccagcgccacaccctgggcctggtagttaaagatccacccccgacctaatcagttatgttatctatagattccagacattgcatggaaaagcactgtgaaaatccctgtcctgttctgttccattctaattaccggtgcatgcagcccccagtcacgtaccccctgcttgctccattgatcacgaccctctcacgcagactcccttagagttgtgagcccttaaaagggacaggaattgctcggttgttggaggcgtgagtcttgccgaagctctcggctgaataaagtccttccttctttaactcggtgtctgaggggttttgtctgtagctcgtcctgctacagatgaaactgaacactgatctcagatgcttctgaacatccttggcagttcacttcatatcagtacctataatatggagtttatcactatagtttataggcttagatcttctcaaccaattctttacaatctctacactgtcccaagtgtcactacatattgacatctcaattagatggaccctgtgaaaggaaaatcttgaggcccccaaattactaagctgaagaataaagtgaagctgggaacttctcagggcaaaacctgcctcccattctattaagtcatccctctgctcactgagatagatgcatattctgattgcctcctttggaaaggcttatcaaaaaccccaaagaatgcaaccatttgtctctcacctacctgtgacctggaagccccctccctgcttcgagttgtccctgcctttctggatggaaccattgtacatcttacatatattgattgatgtctcatgtctccctaaaatgtataaaaccaagctgtgccctgaccaccttggggacatgttgtcaggacttcctgaggctgtgtcacaggcatgcatccttaaccttggcaaaataaatggtctaaattaactgagacctgtctcaaattttcagcgttcacattttggtaaccacaaagggattctgagtagagatgcccctgcctttgacaaatctcctatcggtgcctggtaccagcatgagctaactttatgtctcaaaccaataggacaatttgctgaggtctgagagcacgccctccagaaagtccctgatctcccaaaatttggtcgagatctaaagtttattttgctgtacaattcctgctttttttttttttttttggagttttacttgcttccaacacaaggaaggcaagtttttcctgcctccatgacgatgtaagacaaataactcctttatggaatttgagcgcgcatccaacagggaagatcagtttactttttcctgcttctaggttggtagagagcagtcctcagcctgagacccatccctaggtaagtaactgaattggtgtttgtcttggctaaagttaagattaacaaacagctggtcttaatttccccttaccattagcgcgctcagtgatgataaggttgggattttttgttgttgtttgttccagtctttctcccaatggatttgaccaactctacctgacttggtcaaatctgagtgagaattccaaattatgggttacatggcctctctaatttggctaaaattccttgcagctgcaaaaagcaaacaaacgaaaaaaacgtgtttggtttctgtgtttgcagcctgtcttaaaacaaacaaacaaacaaacaaacaaacaaaaaactcgtcctttcatctacttttcttccaccctatacctccttcccccttttgccatttgcagtaccaaaaaatctagagaaggcgtctaatgacttgaaccttgaaccccttttaaagaattcagaacaaaggtgctctcacccccttttagggtgttctgtcttctttgtggagtttcaagagtcatgggcagattctttttaggtctaaagctctgttttcctggattgcatgacctgacttttttggctttggggtaccagagatgactttgcactgtgagatgatttgcccttgacatgtacagtggcaaatgacagctgtgaagttacaggtggttgagcacagtttacaggaagtggtcttggctgtttatttttcttttctctcctaggaagctgttgtttaaggatcctaattctagttcagagatgcattctaaagggtcttctgtattgcttttacttgcaaatttaatcttaattcggtttgtgtgtgcatttgcatgaggaactgaactgttattttcttttcttttttcttttttttttttttttgagacggagtctcgctctgtctccaggctggagtgcagtggcgtgatctcggctcactgcaacctccacctcctgggttcaattctcctgcctcagcctcctgagtaactgggactacaggcgcgtgccaccacgcccagctaatttttgtctttttagtagagatggggtttcaccatgttggccagcatgttgttttcatacgttaatgagagactgagttttctcagcttcaaagagaaaaggcatttgctcctcctagttgaaagttgcccctgggtgaccaggggccttgtgggagtgtctgggggttgacccccctcaatgtgcagtggccctgcagggaaatcactcaaaaacaatttttttaaatggctcatccaagaaatgcatgtaagggctgatcacccaacgttttgagccttctctgaggtcatagacctctagagagagaaactaagacacataagagggtggaaacaactcagtggtaacacactgtggagtcctgttcacaagcggcacatattgatccaccacacaaaaccctaggccacagctcagttcctccttttaagaaaaaagaaagtgggaaacaaataatctaagaatgatgagaaagcaaggagaatgaccccctttggagcagtctgtggattttccgacacatctacctgccaaagattatgtaaaatggaaataatatggtctttatacacatttacttaaggaaaaagagccctaaggtcaatctgcaaactacagtgttcctaagtcctctttttctctattttttcttttctgcctactctaaatctgctgttatttttgtattaagataaataccactgtttagatccaacaagttctttttgcaagttggtgaatttgtgtttatctcatggctaaaagttctgaagtaaaagctataggatctttgtgtgtatgtatgtgtgtgtatgtgtgtgcatatatatttcaaaggcctttataattcctataatttgtttaattggcaattaaatccattttaatttcccgccagcacaccaaactttttctctctgcaccttataatgtaaaatttgctatttgactttcacctgagttgcttcctttaatatacaaatgtaaggctatttagctgacaactaccgagggttgtgaaacaagtcatcaagaatctgaaagtctaacataggaaaataaaaggtttttatgactctataagatgtatttccattggcatgcctagtatgtctatgtatttgtgttttgcatatacagtgtttcattcctaaaaatatataaaagagttctaattaatcagcttaaaaaataaaaacacaagccagatactaaaaaggaaaagactagtcaaatgctttttcaagttatgtaacaagtaaaattaataaataagctagctttaaaattattggtaaagtaatagttgaaatgtctcaagaattaccagaatacatttttgtttgcatttattaatcaagcaatttcatacttatccgggccaaatactataaggtgtcaaaatttgtcacagaggttacaaaactataagcccatctcaagacagaatgatctttgcttgtgtaatctttaataaataagacattgatattggtttaatgaaaatagctacatcttgaattatttagtataattaccgtaacttctaatcttgtggcttcaggcagtctagtccacatggagtaaggaggtctgttttgggaaaggattgttattgcctttgtttcaaagctcaactataaattaaatttctcccaaagtccaggaatgaacaaggacaccttggaggttagaagcaaatggagttagttaggtcatatctttttcactgtctcggttacagttttgcaacagtagttccataactttaaatgactattgcagttttcataaataatctaggtaaacaatatattaaaacaaaataattaggtaaatgtaataggatacttgcagacaaattcatcataatttagaatataaagttttattaaattaaataatagaaatttcattatttgggtattttccaataaaaatataattgtaggaaaacattctttctaaaaaaaagtgtttcctcttaaaaaagttgaacagtttttttctaattcaaagcttatttaaagatcatgtgtaaaacaaggtaaaaggaaccaggaaataaaagagatataaagacagttttttttttttttttttttttttttttttttttttgagacggagtctcgctctgtggcccaggcgggagtgcagtggcgcaatctcggctcactgcaagctctgcctccagggttcacgccattctcctgcctcagcctcccgagtagctgggactacaggcgcgtgccaccacacctggctaatttttgtatttttaggagagacagggtttcaccatgttggccaggctggtctcgaacgcctaacctcaggtgatccacccgccttggcctcccaaagtgctgggattataggcatgagccactgtgctcagccaaagacagttacaaaaataaagaggtattctttattggtaagaaagcttaaagagaaataattttatttgtggaagaatcttgtatggtaaatttagtcctaaaataaaataactagttgtttaagaaggagggatgttcaggacaaactagaaagtccaagcatgtcatgaatggttggtataagtcacaataagaggattaatattttttaaaaatccaaaaacttttaaatgatcaggttgtcatattaagttttggtttgcttaggaaaaaaaccgacatataaaaaatgtttttaactaaggttattacatccatatagcttcctgtatgtgcttttatatttcttgtgactgagttacagggctttgactccctcgcactacacagctcacattctagttgcaaaaactaaactcaataaatgaaaatttaatttcagattgtgaatagtgctaagaggaaatgaataaagtgatgggcaagagtaaaggaaagggcaggacagggcttcttaagatgatcggaaaatctcttttgagaaactatctggaagttgctcagaaggttaaaaatagagttatcatgtgacccagcaattccagtcttagaaatggaaatggaaacataaatccacacaaaaacttgtacaagaatgtagtagcattattcacagctgccaaaaagtagaaatacaaatgttcattaactgatggacagaaaaataatgtgcgatatatccatacaatgaaatattattcagccataagaagaaatgaagtactgatacatgctgcaacagggatataccttttttttgagacatggttttgctgtatcactcaggctggagtacagtggtacaatcatggctcactgtagccttgaactcctgggctcaagctctccttctgcctcagcctcccaagtagctgggatgacaggcgcatgccaccgtgcctggctttcttttttttttgtagagacagtgtctccctatgttgcccaggctggtcttgacctcctggggtcaagtgatcctcccgacttggcctcccaaaagtcctgggattacaggcatgagttcctatgcctgtgcccagcctggatgcacctcaaaagcattatgctaagtgaaagaagccagtcacaaaagactctatgttgtataattctatttgtatgaaatgttcagaagaaacaaatctctagaggcagaaggtaggttagtggctgcctaaggttggagataggatgggaaatgatgagtgactgctaattggtacaagttttctttttaggataatgaaaatgttctcaaattagatgatgatgatggctgccaaactctgtaaacatactaaaagctattgagttgtatgctttaaatgagtgaatttaatggaatgtaaattatgtttcaataagctgtttaaaatacaaagaaaaaaagaaaagttttctccaagaaggtgatatttaaactgggacctgaaagataagaagaaaccagtcatgcaaagagtggggacaagagctttcaggcacagggcacaatgtgtgcaatggtcataaagagagaaagaagggccaggtgtgctggctcatgcctgtaatcccagcattttgggaggccaagttgggaggatcacttgagatcagcagttcaagaccagcctggccaacatggcaaaaccctgtctctactaaaaatacaaaaattagccgggcatggtggcgtgcacctataatcccagctactcgggaggctgaggcaggagaatcacttgagctggggaggaagaggttgcagtgagccaagattttgccactgcactccagcatacgtgatagagtgagactccgtgccaaaaaaaaaaaaagagagagagagaaagaaggctcataaagaaggggcagatcgtagacaaggttggaaaggggccagagcaggcagcgtcttctgaaactttccaggtcaccacgttccatttagacacaaactataatcagacagtatcattcatatggaagtcaacatgaaatatgttaacagcaaaacccatggatgggacagcaagtgaaaagctgttaaccccaaattctacagctgcaaaacacctgactgtggagaaaagaggtatcatcaaattttaaaagggaaaatatttaaaacaacacttagcctataaccagggaagttcattaaattactcccaccattgtcataaagatcaatttctgtagccagctcataaagaattcacatctctagaaggttgttaatgtgttgggtcctatagaacaccaaacaggaacagaaatcaataaagcaatataaatacagacttcatagtatctgaactttgtgagtagctgtaggtgacagatctgagacctgagataaaaggaggagatcaatccaggttgcaccagcatgggatgtagaaagggatcagaggatgaaacagaattccaagtgagaatatatgaatatccaggaaagagaagataaccaatccttacaagttttcatcaacatccttgataaacacactaatactggcctggtcatccatcttatat

SEQ ID NO: 94 - DNA, 3402 bp, Homo sapiens
  source 1..3402: mol_type = genomic DNA
aatgctactccaacattttcagcactgtttgtatatacatgaactacctcttgcaggaaacacaataaattgataaaaaggccttaggtagcagaggaacaggggagaagagacatgatttttacatatatcctttttgggctttaaaattgtataccagctgtgcacagtggctcacgcctgtaatcccagcactttggaaggccaaggtaggaggactgcttgagcctaggagttttgagatcaacctgggcaacataaggagacccttgtctctacaaaataaaaaataaaacaaaaaacctagctaggcatgatggcatatacctgtggtcccagctacttgggaggctgaggtgggaggattgcttgagcccaggaggtcaaggctgcggtaagccatgatcgtaccactgcactccagcctgggtgacactgagatcctgtctcaaaaaaaagaaaagaaaaattaaaattaaaaaataaaatttgataccatgtagatataatgccaattcagaaagttttttttcaaaagctttttttttttgttttccactctgtcacctaggctggagtgcagtggtgttatcccagctcactgcaacctccacctcccgggttcaagcaattctcctgcctcagcctcccgagtagctgggagtacaggtgaatgccaccacaccctgctaatttttgtatttttggtagagtggggtttcaccatgttggtcaggctggtcttgaactcctaacttcaggtgatctgcctgccttggcctcccaaagtgctgggattacaggcgtgggccattgcccaggtcccaaagttcttttattagataaataacacggatttgctaggagtagtggctcataccatttgaggatgggagtttgagaccaacttggctaacgtggtgaaaccccttcggtgctaaaaatacaaaaaaattagctgggtgtggtggcacgcacctgtggtcccaagcaactcaggaagctgaggcacaaggattgcttgaacccgagaggtgaaggttgtagtgagctgagattgcaccatgcactccatgcacaccactctgtcgctgggcgacagcaagactttctcaaaaaataataataataaatgaaaaataaagcctgtgctaaatacaaatatgaaggttagagaaacctgtgtctttctaaagtgcagtttcttttcctcattattaggtacttaagactgaattggaggccgggcgtggtggctcaagcctgtaatcccagcactttgggaggctgaggcgggcggatcacaaggtcagaagttcaagaccagcctggccaacatagtgaaaccccgtctctactaaaaatacaaaaaattaagtgggtgtggtggtgtgtgcctgaaatcccagctactcaggaggctgaggcaggagaatcgtgtgaacctgggaggcagaggtcgcaatgagccaagattgcgccattgcactccagcctgggcgacagtgcgagacactgtctcaaaaaaaaaaaaaaaaaaagactgaattggaatagttggtaggggacagggacattggagctttgacaaacatctgacttgctatgattcttgttatttgctcctgggcttctctggctggttttagattactaagtaatgtgtgcacaaaacaatatgatagttagggtggctgagtagtgggctccctctaatattttattttcctttatagaacattgtggcaggaacaaaaggggaagctgtgactcttaaataattaaatacattaaaaaagggtaggagaatcaagggttggaagagaagattgcagtagatactcttggctttccttgccctatactaaaacacacctctcctagatatgcatattaactgcctcattcctctgttttgtaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtgtgagttgtgcttgggattagggaactagaatggtatcaaaatcccaaggcaaatgggaacagggctttggggccagatagatcttgattatagaaacccgactgtagctgagtaacactgggaagaatacctctctttcctataaaatggaaataacctccattggattatagttagggttcataatggtgagtatgatgacagtgttgtaaatagccaacacttatacagattgagtatcccttatccaaaatacttggggccagaagtggtttggcttttgaagtatttgcattatatatactggatgagcatctcaaatctgagaatctgaaatccaaaatgttccagtgagcattttctttgagagccatattgatgcccaaaaagtttcaaattttggatttttggattggtatgctcaacctgtatcttatttcccttaggcatttgcaaagtgctttatacgtattaactcatttaattctctcattatttgaaggtaggtaaatttgaaggtagaactgagatttgaattcagataatctgacctcgtgctttaaaccattctactgtaattcagaaaataagtataaaatgtttagcacagtgcctgtctcataattatggctcagtaatattgcttaataatacagttagaataataatggagccttttcacagggcagactttaatgttcaaagctaggagacccagagggtgaagagagctagttgaacatggtcatttttattccttcccggatgcctgtaaaccttgactatttgctaggcatggacttgagttgagggtggtaacatttctaatgtatcctgaatgttggttggtttttttttttcagttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtag

SEQ ID NO: 95 - DNA, 86985 bp, Homo sapiens
  source 1..86985: mol_type = genomic DNA
agtctgtaatgaatcagttgaattcagagacagagcagtctaaaaagtggcttaaaacgtgctcagatttgttacctgatcctcaagaggtaggaattaaagagggaaaaaaagcccctagtggcaaattgacttaaaaggctaagaacaattagccatttgtagccagcaggtgttaattaataaaactgtccagtactgcatttcagggaaggcatgaatgatgtgatgaactctacaaaaataaagtcagctatatgaaaaaaatctctacatctcaggctctagagagaaccaaatcagaatgaggactcgtttccttgtgtgggcacctggaggggatgaggctgtcctgggcccagaagactcatggcaccttccctgtaccattttgataagaaacagtgaactcttcattcatttcatattggaggaactctgagggctgcagcgttgccctggggggacagcacaagcaagaatgcatcagaaggctagtgccgcaggaatgacacaatctaggtgtctgctctgcacagtgctatgcttactgaattttttgactaataactcatattctacacaatacaaaaaccagactccttttatcttcccttcctgctcctcactctcctgcaaacatttaagacagtgaaggaagattcctcttctaggtgagggagaagtggggtgggatgtttggagagggtggtgatgaactaaaaaataaagaaacacttaggctagtcttcagaatcagtttctgagtttactgtatcaaaacactggagcacacacttagggttggcccaggacactcttcaataaaagtctctgaagataaggaggtagatgtaaaatagaaataatccattctataactctggaagttccaacttcctggaaaactcaatatggagtcatcagctgtctttgttatggaaactgaactctctctctctctctctctccctctcctgtttcacagctaaattaggagacacaaaagagctagaagccttcattgctgatcttgacaaaactttagcaagtaagtacatgtctgatattaaaaacaaaaaaacaaaaaactaacagacacttctgataaagtgttgtaatgttaaccagcttgccctggggcagaaagtttcatcctaagccttctataggtttagaaacaggaccctaggccggggcagtggctcacgcctgtaatcccagcactttggaaggctgaggtgggtggattacctgaggtcaggaattcaagtccagcctggccaacatggtgaaacccaatctctactaaaaaatacaaaaattagctgggcatggtggcgcacacctgtagtcccagcttcttgggaggctgaggtaggagaatcacttgaacccgggaggcagaggttgcagtgagccgagattgcgccactgtactccagcctggtgacagagcaagactccgtcaaaatagtaataataataataataataataataataataagaagaagaagaagaagaagaagaagaagaagaagaaacaggactctagtggctaggaatgaaattctgggataagcttgtgttaaagtagaccatgtgcgtttccaaacagtgagaacaggtcactagcaaacaatggcattttgtttgagaaatggagagcgagcaagactggagcattaccatcatgatggcctgtcaggcttttcagagaagaaatgaactgattaaccacaagtgcattattccaacaagccaaaagtcttccatcccatgggccagggtaattttcccaggttagatccagggtttgggtgaaatttaactttaagatgtgggtgccaaaagagagaattggcttgtggggcctttcaccagagacccatgccagtgactgaatgacctggattaggtatgcatacttgcaagcctcttatttgggaattacactaatggttacctgttttgtgtgaccaaaaatgttgagaactgaagacatcaaattataactgcagtataggggcccagaagaagggaccctcacaatctatctacacactctatttccaaaggataagattgcaagagccaggaggaccaactccagcttctgggatggaaggttcagcaactctactacggggggtcctgtttagtcacagagtgggctaggaaaattttgtcccagccccttaattttccagggtaagggttgattttctgtgagaagtatttaatgctattctttgctaaagagccgggtaaactctgaaaaattaaatccaaagctggttatttaaaaataactatgttcttaacactcttgcagacaaacctaaatatcagatagaaagtccttgtatcatttctatttgaaaattgaagattttattgcctcttttcttatgtactgcaccatcttacatcagaagaccagggcttgttttgacagggattattataattgcagcataatttgtattagacccatgtaacaagcctgtctacttcatggaaattgcagtgggttgcccagtcattccagttaatcagacactcatcgtgtgggaagcccagcattgagtttggtgctttgatgcacgtctgagacagtgtgatgtggttaagcataggaattgtgagcctctgagtggataaccttacctatctctcatttacaggtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcttccttttctttttctttattttttaaaatatatttccattcaaataatattctagtgggagtaacatgcctcttgtttccttagcaaggcccctgggtgctgtctgattgcactagacaagaggacagtaaacttaaagtgttcctttagctcattcagtgctctggaaggaaatgctggcagacggctgctgggaaattttaatttcaggattgtgatttcattggaagttaggtttctattctgtctctgccctccttctcatatcttggcaccattgcaggtggcatggactctttctttgaattaagggaagtaccagttcttacaatccaggacttaaatacgagggaaagttgagatagctggaagacttgaaaatgatggtgcttttctaagatctgtgtggaggaagattgatggtgctggttttcatggaatgtccagcaaacctctggtgtgaagagtttgacgggtgggctttgcacatagaagccactgaccacttctcccacttgcctttgtgggggctggagagaggcataaaaataagaaagctcataattttcgtatctatgcttttctgtctttaaaacctcctctaaaataaccaggcattactttcataatcagaataaagttattttaaaacttgaatccctatattcctaaaggacataaatccaaaacataactacttataattttacttgtatcttcaaaagctaactactatatttgatgtgttttttagggaatcgggaaactaaattgcttttctttaacttttttcttttcctcagcttccaggaaaacttttgggttgaactcaaatattttctttatttcttttttaaaaattgagatctaattcacatactacagcacccagttcagcggtttttagcatatccacaggtactgcagccatcaccactgtctatctacttctctgtctccacgaacgtgtctattctggatctttcatataacgaatatgtaatcttttgtgtctggcttctttcacttagcatagtattttcaaagttcatccatgagtagcatgaatcagtacttcatttcttttcacggccaaatcataatccactgtgtggatatgccacagttgtttatctgttcattggttggtgaagatttgggttgtttccactttttagctaacaaataatattgttatgaatacccatgtattagtttttgtgtggacatatgttttcatttctcttgggtgtataactaggagtggaattcctgggtcgtatgttaattctgtttaactttttgagaaactgtcaaacttttccaaagcagtttggaaaaaccattttacattcccactagcaatgtatgaggattccagtttctctaaatccttgccaacttgttattgtctgccttgtcattctagcaggtgggaagtggtatcacattgtggttttattttacatttcttttttttttttttttttgagatggaatcttgctctgtcgcccaggatgggtgctagtggcgggatctcggctcactgcaagctctgcctcccgggttcacgccattctcctgcttcagcctcccgagtagctggactacaggcgcccgccaccacgcccggctaattttttgtatttttagtagagacagagtttcaccatgttagccaggatggtctcaatctcctggcctcgtgagcggccctcctcggcctcccaaaatgctgagattacaggtgtgagccaccacgcccggcctattttgcatttctctgtgactaatgatgtcttttcatgtgcttactggccatttgtatatcttctttggagaaatgtctattcaaatccttggcccattttaaaattaggttgtctttttaactttttttaattttagtttttgtgggtacatagtaggtgtatgtatttatggggcacataaattgttttgatatgggcatgtaatgtgtgataatcacatcatggaaaatggggtgtccactccctcaagcatttatcctgtgtcacaatccaattataccattttagttatttttgaatgtacagttaaattattattgactatagtcaccctgtcatgctatcaaatactaggccttattcattcattccaactatactttgtgcccattaaccatgcctacccttcccagcctctggtaaccaaccttctactctataattccatgggtttaactgttgacttttggatcccacaaataagtgagaacatgcgatgtttgtctttctgtgccaggcttatttcacttaacataatgacctccagttcaatccatgttgttgcaaatgactaaatctcattcttacgactaaatagtactccagtttgcgtaagtaccatgttttcttcatccatgcatctgttgatggacacttaggttgcttccaaatcttggctattgtgaatagagctgcaacaaatatgggagtgcagatatctctttgatatactgatttccttttttgggggacatatacccagcagtgggattgctggatcatatggtaggctctatttttagttttctgtggaatctccaaactgctcttcatagtggctgtagtaatttacattcccaccaacagtgtacaaggattcccttttctctacatccttgccaacatctgtcattgcctgtcttttggataaaagccattttaactggggtgggatgatatctcattgtagttttgatttgcatttctctaatcaataacgtagagcaccttttcatatgtctgccatctgtttgtgttcttttgagaaatgtctattccaatcttttgcccatttttaaatcagattattagattttttttcctatagagttgttttagctctttatatattctgactattaatccattgtcagatgggtaatttgcaaatattttctcccattctgtgggttgtctcttcactttattgattgtttcatttgctgtgcagaagctttttaacttgatgttaccccatctagtccatttttgctttagtttcctgtgcttgtggggtattactcaagaaatctttgcccagactgatgtcttggagagcttctccaatgttttctttttgtagtttcatagtttgaggtcttagatttaagtgttaaatccattttgatttgatttttgtatatagtgagagaaggaggtctagtttctttctttgcatatggatatccagttttcccagcatcatttattgaagagactgtcctttccccagtgtatgttcttgccacctttgttaaaaatgagtttactgtaggcatgtggatttgtttctaggttctctgttctgttccattggtctatgtgtctgttgttatgccaggaccatgctgttttggttattatagctctgtagtataatttgaagtcaggtaatgtgattcctccagttttgtcctttttaaaatttttttttattatactttaaattctggggtacatgtgcagaacacgaagttttgttacataggtatacatgtgccacggtggtttgctgcacccatcaactcgtcacctacattatgtatttctcctaatgttatccttcccctaccctcccccaacccccaataggccccggtgtgtgatgttcccctccctatgtccatgtgttctcattgttcaactcccatttatgagtgagaacacgcggtgctcggttttctgttcttgtgatagtttgctgagaatgatggtttccagcttcatccatgtccctgcaaaggacatgaactcatccttttttatggctgcatagtattccatggtgtatatgtgccacattttctttatccagtctattattgatggacatttgggttggttccaagtctttgctattgtgaataaagctgcaataaacatacgtgtgcttgtgtctttatagtagaatgatttataatcctttgggtatatacccagtaatgggattgctgggtcaaatgatatttctagttctagatccttgaggaattgccacactgtcttccacaatggttgaactaatttacacacccaccaacagtgtaaaagtgttcctatttctccacatgctctccagcacctgttgtttactgactttttaatgattgccattctaactggtgagagatggtatctcattgtggttttgattgcatttctatcatgaccagtgatgatgagcattttttcatgtctgttggctacataaatgtcttcttttgagaagtgtctgtttatatcctttgcccaatttttgatggggttgtttttttcttgtaaatttgtttaagttctttgtagattctggatattagccctttgtcagatggatagattgcaaaacttttttcccattctataggttgcctgttcactctgatgatagtttcttttgctgtgcagaagccctttagtttaattagatcccatttgtctattttggcttttgttgccattgcttttggtgttttagacatgaagtctttgcccatgcttgtgtcctgaatggtattgtctaggttttcttctaggatttttatagtcctaggtcttatgtttaagtctttgatccatcttgatttttgtataaggggtaaggaaagagtccagttccagttttcagaatatggctagccagttttcccaacaacatttattaaataggaacattttccaaattgcttttttgtgtcaagtttgtcaaagatcagatggttgtagatgtgtggtgttatttctgaggactctgttctgttccattggtctatatatctgttttggtaccagtaccatgctgctttggttactgtagccttgtagtatagtttgaagccaggtagcatgatgcctccagctttgttcttcttgccaaggattgtcttgtctatgcaggcccttttttggttccatacgaagtttaaagtagttttttccaattctgtgaagaaagtcagtggtagcttgatggggatagcattaaatctataaattactttgggcagtatggccattttcatgatattgattcttcctatccatgagcatggaacgtttttccatttgtttgtgtcctctcttatttccttgagcagtggtttgtagttctccttgaagaggtccttcacatcccttgtaagttgtattcctaagtattttattctctttgtagcaattgtgaatgggagttcactcatgatttggctctgtttgtctattattggtggataggatggcttgtgatttttgcacattgattttgtatcctgagactttgctgaagttgcttatcagcttaaggagattttgggctgagatgatggggttttctaaatagacaatcatgtcatctgcaaacagagacaatttgacttcctctcttcctatttgaatacgctttatttctttctcttggctgattgccccagccagaacttccaatactatgttgaataagagtggtgcgagagggcgtccttgtcttgtgctggttttcaaagggaatgtttccagcttttgcccattcagtatgatattgactgtgggtttgccgtaaatagctctgactattttgagatatgttccatcgatacccagtttattgagagtttttagcatgaaggggtgttgaattttgtcgaaggtcttttctgcatctattgagataatcatgtggtttttgtcattggttctgtttatgtgatggattctgtttatcgttttgcatatgttgaaccagccttgcatcccaggtatgaagctgacttgatcgtggcggatatgctttttgatgtgctgctggatttgatttgccagtatctttttgaggattttcatatcgatgttcatcagggatattggcctgaaattttatttttttgtcgtgtctctgccaggttttggtatcaggatgatgctggcctcataaaatgagttagggaggattccctctttttctattgtttgaaatagtttcagaaggaatggtaccagctcctctttgtacctttggtagagttaggatgtgaatccatctggtcctggactttttttggttgataggctattaattactgcctcaatttcagaacttgttattagtttattcagacattagacttcttcctgatttagacttgggaagggtgtatgtgtccaggaatttatccatttcttctagattttctagtttatttgtatagaggtgtttatagtattctctcatggtagtttgtatttctgtgggatcggtggcgatatcccctgtataattttttattgcgtctatttgattcttctctctttgcttctttattagtctggctagtggtccattttgctgatcttttttaaaaaaacagctcctggattcattgatttttttgaagggctttttgtgtctctacccccttcagttctgctctgatcttagtcttctgctagattttgaatttgtttgctgttgcctctctagttcttttaattttgatgttagggtgtcaattttagatctttcctgctttctcgtgtgggcatttagtgctagaaatttccctctacacactgctttaaatgtgtcccagagattctcatacattgtgtcttcgttcttattggtttcaaagaacatctttatttctgctttcattttgttatttgcccagtagtcatttaggagtaggtcattcagtttccatgtagttgtgcagttttgagtgagtttcttaaacctgagttctagtttgattgtactgtggtccgagagactgtttgttatgatttccattcttttgcatttgctgaggagtgttttacttccaattatgtggtcaattttagaataagtgcgatgagctgctgagaagaatgtatattctgttgatttggggtgaagagttctgtagatgtctgttaggtctgcttattccagagctgagttaaagcctggaatattcttgttaattttctgtctcgttgatctgcctaatattgacagtgggatgttaaagtctcccactattatgtgtgggagtcaaagtctgggagtcttaagtctctttgtaggtctctaagaacttgctttatgaatctgagtgctcttgtattgggtgcatatatatttaggatagttagctcttcttgctgcattgatccccttaccattatgtaataccctttgttgtctcttttgatatttgttggtttacagtttgttttatccgagattaggattgcaactcctgcttttttttgccttccatttgcttggtaaatattcttccatcctttattttgagcctatgtgtgtctttgcatgtgagatgggtctcctgaatacagcacacccaatttgccagtctgggtcttttaattgggcatttagcccatttacatttaaggttactattgttatgtgtgaatttgatcctgtcattatgatgctggctggttgttttgcccattagttggtgcagtttcttcatagtgttgatgttctttacaatttggtatgtttttgcagtggttggtaccagttgttcctttccatgtttagtgcttccttcaggagcttttgtaaggcaggcctggtggtgacaaaatctcttagcatttgcttaactgtataggattttatttctccttcacttatgaagcttagtttggctggatatgaaattctgggttgaaaattcttttctttaagaatgttgaatattggccccattctcttctggcttgtagggtttctgcagagagatctactgttagtctgatgggcttccctttgtgggtaacccgacctttctttgtggctgcccttaacattttttccttcatttcaaccttggtgaagctgatgattatgtgtcttggggttgctcttctcgaggagtatctttgtgatgttctttgtgtttcctgaatttgaatgttggcctgtcttcctaggtgggggaagttctcctggataatatcctgaagagtgttttctaacttggttccgttctcctcggcactttcaggtacaccaatcaaacatagatttggtcttttcacatagtcccatatttcttgaaggatttgttcattccttttcactcttttttctctaatcttgttttctctctttatttccttaagctgatcttcaatcactgataccctttcttctgcttgatcgatttggctatggatacttgtgtatccttcacgaagttttcgtgctgtattgttcagctccatcaggtcatttatattcttctctacactagttattctagttagcaattcatctaacctgttttcaaggttcttagcttccttgcattgggttagaacatgctcctttaggtcagaggagtttattattacccaccttctgaagcttacttctgtcaattagtcaaactcattctctgtccagttttgttcccttgctggtgaggagttgtgatcctttggaagagaagaggcattctggtttttggaattttcagcctttttgcactggtttctccccatctttgtggatttatctacctttggtctttgatgctggtgaccttcggatggggtctttgagtggatgtgctattcctttctgttagttttccttctgacagtcaggcccctctgctgctggtctgctggagtttgctggaggtccacttgcgaccctatttgtctgggtatcaccagcagaggttgcagaacagcaaagattgctttctgatatttcctctggaagcttcatcccagaggggcacctgccagatgccagccagagctctcctgtatgaggtgtctgttggcccctactgggaggtgtctctcagtcaggatacatggggtcagggatctgcttgaggaggcagtctgacccttagcagagcccgatcactgtgctgggtggtccactgctctcttcagagacatcaggcagggacatttaagtctgctgaagctgtgcccaaagctgcccctttccccaggtgctctgtcctaggaagatgggggttttatttataagtgcctgactggggctgctgcctttttttcagtgatgtcctgcccagagaagggaaatctggcagtctggcctcagcagccttgctgagctgcagtgggctctgcccagttcgaatttcccagtggctttgtttacactgtgagtgtaaaaccacctactcaagcctcagcaatggtggatgtccctccccactccaagctcgagcatcctgggtccatctcagactgctgctgtgctggcagtgagaatttcaagccagtggatcttagtttgctgggctctatgggggtgggacccaccgagccagaccccttggctccctggcttcagcacccctttccaggggagtgaacggttctgtctcgctggcattccaggcaccattggggtatggaaaacaagaactcctgcagctagtttggtgtctgaccaaatggctgcccagttttgtgcttgaaacccagggtcctggtggggtaggcaccggagggaatctcctggtctgtgggttgtgaaaaccgtgggacaagcaggagcagactcagtccctcacggcttcccttgggtgggggagaaaattccccaaccccttgcacttcctgggtgtgatgacgccccaccctgcttcagctcgctctctgtgggctgcacccactgtccaaccagtaccaatgagatgaaccgggtacctcagttggaaatgcagaattcacccgcctgcatcgatctcgctgggagctgcagaccggagctgttcctattcggtcatcttgccagcgctattcccagttttgttcattttgctcaggatagctttgactgttctgggtctttggtggttccaaagaaattttaagattatttttctatttctgtaaagagtatcattggtattttgatagcgattgcattgaatctgtagattgctttgggtagtacagacattttaacaatattgattctttcaatctatgaacatggaatatttttccatttttttggtgtcctcttcaatttctttcattggtgattatagtttttgttatacagttctttcactttggttaatccctgggtatttaattttatttgtggctattacaaacaggattacttttttatttctttttcagattgttccctattggcatatagaaatgctactgatttttatatgttgattttgtatcctgcaactttactgaatttgtttatcagttataatagttttttggtggagtctttaggtttttcaaatataagatatcatctgcaaacaaggataacttgacttcttcctttccaattggatgctgtttctgtctttctcttgttgctctagctagaacttccagtactatgatgaataacactggtgaaagtgggcatttttgtcatgttccagatcttaggggaaaggctttcagtttttcctcagttagtatgatattagctgtgggtctgtcatatatggcttttattatgttgaggtatgtaccttttatacccaggtttttgagggtttttatcatgaagggctgttgattttatcaaatgacttttcaacatcaaatgaaatgatcttatggtttttgtcctttgatctgtgatataatgtactacattgattgatttatgtatattgaaccattcttgcatccctgggataaatccatttggttatgatgaatgatctttcttttttaaattattattatacttcaagttctggggtacatgtgcagaatgtgcagatttgttacatagatatatgcatgccatggtggtttgctgcgcccatcaaccctcatctacattaggtatttctcctaatgttatccctcctctaacccccaaccccaacaggccccagtgtgtgacgtccccctccctgtgtccatatcttctcatttttcaactcccacttatgagtgagaacatgcagtgtttgattttctgttcttgtgttaggttgctgagaatgatggtttccagcttcatccatgtccctgcaaaggacatgaactcatccttttttatggctgcatagtattccagagagtatatgtgccacgttttctttatccagtctattattgatggacatttgggttggtaccaagtctttgctattgtgaacagtgctgcagtaaatatacgtgtgcttgtgtctttatagtagaatgatttataatcaaactgaatccagcagcacatcaataagcttatccaccatggtcaagttggcttcatacctggaatgcaaggctggttcaacatatgcaaatcaataaatgtaatccattacataaacagaaccaatgtcaaaaaccacatgattatctcaatagttgcagaaaaggccttcgataaaattcatcaccccttcatgctaaaaactctcaataaactaggtattgatgaaatgtatctcaaaataataagagctatttatgacaaacccacagtcaatatcatactgaatgggcaaaagctggaaacattccctttgaaaaccagcacaagacaaggacgccgtctctcaccactcctattgaacatagtattggaagttctggccggggcaatcaggcaagggaaagaaataaagcgtattcaaataggaagagaggaagtcaaattgtctctgtttgcagatgacatgattatatatttagaaaaccccatcatctcagcccaaaatctccttaagctgataagcaacttcagcaaagtctcaggatacaaaatcaatgtgcaaaaatcacaagccatcctatccaccaataatagacaaacagagagccaaatcaggaatgaactcccattcacaattgctacaaagagaataaaatacctaggaatacaacttacaagagatgtgataaatgatctttctaatgtattgttgaattcagtttgctagtattttgttgagggtttttgcatcaattttcatcagagatattggtagttttcttttttgtttatgtgtctttgtctggttttggcatcagggtcatactggcctcatagaatgagtttggaagagttccctcctcctctatttttcagaatagtttgagtaggattggtattagatcttcttaaaatggttggtagagttcagcagtgaagccattgggtcctggtcttttctttactgagagacttttttattatagctttgatatggttacttgttattggtctgtttgcattttggatttcttcatggttcaatctttgtaggctgtatatgtctaggaatttgtccatttcttctatattttccaatttattggtatgtatttgctcatagtagccactaatgatcctttgaatttctgcaatatcagttgtaatgtctcctttttcattctctgattttatttatttggatcttctctcttttttaattagttactctagctgaaggtgtattttgtttaacttttcaaaaaaccaacttttcatttcattgatcttttgtattgctttcttcatttcaattttatttatttctcctctggtctttattatttcttttcttctactaattttgggtttgggttgttcttgctttttttgttctttaagatgcactgtggatgggtgcggtggctcacacctgtaatcccagcactttgggaggccgaggtgggtggatcacctgaagtcaggagttggagaccagcctgtccaacatggcgacactctatctctactaaaaatacaaaaaattagcagggtgtggtggagggtgcctgtaatcccagctacttgggaggctgaggcaggagaaacgcttgaacccgggaggcggaggttgcagtgagctgagatcgtgccattgcactccagcctgggcaacaagagcaaaactccgtctcaaaaaaaaaaaaaaagaaaaaaagatgcattgttagattacttttttggtttttcctctttttcgatgtaggcacttacagctataaaattccttcttagtactgcttttgctgtatcccataggttttggtatgttatgtttccattatcatttgtttcaagaaaattttcaatttccttcttaatttcttcattaacccactggtcattcaggacatattgtttaatttccatgtatttgtgtagttttcaaaattctcttgttattgatttctagttttattctattgtggtcagagaagatggttgatgttatttcaattttttaaatgttttaagacttgttttgtgacctaacatatggcctgtccttgagaatgatccatgtgctgaggaaaagaatgtgtattctgtagccattggatgaaatgttctgtaactatctattagatccatttcttgtatagtgcagattaagtccaatgtttctttattaattttctatctgcaagatctgtccaatgctgaaagtgggggtgttgaagtctccagctattattgtattgaagtctatctctctcttcagctttaataatttttgccttatatatctgggtgctccagtgttgggtgcatatatatttaaaattggtatatcttcttgctgaattgacccctttatcattatattgtggcattctttgtctctttttatagtttttgtcttgaaatcaatttgactgatattagtatagctactccttctggtttttttttgttttggtttccatgggcatggaatatctttttccatccctttattttcagtctatgtgtgtctttatatgtgaagtgtgtttcttgcaggcaacagataaatggctcttggtttttcatccattcaaccagtctatgtcttttgattggagagtttagttcatttacaatcaaggttactattttgttttttttttgaggcagagttttgctcttgtcacccaggctggaatgcaatggtgtgatcttggctcactgcaacctccacctcctgtgttcaagtgattctccagcctcagcctcctaagtagctgggattacaggcacccactaccacagctggctacttttttttctatttttagtagagatgggttttcaccatgttagccaggctggtctcgaactcctgatctcaggtgatccacccgccttggcctcccaaaatgctgggattacaggtgtgagccaccacacctggccaacaatcagtgttactactgataagtgaggacttctgccattttgtcagttgttttctgattgttctgtggccttcctctctgtcctttctttcctacctgtcttcattttagtgaaggtaattttctctggtgatgtgatttagtttcttgctttttatattttgtgcttatgttgtatggattttagtttgaggttaccttgaggcttgcaaacactatcttataacccattattttaagtggataacaacttaaaactgtttgcataagcaaacaagcaagcaaaaagaaaactaacaaagatgctatgccttaaatttgtccctccacttttaaacttcgttgttgctgtttatatcttattgtattatctatgtcttgaaaagttgtcgtaattattatttttgattggttcattgtttagtctttctacttaagagtagcttacacatcatagttacagtgttataataatctgtgtttttctgtgtacttactattaccagtgagttttgtaccttcggatgattccttattgctcattaatgtccttttatttctgattgaagtcctccctttagcatttcttgtaggacatttctggggttgatgaaatccctcagcttttgtttgtctgggaaagtcttttatttccctttcaggtttgaaggataattttgctggatatactattctagggtaaaagttttttccttcagcattttaaatacatcattgcactctctcctggtctataaagtttccactgaaaaatctgctgccagacatgttggaactccattgtgtgttatttttttcttttcttttgctgcttttggcatcctttctttatccttgacctttgggagtttgattgttaaatgccttgagatagtcttctttgggttatatctgtttggtgctctataaccttcttgtacttggatattgatatctttctctaggtgttggaaattctctgttattatcattttgaatagactttcttctcctctttctatctcctctttaaggccaatacctcttagatttgctctttagaggctattttctagatcctgtaggcatgcttcattctttttcattcttttttattttgtctcctctgactgcattttcaaatagcttgtttcattcttttttattctgtctcctctgactgtacattttcaaatagcctgtcttcaagttcactagctcttttttctgcttgatcagttctgctactaaaagactctgatgcattattcagtatgccagttgcatttttcaactccagaatttctgcttgattctttttaattatttcaatctcttgttaaatttatctgatagagttctgaattccttctctgtgtcatcttgaatttctttgagtttgctcaaaacagctattatgaattctctgtctgaaaggtcacatatctctgtttctccaggattggtccccagtgccttatttggttcatttggtgaggtcatgttttcctagattgtattaatagttgtagaagttcgtctgtttctgggcattgaagaggtaggtatttattgtagtctttatggtctgggcctgtttgtacctatcctttttggcaaggttttccagatattcaaaaggacttgagtgttataatctaagctgtatctgctttagggaagaccccaagcccagtaatgtggtggttcttccagactcatagaagtaccaccttgatagtctcggacaagatctggaagaattatctgggtttccaggcagagactcttgttctcttctcttattgtttcccaaacaaatgggtgctctctctctctctctctctctttgttctgagccacctggagctaggagtggagtgacacaagcacccttgtggccaccaaccctaggactgctctgggtcagacctgaagctagcacagcactgggtcttgtctgaggcctgctgtaaccactccctttctactgcctatgttagttcaaagcctgggggttttacaatcagcaggtggcaaagccagccaggcctgtgtccttcccttcagggcagcaaattcccccaggcattgggtgggtccagaggtaccttcttggagtcagagactagaggcaaaaaccttagaagtctgcctggtgttctattttcctgtcactcagctggcgctcacaccataagacacagtccttcccactcttccctctccattccagaggtagaggagcctcactccatgaccactgtcacctcaggcccacatggagtactgccagactaccactgatgttcccttaaggttcaaggccacctgagtcagctcgtggtgaatgctgcctggcctgggactcacctttcagaggagtggaccctctacacaggtctagaaatgccatccaacagccaagtcctggaatagggaaccccaagagaatacttggttctctaccccactgtggctgagctgatatctaagttgcaagacaaagttccctttactttttgctccactgtctcaagcaggagtcttgccccatagccaccagagctgggaaagtgctgagtctcacctgaatccagcaagactcagtgtctcacccaagaccctcaacctagtacctgggtattgctgctggtattcaggacctaagggctctttagttagcaggtgatgaatcttgctaggactgggtcttttccttcaaggctgcagattctcttctgggccaaggtgtggctagaaatgtccaggggctagggcctggaatgggggccccatgactctcaccagtgccctatcctgctgtggctgagctggtatccaagatgaaagacaaagtcctcctaactcttccatctcctctcctgaagcaaaaggaaggggtcacttttggagccatgagctatgcaacccggggtgggtggggggtgatgccagcactcccttagacaccccaactggtgtctcagtaggtcacgtgcttcccctagtccactgtttctgggcccagttcatcccaggaattgcctaggtgttacaatccttgtggcctagactgcctttcaagtgtatctggggctccagagtactttagtccaaggtgatgaggcttgcgggaactgaagttcgtactgctgggatcagagattcccctctgtctagggtttaaatgtttcctctgtgggcatgtgtcagcttagtttggtctggttttgctttctcttataacaagggtagcactgaattcaatgcctcacaattgctggtttcagtgcctctctcagagatatgaagttaaaaccaggtactgtgagaattcacttgatttttgggtcttacaaaggtgcttttaaattgttaatagttgcttttaaagcaaaggaaaggtgcttttaaattgtttaattgttgttaaattggtgtccttgtgggaggtgatgatctgtggagctttctattccatcttgctccacctctccctaggttgtcttctttctgtttagttgtaggagctttcttttctttttttcttttgagatggtgtcactctgtcacccaggttggagtgcagtagtgccatcacggctcactgcagcctcaaactcctaggctcaagtgatcctcccacctcagcctaatgagtagctggaattacaggtgcatgccaccacacccgcctaatttttgtatttttttgtagagatgaaattttgccgtgttgcccaggctggtctctaactcctggatgcaagcaatccacttgcctcagcctcccaaagtgctagtattacaggcatgagccactgttcctggctaagtcgtaggagtttacaatgtattctggatacaagttccttaccagatatagaatttgcaaatattttcttgtattttgttggttttcatcacttttttgttctttgaaagataaaagttttaaattttgatgaagactaatttattttttattttgttgcttgtgcttttggtatcatacctaagaaaccattacctgatccaaggtcacaaagagttacttctatgtttttttttttttttgagacagagtctccctctgtcgcccaggctggagtgcagtggcacaaactcggctcactgcaagctccgcctcccgggttcacgccagtctccggtctcagcctcccaagtagctggtactacaggcgcctgccacaacgcccagctaatttttgtatttttagtagagatggggtttcaccacgttagccaggatggtctcgatctcctgaccttgtgatccacccgcctcggcctcccaaagtgctgggattacaggcgtgagccaccgcgcctggccactcctatattttatgagttttatagttttagcttttatattaggtcattgatgcactttgtgttaatttttatatatggtgtgagatgaggtctaacttggttcttttgcgtgtgaatatccagttatcatagaactatttgttaaaaagacaattttccccactgaactgtattggtacctttgttgaaaatcaatagactattcataggtttatttatggattcttaattctattctattgatccacatgtctatccttattccaataccacagtcttgatttccatagttttatagcaaggttgaaattggaagtgtgagtctttcaactttattcttcttttgccagattattttgactgttctgggtccctgcatttccatatacattttacttaacttatttattttatttgattttcgtagagatgggggtcttgctttgttgcccaggctggtctcaaactcctggccttgagcgagcctcccaccttggcctcccgaagtgttgggattaaaggcatgagctgccacacctggcctccatattaatttcagtatcagtttattaatttatgcaaaaaaggtagataggatttttcacagagattgcattgaatttatagatcagttttgtgagtattgccatcttaacaatattaagtcttccttgcaattcatgagcaagaaatttatttaggtctttaaattaattttggtctttaatttttttcaactatgttttgtagttttcacagtataatttttgcatacttttggttaaattcattccttttttgatgctattttaaatggaagagttttcttaactttattttcagatttttcattgctagcatagaaataccatttatttttgtatactgatgttgtattctgtacccttgctgtacatatttattaattcgatattaattctaataagttttttttttgcgagggtggatgtgtggattctatacacatcatattatttgtgaataggaataattttacttcttcttttacagtctgaatgccttttatttcttcctcttcccttcttaacctagttagaacttccagtacagtattaaaaagaagtggtgaggtgacacatcctcattctgttcctgatcttagaggaaaaactttcagactttcaccatcaaatatgttagttgtgggaatattttctttgttagccaaataagctcttgacttgttttcaaaacttaatttttccattacctggatctggttcttattcatgcttgggaacctgtatctgctttgggcaatttttttttcatcatggcaccagcagctgttcattttcactgtaacttttattattagtctcttctggaatggaagatctaactgtgtttggctgctgtttcttcacgagctcctgggatctggactccccaagtcagaagtgtaaggtgtgaagctttgtggcttgttgtgaagagaaagtcagtggttttgggaaaagaaatggatctctttacataagtgtgtgtgtgtgagagagagagagagagagagagagtgtgtgtgtgtgtgtgtgtgtgtgtgtgtgtgtgtgtgtgtggagtgggggagggggcgcgggtagtttgtactccataagcttcttttggataatgacttaagggcaaatgggctgtggactcagtcacagtttggagttctgggaatgttgaaaaaagtattttcagagtttcccaagatatgtttcaaggagaacagtcctaactcgttttgcaaaaattgctgttaaggtcatatgtgcttgagaaatgctgcatgctataggctccacttggagattcattatgcatattagtgcttatattacttaggggccagtctaagttctggatcaaagaccccaagatacagtggctcaaacaagatggaagtttctttctaacaatccagagatgattagtacaaggctgagtaggtggctttctggtccaaagtggctgctcctgctcttgtcatcacatttacatcccagccagcagaaaggagaaatggcaagtcaaacataggcttatttctttaaacaacatgactagaagagacacctcacttctgctcacatccccttattcagatcttacatcctcattcccagctgaaagggaggccaggaaaaagcatctagctggcatatatgtgttcagctaaaatttaagagttttattattaaagaaagaggaagagaatgactattggagaacaactagttatctctgccacagcatattgaaggctttgagaaatcctgcagctaagagatttggtctgtttttggtttttgttttgtttgttgatgaaaaagctaccaataatccagagtcattagtgttccttggaacatgccttgggaaatgcttttataggtaacctcaagtcagcggggtctattgcactccccttcctccaagatctgagtgctgagaccatggccttgcaaactgcctgattattatttggagagtgtcagctagtgggcttttctggaacagaacgagactggatattgtatatgggaagctggtagaatattgtgcatgcaaagctggtatgtttttgagtttggaaattctctgttctaatttcagggaggaacagttagagcaaaacaaaatgacaaatactgcacacacccaagagtaagaggctctagtgccagcccaaatatttatacaccagccagcctccagaatgggacagaagaaccaatgaataccttttccctgggggatcatgacagaggtaggctacattgcatgttccacatgtgagaggcatgtctgaaatgaggagcagtagaagggcggccattggcaattagtcaaggttgggaatcctgaggaggcttctccatgggaacatccccctgggtctgggctgaggaaaggaggagaaagtatgagctttcaggctagacagggttcaaatcccagctctgccttgtagtagctgggtgaccttgagcaagctctttaacctctcagaggctctgtttcctcatttgtaaagtgtaggtgtgagtcactgtctcctagggtcattgcaatgatcaaatatagaaaagaaaaagtgtctggcactcctcctcctccttttcataccacaaggacattgggctcctgtacccaaggtaaaattaagctttgcctacagtggctgcagagggcagttctagccccattattccttgtctgatagaagaaagtggcaaatctggcctaatgcaatcacagcgaggaaggcagagaaaaaacactgggcaaaggggcaggagagagggtgaaagccccagtcctgctgtgaactggatcccttcccctctctgggcctcagattcctccaagttaatcggactaaatggcctggggtctgttcagttcatacagttggtgggctctggccttatcctcagactgccagctcttctctgaaaaatagatggaatttttcttgaattttcagtatgtgcaagaagcacgtacttctccaaaatgccttcctgtgttaatttatttgactaagaaggtttgcagtgacagacaccaaacaggaaacggctgtcatagctgctgtctgcaagttttgtttttttttaaggctttctcctgcacaactcaccttctcttcatggcttggtatcaagtgctggggtgaatggaagggaaagggaaagggaaacacatttttagaagggaacattttccttcaagttcagggtctactgaaggttaaggagtatgactatccacaatggcagcgttaggtggctccattgcagggcctttgcacactcagttccctctgcctggaatgtccactctgctcggtttttctagttaattctacttctttaggatcagctcaagcatcactttctcagagtcttccagatccgtctagattgtttgttggtgctgtgttcttgtagaaccttccttcagtgcactcatcttggtttgcaatggcatgttcagtagtgtgatgttttggttaatgtctccctaccctcctgtaactggaccataagccccacaaagacaggagccttgtggcttgccaccacatctctggcagcgagcatggtgcctggtacatagtaagcactcagtccatgtccattgaatgaatgagaaaactcccaccccttccacagcccaggtaggctggccacgacacagtgtctgtgggatacatcttggccttgtcccctcgcctggtcagcctcgtcatgcaggccttttttgctttccattctccaggactttgtttccactctaccaaagcatctgataaattaatccagagccaacactggtgccggaggcccatgacagccccttccgcagctacttataactaacttggggagcaggggcctctgaagactgcgagaactttgaggccaaaaggaatgagtatctaatggtggaacttcaggtaccccaaatggcagtagaggaaaaggctaaccctgatcttaacactgtatcaataccttttcttggaactcaaagactctaagtcagccccgtcttccaagccgcattgagggcattgtgctagcacactgtgggcacatgcatgtgtgtgtgtgtctgtgtgtgcacacgtgtgcctgtgtgtgtgtgtgtgtgatgaattagagggaacagaagacaaagacattggtcttgattggcagacctataggagaaggcagggcccccagatgatctcgtgttgaacaactcaccagactgtcctgctggcaacagcacgacggcctctggaagctcgcccttgcttgtcgacattacagaacaggattatgttcctaactggggtttcatgcagcacatgggaagggcccattcccttgggctcctgggaggtgtgtgacctgctgtcttaggcccagagccaaagcctgttctggaaccagaagagtcagggcttggctgtggcttcggagccaaaggaagcccccacccagccaagatcaggtctgggaggggcaggaccagaatgtgacccttcccttgagggtatcttgaaggtgaggcctggagctacaggaaggaggccctgagagccctaggtggggaagggcgcagcagaattacccactgtcagaggggattctgagggagggcctcctgcttcttaggaaagcacgagtgtagagtaagttcctgggataacttgggcagtagagaggaatttgggaaacaggatgggttttttgggagttttctgggaggtaagtagacttgaaggaaagcaaacttaaagcagaatggagttcaggatcctggaaggtaagttggcagcacatcttccaaagatgagagctgttggtgtctgataccaatgctgcctccaatgggctgatccaaaaaagctcactctagttaagctgcctcatttcagagacaagaaaactgaggctggggccaaaggattaagtgatgaaacattgcatctctcaaacaaaaacgtttcaggaaggtgaaatcagagatgtgaatgtgccatggggaaaatagctccacaaacccaaaatataatctgccaccataatctcaaggggacctaggaccgattgagagattagttgtgtccagaaggctgttcccttaccaagcacgtgtgcacagataagagaggttatataagatgggaggccagggagccaggagcatgcagacaagaaaaacattagtgcagggaggtcaccttgatccgaggaagcccattgtgctaagattagagctggccctcacagaggttacaaaacaaatcagggtcacggccctgtgggccctaaggcacacgggaaaacaaaatctggaacctttaaacactttaaaatctggattgagaaagtgaagagattgctcctctctggcaggctgctcactggaggtttttcaagctgagccagactgcacacaattgttagtaatttgtgatcctgagataccaaattagttaattttcctgcatgtgaattttccttttttaatcccacctcatctttaggtccagaattcagctcctgctgtattaaatcctgtttttaaaggcaaactgtttttttctcctggaaaaaaaaaagagatagatgcattaacatgatctgaaaggccagattagcattttctcctgataattaagattccgcactagacaatcactaccttatttctcctaagatgatagacacctggcttatgtttcttccctcggagattagacacttgttttctgagtctcttactggctgcacaatccaagagagacatggaaaatgtggagatagaggggttgggtaataagacctcttatttcaaagaggactggggttttgcaggctggagaacaaaagactgaatggcaatttaatgctactcaaaaaaggtcacctggcagggtgcagtggctcatgtctgtaatcctggcactttgagggggctgaggtgacaggattgcttgagaccaggagtttgagggtagtctgggaaacaaagtgagaacccgtccctacaaaaaaaattaaaaaattagctaggtgtggtggtgtgcacctgtagccccagctactcaggaggctgaggcaggaggattgcttcagcccaggagttcgaggctacaatgagccatggtggtgtcactgcactccaacctgggcaacgggctccccatctcaataaaaaaaataaggtcacctgcttttcataccaagcaagggaccccagggttaagggacagcacaggacatttaagttggacacacttatctggtggggagtgtgtgggagtgttggggtttgctttctcctgtggctttttcatttcaaaaggatagattatcatttgctctaatgggtgtagggaagtccctttctgaaggcagagggtgggcctggagcctgtaagcttttcctgtcccgtggctgctccctccaggtctctgttcttcactgcccccctcttgagctcttctactttaaggaaccaaatgccacttccacggtggaactgcgtgagctggcgcctctatgcccagaggctgcagggcaggctaaaaagagaatgtggcctgggatcacctaacgttgccgtttcagctccatctcatcaatgcagtggaacaaggtgactgtcagtgaaatgtacccttttctgggcagcaagatcacctcagagctcacacaagtttctgagggcaaagacatcctgtcctgggatttaaatagacaagtctagcatttaaggagcatgaggtcattttcaaagagggcggcctaaagagggatgtttatgtgaatgtgatgccaaaggaatccactccagcttttagagaagctctgaccatctcctcatggtgggaatgcaataccaatgggtaacagcaccatgcacgaggtatttcacgtgggagctctcatttcattctcagaggagccctgtgaggcaggcattattatccccaggcaacagatgaggagaggaagacttgggtcacagtggtggtgaatggcagagccagcctgcacctagtttcactgcagttatgcacatgctctttctttcatactagcagcccccatggaaagatctgggtcagctgatctcctgccattcaggctcaaaggttggcctctttgggactatgatcaggcagaagtctcagagccttgtactttgtcaatgaaatccagtgttttccttcatcttctagccaatgcccgacaacctcagaaggaaccagggtcaacgtcaccacagttaacacatgccttccaaaaaaggagctgggtaaagcaccagggctccctcagtttcccaggctgggccacgggaaatgcatagaaccagtttcctcaggagctgagccacagggatagctggtgtggcagccacccagcttggtcctctagatagttgagtatcctgggaataagattaatgccagctgaagccatggctgcctcatttgtcttcacatcgcccctcgtatctcctacatagcacctgtgtcataccctgcttccaccacgcccagactagcacacaacctgtctcctccgttagaccatgaggtgttgaaaggtgtggctggtgtgcccacaccatgttgccaggaacacgtggtagatagaggcttggatgaactgagttgaaaggagtttgtgttagaagcaggtaagaggtgcttcttccctctttgcacaaactttgatcttaaattcctgtggttagaatatgaaattaatgactccaggtttttaaactagcttggaataatgagaataaagctggagtaggacctagcacaactccctcaaatcctgggtttgctactttctaagatttgggcaagttatctaacctatttcaacttgagtttctggcatcaaatatgagtcctagttaatctgagttttaagagaaatgaatgagatcacaaagatgaaaacacttgtaaacgggaaatacaaggtgaataattttttgtgttgtggaaaaaatataatgaataatccagttgtcttagcagttctagagttttgttttgtctcattttatgacatagccctcaagacacacacacacacacacacacacacacacacacacacacacacacacctgtaactacctaaatcaaaatatagaatattagtaccatcagaggctcattttggggcccttcatagtcaatatcccccaaaagtaaccctagatttgactttcctgttcttgcatttgggattttacctgaaacctctttgtttggggtttccccaacatcccagctcctcctcccctgccttccagttctgcaatgccccctgggttctcccactcaagagaggttacaccgtgagatgatggccacgaggccagcctcagggcccacagaccgtggaggagcccaaggctggaagccactccccgcctctcaggctggatgtacctcacaggcctctgttaccacatttccataacttcacacccatctgcctcagagtcattctctcccaccagcctgtgagcttcctgaggacatggatcatgttctatccattctacattccttgatccctgccgcagagcaggtgtttgcgtaacccacctgagttgtagagtttggtataggacaggatatcaaatttggcaggtaccaaattcattacccaaatcactaatcaggtaacgaattcaccttcttagctgagctcagtggctcgtgcctgtaatcccaataatttgggagactgaggtgggagcaacacttgaggccaggagttcacgactagcctgggcaacataacaacactccatttctataaagaaatgaaataaaaaagaattaacctctagggagtttgccttttcagcaccaaaacatggagaaagtttccaaggttcttgcaactggggaaactaacttgcaaaatatcaccctctccttcagtgggagacatcccaaggatacaaaaatagcttttaaatgtgtgcaattatttattaatttttttaaatgacaaaatgtcaaggagccccaaagccagcagccaacattgcacaacccaggttgctaggagtggcactgctgctgggacagttgaggcaagaaccttgaaaactgtcttcatgttctgttgctgaaaagacaaacacccaggaggtggatccctgagccagcagcatgactgacccagcgactcctcagctgcacacaattggacaggaagcaggcctggcacttcttatgtcctatgcaggttttgcttggccagcttggtagatggggttttacagggagagcggccaagctggttctgtgccttctctgttttttccacctttgacccagcattaactctaggagatttcccctcccccagctactcactagcccagctcagccccattggtaaaaatgtggagctgtcaccaagtccatcaccatctccccttgcttccaccttcctgtcctgtctcaagtccacgtgttctctccatcccagccacccctgccttagctcagctccgggttaagtctcacctgggtcaccagtctctgttcttctcactgctgaatccgctgatgacatcaccaccagtgtgacacctgatggcctcaccatcacctgcttaaaaccattccatgctttcccatgggcttaaagatagattttaaaacaacagcttcactgaatatcttcattaatatataattcaaatatcacagagtccactcttgaaaagtacaattcaggccgggtatggtggctcacgcctgtaatcccagcactttgggaagcctaggtgggtggattgcgtgagtccaggaattcgagaccagccttggcaacatggggaaaccccgtctctacaaaaaatacaaaagttagccgggcgtggtcatgcacgcatgtagtcccagctactcaggtggctgaggtgggaggatggcatgaacttgggagtctaggccattgtaagctgagatcacaccactgtactccagcctgggtgacagagagagagagaccctgtctcaaaaagaaaagtatacaattctgttgtctttagtgtagtcacttggttgtataatcgtcatcactagctaactccacgttttcaccacgtcaaaaaagaaacccttcatccattagcactcactccccaatctgccttccccccagccccagacaaccacgaatctacttctccctctacgggtttgcttattctgcatattttatattagtggaatcacacaatatgcagtcttttgtgtctggtttctttcatttagcacaatgttttcaaggctggtctgggctataacatgtatccgtattttattccttttcatggctaattggcatttgatggtgttgctatgccacattttgtttatccattcatcagctgatgaacattttggttgtttctgctttttggtgattatgaatagttctgccatgaacacttgtgtacaggtttttgtgggggcctacgttttcgtttgttttgtgtaactaactaggagtggagtttctgggtatcttatggtgtttaaggatccatttcaacgccttactgtgaggccagggccctgcccattcagagcctgccacgccctggcccagactccactcctgtcttgccagagcagatgactgcaacactcagaacataccacacccgacacttcctgccatccaccccctctgcatggcctgcctctctccagcctctgcacctggataactccttcaaagctcagttcaggcatcaccactaacagggaattctccagtgaacaaaacaaaatccctgctcttgtggaactcttgttggagagaagtgaaataggtaaaaagaaataaaagtatgtattaacaggcatacatgttatgcacccaactgtttaccaaaaatttaagcttccctttccacagtgtggaattgttgctatcccaacaggaataaggtttctattttccagccttctttctatctggatgtgaccacgtcatgaattcttgttagtgggatggaagtagagagatgtgtgtcacttctgggattgggcttttaagaagtgggtgggtttttgccatactctctcttctattctgcagtttgggtgcaggggactttgaggcactaggaatggcaggtctgcaggatggcaggagcctgagtgcctgaatcaccacatggaagccacccatatgctcaccaggagcaccacatcaggctgatggaggatgaggatccaactcctattgtcttgggccactgaagtgttgagttcctttctgaaggcagttagtgtttccctcatacaattaaaaatgaaaggatttttccatcaggtagtcagacatagttcatcttttctggagcagaaaagaggatgtgaacttttacttgcttcctgctttggtgccttttgtgtgagggtctgctaagtcaaccctgaaaaattttccacctgtcaaaaatattcccaagcccggtgcggtggctcacgtctctaatcccagcactttgggaggtcgaggctggcagattgcttgagctcaggagttcaagactggcctgagcaacatggcaaaaccctgtctctaccagaaaatacaaaaatacaaacattagccagatgtggtagtgcacatctgtagcccagctactgggaaggctgagatgagagaattccttgaactcaggaggtcgaggctgcagtgagccatgatggcatcactgtactccagcctgggcaacacagtgacaccctgtctcaaaaaaaaaattctcaaggtaccctcagcagatccagtcaaacgagaggaagcatggatttttgggaaggggagagaaatggggtttctgccttttatagtaatgaccccctcccaccagttcccaagtctcctcacctaaacatatacaatttactcatgtaactgtctgcaggccgagacatattttctacaccagagttttggaaatgagctctcaaaccctgtgatagcagagctctaggtaaatgaaaacatggcctgtgccccaggcctgctgttctctccttgaagctcatctctgcacattgcgcatgttcaacttgctgagcaggaaaagaagatcccaggtggagacacgggagggggttacatctcactcgagagcacagcgtccccactctcaccttaattggctctgctctgctcaaattctctcctcacagcctctttgcctcctctttattccctcctcccctccccttccctggtcccacctgttcatctcggcctcatgcctcttcaggaagttgcctctgcccagtgtgggaccccctcttttgggtctctccctccttttttcatatacaaagcatcagtatttccattttacccccttaatcctagttacacaaattaactttctctgaatccacccttaaacaaagtagagcaagggcgttataaataaccataaggttgtttatcctagcaggaactcaaaaaatgcctattttcattctttctttctgtcttttacatgcccaaaacatctgccacagtataaacagtcaacacatccttatcaaatgcaaccaaggggctttggaaatatattggaaacacattgaatgtaccaaaagaaggcacaatttaaggtggagttgtgatggcaactagcatcttattcagttgcatgaaagattttaagttgattcaaccaaggatgcagaaggaaagagctgctttgcaccacgtggtggcatctaacagataccaacaggtgttcctggcttatcgctaggtgattgtggtttcgcatttaagttcacgggccaccaacacctgcgattttgcatattcctgctcagaccacaaaaatctttattataacgtttgagtaccctggagtggataactccaaactgacccaaacaccgtccttccatcttcaaggtgagtccagtcttttaagcgttttaaattctgtagacatgagacgtgtgatgcagggtgcctgctccttagagttcacaaggattgggtatcttccagcttggagataatagttttcccatcaagttgtcgttactattattattcttttatcatttttttttagagacagggtctcgctgtgtcacccaggctggattgcagtggtgcaatcataactcattgcagcctcgaactcttggactcaagcaatcctcctgccacggcccctcatcattatagccaaactttattgagcattacgatgtggcaggcactgtcctaagcactttgagattttatctcacaatatccacgcaactgtcctaggaggtagctactattgttgtccctattttaccaaggaggaacctgaggagttaatccatttgtctaaggtcacttggtaagtaaaaattggaagacaggcttccaggtctatcagactccaaagatctgcactctgaacccccgtgtttctcagcaggtggaacacctgacttttatgagtgacacaagtataaagttggaatgcaaatcattactctggtgcatccctgggcccccagcagtatggctggtttggttcagggcctttgttgaaggttcaggtctgcttcgcagatggcttgaaaaggaggatgaagaggaaggggaggaagaggaggagaagtaagttgcttttaggctgtatttagcatattctaaggcaattagtgaatgctcttttttgtgtttcagatgaatggtggccccttcagtgatgatagaatccaccagtctcccatttagaaggaacctaacaacatgtagttgaggcttctgcctccaggaaagattggagagatgaccctccagacctgtttccttatcactacaaatgggcttaggggtgcaggcagaccgatggccttgaggcctgtattagtccattttcatactgctgtgaagaaatacctgagactaggtaatttataaagaaaaagaggtttaatgggctcacagtttcacatggctaaggaggcctcacaatcatggcggaaggcaaaggaggagcaaaggcacaccttacatagtggcaggcaagagagcatgtgtagggaaattgccttttaaaaaaccatcagctctcgtgagacttattcactatcatgagaacagcatgggaaaaaccctcccccatgattcaattacttcccaccagatccctcccatgacacgtggggattatgggagctacaattcaagatgagatttgggtggggacacagccaaatcatatcaaggccctttctggactgggttagaaggctgggagaggtgccagcctctggtgttcctctgtagagtaaagccaaggattccatcttctccctaggatgatgtccattatctgataacctatcaaggtgatctccggctgcagtctctcctctggaggagatgggtagaagaaatgcttgaagttctggggatctgggggctgggttgcaacagagctgttgagaaggtaactaggaacaggagctgtccattagattttggttgaaccactatggaaaacagtgtggacatttcttaaagaactaaaagtagaactacaatttgatccaacaatcttactactgggtatctacccagaagaaaagaagtcattatatgaaaaagatacttgcacacatgtttatagcagcacaattcataattgcaaaaacatggaaccaacccaaatgcccatcaatcaacaagtggataaagaacctgtggtatatatatacaatggaatactactcagccataaaaaggaatgagttaatggcatttgcagtgacctggatgggattggagactattattctaagtgaagccactcaggaatggaaaaatgttctcactcataagtgtgagataagctatgagaatacaaaggcataagaatgacacatgggactttggggactcaggggaaaaggatgggaaggggaatgagggataaaagactacaaataaggtgcagtgtatactgcattgggagatggatgcataaaatctcacaaatcaccactaaagaactcactcgtgtaaccaaaaactacctgttccccaataacctatggaaattaaaaaaaaaaaaaaagattttggctgaggaatctgctcttggtaaattaactttcaccttccatgtttgcattttgatttgtttttccttccttattggttgtgatagattgatttattggccctgattcttcactctttcccgtgttcacacctctacccatgtgacttggcagttccacccactagaggcagatcttacttgttcctcagctttgggctcaccctgtgactggcttggtcaatgggctgttaacagatatgtgagcaggacttaatatgtgtttgcatggttaggcttattttttcaggcctttgccaccatcatgagaaaaacatgccaagcttgcccactggtccaaggagaataagggatgtgtggataagatctgatctcaatttgcagcttagagctattcagccaagctcagcctgtatcagatggccctccagccaataaacagatgcatgagcaaaatgcatgcttgttaggatgtgtcactgagattttgtggttgtatgttatgttgctatggctgactgataaattagttaaagttccttttgacgcactccaatgttctctttgctgaatttataagtaaaagtatttcccaaactttggttagggtatctgctggaatctagatgctcctaagtccaggaggccatctccaaatcctggggagggctgcagcaagtctagaaagaaagaaagaggatttaggaaatgctaatcaacctggaataagaatctgttcttacgctttgaaaagtttgttgtaaaatgaatgcttccattttatctttaggtcaaaactgtagaatgttcagctctgatgagataaactgaggctgcttgggagagaatttttggatctgcctggaatttgtgcaatctgaaatgaagaccatggaggctctatgtgaaccacgagactagaaagaatgatgcccattctcctgcttccaggaaggactgtatttttacacatagtatttttgttctgactatgacaaaaatacatacacattttggaaagtacagaaaataataaagaaaatgaaaacaatctacaattctactacccaaagatgattacgattggcatttgaaattttctgagtttacaaaaaaatgccttttatcctgccttttaaaaaatgcatagcattatatctgaagaattctttcatgttgttaaagactctttgtaaacattagtttcaaggaatgatactatttcggagatggttttcctgttatttgtgttaccaattccctaatgttaggaatttagttattttcaatttttcacaagggtaaataatgcttaaataagcatttttacacacatttttgttacttatttatttttaagacaagttcttgttctgtcacccaggctggagtgcagtggtgcaatcacagctcactgtatccttgacctcccaggctcaagtgatccttccacctcagccttcctagtagctgggactacaagtctgcaccaccaagcttggctaattttttatatctatttttagtaaagatgaggtctcactatgttgcccaagctggtctcaaactcccgagctcaagctcctcccatcttagctcccaatgtgctgggattcgaggtttgagccactgcacctggccctggcctgttagtttttattgttatcttagaacagattactaaatgtataaaaggaacacacacacacacacacacacacacacacacacatatatatgtgtgtgttagtctgttttcatgcttctgataaaaacatacccaagactgggagactgggcaatttacaaaagaaagaggtttattggacttacagtttcacatggctggggaggcctcacaatcatggcagaaggcaaggaggagcaagtcacatattatgtggatggcagcaagcaaagagagagcttgtgcagagaaattcccatttttaaaaccatcagatctcatgagacccattcactctcatgagaacagcatgggaaagacccgcccccatggttcaatcatatcccaccaggtccctctcacaacacatgggaattatgggagccacaggatgagatttgggtggggacacagagccaaaccatatcattctgcccctggctcctcccaagtctcatatcttcacatttcaaaaccaatcatgccttcccaacagtcccccaaagtctcaactcatttcagcattaactcaaaagtccacagtccaaagtgtcatctgagacaaggcaagtcccttctacctataagcatgtcaaatcgaatgtaagttagtttcctccatgggtacaataggagtacaggcattggataaatacagccattccaaatgggggaaattggccaaaacgaaaaggccacaggccccatgcaagtctgaaatccagcagggcagtcaaataaagctccaaaatgatctcctttgactccatgtctcacatccaggtcatgctgatgcaagaggtggattcccatggtcttgggcagctccacccctgtggctttgcagggtacagcccccatcctggctgccttcacaggctggaattgagtgtctgcgtcttttccaggtgcatggtgcaagctgttggtggatctaccactctggggtctggaagacagtggccctcttctcacaactccactaggcagtgcccccatagggactctgtgtgggggctctgaccccacatttcccttctgcactgccctagcagaggttctccatgagcacccacccctgaagcaaagctctgcctggatatccaggtgtttccatacatcttctgaaatctaggtggaggttcccaaaccccagttcttgacttttgtgcactcgcaggctcaacaccacatggaagctgccaaggcttgggccttgcaccctctgaagccacggcctgagttctacattggcccctttcagccacagctggagtggctgggacccagggcaccaagtttctaggctgcacagagcacgggagccctgagcctggcccaggaaactgaatgcctttaacagcacctttaatagcacctcttgaatgctttgctgcttagaaatttctgccagataccctaaatcatctctctcaagttcaaagttccacaaatctctagggcagggcaaaatgccgccactctctttgctaaaacatagcaagagtcatcttttccccagttcccaacaagttcctcatctccatctgagaccacctcagcctggaccttattgtccgtatcactagcagcacttttgtcaaagccattcaagtctctagaaagttggagtttcccacatttttttgtcctcttctgagccctccaaatggctccaacttctgcctattacccaattccaaagtcgcttccacatttttgggtgtcttttcaacaacgccccactctgctggtaccaatttactgtattagttcgttttcacgctgctgataaagacatacccaagactggacaatttacaaaagaaaaaggtttaattggacttacagcaaagatttttaaagtatcctcaaagaataccaaggagaactaaaacagaaaccctcacacatagctggtaagagtataaattggcacaatttgcttcagaaattataccctgagtcttaagaatattcattttggctgagtgtggaggctcacgcctgtaatcccaccactttgggaggctgaggcaggagttcgagaccagcttgggccatatgtcgaggctacttggtattctagaccatgatctgaggtcaagccagtggacaggaaaatcctgaggtcaacctgacctcaggttgaagaactagcccaacaggacggttataaggggaggttcgtttatgattttgctccacgaggattgctcattctacgtatctattatttgtaaaagatcagcacataataatccatccacaaaggccgtttacctttgtctctgctaagggttgattttccatctgatccaaaataagcagccaaatgtactactgtattaaaagtaaaaacatcaggaatccagataaaggtgagttttaatgttctttgctttttattttggcttctaaggtggagtcaaaagctgtctagcaacccctagctggggtaaaataattcctatgaatgaactcagggtcctctgaggaccaggcaggagagaaggaagaaccaagaagaaagcaagggagagacaaatgaggaaacagaacaagagctgagaaaccagacacaaaagttgtctctgatgtgaaattagacaaaatgccatgactattggcttagggcacaccacttaaaatgaacatcttaatgagttttattctatgtgtgtgcattatttccgtgggaaacatggcaggtgttaggctaaggtttgggtaggtgatggttagtccgcttgacatctacaagtttaagaaaggcccctttccttggactttgagaggattttgaaaagaaaagcgatcactggaaggttttaggaccgccaagaaggcaattttacaacattcattagacatacagtgtgaaacatctctgctttgtgtttctggacagtagagatgacatggccttcaatggctggggtgactattcccctccaaaattaaagacttggaacttaattaggaaattgagctttcagaagaatttggccgccttttatttgttctcaaaatccactagtcaattaaacaactcatttgaacttccacttcttgccaaagtagactaagagaggcaggaattaccctcctgtgggcctgtcttacagggtaagaaaaaccaaacggttttgcctgctctgacacacactcaacatgactcccctgacaccagattctccagtggacacagctgggaggtgtcctataattcaattctggagatgctgtcagatcctgcaggttgaagactcagtcccaccggaccacccccacttcagatgccaagtcccaggtggtgacctgaacttttgaccaatgggctataaattggagttcccatgaccgcctccttgggtttgattagtttgccagagtggccctcagaactcaggaaaacactttacttctgtttagccatttattataaaggacattaccaaggatacagatggacagccagagggaggagatgcacagggctaggtatgggaaggggcacggagcttccataccctctctggatgcgccaccctctgggaacctccaggtgttcggccatctggaagctcatctgcacccttggcattttgtgtttttatggaggccttattacatatacatgattgatgatatcattggcccttggtgatcaacttgaccttcagcccctctcttctccctggaggttgggggagggggtggggatgaaagctccaaccctctaatcctgcttggcctttctggtgaccatcctccaccctggagctatctaggggagcccaagaggagacaaagttgcccagagaaagaactctggaagtctgcagaggggtctcgtgagcattatggtgagcactgaagaatatatgtgaggaaactaagccaaggatggggaaagacccacctgaaggactagagggagagtctttccaacaaatggtgctggaacaattggtatccatgggtacaaagatagacctgaatgtaaaactgcaaaacatctagaagaaaacacaggatctttatgatcttcagtcaggcaaagatttctcagataaaacactgcaagcaagatctttaaaagaaaaaatggataaattggccttcatcaaaattaaaaacttctgcatttgaaagagatagctaggagagatttgtacacaaaaatactcatagctttatttgcaatggtaaaaacctggctgcaagtcaatgtcttctttccctcatccttgtcaacaagcgttattgtctgtctttttgttttagccatcctagtgtgtataaagtagtatcatttccctgatcgctaattgtgtggaacatattttcatgtgcttattggccatttgtaaatcttctttggagaaatgtcttctcaaatcctttgcccatttttcaactggcttgtcctattgttgagatgtaaatgttcttcatatattctggatacaaactccttataagatatatgatttgcaaatattttctcccattctgtctgtcgtcttttcattttcttgatgatgtcctttgaagtgcaaaagttttaaattttgatgaagcccagtttaccttttttcttttgtttttttgcacctttggtgtcacatctaagaaatcattacctaatccaaagtcatgaagatttgcatctgtgttttctctgtgagttttatagttccagctctattttaagttaatttttgtatatggtgtgaagttgtggagatatgttctttgtcttgattatggtgatacactggtgtacatacatactaaaacttagcaaattatacacctaagtgcagtttattgtatgtcaactatatctcaatatatcagctttaaagagtgatttcttaataatgtaacaataatacatatttatgatataaatgtttttaaatagaaaggtatatagagataaaaaatcacagatagccccatcactgactgttaacattttgttgcttttccattttatttcagtctttgtcagttttattttaaacatctttatcgtgttttaatatttttcaagaatattaagaatatttttaacactaaataagaatgactattttatttgtttaattaacatttaattaaaattaaaatgtaattaaacagtccattaaaaataaaatttaaaattagctaagattccatatttgaaaaagtttggaacaggagaggactggagtcttacaggatcccagctgggaaaggacttgttctccctagattcctgttgtactgtttaatttttttatagtgtgcataaaaataaattcatttccattgaaaagatacataacctttcttttgtctgttctcagaaagagcacctttaatccagacatgttctgattcctcagtgtcctcacggctgcagcttaagaggctcttttgccctttcttgggctcccttgggtgaatttcgatggctttcccagtgggaaaggagggagaggaccaggcaagagcaagaatctgctgagcacggagcgcagcgcacggaaccccacactgctcacggtccggttggtatcaccatatgctgggtgtgttggcatgagagtgagaggaattcctctgaggggagtcttcaccataccctaatctaagacaggatttaacctaaggctaggaaatggccaccaaacctcagccttccacagcacgaggtggttccagcctaccccatccggaacaggtcagcccctcccgctgcgtgttagtttcacctcctagaagtttctcagggcagctactggctgtggaggagaggtgggggcgctgcctgggagcccctggtggcatgacagggggaaatcttgtttttcccgtaagcgcttcactttatcatcttttacagaaatctgttttccaataatatagcagtagctgaatttccaaccagaagcaaggaaacccatcatctgaaagttgaaattaaaataaattttaggttagcagttcaacaaatagtatctctcctagtccttttgagctgctgtaacccactaccctagacataacacagtgctgggtggcttacaacaatagaaatgtacttctcaccgttctgggggccgaaagtctgagatcaaggtgcctgcaggatcggctcctggggaaggcccctttgcaggttgcagactggaatcctgtctgaggtcccttttataaggcactaatcccattcatgagggctccaccctcatgacctaatcacccctcagagtccccatttcctactactatcctattgatggcaaggacttcaacatataaattctgggggtcataaacagtgactggaggcccactccgtgccaggccctgtgctaggtgttggggatagtgacttaggtaagactgaagtggccctgctctctgggactcaagtgactctatgtgaataggggcctgctcagaggcacagagagggaactcacccagactggtagggtcaggaagggcttcctggaggaagtggcatgtccacagagatttaatggatgagcacatgtagccaggagaaggcagaggggagagtattccagctgaggacacagcatgaggacggcacctggtaaccaagacgcttgtcatctctgagcctcaggaaagttggtaactgttccaacctgtcctcagctgtcttgtgggggcagtgaggagcactcctgtgcctgcacttcagccaacctgtttgaggtcatgagtgaggctgcggtcattatggggagatgcccagagggaaaagttcttaagcacatggggctgggccttcagccaaccacgcatggtgagcttctcactccactgctgaccctggcgatccagatttagtccagggagacagcaggtttgttcacatactttggtgcaatttgtctgatcagatttgttagccaccgggcaatgggatggagacgtttacgtggacggacaatgagagggcgttggaaccggaagctctgggtgcatggccctggaaagagaccaggccagcgaccatgaagctgagcaagggtttgcctggggctggctctgactagataataataacgagtgcttattgattgcgctacaatcaatcctaacagcttcacatatattaactcatgggaaaaactgaggcccagaaaggtcaagtaacttacctagcacaaagctacgtagcagtagagctgggatttgaaagtaagttgtctgatactattctacctctccatgagggtggaagctgatgatggcattaacctgtgcagcattgattgtgctccaggtcctactcaggccaggtattgttctgggttcctgagattcaccagtgaacaagaccagcaaaggccctgctttcatgggcttatgttctagtggagagacaggttaaaaaaaaaaaagatagttaaaaaataatttcagagagcaacaagtggtatggaaaaattaaaacagaaatgtgacagagagtaacaaggagaattggaatgaatttaagtggcttggaggtcgcaggaagagaatgaattgacaggacctaagcgtgggccatgcagaaagattgcatctcaaggactgtttccttgtctcggtagatgctgtgaggtcagcacgccagaagtcatcatccacccagtttttatttcttagagatggagcagccaccccaaaattaaggcagtcctagagtttaatgtttaataaataaaggagcattattttaaaaattttccctatttgtccagtgataccaggtttttagtttggctcttcattttgcatttaatattaaacgtgttactacttacacctgaaaagagatcccttaggaacaaagactcacagcgtttgcattacaaacttccctgtgctgattttgactgaggataaacatctttctggaatggactgtgaatggaaagggaaaatgtcacaatttgaatgcaattcaaagtaacatcagagaaaggtcagtgccttcgcatgagacctctcttttcaaagtaaacaagtggagcataaaagcactttgggaggtttcttttctttttttttgtttgagacagagtctggctctgttgcccaggctagagtgcagtggcgcaatcacggctcactgcaacctccacttcccaggttcaagcgattctcctgactcagcctcccaagcaactgagactacaggtgcccaccaccaagcccagctgttttttgtattttcagtagagactgggttttaccagattggccaggccggacctcaggtgatcggcacctgattctccagtggacacagctggggggtgtcctataattcaattctggagatggtgtcagatcctgcagcttgaagactcagtcccacggactgcccccacttcagatgccaattactagtcccaggtggtgaccttttgacaaatgggctataaattggagcttgagttcaactcctgacctctggtgatccgcccacttaggcctcccacagtgctgggattacaggcgtgagccaccgtgcccagccagcacttcaggagttttatgagaccagtgccgctggctcctagactgacctattcgattgtggagtgtcacccctggaccccacccacaagccctaagagcttaaaagtctacgggacaaggttggttctgacataactcacggttagcagctgggtcccttgaaggggagcaggaagtaaggaagtttcagtggccaagtgcggtgaccacctgcctgtgccaggccccagtgacggggtggaggggtcagtgcactgcaccctgggatgccaggtggacacgggttcctagtcatgctttcactctcccctgggcctgtcgcaggtgtgttctttccgagcctcccctccttccttttgccgtaactctggcgatggccaacagtgcggggagggcaggataactgcagccagggtacccagccaggaggagctggggacgctagggtagaacaggtctggtgtgggaacagaaaggacaaaggcagggagcagcagtagtcagccaaaccacgaagtggcagcaagtcctggccaggtggatggggcgggggctggcaggaatgccacggtgggtcaggtaatgtgtacaaatgcccaggcagggacacccatggggacttcctctgggagcaggtgaggggctggccagtagtggggaaagtgggctaggtggctaaggcacagcctaggcagcagtctgctgggtgaccttgggcaaaggacttaatctccttgggcctcagtttccttgtctgtcaaaaaggatggccctgtccttccccacatgcttgggcttatgatgtggatgaggtgatgagaatctcaagggcctgggctccaggcaggttgccaactcaatataatatgatgaagacccagttctcagactaagatgctgggcgtggcttgcatctggaaagttctaaggtcagaactaggcctcaaggtggggctgaaaaggcagcagaagctgtcgcagaggacctgagagtcaggctggcgcaggggtcccccaggggtgggtggagatggttctgcaaggtgcttaagtgagaagcaaaatgaatgttgagaaatgcctcatgacatagccccttcttggagagttagaaagcatcgaccgtattagtagttttgagaactcctgctgttaagacacctctttaatcccagtgattctcataccgacctttcccccttttccaaatacctgggaactatatacgctagaaacgtttgggtttcaaatctctcagaagtccttctttctctctttgggattggtcttagggtgggggctgtggcagaggattctccccagccacagggattgatgaaggaacatagcataggaacctggccgggcctcatgctattttatttttcttttttaagagaataaacttttgattttggaatagtcattaatttatggggaagttgtggagatagcccagagagttctctgtaccttcatccagctccccctaatgttaacgtctcacacaaccagagcgcatttgtcaaagctaagaaattaacactggcccagtatggttaactctccacagactttattcagagtgtgctttattcagtttttccactctgtcctttttctgttccaggaacaaatccaggatatcacattgcagttagcttgcttttctttttccttccgtattccttttaccctcagtctgtttggttgttgttgttttagcttcctcctctcgtacttcgtgtctgaggcctggagagcaaggtgagggggacggtgaggtgagcacaggaatcctctgcaccaggacagacaccgtgatgccttctatgaggtgagtggtggctgcagggagaagcccgcattgtggccagatggagagggagttcgggacaccatcaccagtcatgagcaggctgaggaggctacaggccaactggctgagagagcagactctgcatctggtgggtaactaaatgggctggtggagaaatccatgaagcttgaggggcctgccatgtctacagctgctttctgaggaaagtagccccaattgttcgccatctcaatcacaggtgcaggtggggtttgttagtgtcagtaccttagcatgttagcagaacccagccctgctacctgagacccagatggttccatcaggcgtcacaatgtgggtcaaggcaatgggccaggtgagggggcactcaggcaccagggtggcttggcaagactgctgctcagaggtgccccatggtgatggaaacaagccagtcaatcctagctctccctacatgaagggcaggctgtgtaagctccgggactatctgcagtaccaggaagagacactcctgggtctctctgaagcccactccatgcaccagtggagcagacaatttcgcacctacccaccatggatttatccccttctttgccagcacagccctgatttagttctggtctctaccctttgcccaacagccaaatgcttcaggaaggctggctttgaggggcaagtgccagttggtgtgcaaactcatcaaagagctctgatactgcctgccagtagttgctttaagcatggacatgtgtataattctggccaacaagccagatgtgaggggaagtcccctagtgtgtagggggcaggagagagggataggtgttctgagaaaggtttcctcactctcaacaagcgacacaaagatgaaatggctccttttcctgagtcttggcaatggtatgcccagatgtgacacctggaacgttggtagccatcttgtgactgagagagcagtgagatgagcagaagggaatgatgggaagaaccaaggtcctctccatgtcactgagtcacccaaaaaaaccaagcttggagcctgctgcctttggacttcttgttgtgtgtaagccagttgatgtaggcttttcttgtaacttgagatcatggaatcacccactaccagatctgtgacctgagggactgcaccccatgaggctgtcccagttctccctcttggtcctgtgaattcatgcctgagatctctggattagttccctgttaatctgccaataatttagtggtttaaaccaatgcaaatttattcttttaccattctggaggtcagaagtttaaaatcaaggtgttggcaaggccacgttccttctgaagtcttctggagaatcctgtttcttgtctattccagcttctagagccccccaccattcttttcccctcttgtaaggacccttgtgattccactgggctcacctagatcatctaggatcatcttcttatctcaagatccgtaacacaatcccatctgcaaagtcccctttaccgtgtaaggcagcatattcacaggttctagggattagggtatggatatctgagggagggaattattcagcctaacagcctccctcacccaaagtgatccatgtgtccctctcctggttctttggaggctggtggttcctgtggcttcctctccatggcaccacttgcatggaccccagcctgacagcccacctagtgtttcccaccaatcaactatggaggctctgcttgggcctagtgtctattcctcgtgggagaggagagcctggggaaagggggggagagagagagagagagagactgtggatacagaatgaactgtagctacttcaaagtggagagaaatagtggccttgtgttttctcaatagcagcgaagctgaaaaagatgtcagaggtctaccagatggtttcagtgaagttcagtgtgtccttatgtactcactgctttggggatcctcctcaacatcagagtccctgcaactctgactagatctgggtgcatctatcagggcatatgaggatcagagttggacttgaaaaccaataggccactgatctgtctctcctccattctggacattggctagatttgtgtgggtagaattcagagttgcagggtcagcttttgggagctttccagccacttttctcctttatgccacatgctgggcttcaggctgggccaaagaggcccatatatggaacctggatgcattctgcacaccacagaccgcatctctgtgtgaccttccgcgttctgcctttgcattggatgtgaagtagggtcaccttgactgtagaaggaggggttggggccaggctctaaagccctgcagctctccaacattacagcttgtgtatgggacattgaagagaaatttttggtgtcaaaaacaatgaggacagagcattcttggggctttcatcatcatccccaactccagaaagggttgtggtggagatagtggactgagttggctttgggtgaccatctcccacagcctggcctaggatgtgttgttctggcctctgaggcatcagagcacctcatgatggctccaacttgctcccaccccatcacccctgccatctgttcccatgggtgggaagacgtcctagctttggagcaggccagccccatcaggagaagccaatccgtgatgcaagagatgataaacagagcaacacaaatcttgtttggagagtaagccactccttagaaagcagagctaagacatccttttgttgtctagattctagggatgataacttctcactcttccccttgatgagtccttagagaactgtaaacttccaaagaatgctttgtttaatgggttgaaagaggaagaactgaaaggaggaaatgggggcctttgtcctctaaagagtaagcagtgtggatgatgacatcaacggccaatgtggacgtgtcaccagcactggcaccagcagccctgagttggcacaatctggcttcatgtgaattcttctgccacattgggagtccctcttgccctcgcttggcctcacttttcctagggagattacaaaacctatgtacttacctgaaggaagttgtgttacatccatgggataagacgccggactagagggctccttggaaaagatggcggatctgagaacccagtgctcacaggagtaggtgaagcagtctattgctgtgtagctcttgctgcctctgacctccaaagtcagcatgagtctcctcagcagaccacatgtgtaattagcatagggaggcttctgggaaggcaccaggcttctcagacatagccatacgtgaaggaaaagacccacaatctggaggcccaggggatggaggaggaggctcttggcattgggtttgggcatttgtcagggtcgtggttagaaatccctcctgggcttgtctgctcagcggttttgggtgtctgtgccaagggtggctggggggcccatcgaggagtccccagatctgcggggtctgattcatcctgtgtcagcccagggcgatgacagattggtccgatttggggcagagaattgcaaaccagtgttaacgagagacaagcctctcctagatggctttggggaacttctcagcatgtgctcctcctaagctctttgtctcctttcccatactcagcagcaaggcagcccacaggctccaagcagtccctggggaagcggggtggtggtgaggcagagatggttttctacggagccaggatacagtggggagcaggcacgcacatcctcatggggatgttccagttactagctagaaaggtggccaatttcttgagatctgaaaggtatcagggttcagagtgtgactactgggaggccattctgcccacactggccattggccagggctactgggtacttgatatagccaagagaagcagacattgggggtaagatggcataaaggaatcccctcgttagccaagaaaatgcaagatccttttatcagtcagggtttatagctgcaagcaaaagcaactgcccctggctggtgaagcagagacattttattaacaacagtgggcagctcatagtgtcccttgagccctggggcacgtggattggaagtcgcacagccaggtagagcaccctaacttctgccactgaacccatctgggaaagacatatttgctttgctacagggcccactgtcaacgccccaaccctgggtgctggctggaacagagcccctgtacctagaaactggatgttctgccaccaagatcatcactgcccatcaccagaacacaagttgtgcagggagacctgctgcttcttgtaagggacagagccacgccacttaccttgtctacctgccacaggggctggagaagccagtgtctggcacttttgatttctatagtgatgggtgggtctcactgtgggggcacaaacatagaaggcaatacaggtttttggtgactaaacagatgacagttgtcccctacaaggcattaggttataggaactgactacagggcatctgactctgctcctccttggaaatggccttcttttgatgctagtgtaccagcctcacctctgctgagggtggtggacacttaagctcagtcatctgttcctgaatatcagatgttctgtgtaaaaatgccaaccagtaaacaattcctgcatttaagttttattttttcagctttatcgaagtataattgtttagattatagattcaatataaaaaattgaatctatacaataaaattcagggtgtacaatgtgatgatttgatgtacatatacattgtgaaatgatagccacaatcaaatcagttaactcattcatcaccttagttactctgtgtgtgtgtgtgtgtgtgtgtgtgtgtgtgtgtgtggtgaaaacatttaaggtctactcagcaaatttcaagtaaagaattacagtattattaactatagagttaataatactggtgttttgtattattaactctatagttaataatacttgctgtgcattgggatctgatgttcctgttagtatagtttcctgttattataaatggaaaaggttataaggcacacatccaccaatcaacttcccaaatgtgattagatgtgttgaaacatctatataggtaataaactaccacattaggatgtaaaatactaggctgggcagcttagctcatgcctataattccagcactttgggaggttgaggcaggcaggtcacttgaggtcaggagttcgagaccagcctggccaacatggtgaaatcccatcactaccaaaaatacaaaaattagccaggcgtggtggtgcacgcctgtctcccagctacttgggaggctgaggcaggagaatcgcttgaacccaggagacagaggttgcagtgagccaagattgagccactgcactccagcctgggcgatagagtgagactctgtcaaaaaaaaaaaaaaaaaggggatgtaaaatacttaaaacatagcttaaaacactatagttgttaaggcctactttgtaagaagtgacaccgtgatgcctgtcagtgccaacaacttgggaaaacctcatcccctttgctgaggttcaccatgctttatacaaccttctacatgcagttctggcattctgttaagtgtaattgtaatgtttctcaagactttatagatatatttgtttaaaatgtagggtgttatgttttagggatataaatttacatttaccttagataaattctggccaaaaaatggcattgagagagatacgtatgttccctgaaatttggatattaaaaaccaagtggcatcctgcaatggggatgttaatcaggaagatgttttgtggggaaggtcttgatttgaagagtatctcccaaatgccaagggctttccacatattagcactaatgcccagagtaaccttaactccactttacaggtggaaataccagggtctttctcagggccccactagagctgggactcaaacccaggtttgtttgactccataatctttccaagataaatccagtttcttgttttctgagtatagctgaacaaagctgaagtattcaagagaaactttaccaaagtaagagaaatcgaaaaaataggagataataaaattactcaagagtatgaggcatagtttttttttaaccttacatttctattgcttacccatcccatttagcacattgtgttccataatctgtctaggatggtgggatgaaagggtgtgagcattgaaagcaaacaaatgtgagtgtgaaacctaaagctatcagtgattagctgtgtgttggccactggacccttcccgacctcaggcttctcagctttcagacacggatgataacgttttcaccagaagattgtggtgagggctttttttttttttttttctttcagggcgattgtgttggtggcatactggatatttctaacatgtataaagttaagtattttgattgactttctttctatgtatatgtacttctcttcaaatgccaagagctttttcttgctatcattgccttttgaaacaattcaattttcaagtctactgttgattgttatgttaaagattgagtcactgatattcaagatttaagtctgaaacagtcaaaatgaaccctcaaaaaaaaaaaaaaagaaaactgcttattggaaatcattactgtggaaatgaactttatttgccattatgaataatatccaatataagaatatgcttctggaattcagtactgcttttaagtaccaatgatacttatttttcaaaaatgtaatggcatgttattgctttgaaatgcttgctttcatgttatcttaaaatgcgctggtgaattctccatttttgacatccatttcacacgtaaaagacaaaaaaaaaaatctaggttggccttaatattgggatgataaaaggtaggtagcattaagaaaataaaacaatcttcatgttagagatgaacccattaaaacaatttaggaaatgaggggcaaaatggaagaaataatattccaaagaacatgagcataaaaatgaatgcatttcaatgtttaagaaggcttgatacaaaaagaatgtcactttttgatttaactgaaaacaaaagattgtggtgaggattaaatgacaatagtggacataaagtcatgtagatttgtggttcaagatgtagactgaagacacttgtttacttctccttccgcccaggatgccacagaaattacagacaagctgttaaaaaaataataaggcactcattctctctcctgctgccctgtgaagagatgccttctgccatgattgtaggtttcctgaggtctgcccagccatgcggaactgagtcaattaaacctcttttctttataaattaaataataacaacaataaatccataatttaccaggcatggtggcacatttctgtggtcccagccactcaggaagctaaggtgtgaggagtacttcagcctagaaatttgagacaaacctggtcaacagagcaagaccttgttttattaaaaaaaaaaaaaaaaaaaaaaagtcataactgctggaagaacatcagaccccagaattgaggaagttactgaaggatggattgaggatggtactggagtggtatagaaagtggactctgtttctcatttcctttcatcgccatatttcttgtgggttattcagatttgtacttcttcgccctgtgttgactctgggaaccactacaatctggctttttctaccatgattccattgaaaccgttcttatgaaagtgtctcatgacctcccccttgctaagtccagcatccggaggtcatatcactgtcagtatcttaggcaacctgttagcaatatttgtgatagttttccacttctcgaaaccttgtcttttcttcatttccatgacacctcagccctctggtttccttccacctcagtggtggctcctgctgtcttcttggctggctttgctctctctggctgatctctgaacatccctgttccctggtcctggcccctttttcatcatcttcaatattcttgatgagctcctccattctcacagctttcaacactatgtctcgatggctcctgcagttctgtctctagtctagttctctccttggagctctagacttgtatactcaactgcattaaaagcaaaacaacaacaaaacttttgagctggatgtagtggcccatgtctgtggtcccagctactcaggaggccaaggcaggaggactgattaagcccaggagttcaagaccagcctgggcaacatagtaaaacactgtctcagaaaacaaaaacaaaaacaacaacaaccttttttaaaatattttttttttcaaacttatacaaagcttacaaaaataaaaatagcacaaaaaacacctgcatacgctttacccagatttacccaaaattaacattcactccatttgccttatttttttcttactgtgtgttcctctatgtgtatgtatatctataacacacacatatataatatgtaatgttatgcatatgtgtgtgtgtgtatgtgtgtattttttttcctggaaccatttgaaggcatagccctttacttctaaacacttcagttttcttagggataaaaggttttctcttacctaaccacagtgcagttatcaacttccgaaaatttaacattgctaccatgctttatctttttttggttgaacttttaatttttttaattttaaatttttataattttaattttttatttccgtaggtgttcggggaacaggtggtgtttggttacatggatgcattcttcagcggtggtttctgagccatgctttatcttgtctaccattcacattgcaatttttgtcagttaacccaaaaatatcctttatggcttatttaaaaaactatagtacaggatctagactagagtcagatattgcatttaattgtgatgtctctttggcctctaatctggagcacttccacagcctttctttgtcatttatgacattgacatcttttaaaaaactgagcacaattttattgaatccttatagtccctgcccccaccccatgaggtcagaactattattattctcattgtacatgcagggaaactgaaacatacagagagtaagaaacttgcctgacatcacaattagtaaagttcagagctaggattcaaacctgtgctgttggaatctatacccatcaacttgactatcttagagctgcttactttcagtaccttcataacacaaaaatacccttactaatgtttttactgtatattacactgtacattaacatttttgaaaaatacagttccctctcatttaaaaaaaatttaaaataggacttcattttggttttgcctgatgttttctcaagattaggttcaggttgtttgtgccctgctggaataggacttggttaggtgtgtgcttctcaggccatcacagctggaggcacacagcatccgcccatgcctcattggcgatggtaattttgatcaccttgtcaaagtgctgtttgatttctcccctgtataatcactggttcttccctctctcttccttgtaaataacatatggtctgtggggagacactttaagaccagacaaatatcctgttcctcatcaaaatttacctctaaatttagcatctactgatgatttgtccctgacccaacctttactaggatggttggaacatggtgcttttccgactccaaccatcactcccccaacactgacctgtcaaccctctggattgtgctggaagtaagaccttccttttccctacccatgtactttctcatctattgattatcagtatgggctcatgactttctcctttaatggttagtaactttgtactgtacttattaggtgctgagattgcattttcgtcttctcttggctgtctcacggacaattcaaacctaacctgtccagagcagaactcttgatttcccaccccaaactaatctccctcctgaccttagtctttcccatcctgggaagtcatcatcatccacccagtggctcaagccagagacctgggtgtcatccctgagtcctccctttccctcagaccctcaactaatttgtaagcaagttctcttctggaattcaattttgttaaaaacgttaatgagctaaatggacagagctgaagattgaattagtgggctggaggagtgcttttcaaattttgttgcatattggaatcacctggggagattttaaagctcccagtgtctaggttgcatactatataaattaatcagactttctgggggtgggtccagacaacatcagtttttaaagctctctcaagtttgagtaaaagaggtttcccagaaggagaggcaaaaggaaaaataaaatatatagttgagggatctgtttgacagatttagaactttctatacccataggagatccaatatatatcctgacaccaacagaattttttcatgctatttgtaaaacagacccttgacttcctaaggaaaagagagtgtataagaatatttgaagtcaaagggaggctagtttccagttctcagatgtcagagtagaggttctgttgaaactttcttctcagtatgagcccccagacaacaaggagaataagaaacagaaatgtaaactcaatctttgattaaactaggaaacatctgaggcccagcaccacatttgaggaagggctgcccagtgaagagaaggtcaacaatgtggagtgaggatgctgaagatgctgtggctgcagcaatctgctccattcagcagagagtgcttctgcaaagtgagaggttcactgggtcccaaaccagcaagaacttacctgaaactgaggtaggagggaggcaggaccccgacccaggttgaagactggacaaagctgggaaaaggtgccaaaagcatgggtctttaagacacacccaccagtgccatgccagtttaccatcgccatggcgacacccagaaattaccaccccttgccactgtcaacacttggaacttaccacccattttctagctaattctgaatagcctgccccttaattagcatattatgaaagtgggtctaactgctgccctggctgctactctcagcacactgcctccctgctctgaaggagcactcatggagctgtaaccctgcttgccttgataaaactgccctataccaccgggtagctcttgaattcctccctgggtgaagccaagaacctaccctgcattgaaaccatgagaacagggtaccaggaccaagggcaataacttccctagacctatttcctctaggagaggctgtgctgaaagacagaatcttaggtaaactatctctgcaggagacattctgaggatgaggcagatggaagacagggactgaatgataagaacccctgtagttgccaacctcttttgagtggggagaaaacaacatatttcttgtttctgtcctttctactcccaacctctcaccttcccaccataccccctccaccccaacaagacacctgaccaaagatggcttcacagcagaattctatcaaaactttgaaggaagatatatgcagtgtccatagaaaaagaagaaaacacatccaattcaacaaaaacactgatgctaaaatatcataaaaggagcaaaaaaagagataaaattgtaattttacttattaatattggtgcaaagtttcaattattagctaatggggtccaacaatatgttggaaaaataaatcactatggtcaggaggactttatgccaacaatggaaggatatttcaatattagaaaatgatgagcatagattttcacgattaccttcatagttgctgataaggcatttggcaaaatctaatatacatatttgaccaaaaatgttttataaactaggaataggtaaataattttaaacatggtaaataaaagaaatatacgtatttcaaagttgccattatgctcaaagtaggagaaaatgagaaattttcttacagtcagaaataggaggaagtttctattgttttatgttattctggaagtatcaaatcatgcatgtagacaaaagaataaactgtaaagagagagagacatttataattattgttatatgattttatatctggaaaacccaagaaaataagctgaagagtaatttctaatgacaaaggaaattcataaagttggtgaatacaaaatcaatatgcaaaataacttgcctttctatatacgaatagtaaccagttataatggaagaaaatatcctgtttatgacacagtgacaaaatactcaagagtaaatgacaagacacacaagatctaaatgaagaggactttaaaatgctgaggtaaaccaaaaaaaaggcttggaaaacatgtaaatacatagtctatttctgtctagggatgattaaatatcatgaagatggcaattctccataagtgaatccataaatctaataaaaccctaataaaatatatcaataagaaatgtttgtgactaaaagtctacagaaaagtagacatgcaaacacagccaggagttttctgaaaaagatggagccacctgatggggctggggagtggggtggggccttagggaatagctctaccagaactgaaacccatctttaaagccacagcaattgaagcaatattgtactgggtatgaagaaacctacaaatcaatggatcagaatggagactccagaaatagacacaaacacatatacaaatatatgataagatagcattgcatattaatgaaggaaggtaggctgttaaaaataatgtttatactccagagagccatctgggaaagtgctatggactgaatgtttgcgtctgtcctccccaaattcacatgttgaaatcttaatcccccaatgtgcaattagaggtgagacccttgggaggtgattaggtcatgagggtagggccctcacagatggagttagtgtccttataagaagagacaggagagagtctgcttcctccccctctctccctttgctcttttctccctgtgagaatacagtaagaagatggtaatctgcaagccagaaagaggaccttttccagacatagaatctgcgggcaccttggtcttggcctgcccagactccagccccgtgagaaataaatggttattgtttaagccactcactctatggtattctgttacagcagcccaagctgatcaagacagaaaactggacccctgcttcacttcttatatgaacaaatggcaattggatccaagatttaactttataaaatgaaattaggaaagcataaaatttaagacaatttaaaaataactaagagaggtctttttaagtgttgcacaaaactcagaagccatagaaaagattaacaaatttaataatacaaataaaataattctgcatggcaatcagacaaaaatcccactataaacagagtcaaaagagaaatgatgttttgatggggaaacgatggggacaatatttgccacagaaattaagttatttaatataacaatgtgctctctcaagtcaataagaaaaagaaccaccatcaaagaaaaagagcaaagaacaagaaaaggaagtacgaatggttcttaaacatatgagaagatgactgacccactcataataaagtaaatgcaaatatggacaatgagatgccatttttcatctatctggtatcaaacccaaaagtttgatagcatgttgtgttggcggggatgtgcagggaagtatgtcaacatatctaagataagaatataaacagatggaacctctagcattgttatcagaattaaaaacacgtgtcagtgctctttgactatagtcacacgtctaaggatttattggacagatatgttcacatgtgtagaatgtatatgcatgcatacttcctgaaacattattttgaaaagtaaaatctcagaagcaagcttactgtctgcaatgggaggctggataaataacatggttttcatacagtggaatgtagaagaatgagacagttttatatatactgataggaaggatttacaaaatacatactgaatacttccataattgtatgctgatatatgcctaggatattcctggaaaaaaatggaagagatttcctctggggaggaaaactgtatagctggggaacagcagtgaaagaaagagggtgactttataccatgctttgtgaattttgtactctaggcatgtattacccatcttttaaaaaagaaatagccaaaagaatcagaagaggggcttttttctcaacctaataggatatattttaaagttatagaaatggaaattgtgacattgctatagaataggcaagtagattagtaggacagaataaactcaagaactagactgtgttagtctgtttgggctgctataacaaaataccatagcctgggtggcatataaataacagtttagaagaactgtttataagaattgtttctcacagttctagaggccaggaagtccaagactgaggcgtcagcaggttcagtgctggctgagggctcacattccctgattcatagatggtgccttctcactgtgtcctcacatggcagaagagaaaagggagctctctggagtcccttttataagggcacttattccattcttaagggctccactctcacggcctagtcacctcccaagcaccgtgccttctaataccatgacattggggattatgtttcaatgtatgaattctgggggacatcaacactcagaccatggaacagaccaatatacacatgggcatttggtgtgtgacaaaatggcactccagtatgtggggatagatgggtcagtaagcacagttggtctaattggttattcatagagaagaaaaaggtgttgaatccccaccttgcattatgcacgaatgtaaattcccacttgtttaaaggcctaaatgtccaaaacaaaaccacaaaatattttaaagaaacatagaagaaatatgtcgttttgactttggggtagggaagtccttaaaagacagaaaaagccctcccttcccaccccacaaaaagctgggtgaggtggcacctgaagtcctagctattctgaggctgaggcaggaggatctcttgaacccaggagtttgagtccatcctggacaacatggcaagaacccattcctaaaaaaaagaagaaggaaagaaggacgaaagaaaagaaaggatgaaaactcttcaaagtaatatatatatctcttaaatgtgtttgtgtgtgtgtgcgtgcgtacactgtgcatttatatttcaaactcataatagtggttcctttaggtaaggttgggcatggagagggattgggaatggtgggctttagctttacatgtaaagggctttaaaaattattatttaaggaatttatttttttattatactttaagttctagggtatgtgtgcacaatgtgtaggtttgttacatatgtatgcatgtgccatgttggtgtgctgcacccattaactcgtcatttacctaatgtaaaggaatttatttttactgttaattattgtcataatttgacactaatctttaaaaattttttttatagagatggggtctcactgtgttgaccaagctggtctggaactgttgccctcaactgatcctcccacttcagcctcccaaagtgctgggatgacaggcatgagccaccactcccagtctcttacctaaaaaataatagaaaaaatattcccaaactgaagaaagccaatacatctttagaataaaagagtctgttgagtgttgagcatgaacaatgaaaaaaaaaagattcaaatctaaatatatcctcttacaattttataatgacaatgacatgtagaaaaaatcttaaaagctctgagagagcagagactttcaattcatattgcaaatggtttctcccaaaagatgcagccaccggcaattttcaggagcctctggtcctaccgtgttcctcttgcccacctacgtttggctgggttctgtgggaatagaggccctttagccgatgtcccacctgcagaaagaattgctgaagccgcagtgagagggaggtcagctctgggtttggaaggtgataatcctccccagtctgctcctttggaatcttgtagtgaggtttctgtgtatccgggagcaggtaaaatgaaactactttgaacagaagtgagctgtgctgcccatcgtggggccctgaaccctcacaatagtgtttcttacttccctactccttcttgtagaccaaaacacctgatggttttgtaggattttccaaggtactttctttacctactctatcatcactgctgagagattttaaaatgtaagatgcaatcgaccacccgaagaatgtgtgagcctgtggcatagagctgggtcctctgtcttaaggctgcaatttcaggaatttcttaatgtatcttttatgtgttgtgatgatgaaagactctagtggaactccctgtttacacaaaatgtgacacttacaagtttccaagaaaacgccctgcctgtctggcaaaacggagctaccagaagacttggaatcaggcgaggatgcttctgatatgcacgttatccacaccccacgggacagagctctcttgccaatggttggcggaacacaggaaaggcttgttctggaagatccttctatctcaaacccatacaaacactctcagccctgctcaggctggagctcaggatgctcttgttgcagcttcagggagggggctcaatttcctttggagaagatgtctaaatcctcagaatgcagtggcccaatgctataaacaacatcaaacgtgaaagagcaaactagatataactgatggaggatgaatattattccgatatttattcttctggcaacggagtgtgaggggctcatctcactacactctcgtattactggaactacaagacataaaaaatgacattccgctttttttcgacacaaagtcttgctctatcacccaggctgcagtgcagtggcgtgatctcggctcactgcaacctccgcctcctgggttcaagcaattctcctgcctcagcctcccgagtagctgggattacaggtgcccatcaccacactaggctaatttttgtattcttaggagagacgggtttcaccatgttggcccggctggtctctaactcctgacctcatgatctgcctgtttcggtctcctcatgtgctgggattacaggtgtgagccaccgtgcctgactgatatcctacttttaagtgccattggttgagtgcctgagaagaaaacattttttccttatgattgttcctttttgttttgtgtttgtttcacagtctggctatgaggaaatgattgttcctttataaatcatgaattttctgtcatctgtgaattttcttttcttttttttaattttattattattatagtttaagttttagggtacatgtgcacaacgtgcaggtttgttacatatgtatacatgtgccatgttggtgtgctgcacccattaactcgtcatttacattaggtatatctcctaatgctatccctcccccctccccccaccccacaacaggccccggtgtgtgatgttacccttcctgtgtccatgtgttctcattgttcagttcccacctatgagtgagaacatgcagtgtttggttttttgtccttgcgatagtttgctgagaatgatggtttccagtttcatccatgtccctacaaaggacatgaactcatcattttttatggctgcatagtattccatggtgtatatgtgccacattttcttaatccagtgtatcgttgttggacatttgggttggttccaagtctttgctattgtgaatagtgctgcaataaacatacgtgtgcatgtgtctttatagcagcatgatttataatcctttggatatatacccagtaatgggatggctgggtcaaatggtatttctagttctagatccctgaggaatcgccacactgacttccacaatggttgaactagtttacagtcccaccaacagtgtaaaagcgttcctatttctccacatcctctctagcacctgttgtttcctgactttttaatgatcgcccttctaactggtgtgagatgatatctcattgcggttttgatttgcatttctctgatgatcagtgatgatgagcattttttcatgtgttttttggctgcataaatgtcttcttctgagaagtgtctgttcatatcctttgcccactttttgatggggttgtttgtttttttcttgtaaatttgtttgagttcatcgtagattctggatattagccctttgtcagatgagtagactgcaaaaattttctcccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttattctaaggtttttatggttttaggtctaacatttaagtctttaatccatcttgaattaatttttgtataaggtgtaaggaagggatccagtttcagctttctacatctatggctagccagttttcccaccaccatttattaaatagggaatcctttccccatttcttgtttttgtcaggtttgtcaaagatcagatagttgtagatatgcggcattatttctgagggctctgttctgttccattggtctatatctctgttttggtaccagtactatgctgttttggttactgtagccttgtagtatagtttgaagtcaggtagcgtgatgcctccagctttgttctttcggcttaggattgacttggcgatgcaggctcttttttggttccatagggactttgaagtagttttttccaattccgtgaagaaagtcattggtagcttgatggggatggcattgaatctataaattaccttgggtagtatggccattttcacgatattgattcttcctacccatgagcatggaatgttcttccatttgtttgtatccttttttatttcattgagcagtggtttgtagttctccttgaagaggtccttcacatcccttgtaaggtggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgctctggccggaacttccaacactatgttgaataggagtggtgagagagggcatccctgttttgtgccagttttcaaagggaatgcttccagtttttgcccattcagtatgatattggctgtaggtttgtcatagatagctcttattattttgagatacgtcccatcaatacctaatttattgagagtttttagcatgaagggttgttgaattttgtcaaaggccttttctgcatctattgagataatcatgtggcttttgtctttggttctgtttatatgctggattacatttattgatttgcgtatgttgaaccagccttgcatcccagggatgaagctcacttgatcatggtggataagctttttgatgtgctgctggattcagtttgccagtattttattgaggatttttgcattgatgttcctcaaggatattggtctaaaattctctgtttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggtgggtaagctattgattattgcctcaatttcagagcctgttattggtctattcagagattcaacttcttcctggtttagtcttgggaggatgtatgtgtcaaggaatttatccatttcttctagattttctagtttatttgcgtagaggtgtttatagtattctctgatggtagtttgtatttctgtgggatcggtggtgtatcccctttatcatttttttattgcatttatttgattcttctctcttttcttcattagtcttgctagaggtctatcaattttgttgatcttttcaaaaaaccagctcctggattcattaattttttgaaaggttttttgtgtctctatttccttcagttctgctctgatcttagttatttcttaccttctgctagcttttgaatgtgtttgctcttggttttctagttcttttaattgtgatgttagggtgtcaattttagatctttcctgctttctcttgtgagcatttagtgctataaatttccctctacacactgctttgaatgtgtcccagagattctggtatgttgtgtctttgttctcattggtttcaaagaacatctttatttctgccttcatttctttatgtacccagtaatcattcagaagcaggttgttcagtttccatgtagttgggtggttttgagtgagtttgttaatcctgagttctagtttgattgcactgtggtctgagagacagtttgttataatttctgttcttttacatttgctgaggagtgctttacttccaactatgtggtcaatttgggaataggtgaggcgtggtgctgaaaagaatgtatattctgttgatttggggtggagagttctgtagatgtctattaggtctgcttggtgcagagctgagttcaattcctgggtatccttgttaactttctgtctcgttgatctgtctaatgttgagagtggggtgttaaagtctcccattattattgtgtgggagtctaagtctctttgtaggtctctaaggacttgttttatgaatctgggtgctcctgtattgggtgcatatatatttaggatagttagctcttgttgaattgatccctttaccattatgtaatggccttctttgtctcttttgatcattgttggtttaaagtctgttttatcagagactaggattgcaacccctgcctttttctgttttccatttgcttggtagatcttcctccatccctttattttgagcctatgtgtgtctctgcacatgagatgggtttcctgaatacagcacactgataggtcttgactctttatccaatttgccagtctgtgtcttttaattggagcatttagcccatttacattcaaagttaatatcgttatgtgtgaatttgatcctgtcattatgatgtcagctggctattttgctcgttagttgatgcagtttcttcctagccttaaaggtctttacaatttggcatgtttttgcagtggctggtacccattgttcctttccatgtttagtgcttccttcaggagctcttttagggcaggcctggtggcgacaaaatctctcagcatttgcttgtctgtaaagtattttatttctccttcacttactaagcttagcctggctggatatgaaattctgggttgaaaattcttttctttaagaatgttgaatattggcccccactctcctctggcttgtagagtttctgctgaaagatccactgttagtctgatgggcttccctttgtgggtaacccgacctttctctctggctgcccttaacattttttccttcatttcaactttggtgaatctgacaattatgtgtcttggagttgctcttctcgaggagtacctttgtggcattctctgtatttcctgaatttgaatgttggcctgccttgctagattggggaagttctcctggatgatatcctgcagagtattttctaatttggttccattctccccgtcactttcaggtacaccaatcagacgtagatttggtcttttcacatagtcccatatttcttggaggctttgttcgtttctttttattcttttttctctaaacttctcttcttgcttcatttcatgcatttcatcttccatcactgataccctttcttccagttgatcgcatcggctactgaggcttctgcattcatcacatagttctcgtgccttggttttcagttccatcaggtcctttaaggacttctctgcattggttattctagttatccatttgtctaattttttttcaaagtttttaacttctttgccattggttcgaatctcctcctgtagctcggagtagtttgatcatctgaagccttcttctctcaactcgtcaaagctattctctgtccagctctgatccgttgctggtgaggagctgcattcctttggaggaggagaggtgctctgatttttagagtttccagtttttctgctctgttttttccccatctttgtggttttatctacctttggtctttgatgatggtgacgtacagatgggtttttggcgtggatgtccttcctgtttgttagttttccttctaacagacaggaccctcagctgcaggtctgttggagtttgctagaggtccactccagaccctgtttgcctgggtatccggagcagtggctgcagaacaacggatattggtgaactgcaaatgctgctgcctgattgttcctctggaagttttgtctcagaggagtacccggccatgtgaggtgtcagtctgctcctactagggggtgcctcccagttaggctactcgggggtcagggacccacttgaggaggcagtctgcccgttctcagatctgaagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgcactccaccctgttcgagcttcccagctgctttgtttacctaatcaagtctgggcaacggcgggcgcccctcccccagccttgctgccaccttgcagtttgatctcagactgccgtgctagcaatgagcgaggctccgtgggcgtaggaccctctgagccatgtgcgggatataatctcctcgtgtgccgttttttaagcccattgggaaagcgcagtattagggtgggagtgacccgattttctaggtgccatctgtcacccctttctttgactaggagagggaattccctgacccctttcacttccagggtgaggcgatgcctcaccctgctttggctcacgcacggtgcgctgcacccactgtctggcacaccccagtaagatggcctggtacctcagttggaaatgcagaaatcacccgtcttctgcatcgctcacgctgggagccgtagactcgagctgttcctattcggccatcttgcacacatgttctcatctgtgaattttctgtccatgtcctttgtcatacacctattgggacatcaatggattttgctgttgttggtcacttggcatgagtgcattcaatacaagtacacttggcctgtcatatatatggaaaataattttcctaacttgcctgagttaaaatttggttgttgctgtattttgtcttgcagaaacctccagttcttaagtgatcatgaaacctgttgctatttccttttaaacatatttcccctattccttttgtagggccattccagaggaaagagcttcttgcagtagactctttctgaaaatgactgacttctctgcaagtcaggcaacaataatgatatagttcctaacagtaagtgtcaatgcacttcatctgatttgatgaaatttgggggcaaggacacagtggcataccaagggtaggtggtgggaacagcctaccctgcatgcaggcaataaaggagtgccttgtgtgtagcatcattaaaaacagtaataaaactgactacacgttggtcagctttttattatcactatatgctggttattctaagcaatgtccgtgatgaagtacttactccttccccccaaaccatttattagtctaagtcctaaacagttgctgctattagtgttgtcttttagtgatatatgtccaggcttaaagagtgcacattttattacttatgttttaataagtatgtttaattgccttctacatggaagttaatttggaacacctccaattacacaggatataagcagagtcagttgcaggctggttccaagagtcagtttgcaagggtgacaattcagaattgttggcgctcacttctggggcagttggttccttgtactccggatctacgccgtattcctgtgttgaatgagtagggtggaaatgaatgaggctagctcggtgaactggattcacttcagttctgtctgtctgggtgcgagccagtctctaaagctttggagttcactcttttggaagtgtttcttcgtgcatgcccccacttaaaaaaaaacacattagggtaatgattaatccatgactttttaatttttgtattgtaatatttattttgcttttattaaaaagtttttacaggcaaaattatatatacaaagttcaatcctgctactaatttctctggccattagtattcatttcatttcattatgaccgaagatgatttcattgtatgtggggatgttgaaggtaatctgcttgaaactaatacaacagttgtgccacagcaggtgtgtttcccagtcttcaccacagggccttgtcacatgcaagctggaagagcaggtggcaggtatggttgtgaagaagggatggccagcaggactggctggtttctcatcattcgacttccattcaatgcaggtcaactctcctggggttgtcctgagcaatgcctccagatccgtgttgacggtgcctacttggccttgggggacaacccactgaatacacaagagtgtcttctgcaagcagccctgctgcccctccttgtcggatgtgttctttcctgctgctggtaggcaggtggggctggctcccctcccctggtccaccagcgagatgcgtcactgtggtctctctccatggtggccggtgacaggctgggaaaaggcttcctccagctgctctcggcctggcagatgcaggagatgcggtgccccttgagcctcgtggtgttgttgtctttgttacagtctctgaggactcgctgggccacaggcaaagagagagcaaccatctttttctgtcccacaaaactgctgacatggttttgacactgtctggagtcataacgtcaggctcacttggcgtaagcacctcaacttgaagagcaagtgggaaggagggcatcaggtgcctgtgtttagtgttggttcagttctgagttctgccagtgattttgagaggtgaagccagctggacttcttgggtccagtggggacttggagaacttttccgtctagttagaggattgtaaatgcaccaatcagcactctgtaaaaacacaccaatcagcgctctgtgtctagctaaaggattgtaaatgcaccaatcagcactctgtaaaaacgcaccaatcagtgctctgtgtctagctagaggattgtaaatgcaccaatcagcattctgtaaaaatggaccaatcagcactctgtagaatggaccaatcagcactctgtaaaatggaccaatcagcaggacatgggaggggccaaataagggaataaaagctggccacctgagccagcagcagcaacccactggggtcctctttcatggtgtggaagctttgttctttcacacgtcataataaatcttgcagctgctcactctttgggtctgcactacctttatgagctgtaacactcatcatgagggtctgcagcttcattcctgaagtcagcaagaatcatgaacccaccagaaagtacaaactctggacaagccacctttaagagctgtaacactcactgcaagggtccgcggcttcattcctgaagtcagcgagaccacgaacccaccagaaggaaccaactctggacacaatttcaggagggtcggcctgaggttgttaaccctgccacagttccatgccaccgggaggagcctcaggagctgtccagttccagaaagagactgcttttttggagctgatcgcaaagatgcttggagtcaagggaactgattttgttatttagagatgggatcttgctttattggtcagactggagtgcagtggttatttgcaggcacaaacatagtgcactacaacctggaactcctaggctcaaacaatcctcttgccttatccttctgaatacctgggattccaggcacgcaccatcgcacacagtttattatattttgacatcttaaaaaaccctttctggctggggagacactggctctttggagctagtcaatccttagagacagcaagagggcatgcctttgatatgcaaactacccaacccagggcatacctcatccatctggcccgcataccccaggaggctatgttcctctgcctaatcaccccagggccaggtgccaggcagctggagaccgccctgacagcccaaaacccttcaaaattatctactctagcccatcttaagctgctcaccccaccctggctatcccaaggagactccaacaaaggccgtggtccaagctcatcctgcacccctgcgttctgcctcctgaccaacactggtgcttcccctgtggtcctgcttggtatgtggtgaccccctttctggagcctgtgagtgtaatggacttcattgtcctgcgcctctcttgcatctcctcttgtggctgtacctgacctgaccattgcttgaaaggacagagcagggaggctgaaaacatcttcgctgtttgcctcgggctcatacctgttccccttgggtgtccttttctctttctccagccccaggttgatgagtgacccattcatgatttgtgtcctgtgctgggcaacttgatcctcccgcttcctgggaaggtgatggtggttatgtcaccatagtggagatgtggcagcaaacagattctcacaaatgtgaatcattcttggcataactttgatgtcacataataataataatgataaaaagtcccctttcccaccagaggtgagatataaaaagcaaaacttgagtgaggatggaataacctatcctgccatggtatagtttttgcttaagcaaagttctgttgaatgaagacttgtttgcttcttggttcttaactgggtctcagactatgcatgtatgcatgagagacggagagaactagacacacacacacacacacacacacacacacacacacacacacacctgtccacacagatggcatcaccattaaagtcaggcaataggacccttgcctgggttccctttttgagaaaggtgctccgtctctcctttgactgtgccctaaaccacattatgaggaagctgaagggccaaggagatgcactcataggaaaccatgcttgccctgctaggccacattctgggcattggggtcctgaaacactgtgctcgggggggccctgagcctgcttccagagcttgcatgggcttctctcctgggcttgtcctgaagggaactcctcattgttggtgtgtgcaccctagatccagtggggccaagggcagctgctgcggcagaaggggatgggagaggaacatgcgagagaagcagcaggctggcaaggtgaggagggctgaaggctcatacctacatctgcaacctcccctgggccacatgtactggtatgccagggatacagggcagtgtgcccctgcctgcctcgccacatgactttcttagagcagttgttcaacaggagccctgattctgaggatattttcccactagactctctcattattgagtactttcctgcccaggggcccatcctcccagcacttggattccaatgtggtttgtgggaatgattcatgtggcgcctaataatggagaaagccgtggtttatggtttagttttgtctgtcaggtaaaggtggagatagtgacacacaggaaaaagttctcaccaaagtctccaaaggacactgggccaaggcccctctctgcatctcatcttcacatggaggagggggtggccctgcaagccatggggaccaagcagtgcctcgtgctcttcccaggtgagtgtcaggagggctggggatcagtggccgcagcagcaacccccatgctccctttctggtcccttcacacgtccatcttttttcagctgttgaccatgattgatgtgttggactatgtttttttggttgtgcccctggatggttggttttttgagatgtggggtcagtctcttaatctcacttgtctaacaagaagatccaaacaaagaccttctccttctgggttcaaatgggacgtctattcaatgcacactctgcccctctgacatgcagtttccctcccacgtggggagctccagcccgaatcactgaccccacttcctctgaccacacgctccctgactgccagtgttccctgcctctgttcgccaggctccacactccaggctggaggccttggcttccccctcggctccctgcaccattgagccagtggcagcaagtagcttcatcagctttattggtggaggatccaggggaaggctgtttaactcccaggccaagctctttcctcctctcctcttaggcaaagatctggggcactagctggccacacatgggtgatgctgcctaagtcacttcttgaagcactgggttagactggtccttcctgtctacctggaccttaggactcttccccagcaggatggggttagagggcccagcgtgaccgaagcattgggagggcaggaacaagttagtggtgtttgcctctccctaaggcctggcttacacttggagaggaccagcctttgaccctgcacagcaggctggggttctgcaaacagccccgaccccaagatggatgttcagtgtgtatctgcccccaaactcccacaggcctcagaaaaccgagggctgcctctgggggagcaggctttgggcattcctggggctgtccctccgctctgccacttaacaaccgtgtggctgtggttgagtgactcagctctctctgtaaagcagggatggaatgagtcctttgaatcagcatggggaagatccagtgagcttctatatgcccagcgcatcacaaggtcttgggaattagtggttagtactgttgttgctgccattcatccatccctcttgcaattgttagtttactttctgtcttccccagaagctcctctctccatatctgtgccgtccgcttctctgaccccagaacccagtgtcaatacatatggctggatagatggttgaataaatgaatgaatgaatgaatgaatttattgttatggagattaaatgagacgccacaaaagctccaggaacagaatgactttttatctggagaaggcaaggggacaggccacaggcagcccgcattgaggcaggcccagggagacacatgaggcctgggttgcagcatcacagcacagcgcgggagagcccagtgctgctgtggtgaaggtgtccaggtgggtcacctttgctggtggctctttacttccgacttctgtgtgtactcaccttcccagacccttggcctccctgggagagctgccctcctggacctgagcagtgggtgacagccgcacctgtccacagggaaaatgttgtcgattttctgtcagtgtgaactctcacatttacatttttgccaagctgaaaataacagtaacataaacacgcctccatggccctgtcctctctgaagggagaggagaaaaaagtgcagcccactccagaaaacaatgttccctctgttagcagacacgggcttctgtttaagtccccagggcccccacggctgcagtggaatgagctgggcccggcctgctgggtgtaccggctgcctgggcagcccctcccgaggccagccttgtttacgaccgtgggagagggggccgctcccagcccagctaggcacccgtgaggcactgaccagccagccctgtgggaacccagggccctgaatgcctcccctgtgcagaagggtcagtgctttccaaccctctgccctgtgcactgtggtcaagggcacatcatgtccccaagcacagagtgtgctcagggtcctattcttcacaacagccttcctttcactgcctgctcagcaagcagaaaaggttaacatttccatcttccgtcctaaggagatgcctgctgggacttggtctcaggcatgagtcttttcttcctccttcctgggaggggttggaactaagcctcaaagcagagtagctgacaacgtggcgtgggagaggcttggatgtgtcgctggagagaaacattcttgccacccccaccctaaagaggctgcggggacaggcagcccagccctcctggcctattttcgggctggagagaggttcagtctcaggcacagttttgggaggcagatcagcctccctgttccggcctcccactcccatggagctctctgctgcctcttccaaggggccgcagatacccgttccttgctctatttcttcaccagccctacctgttctcagtccattacctcatggccctgctctctgcttactaaagtgacaattcgtctataaggaagcccttgcactgtagctgaggattcgcgaggctgcaccctcagcaggcactgtggccacacagcactggcctgagatctgagttcctggagcctcggccctgaggcccatggtgagtatctctgtagctactcagccagcctgccttggcctggtgatcaataacctgggacctttcccccagcaccagcatctgtgagctcaaggaagacatctgaacttcttgatagcagggcagggccaaaccatctactgaaatcatcagcaaaagtgaggggaatgcaggactggtcgctccagaaacttctaactttttagctagatgtaaatcatcgcacagcttttgctgcaatgtggacattgtgaagggtgttttgcctcttttaggggtgcaataaaaaaggaaaaataatggaatgagaaaaaaatccaaaaaatggataaaaatctttggtcaagtcctgtaaaactatgatcttagttctcagagtctatgggaaacacatcacagtgggtcgacttatttctgtctccaaccctagagaccatctcgtgtaaaaaaaaaaaattttgtaaaacaagaagagttagtcttattattcagtataccacaattacttgcttagttttcattttgttgagctgcttctggtttaaatataatatatatatttgaagtcttaatagccattgtgatcacaaaactgctggcaagttttatcaaaacccttaagacaggcaaacgtgaggctcttaaagagaaaatcctcagtcgccccctcatttctaatttatctagcacagtcagtaaacatgtctttcagagggaactgaagacaattagaaataaatcaagatacaaatgaattcaatacttactgttgtatagatcagcagctgtcaaccaaagggtagctttgcctcccaggggccatttggcaatgtctgcagacatttttgattgtcgcagcttggagaagaaaggctgccgctagcattcggcggtacagactaggaagtctacaatgctcagaatggcctcccacaacaaagaattgtctggcttgaaattccatagtgtcaaggttagaaatgctggtatagaaactatgagagacacaaaacggcataaaggcataattactgcgttttaggaatttgcaagctaacttgttttcaaaatgctacataatgaaaacagactttaatttctcgtatttatttcccttgctctggtccctgtttgagatgtatgggaaagccaggagtcccgcgatgcttctgagtgaggcattctgggtagcgccaagaagggcagtacagggacattggtgcatgggccacgggcagatggcccttgctgggctcagctgttcactggaatgtgcactattcttggggtgacagtgaatgactaagccattttaccttcagggggtctgcagctctgaggccacccaaggacaccaaaaccaggccaggaagctctagtggggaaggtgatgagagggggggcgtcggtgcacagagcggcaccgtggctgcgtccaagtccagtcgggttttggaatcttgtcctgcgtgtctgtttgtgattctctcactctcctctggcttctggacctaccatgttctatggagcatccaaaactggggagctgacacctcagggccagccctgcactctcatttctggcgtataccacagtgggccttacttgggaggcattcggggcagggcccagcacagacgagattctcagaatgtgtggacgatggcactgtagttgaagaggggagtcctcgcttctagagctccacgcctgaatatttacaatgaaatgatgtgatagccgggatttacttcagagtaacctggagtgcagagacagaggctaggcgatgggaaacgagaatggccatgagccttggggatggcccatgggggtctgatctacatctgtctctgctttcgcatgcatttgaaattgttcataaaaatatctgttaaaccatacttgtccctccaaggccaaggcatggtataggggccaaggtgagtgaagaggccccggttctcttttggagagaattacttggtttggaatgagagtttttaatatctccctgttgatctggaagagtggggctcctgtcacgggtgggtaggggacccagtgccagtggttaggggaggctggaggctggctgggtccatcaggatgtgctggtgaggacgcggctcgggccatcccctcagagctgccctgaagcaggaggccttgcaggggtttgaggaggccgagtctgcactcaagaggttgcaagaaccaagctgccctgatgccggggatgggccccaggctgaaagcctgagcacaagccaggcctgaagggcactgagcggccagagctgacggcacttctgaggggctgaatcagagtcagtcccaggagagggaagaggatgaaaggaatcaggagggcttgtttgtgctttaagcctgtccacaagaaccaggagatgggctcctgggatttcacaattcgaggtccgtctggtgcctcctgcatcctctgcacttgcacattgtgtgacatatgaaagtcggaagtgacctgaagacacgtgcaccacaagggatgctgtggagacgccctacagggactctgatgtggggggcatttccgatttctggggcctggcttttagatgaaggcagcagaaagttacctaaagacagcaatggagaggtctttagtgatccactgctgtgtaataaaccaccccgaacttaatggcttgtaacagcaagcatatattccctgccatgtttccgcaggttgactaggctcagctgggcagttcttggctggtctcacttggggtctcttgggaggttgcaggcagaatgcgcctgggctggagtcctctggtcgctctcccagggtcccagaacagctgcctgtctacgtggtctcaaggccttcgctccctatatggcctttctatgcagtgtctccatgcagactttctggtgaagggagctgggggcttctcacatggaggctcggggctcctcaaagtgcagaaccagaagccttcttaacacttagccagaagctggcccagtgtcacttcttcctccttcctttggttgagctgttgtggccagctcaggtccagggtagggaagtaaattcttgatgggagaatgacaaggaattgtggccatcattaatccaccatagggacccagtctggagcctgcacagaagtggggaagctgcggccgtgttaggtgatgccgtcttgtagacgcgggagatgccagaaccgctatccctggctccttctctgtgtcctcgctgacttgaacaagcaatgggtcattgtaacatcttcagatgcctcttggcttcatgtcatcagctataaagtggcatcacagtgatatctctctggggccagccctgggtccacctgccaaccacctccctgtgcacagttcttggaagtcattcattcacctgaccagacgctgaagccagacccgtccccacccactgaggccacctccgtaaggtcaggttgtggccatgtgctgggtcatttcactcccttctgggctcacaggaaggaaggaggtctttgcaggggcaaatggagcaccacctcatgtctgctgcacctgctcacatcctctagctcctcctcccagcaaacctgcctcaagggcacacagagtcctggtggagtcaagactcgagtccaggtcctcatacagcaatgccttgtcttccctgcaggctcccaggggcaggcaggtgggagatgggtgcacagggagtgccatcgtccccacacccagactcctcagggattctctttcctcagttacaaagagtgctggctctgctagccaggacagatgttagcaattttcaaggagcaaacatttctcatttcatcttaccttaatcaagttacttgggccctatccacaaaagtgtctgaggaacagatgactgaagaagggtgacagctgctgctggcctggtgggggcctctgtgcagtgaatggctggctggctgctggatgtggcgtggcttgctgatgggcatgaatgtggggagcgggagcctgcctctcagcttcctgcatctggaattgaaattggacctgtttgcaggtcagtgtgccctgggggaactgccattctctcactctcctctgggtcctggctaccactccagcctgtcccagtgcccatggctgggaaaggaacacccaggacatcgctggctcagcccacactctgtcacctctctgccacattctacacaccgtgggcccttttgggagactttctgggcaaggctttaccagattgcatttaaaaataatctttcaaatatgcttcaccttcaaagccaggctagagatggagaggcataaagcgtgaccaggaggattcaatgttttcttggagagtctgatttgatttcagtgctgagtaggaggagaatgtcctgcagcccctctctgtttcaccttaatttgtaaggacaggggtgtttcttcccccccacagtgcctagacctttgctaagcacagttggaatcagcaaacatcaagaagcactgaagatgcacttgctgatcgaaggtaattgctctcgaccttggccgaatactaggaaactttaaaaatcatggatgcctggctcccacccccacattctggcaattggcctggagtaggacccgacagaaactcccctgtgattctactgtgcaggcgaggtgaggcctcctgccccgatgcctgctcctccgctcctaccagccctgctggattgagcctgactttgcctcagctcgggtgtgctcacaggggtgtccagccagctgcctcttgtcaccaccatgacctggacaagccctgctgcttcccagtacattcggacaacgggaccggaggaaagaggatctcagttggagagtccaaggtgcctcaaatcaaaagataaaacttgcagatggctgccaatggctcgggaagacaccgctaaagtcatgtcatgccataactgggactgcatctgtgagggaggagcatgaccttggaggcagaaggtcaaggtcaaggctcacccattctactccatgtgcttggcttccccatctccataaatggcagcttcatgttttcagtattgcaagccagtggacttatggtcatctttgattcctctttctctcacatttcacatctaatccatcagcaaatcttgttggctccacattccaaatatatccggactctgacggctgctcaccacctctgctagcatcttgtcaggtctgaattaccgcaaccacctcctaactggtccctctgagtccatccctggcccgtcacagtctattctcatcgtggcacccagagcagtcctttcaaaatgcaattcggagtatgtcacccttctgttcagaaccttcactggattctaaacttacatcgtgggacatcccaaatttttactgtaatctctaagactggccaggtctggtgcctgctgtctcctgggctcattttctgctgctctcctcctcatttatgccaatctggccaccccagcctccttgctgttctctaagattcccacggtcccactgcaaggcctttgcacttgctgttccctctgagtagaacacccttcttgatatttgcacagctcactgccttccttccttcaggtttgtcttcagttattatcttatcagagaggcctccctgtgtaccttacttaaaatagtgtcccctaaccgaattctaacgctttttttttttttttaattttttttggaggcaaggtctcactctgttgcccaggctggagtgcagtagcctgatcacagctcactgcagccctgacctcctgggctcaagcaatccttccacctcagcctcccaagtagctgggactacaggcatgcaccaccacacttgcctaatttttgtatttttttgtagagtcggggtctcactgtcttacctgggctggtctcaatctcctgggctcaagtgatcctctcaactcagcctcccaaagtgctgagattacaggtatgagccacctttttcctttcattctcagaatctgtcaccacccacatattatacatttacttgtttacttgcaggctctttcccctagaatgtgtgttccctaagagcaagttcactgtggtgcctccagcacccaggatagtgtctgaaacacagcaagtgctcagcaaatatttgctgaatgcatgagtacatgtatgaggaaaagcagttgcaaagaagattccagggtgggtcttttgggaggtcatgtgaaccagaccttaaaagactgagggtgagcatgtaggggtggagcgagaggcttttccagaaaaggggataaacagctgtcaagttggtcaggagctcaggccagcggtgggagtgtgggtgtgagtggagcatctggatggagctgtgcgcgcccagctcatgaacccccctcagagctactgaggctgagctgatgtgcttgggagccctgtgcagccaggagaaggcactgcatgggcgtcca

SEQ ID NO: 96 - DNA, 10280 bp, Homo sapiens
  source 1..10280: mol_type = genomic DNA
agaattcaggagagttcatgagtagagagagttttaattccagttcaatagtgatgtccaaaaactaaaccaagaattcattttccttcttttttttttccagacaggatctcagtctgttgctcaggctggagtgcagtggcatgaatgtgactcactgcagcctagacctcctgggctcaagcgattcttctacctgggcttccctcccctaaatgtttgagtatgaaataagtaagcaatttcttattcttaacagtatttagcctgtacaactccttgatggaagaagttccacttttaccatcaacattaaagtggcagagtaaagggttgcctatttgtttctcagaatctgaaataaaactagaagatttcaagcagaaaagcaatgaaggcgtgcaatgctaagttccactcactattaaaacagtgaaattgtcaggtgaggaaacggagagctgccatcaagacactgtgcaaagtcagtcttcacaattgaaagaaagctaagactaggtttatgagatgagagtttccaaaattctaacctcaacagttaaatgcaaactgaaagcaaaccttctaataagtgtggtttcaccttaagtaggagtgaactgcacagattttaaaaataaaagaatataaaagaaaaaatcagaacagagagcacttaccactatgcagaatgttaagaatgaaacaatgtgcggtagccccaaaatcattgtatgatgaagtattaaaaaaggaaaacatacaaagaaacaaaaagctagtagtaaaaaaggaaatataaaaacatccagaagtaaaatgaatataaagaataatcagaaagtaaatatataaaaaggtaaacacacaaattagctgtagtcacactaaaaattgatgtggaggctgaagttactagtaatataaaaacatgactataaaaactgtctatatagataaaactggtaattcctatgtgttttgagtaagagagggaggcctcactattcagtatatactaagcaatactatattctaggaattagggatgtaaaaaatagttcctgaccttcagaattctagtggggaaggcagacaataaacaaaaatataatgtaatggtagtattatagcgtgacgaaatgcagggtaaggtgacagagtgacaagaaaggctatttagatataacctgggacgacctctttcatgcggcttttgaacagaaagagactcgaataaaatgaagaaaaagccacaggacctggagaaaagagcattctggactgagggagaagcatgcttggcgtgttcagggaacaatgaggcccaggtggctggaggggcatgagctaggaagagtggtaagagatgaggaatccatcttcgaagggccctgtaggccacagtaaatacctacgacttttttccagtgtgacaagaatctcttaaaaagctctgagtagcggagatacctggtctaacttacattgcaaaaggctcatccagaccgccaggtgaggcacaaagtttaaggaagttggaagaccctgttacaaggctactgcggtattccaggaaagagaatggcggcttggacccaggtggcagcaagaggaggtgaatttagagtgagagaaaacaatatgctgatctgattgtatgtcaggtgtgagggagagttgggagcctccagtaatttgtcgatttcagtttaggcactggtttctgtggagcttctgctctaagctgtggttctctgtattcgcagtctgtctcaccaatttgggggacagcaatttgccctgtgacctcgcttctctgacagatccaagaggagttgttgatttttcagtttgttcagtttttccttgttgctaggacaggtggtgacttccaagctcctcatgcgctggatcacaaagtaaaagtctaccgctttttgtaattttcttcataaaacttttaaatatcttttattagatttcttgcaagatactccgtaattttttttttttaagagatggagtctcactctgtcactcaggctggactgctgtggtgtaatcacagctcactgctgcctcaaactcctgggctcaagagatcttctcttctcagcctcctgagtagctagtactacaggtctgtgcctccacacctgattaatttttttatttttatagagataaggtcttgctatgttgcccatgctggtctcaaactgctggccttaagcaatcctcccaaagccctgagcttacagtcatgagccaccatggctggcctgtaatttcttcatgttataaatgacatctttaaaattatattttccaactctttatgtctgaactaaagaacgttcaacaatggaatcaccttgctgactctcacattaattctaataatgtttgtaaatgatcttggcttttcctatgcaaacaatcatataatctgtgaatgactgcatagaaggatgtgcagtaggctgaataatggccctcccaaatatgtccacatgctaatcctcaaaatctatgaatatgttaccttaggcaacaaaacagtattggtagatgtgacaaaattaaggacttggagatgtggagattttcctggattatccaggtgggcctaatgtaattgaaagggtccttataagagggaggaaaaagggtcagagtcagagaaggcaatgtgacaacggaagcagaggctggaatgatgtgctttgaagatggaagcagaggccacaagctaaggaggaaacattctcccctaccgcctcagaaggaacaaagccctgcagacaccttgcttttagcaccgtaagactagtttaggacttctgacctccagaactataagataataaatttgtgtttaagccaaaaagagttcaactttaaaaaccccataattagtataattctgtttcagaatatcttaaatacaaaacttaacgtaagagaatggataaaatgacttatgaaagattgactcgaaatgcactaaatcatataactaagcaaagccaggtagacggttgacagctctctgacttcccctacttcccaggaatcctcgaaagcaagatcagttagagaaaaatgacagacagcagtcaatggacacctctttcagcccctgtattctaattatttcttacctcatccctttcttacattttgtatggacttgggtaactcctggcctaaaaatactctagttttagtactcctattctgggaagtgtgttataaattatttgcctacaaatagtttattggctacaacagcacagcagcacttgaaacagaaatggggctaagatatactttaaaagtcaaattcatattcctagcattataaatgcatactctaaaaggctaaaatgctatactccatcttcaaaaataacttagagactaagaaaatgtttgcggtgctatctctgcaaattttcctaacttctttatccaacactttaaaataccgtgttcctggcttcgaataactgtcgcctaatcaaagcccaacaatccttgatctgcattcttcgggctagtgcagggtggggaagaggagctttcattacaatggcaacggctaccggctcaggtgcaaaagagaaggagcaatgcaagagggacggctgaaggtcaccggctcgcggacacaggactaggggagacctggggaaggctcagggtggcacggcctcgcggccgtgggaggcaggctggcggaggacagggcggggcggccgctcacccacctggttggtgacctgaaacggaagcagaaacacaatttagagaaacatctttcttgctccagagcctcgctgcccactctccttccaggttggaactcacatcggacttagcatccagcggcggctcgctggacgcctccatgggcagcgtctgggacttgcggcccggactcgagagaacgcccccagaccagcgcttccgcttccacgtcctgcccctagcggcctggcgcatggggcggacgtagcaggggaagctgaaaaaagcatctttatgtgactcatattttttcttaattcaacatatatcttaggagacattgagctaaaagaaaattattttatggaaaaaggccaaagatttgggagatactttgagaagagaagcgctaattaaatttaggatgccgcttcccccatctaacagtgacacgtgggctcttccagactggagcggggcggggcacagcatcccgctgcgcggctcctcaatcccaaccaaattcggaaggcgctgggcgaccgcacccccggcacatgggagtttgtcctgcaagggaaggctgtgggaaccacagttataggatgagctgcttcgctggcctagctgtgggcggggcatgctttccattatccctgctgttcctcttgaatcccagccctcagtctggctgcggaataccttcccatcttgtcttcccacctctttcctattgacctcaaatccatcctacaggaagtatccacagtgatgttttttccccgccaactttgtattttgaaaaatttatttttttcagaaaaattgcaaaaaataattcaatgaacacctgtatacccttcatctagattcaccaactgttcgcattgtacatatttgctttatctcggcttgtattaaggatgatacttcactcctaaatgcttgagcatgttgtctcctaagaactagggcattcttctaaataaccacaattcaactatcacattcaggaaatttaatattgataaaatactattctctaataaataagtcaaattaaaatttccccacttgtttaaacaatattctttaaagttattccctaccccatccacaactagaatctaatcaagggccgccttgaatttggtgatcatgtctctttagtctcctctaatctagaactgcaccggtaaacggtcagcaggactgtgttcctcaatgaaggttccggggtggtggggtttgggtgggggacaggggtgggatctgctttcagcctcaattcaggttgttggcagagctcagttctgtgcagtttccttgctggcttttagatggggactcccagctcctagaggccatctgcattccttggcttgtggctccttcctccaccttcaaagccaggaagggcaggtcaagtcctcctcacactttaaatctctctgatctccctttctgtatgatctctcctgttcctgttccttcttttgccacatctctctgactctagcctgaaaaaattctctgtttctaggggcctaaaaaattattagatcaaatataaccaaacaattaactttttttttttttgagacagagtctcaaaaaaagacactcactctgtcacccagactggagtgcagtggtgcaatctaagctcattgcaacctctgcctcccaggttcaaacaattctcctgcctcagcctttttgagtagctgagattgcagacatgcatcaccatgcctggctaattttcatatttttagtagagatggggtctctccatattgggcaggttgatctggaactcctgtcctcacgtaatccacccacctcgggccttggcctcccaaagtgctgggattacagacgtgagccactgtgcctggcctctttctatcttaaggtacataaattttaattatatttataaagtcccttcagatcagtacctaaattagtgtttcaatgagtaatcaggatggaaatctttggaggagggcatttttagaataatgcttaccttaaataccctcatagggttgttggagaattacattagttaatgcatgttaagcacctaaaaatgtccctggcatgtagcactcggaaactaggccaaaaaaccaaaaaacaaacaaaaaaaccccccactgactcaaggttattggacgtgattaaatgtactaattagcttgggaggatagtccctgaatgaatcagacgatttcttctctaaggaagtcagatgaaaacacagaacactgctgtgcatccagctggtcagtgtgtcggttctttttgcaaggaaatctttttttttttttttttttgagacagagtctcactctgttgcccaggctggagtgcagtggcgtgatctcacctcactgcaacctccaactcccgggttcaagcgcttctactgactcagcctcccaagtagctgggattacaggcgcatgccaccatgcccagctatttttttgtattttagtagagatggggtttcaacgtgttgcccaggctggtctcgaactcctgagctcaggcaatctgcccgcctcagcctcccaaagtgctgggattacaggtgtgagtcaccatgcccagccccaggaaatctttttcttcagttcttgttgtcatcatggtgagggggtggtaaatacacacacacacacacacccacacacacacacacacacacacacacagacacacaccccttaactttgtaaaaatgcttcaaaaaggtgaaaagatgtgtattttaaaaggtattttttgttatttctttgtatttttcatgcatttctttaaaaactgtttattattgttctaattcaacatgagtgcacttcaaaaacctatcgatctgatttggggagagtaaaatgtcattagagtttagggcaatctctgccaattgttactccagcaacacgtgataaactgtttatgtttcagacctccatcttacaagagatcacttacacaaacttcgcagttggaaaatacagatgttatcaatagagtcaaaaaatgctaatattaaaaatgcatgagtataattttgttttatttttacataatgacatataagtagaacatatgtcagaaaatatttttggagctcttacagtaagcctagtactatcacatgcataggaagaaatccatagaactatggcataaactctgatctcatgagcattatggtgtaatgtaaaaaacgaaattggtactcatgaagcaggcaatgcttcaatttaagtatttattttaagacttttttgtgccaagagatatgcagttgtccctcagtgtacttaggagattggttccaggaccaattaagggagatgacaatgtaccaaaatctgcatatactcaagtcctacatacagtctgtcctgctgaacttgagtataggaaaattctgcctccctatttgtcggtttagcatcctgggagtatagcagctttgatctgtggttggttttaaaaaaaatctcaccagcacagttcaaacccatgttgttcaagggtcaactgaaattctaacttgagctagcctaagcaaagtagcagaaattattgtctcacagaggcagcctttgaaatgtagtggtagcagcttcagggtcaacagaattgtgagatgtgaatagcaaaagtgccccatctccacttctcagttgtggtatggccttctgcttgactgctggcttcggtctcttcagcttctccatacattgttggagagtagtgtgtatatatagacatatgaccaccaacatctctgggttcacagccttatgactcatgatccaaggagaaagaggaagctgcccgttcatctcaattctcagagaaggactctagttgatctgcttggaccaatacgggtctggagtgatgtgttactatttttgcccatgttgcctgctgtgttcataaggcgtagagttgtgtgattggtagagtcactggaagtaaaaggggtgaaaagccatgctctagagaagatggaggtgagaatgaggcaacaaagcttgggtgcaaatatactagggaaacaaaataaatgtgcactcaacatatttactatactgtattacaatacactatcctgtgtagtcaatggatatggtatgcagaataatggccccccaaatatgttactttctaatccccagaatttatgaatatgttatggtgcatgtttaaataacagacagaggctctctaaaagaaaatatttatttgcgcatagggcattgcagcagaaatacatatgccatagtaaactatgtgcatattcaaggaggtaaaggaagacaaaggtttttaatggaaaaatgaggatgattacataattgttttgtgataattttccttgcctacaagtattaataacaagggtgatgccagtcattagctggacaggcagttgctgggcagatgaccttgcaaaagtattttttgtgtaagggtgcaatggcctttgtgcaaggttgtggtattggcagagtcttttgtgatggtttttgttatctggcatttatgcatgaaagctgtctcatggccttccccagctctatttgtcaaggtttctttttctttctttccttttttttttttttttgatacagagtttcactcttgttgcccaggctggagtgcaatggtgcgttctcagcttactgcaacttctgcctcctgagcttaagtgattctcctgccttagcctctcaagtagctgggattacaggcatgcgccaccatgcccagctaattttgtatttttagtagagacagggtttcaccatgttggtcagtctggtctcgaactcctgacctcaggtgatccacctaccttagcctcccaaagtactgggattacaggcgtgagtgactgcacccagcccttttttttctttttaacacaagtgactccattatgattcttacaattttcacaattacataaaaagggggaattaaggttgctaattagctgactttaaaaggaggacagtttcttggattcctcagatgagtccagtgtattcacagggtccttaaagatgaaaggtagaggcagaggagttagagtcagagacagagagggagtgttagagtgatagattccatgtgagagactcagccagcctttgctgattttgaagacagatggaggccaagagccaaagaaggaaggctgcttctagaagctagaatgggcacattagcaaagacatggaatcaacctagatgcccatcagtggtgtacctggataaagaaaatgtacatatacaccatggtatactacacagccataaaagagaacaaaatcatgtcctttgcagcaacatggatggggctgaaggccattatcctaagcacattaatgcagaaacagaaaaacaaatacatgttctcacttataagtgggagctaaacactgagtatacatgaacataaagaaaggaacacacactggggcctacttgagggtagagagtgggaggaaggcgaggattgaaaaatgacctatctggtactatgctcattacctgggtgttgaaataatctgtatgctgagcccccctgacacacaatttacccatgtaacaaacctatacatgtatccccttaacctaatataagttggaaagaaaaaaaacagctggaataggaaagaaaatggactctcccttatatctcccaaatagtttccagaaggaacacagccctgtcaacattgtgattttagcccagtgagccccatttcagacttttgaacttcagaccataagatacaaatttgtgttgttttaagccactaaatgtatggtaatttgttatagcagcagtaggaatttgacagagtagagcataacaatgagtgctgcgatcttgacagtcacctaggcctgaatctaaagccctcttctaccactcagctgtgtgatatcattcaagttggcttttctgagcatcagctttcttagctgtaaaaatagagctatcaatatttgtcccacaaggtttttattaagggataaatgagatcttgtatgtaaagcatgtaacaaaggttctgaacatagtaagtgctgataaatcctagatgctattgtcatcagcacgatattcaatactccaaagaagcctataggttatgtagatcatacattatctctattttaaaggtgagaaaactgaagttcaggaatggtaagcaacagcacctagctaataagtaaaacttaaagcagtctggtattaatttacaatttgcaatctaatttcagagagctctggagagattcctgactcccagtgtatctgctgaaatgctcctcagctactttctgctaattgactgttttatttgtactccaggttattcaagaagatgagtgattctgtgtgtgttgtggtggtggtgggtgggggggaggtggggtaatcatcaagcagcatcagtaagatgcagaac

SEQ ID NO: 97 - DNA, 3283 bp, Homo sapiens
  source 1..3283: mol_type = genomic DNA
tttttaatactctgacccagtagataattagcactgtattgcagagagcaaataaatagcgtatgttacaaaggtctcaaatgtaaatgcctatggggcaacctagtcacgtaagagagatgtgagcttgacataaaataacaaatgacaattcaaactcagcctctatgccagggtgacaacaaggaatgctggacactgaaatcagaactattctcttagttgtagcagatggctgccatatggaaatgcagccattgtcgctgaatctgccatttacttaaggaaaacaatatctccatttttatggaaatattcttaatttttaaaaataatggttgctaattcaaataaaggaaaaaaaacaatggatgctaaagaaaacctttggtcacatgaagtctacatgccacagcttgaaacatcttgtgggtcgggttggggggacctgtgaattagagttggaatcagaagacctaactttgacttctatctgatcaattctattgctgtcttacctggacccggtcatttagcttgtcactgacttggcctcctattctggaaagttaaaaaggtagttaaattctaaagtctttaagttgctttaagatatatggatctagattttgaccaatagccagcctgtgggtgatcaaagctagcaggcttatgagagagcatgagttgagcgggtaagaaaggtttttctgttcccaaacacctgtctactagtacatcagtgtctgaggaggagtggaaaatgggacttagtgggtgggtttggaggatcaaccatcacagagcacttgagtactgagatgcaggcagctaaagaggaggataagattcttgccttttaggagtggaaagactgcctgagaagaaagagggtgctgataatttatcaataaacagaagccaaatatctggctcaagaaaacctcaacagattatacaattatatgtaatgactcataagtggattagctggtaagaaaagtcttacttctcagtgttctgcttggtgtttctttacctgactggatgatagcataagaagctaatgacctacagctaacgagcttttgtaacataaatgtaagacacccaggtttaaattcaaattttgacttttttctatagctcttaggcacatttaaaaaaatcctgtagatgcagattcatatcaaccatgatactaggatcaaaaataagaataactattattactactattaactctttagcttgggtaaaagtcatacagataattaaacaatatcttactacttcatcctctcatttacccagtgaaagttttccatgttttataacttcaagttgttgtttcagatatgtttgttgagtttgtgcatccattttgcagtgttttccttttttattagactgtaagaattgcttcttttcaaactgcgtccaagtccatggataaagaagctggtacacagtgggtattgttattatactgaaggaaattagaagtcaagacaaatttatggaaacattataagtgaaacttttgataaagggttaaaagatcctttggtcttattaagatatgacaacaaagagactattactagctcctttcagtctccaacaagggaggcaaacatgtttgaaaaactatggcaagattttgttctatgacgaaagaaattgaagaaaattccagttacctgtctcagttataagtgagggttatatatccttcttttgtgaccactgtcactaaaaattcttcccctgcctttgaaaatctcagcacataattcacctcagcagaggcataggttttgatggccctttggtttctcccattgccaggaacccaagtgcaagtcttagaaggtcttgaaaacataggaaacattttcctcaggcttgaaaatccatttgcccaattttacacttctcttcaggttaaaaacaaatctctgtgttgttaggggtaaagaatatctccttagttctttggtcaatattactttaatgcaggttatttaacatatggcttgtgcttccacttctgtccaaaatagattaataggggccttggctcactgcctggagttttcaggctattgcacaggacgggaaacctcgtcagagcctgacagtcttgcagagttgaggaagaagagattagagtttacagaggccaaaatggccagcatttgtggagcagactaccagagaggcaggagtttcacagtcagaaggaaatctgaagagagaatccccttaagcctttgggtcaataatgatttgcaaaagcatgagaggtaactaccaaaagtggggctgggtgttggggggacacttaaaagtaataaaacaattcccacagggctaggaatagttgttgtttccaccagctagagtaaaaatcttgtaatacatgtgttactgggctactggatagaattgtcagaaggttatcatcttaagaatttggccctagaccagaggtccccaacatttttggcaccagggaccggttttgtggaagacaaattttctgcaggacggagggtagagggagggatggtttcaggatgaaactgttccacctcagatcgtcaggcattagttagattagattctcataaggagtacacaacctagatccctcgcatgtacagttcacaatagagttctctctcctatgagaatcaaattctgctgctgatctaacatgaggtggagagctcagtggataatgcttgcttgtctgctgctcacctcctgctatgcagcctggtaccagtccagggcctgggggtttgggggacccataccctagacaaaagctatttgtacctgctttaataaaacttaagtgcaagccttgaaacatcacttgattttgggtaacttaactgaatgccagaacaaaggttaacatcatagagggcataaaaatccagcaatgaacaatgtccagcatacaattataaatacagaaaagcaaagaaacagaaaaatattatgtatattcaagagatagatgatagttggatataaacagatgtagagctgaaaaagatgattgaactaagacaagaatgccgaaacagtgattataattattcctcacatgtttgagagagtagaggaaaacatgctcatgactaggagagaaattgaagatgtatatattttttaaaagagctgagaagaattttattaagcatataaattggtaaattgaaaatcaagcctaaaagagaaaaatctagctacactgtatgtcaga

SEQ ID NO: 98 - DNA, 32 bp, Homo sapiens
  source 1..32: mol_type = genomic DNA
tttttaatactctgacccagtagataattagc

SEQ ID NO: 99 - DNA, 23803 bp, Homo sapiens
  source 1..23803: mol_type = genomic DNA
cctccttcagcaagaataaagcaatatacaccttaggttccactaagtaacataggcataagcagggaacgtttcccccactgtgttccagtgcagaggagacgaagcctgtcctcaccgcggctcgctgggcccaggctggctctggaaagcctgtgcggtcctgggcaggaagcccggcccgtggagcaggttttcgttctgcttcagcaataaataagggtgaccacagggactttgcttttggtttcctttcctgtgaaaaggttggttttaaagtgagatacacttttccgtagaacaagtgttctatctttaaaaacccaaattgcagcaccgtggattactggtctcagaacaactcattgcgcatcagatttgactctctgattttctgtctattggccaaattgccctttaactgcacctgaatcctttgtgtactgatgcctttgagctgggcaccttgggagagtgttgtgttgctgtttacggttcttccttgcccttgctaattacagtctctggtgcccagcaagcccctttggcttccttccgtgactggtcacgttgtctgcctgggctcagcgtggacctgccccatgctgcagaacctggcctcacctggacttttcactagaattgccagcttcctcaacttagcagatcattcactcatgcgggcacaagcaaagatcaacactttcttttttggtaagcttgagttttacaagttattttttggtgatgcgtaagacattgcagtgggaaaccattcaacttgagtttattggagtttgctgttgtagcaggttttaactcaggaacaactcttgtctgatctctccgcccctctgccgggaggcgacattaactgtcctctcggagccggtagcgttgctgtccgagtccccaggacggatctcctgcagacctgccttaatgctcagatcgaagtatttcacaagaatacttgtgtttttaacagcccttcccctggacggtgcggccatgagggcctcatgttacggcattgccttttctttctgtggatccagtatcttcctcggctttttagggagcaggaaaaatgcgtctgagagcaactctttttaaaaacctgccctgttgtatataactgtgtctgtttcaccgtgtgacctcccaagggggtgggaacttgatataaacgtttaaaggggccacgatttgcccgagggttactcctttgctctcaccttgtatggatgaggagatgaagccatttcttatcctgtagatgtgaagcactttcagttttcagcgatgttggaatgtagcatcagaagctcgttccttcacactcagtggcgtctgtgcttgtccacatgcgctgggcgtctgggaccttgaatgcctgccctggttgtgtggactccttaatgccaatcatttcttcacttctctgggacacccagggcgcctgttgacaagtgtggagaaactcctaatttaaatgtcacagacaatgtcctagtgttgactactacaatgttgatgctacactgttgtaattattaaactgattatttttcttatgtcacagaatgtgtcgcttcgtcttctttgatgtgttttctgtgtgcttgttagctttacagtttctttgggctgttttagatttgaaaattctgtctgtctttgatactgaagataacatgtttcctttaaagtctagagtttgagaaaatttgaagatttttttttaaaagacaaggaaagaacactggaagtcttaggaacaaaagctgaagtaacaggtcacgctggtaggcacagcccccaggtcctcacccatgcctggaggaatgacctgcattctggaaggcgctcaggacaccgttttgtgggatcaagtaagcgaaactttcttgaagatatctgtggggtcccttttaggagctgtcataagacaaaaggaaattgctcgtgtgtgtccctgtgtggcggtggtgcaaacgagggtgtcttccggaagggtggccgggaggaccaagcggggtctcctgtccatggtccgtgtacctggctcaggtgtgtctacagctccgctgcatgtcatttcagccagccagaggtcaggtagccacacgcagtgcccagcccactggcttattgtaggagctcaaaagaagtcaggatctacactttcaaggactttagtcatttcaggttaaaacaagtaggcgttcaaaaacccatttctgttgatttgcattgtgacaagaacgtgcgatgcataagacacctaatgtgaattgttcatcttactggtggagtaggtaggcatttgtacttgatacctcaccagtaattaaaaactaggatgtacctgagccatgtataccgttttttaactgtacactttttaaaggtatactgggccatgtatacttcattttcttgcagaactatttatatttttcccataagcaggtattattttcctaattaaaaactagcatgtaccagagtttttaattgttaaaataatacctgttgatacggaaaatagaaacagtataccaggatacaaagtaaaaagcatgtattctgcctcccagcgccctgaccctgttccccagaagtagctcctgttctgcgtttaggttcttctgttcattcttctgagcaaatgccagtgtgtggtgtctgtgttttaacttttttcccagcaagtgagattgcattaagtatattctttcctaagttgcctctttgaaccttatctttccatatgggtatatgtagtttgaaccattcatcatttttgaccactgcataaatattcccctgattgagtgccctgcagtttgtcacctatgagtggatatttgggagggggcagtcgctattgcagaaatgctctactgaatatccttatgtatacagctgtgcaactgtgcacatacagctaaatgattaacttctggaaacgtttgtgcatttttaactttgatagaatttgccatatttttacaaggtgttttggaaatgacagccttggcaattgtacagttctagtttctcaaagaaggaatggggccatgatggcatgggaagcatgctcttcgttgtgatgctttcccatggaagccgttgactccgaaacatgctcttcgttgtgatgctttcccatggaagccattgattccaaaacatgctcttcattgtgatgctttcccacggaagccattgattccaaaacatgctcttcattgtgatgctttcccatggaagctgttgactctgaaacatgctcttcattgtgatgctttcccatggaagcagtggactctgaaacatgctcttcattgtgatgctttcccatggaagccattgattccaaaacatggtcttcattgtgatgctttcccatggaagccattgattccaaaacatgctcttcattgtgatgctttcccatggaagccattgattccaaaacatgctcttcattgtgatgctttcccatggaagccgttgactctgaaacatgctcttcattgtgatgctttcccatggaagccattgattccgaaacatgctcttcattgtgatgctttcccatggaagccattgattccgaaacatgctcttcattgcgatgctttcccatggaagccgttgactccgaaacatgctcttcattgtgatgctttcccatggaagccgttgactccgaaacatgctcttcattgtgatgctttcccatggaagccgttgactccgaaacatgctcttcattgtgatgctttctcatggaagccgttgactccgaaacatgctcttcattgtgataccttctcatggaagccgttgactctgaaacatgctcttcattgcgatgctttcccatggaagctgttgactccgaaacatgctcttcattgtgatgctttctcatggaagccattgactccaaaacatgctcttcattgtgatgctttctcatggaagccgttgactccgaaacatgctcttcattgtgatgccttctcatggaagccgttgactctgaaacatgctcttcattgcaatgctttcccatggaagccattgactccgaaacatgctcttcattgtgatgctttttcatggaagccgttgactccgaaacatgctctccattgctgacgccttcccttggaagccgctgcccccacacgagcatggctttgaaagtggggaagattggggtgggtggttctttcctgtgccaggctccttgctcatctttctaaggcatatcaaactcgcccttgtctagggtcatgacttcctgcctaacctggccccttccactccacgctgctctaaaacgtggcaagtgggcagggccttcctgctaactcctgggtgcttttagaaaatgtcagttcctgtgccccccacccccaccccccacctaaggagctgatttctgagggtgggatccaggagtctgcctttttgacgcaccccagtgctgttagtgcctgtagtaacaatgtactgatgcccatttaggtgggctgctcagttgaggtcttctgcatttctgtgcatgatggttacttagtgtctgggcagccaaaggagaagggcgtgtgaccagcctgtgtgcaggaataagcccggcacccccagcactgccacatcctagttattctggaggccacaccttctttgccatatcactaagagcagttgctgcctgtcgtaattggagagggtcatccattctaaaacatgttcaggttttacagctgttaaagtgctttgagaatcgggggagttgagatgaactatggcattgggggtcagtcctgtctccagctctccacagtggctacatggggtctcacaagtgcaaccccacttcctcctccttggccctcagaggatgttggactgcttacaaaaaggtgcaacctgctgcgagggaactgcctccacctctcaccacacttaaaaacctgtcaccatctgtcccgctgctctgtcttgtttcggtggaagaattcgcccgagcccccagccccatggcttccttgcaggcctgggagcctgtgtctcttctcctgccttcctgaaagccagacccttctcttggccgctatgtctgttgtgtttgtttcttatggaaaatgtcaagcttgtatagaagtaggataatgagtgatgattgctctctgagatttatgaacattccaggccctgtgactgctggtctgttctagaatgaaggaaaatggctgtgcagtcccaggagaaaaatgctatgatcatatgattatattaatacatttagttacagttcagtatccatttgtggagatgaaaccaattgcagaccaggaataaaagggaatttcttcagtctgattgagaacagttaccaaaaaacctatcaatatacatataagaaggctagtaacgctcaccggctattccccaggcatgctggtggagcaaggcaaggaaaagggggaggggaacagaggttgtaaagaaacaactacaattgccacgacttcccaactatactgttgtttatgtagaaaatacaaaagtatccgcaattaaatagaattaataatgctgccagatacaagatgtagcaattttctctaaatcaggaacaaatggaaaatataaaaatcttttcagtagcaaagatgtcaaataggaataaaatgaaaaatatgtaagaccttcatgtagaaaactacaaaacactgttgaaagaatttagggaaggtctaaattaacagagcgatgtgttgatggttaaaggactgcatggaaaggcatcagttctccttgttgattgttggaggactgcatggaaaggcgtcagttctccgtgttgatggttaaaggactgcgtggaaaggcctcagttctccatgttgatggttggaggactgcatggaaaggcattagttctctgtgttgatggttaaaggactgcatggaaaggcatcagttctccgtgttgatggttagaggactgcatggaaaggtgtcagttctccgtgttgatggttaaaggactgcatggaaagacatcagttctccgtgtggatggttagaggactgcatggaaaggtgtcagttctccgtgttgatggttggaggactgcatggaaaggcatcagttctcctctgtgtttatggttagagtgtagaaaggcatcagttctctgtgttgatggttagaggactgcatggaaaggtgtcagttctcctctgtgttgatggttggaagactgcatggaaaggcgtcagttctccgtgttaatggttagaggactgcatggaaaggcgtcagttctccatgttaatggttagaggactgcatggaaaggtgtcagtcctccgtgttgatggttagaggactccatggaaaggcgtcagttctcctctgtgtttatggttagaggactgtgtagaaaggcatcagttctcctctgtgttgatggttggaagactgcatggaaaggtgtcagtcctccatgttgatggtgagaggactgcatgggaaggcgtcagttctccgtgttgatggaagactgcatggaaaggcatcagtcctcctctgtgttgatggttagaggactgcgtggaaaggcgtcagtcctccatcttgatagttagagaactgcatggaaaggcgtcagtcctccatgttgatggttggaggactgcatggaaaggcgtcagttctccgtgttgatggttagtggactgcatggaaaggcgtcagttttcctccgtgttgatggttagaggactgtgtggaaaggcatcagttctctgtgttgatggttagaggactgcatggaaagacatcagttctcctccgtgttgatggttagaggactgcatggaaagacatcagttctcctccatgttgatggttagaggactgcatggaaaggcatcagttctcctccgtgttgatggttagaggactgcgtggaaaggcatcagttcccctccgtgttgatggttagaggactgcatggaaaggtgtcagttctccgtgttgatggttaaaggactgcatggaaaggcatcatttttctgtgttgatggttaaaggactgcatggaaaggcatgagtcctccgtgttgatggttagaggattgcatggaaaggcatcagttctccacgttgatggttagaggactgcatggaaagatgtcagtcctccatgttgatggttagaagactgcatggaaaggcgtcagttctccgcgttgatggttagatgactgcatggaaaggcgtcagtcctccgtgttgatggttagaggacttcatggaaaggcatcagttcaattaattgcttggtggactccgtgccagccattcaattcctgtgagttttttaccgcttttctggatcttgaaaaacaatttatgtagaagtgcaaagtgccaagaacagctgagagcctcgtgcaaacgcagagcaaggcgggaagacatgccgtgcaggatgacgaggtttaggcagccaacccaggggtggtgcccagggagggaccgctggagattacaccaggggtcttgcggcagagcagtggggaaaggacaacgttttcagtcagtagttccttttagccagcagtttttccacgggggtgaatgtgaaccttgactcctccctcacactgtgcccattaatcttaggtggatgttaaatgtaaatgtgcaggcgaggccgagcgtggtggctcatgcctgtaatcccaacacttcaggaagctgaggcaggcggatcgcttgagcttgggttaaagaccccatctctactaaaaatacatgcaaaaaatgccaggcatggtcatgcgtgcctgtggcctcagctgcttgggaggctgaggtgagaggattgcttgagccctaggggcagaggttgcagtgcgctgagatcgcaccactgcactccagcctgggcaacagagccagaccctgtctcaaaaacaaaaatgtgcaggggaagcgagaaccctttagaaaataatgtaggagaacatcttcatgacctgagagttaggaaagactttttaacaggacacacaaagctccgatcacaaaaaaagattaataactttgactaaaatgaatgtaaccaatgataaactgcttaaaccacagagaagatgcagccgtgccatcttctcagtggctgagtaagagcaccgcacaccaagggccacacccagcctatgtagcaaatcaataagaaaaagacaattgagacaaggtaaaagatttgaaagacatttcacaaagaatataaaatggccggtcaacataaaaggtctttgatctcatttataattggtgaaatgcaagttaaaggtaaaaattacactattaaaataccactaaaatgatgaatactgtcaagtattttcgaaggtgtggatgctgttggttgcagagtgacttggtataagcactttagaaaagagccgggcatcatctgccgcagatactccgctcccacatgcattcgtttgctagtgctgctgctgtgaccgactgcgtgcctcacctagcatcccgagtgtgtctctgtctctgtgggtcaagagtccaggcatggcagagctgcaggtcctgcttgggtcctcccaggctgacattaaggtctcagagggaccaggttctctgagctcggggccttttccaggcactcacacaggtggctggcagcattcgctccttgtggtggagggatggaggcccattttcttgctgcccattggccagaggttgcttttgctccttggctgctagtcattctctctggttcctgccccctggcccctcacacattccaaacccagcaggagaatctctgacttcagccaggacagagctccgaatttcatgccataatcacaggagccaggatcacaccgactttgccttacgatgcagcctgatcctgggggtgaccccgccctattcacagatcccaggggtgactgcgtcctagtcacgaatcctggtggtgaccgcatcctattcactggtcttgggggtgaccccatcctattcacagatcccggggtgaccctgtcctagtcatggaccccgggggcaaccacatcctagtcacgcgtcccaggggtgactcagtcctagttacggatcccaggggcaaccccatcctattcacgaaccccaagggtgaccctgccctattcacagatcctggggacaaccccatcctactcactggtcttgagggcaaccctgtcctagtcatggatcccaggggtgaccgtgtcctgttcacagatcctgggggtgaccatcctgatcctgcctggacctcacagggtcgggggcagacaccgggggcaggaatcctgtggcgtctttgaattctgcccaccataccatgtagtgtcactcctaggagtatgccccacagaaatgacccagatagtttgaatggataagtggtgaaaatgcacatgtcaaaccaaagctctgctcctcaacgtgggtgatgctctgaacgtaacattaaatgaaagaggccaggtgtagaaatacactaaattattcagtttatgtaaagtgttaaaaaaagttgaaccatagcatatagggatgcaagcttaggtggcaaaagtgtaaagaaaagaatgtgattcccctaaacaccaggcctgttttgaccaggtggaaaatgcccttgggatggagttttctgacttggagaggtaagggaacatggcagactcggggctcatgggccttccctgtgtcacggggggacctcccaccccaaagggctgccacagttaggatcctttaagcttttcaagaaggcgggcgcatctccggtgccgttctctgagtgaggaacacgttgacagaagtgggttgtccagatatgatcaaggcaggggtcgaaatggacctcctgatgggaagtccctctgggaggagtgtcagctcccaggcaagggctcgctttgcccctccatggcactgacctgctcagggcctcagccaccgtgagtgctgactcatgggaactttgattctgggaatgaggctgtcaaggcgcaagagcgttgcttttgtttatggatttggagagagtgctgggctctgaaactgtgtacatgagagcctcctggagcatccatggccccagaggagccacacgcatccgtggaagggtggagaggacactggggccccagaggagccacacgcgtccatggaagggtggagaggacactggggccccagaggagccacacgcatccatggaagggtggagaggacactggggcccctctggctgagacagcagaacaagaaatggggagaacaatctcagatttggttttttggttgttttttgagatggagtcttgctctgcactccaggctggagtgcaatggtgtgatctcggctcactgcaacctccgcctcccgggttcaagcaattctcttgcctcaacctcctgagtagctgggactacaggcactcgccaccaggcctggctaatttttgtatttttagtagaggcggggtttcaccatgttggccaggctggtcttgaactcctgacctcaggtgatccacctgcctcggcctcccaaagtgctgaaattacaggtgtgagacaccgcgcctggcccaaactcagatttgaatttaattttatttctttgggcctcggcttgcaaaagcagggagatttaacttgcagacattaattttcccaaaagttcatcaagaaagagttcgtattaggatatgtggtgtctgcgtgttgatgacactgcatcatcagaacgtctgagtctgcctgagttgtcacgtccttgtggttagagagggccccacatacatgccaagtatcctgtatttgcccctaagaatgaaaaggggttactcttgttccctggtgtgtctcatgagttttgttgaatactggacacttcacatcaactctggattccagagggcagttattggagttttgtttgttaaataacatgtctggacaaaatctgtgatgtctgctccctgtcagtgtggggcacagatgtcggcactcaatttttgctgggggcagaggggggattgttttaattctgagttttggtgggttttgctctttgcctgcaagattgagctggagactgggctgaggcttggctggagctgctgctccctacacagcatggcctccactctgctagggctctgtgggtgggctgggagcacatgcacctcttcctccagctctctgagtgtgccctctgggcatgtcccagcagcacctggccagggaggcaggcttgggccctccagtgcacccgcctgcggcctcccccagcccctcctccctggccccgccctgctgagtcctgcagggcccccgtgcttcactagccccgcttttggacaccccgcagggaagcacccccagtggagagctgggctccactgtgtttccacccctcagagtcctcggctgtgctgtcttctcttcagtgcctagaagcaagaaccatgctccttccctgggtggccccagcaaagccccgcagactgcatggcctaaactgcagaaatgtgtcgtctcctggcctggagcccagggcccaagctcagggtgtcagcagggatggctccctccgaggctgtgcaggagaatccgcccaggcctctcctccagctccttggttcgctgccgtctttgaggttccttggcctgtagacgcctcagccctctgcactctgtgaggctggcccaaatcgcccccttcataaggacaccagtcacatgggattaggggtccgccatctgacctcaccttaatgcagcacatctgcaagaccctctttctagacaaggccatgctgaggtataggggtcaaagttccagcatatttttgttgggggcagacataaccaataacaccagcctcatacatttgctcaattttacaggtgagttctcctggaagaagaacctgatgccagccatctgtcaaggaagacaggaagtaacagtgcaggctcagtaagtatctgttggatgaataaaggaaattagggatgacatcctacaacctgaggaaggtgtggggcatgcacacgcctcccgccacccacaccaccctctgctgcctcgtggagcccccgctgtctgccctgaggctgtcccatgcgcagctcctcagatgcttcctggaaggagttctgtgcactgtgggctgtgccgttgctgcaagacggtggcatttcctggcacttctgagttagaaagtgccagttatttccaatgttttccagacattgctggaattccatgaccaaagggcaagggccagggagtgtaacgctgggcccgggtgtcaaaaagtgctgtccacagtggctgagaacagagtgaaaccagtgctgccgcacacacagaatccttcaaggaccctcgcttttcccttttccaaataccggatgcacattgtctgggctctggctgggctgaaattgatgctgttttaatttctttcttactgtatgagtctgtttcacactgctataaagatactacctgagactgggtaatttacaaaggaaagaggtttaattgactcacggttccacatggctgaggaggcctcaggaaacttacaatcatggcagaaggggaaggggaggcaaggcaccttcacaaggtggtgagaaggtaaggaagtgccacactttaaaaccatcagctgtatcatgagaactcactatcatgagaacagcctgggggaaaccacccccacggtccaatcaccccccaccacgtccctctcttgacatgtggggattacaattcgagatgagatttgggtggggacacagagccaacccagatcacttatttagatgcaatatttaattaacgtattttattcgtaaagaaaggtggctggcatctagtagctgggaggaggcctgtgggtggtgatgctgccgtgtaacattctccgccaacagcttcacggagtgaggaatcatcccgggagccgtccactctgaggccgtaggggtgagggtctgcctgtgaagttggtggcctgctgtcaccccatgctgtggcgaaggatttgggtgtaaatggaatcagctgtcttgtgtggttggcagcagcatgtagggaatgcaggaaagccaggcctgagatggcgttgccctctggtgccctggtgctcagggtgggggccacaggctctggtgtgtccccaggcccacctccagtctacagtgtgacagacctggcgtgctcctccggccttcgtgttgttttatttggggttgctttctaatgggaatactggacaggtgttgaagatttggaagtatctttgctcggtttattgtcccagcgaagtcatcaacacgggcgtgtttgcttcctgcggctgctttcacacagcagcaccgacatggcgccaacagcagagctttcttctcgctggctctgcggccacaatctgaagtcaggacgtgggccgagggttctggggagggccctcctgcccctcccaccccagggctgctggcagtcctccgtgttccggggctcgcaggcgccttgctccttcttcacctctgttgctgcacagccgtccgtcccctccccgggcctctgcgcctgcacttgacaccctcccggtgtctctctcttctcatcttaataggacaccggtcctattggacagggccacgcttacaacctcagctcgattacatcggcaaagaccctatttccaaataagccctcatccttaggtcctaggggttaggacttcaacatctcttttttgaggaaacacagttcagcctgtggtgatggggaaactggactcacacccctgtctaggagccccccgaatcccctgctctcagcctggctgagctgctctgctgggagtcaggtctgagtgctttgctcaagttgttagccaagtccgttacagggttaatagcttcatagttaggggtcctcagaggtaacgggtccccgtggcacttgtcctatttccaaagaaccccacggcagctccacacattcccatgggaagactgcacagtctacccctgcaaacatcttgctcttagctaaaattgtgtctgtcagtgtagtcactggttatcacgtgggaacgggactcaggacccatatagacagagctgagtccatgctggctgctccgtcctgtggcctgctgggtttcactcttccacggcgtggcctctccctagaagcccttggtgaacacccctctccctgtgagtctggggcagtccctgccgcccccagccagtggctcccgcagcttcccggtgctggctcagtcctggcaatgaccacactgcaggctcatctgtctccactccttccccggaagctcattgatgacgtggttctccagccgactgctgcccaggttggtgcctgctgtaggtgacagttcccaggagagagaagcagtgtctctgcctgggagcctgcacgcaatgctggtgggaacgtgaaatggtgcagccactttgtaaaatagcctggcaggtcctcagagggtgaaacagaattcctgtatgtcatagcccatctggactgtaacaaaaatgccacagcctgggtggcttataaacagcggacactttttgctcacacttctgggggctggaagttctagatggaggtgtggcagatttgctgtcctccgaagtccccttcctggctcatatccggcgccttctcactgggtcctcatgtggaagaagaggcgagggagctctctgaggcctctttaatgggggcacgattcccattcgtgaggcttcaccctcacgacctcctcaccttccaaggcctcgcctcctaatcccatcatcttgagggttgggattttgacttgtgcattttgggaggacacaaacattgggttcttcccagcgtgtgacccggcaattccactcctagggatataccaaggataagtgaaaatctacgtccacacagaaacttacattgagtgttcccaacagcattattcataaaagccaaaatgttggcccaacccagtgcccatccacagacgaatgactaagcgaaatgtggcatgtccctgcagtgggatattattcagtcgtgagaaggaatgaagctctgacacgtgctacatagcaggtgaaccttctgcaacatgaaaaattcagacacatcaacccaaattgcgtgtatgtgtatgcttcctgggcgtgtcccctagatgcctcctctgtccacctgatgcccacagcaccagcctccagccccccagcagcgtcctcggctcaccattgactttttcttctcttgctctccacatccaagccgtccgccactcttattaattgattagttgattgacacagtgtctccctctgttgccctggctggggtgcagtggtgcaatcacagctcaccgcaaccttgacctcccagtctcaagcgatcctcccgccttgccctaccaagattctgggattacaggtgcgcaccattatgcaaggcccactccttcaactcaaaccatgaaaagtagcagccccctccggcagttgcctgccttcttcctcatgagtatcccgtccttcctgctcacaaacctcccgacagccgtttccagcacagcagagtgatgctgtgaaaatgattccatttctcgcacaaaatctgctagtaactccctactttgctcagaataaaggccaccatcctcaccatgacccatgtggtttcatgccctgccctcctgcggcatctcggctccttgtgtctctcaagtcgccacaccagcctccccccaggacctctgcatgctccctcgtcagccccagacacaccttcctccctggaggccgcctgcccaccctgtggcaaggggcaacccctgccctgatccagcctggcccacgccctgagtttgccttctccccacggcccgggcctggtccgaggcagctacgtcactctgtcctctccccaggagggaagggatttggttttgttctctgctgcacccagtgctggctggcagagaggggtgtcccaggaaggaccgggacacaaaggaagggagggacaggactcaagcacctgtgcccacaggcttggtgggcaaggggcgggggtatcctgcagggaaggtgggactcagcccatggtgtccccagcagcgtcttgcccctggaactccctccctacatctgttcatctgagtggccttcgtcctcaatgcagccagtgtcaaggtggacacgcacacggctccgaagtcctgtgtgacgcccacgtgacctcatgaggctgtgtgatgtcacagcgggcggggtggtgtgtgcccagcctggtcccacagtccatagtgagcggcagacagaggggtggccagtttgttgttttacctaaaaggtgttttccacgtggagtgggactgagaggcacaggtggctgaggggacccgcctgggatgtgaggcgcaggtgagtcgatgaacgccccctcctggtgtgagccgcccgctccccaaacgacgtccccagggccccgcccgtgctgacctctcctgttttccaggtgtgctcggccccttcatctgtcagctgcagcaatggaatacgtgctggaagtgaagaactctccgcggcacctcctgaagcaattcacaggtatggagggaaggcgccaggggggcgggtggggtgggggagcagttgggggggggcacagggaggagctgtttgagcccctggcgcggacagggggtcctggtcccagacctggctaggagggcaaggcagcaaaatgtgtgttcaggaaataacctgggaaaacgctgtgaagacttcatttttgaaaattttattacaaaatacacccgaacctgaggttttctagatgaagaaatacatttaactatttccagggctttaacaggtcaaaggcattttgtccatgaggcgctgaagatccacttcaactacttcataacttttattgcaggagtgacttttttaattaaggaaaaatatttatcagcaatgaagaagttccaccttccctttccccacccgggcaactgacccggaggcagacactcaccactgggactggaaggaaccaccggtgtgggatgtggcttctcccacaggtgccgttaatgtgcatagatgggggatgacagtgacttatggtcaggaaaaggaagattctggaagtttgcacctcccccgggaggcaggagatgccaccttccatggctcaggtttacctgctacttgaatgtttttttctcaatggatcttgtgttcatgcaatgcttttataaaacaacaacaacaaaaacaaaaaaaaacccaagaaaatcggatgggcgtggtggcctgtaatcccagcactttgagaagccaaggcaggtgggccacctgaggtcaggagttccagaccagcctggccaacatggcgaaaccccatctctactaaaaatacaaaaattagccgagcgtggtggcgggttgcctgtaatcccagctacttggaaggctgaggcaggagaatcacttgaacccgggaggcagagattgcagtgagctgagattgtgccactccactccagcctgggcgacaaagcgagactccgcctcaaaaacaaacaaaccaagaaaatggaagaaaaagaaaacaaattagattgttttgggttgttacctttgttgggaaggtaggctagggagcacctctcaggctggccaagatgctggcagccactgagcacctgcccacagcagcacctggccctgcagctctcgcagcgggacagggcggcccaggtgccaggaatgtgtggcatctgccagactgcgaggccttccaaggccaccaggccaccagactttgtcacaccaggggggcagctatctctttggacaggaagaggggtgtccacaagaggggtctttgcagttccctatccagatgcacccagggtggagtgggaggcctgcgcctggggccccgagggaacgggccgctcttgtggacggctggggtggcccctctcatattctggcaagatggcctgtagccagggcaagcacgggggagaaagcgctccctcttccaggcccttgggggccaccctcctggtttctgcttcagggctgtaagcagtgcagctgttgtgtgtacaagctgctgctgctgggcctggccaccccgtctgtgaggggctgtcaggggctgctggaggctggtgccacttctcagggtgcatgggactggtgggggtcatctcaggtgtgccaggtcacccaaggcactgcccaagctgaccctgggctggagtcatctcaccttgccatggccatgcccaggacccagctcctggtgtctgcaggcgacactcctgtgtgctccccacacagcctgtcctcgtgaactgaagaacgcatgcaggggcgtcagcattgtctttatcattctttgcacactgtggcgtggctgttttgcaactgtttctattcctttaggggtgtagggaggctgtgaaatgacaaggtcagggtcttcctggcttggagttggctcaggtgtcagcaccaccggtggcctcagcgggcaggtggggagctggaacctttagccacagtggctggccctggccctgcagctcaggccctctctgccacccacccctgggtctgaacccaagaagcagcctagaggaattcctcctgtccttctctgcgcaactttgcagatgtggaagagactctgtggccgggtgcagtgcagactctggcctccaagcccacccactctgcagcctcttcccatgtgggtgcagagccctgcacgcctccccttccacgcagccctgctgggcttccccatgtccacactcactcatccgggacaggaggcagctgggcctccagacagccccctagcaggtgatggcctgaggctggctcccagggcaccatgttcacatggccctggatggcgggtgacctgggggtgaaagagcggaaatgaggatgggaggatgacaggtggcccctggggaagaggcgtgtgtggggccactcagccctggctggaggctctgccttactgcggggatacagcctcggctgctgcctgtcagctgctgcctaaagattaatgtcaattctctccctaaataaaatagtttctgcaaaagtgcttttaaactgtgacacactttccacaccggtgtgagttcttctctgagtggcttgtatgaaagagtggggactcgaagccactgcttcttctccacaggctcgggggtctgtggacatatttggactctctgtgtccgaatccccgggatctgtggtcctgcacaccccagatccccatccgtggttcacacgtgctccaggcaggaaggccacacacatgagcctctgcacacacagggatccgtggccctgcacgccccagatccccatccgtggttcacacgcgctccaggcaggaaggccacacacacgagcctctgcacacaccatgccagctccctgaacctgctgtgatccctgcccagcttcctcctcctcctccttctcacctctccttccgtgttctgatgctcaaactccgggagaactggtgtcttctgtccaaagataacttgacatgcagcttcaagctcagtgtcaagaaaatgggtctccaggttcagagatttttatgttgtttatgacatctgctgtgaagacacattcagccggattccaggtggtgtcacagctcacagacagaaaggggtgtgcagtctgggcccgctgaaggtcctgggggtgctggtggcaatcgtgaccgcaggcacgtctctggagttcccacacatttcctgtcaccactgtactcagaatcttgtcttctcttcccgcctggaccatctttggaaacctgtctgtggttgggtcttgctgtccgtggccacgctgccaggaaccctcagctgggacattctagtgggccgccgggcagtgtggcttggaggtgtcccctggaggccagcctgatgcctgcctttctaggggagcagctcccagcagggaagctgagcctcagaagtgctggaagcctccacggtgctgtgaggtcatggctgctgagtctgccagctgcttctccaggaggcgaccatggtctgtcccctgctaattgactgcttcatcgggaaacgaggtggcagagggacttggatggggagtcacactgaggacccggcgctgccctgagagagtctctgggcttgactcctcccctaggaagaattcctgcaagtgtgcgtttcacagagagagggcaagggaggtggatggagcacaggaaggagaaacgccagggaatcgtcagccacacttaaaatggtgacgcctccccacctggatcatcagccacgtttaaaacgatgatgcctcactgcctgggtcggaaagccctggcctcagatctgcacctctctaggcaccatgcccctcctgaacctttcctctcctgctgcagaagcagcaaaatgcagagtgaagagactttccatggccttggagaaaaataacggaacgtttaccaccgtgctggcgtgggcgtgttagaagcctcaggaggtggctggcgggaagtgggatgagcgagggaatgaatggcagccccactgtccctggggagcggtggcttccctgggcttgctatccacgcagacggggtgacgggacagattcatgggatgagctttgaaacctcactccacgggcccccatctcacctggcacccctcagccagggtggcttctcccaggaagcactcggctcattttagattgattggtttaaccccagtctcgtttcagtagatcaggaagaacgtggttgccccgccatcctgaggcagcgcctccccgttcccctagcctggcccagccgatggctcctctccctcttcccagccacgctgtcatgactctgggagagcacagggagagagccaggcagtgagccctgcgctccagccgtcctggctgtggtgtggggggtgtggagggcctactggagataccactgctggtgccagtggccgggagtccagtacctgtgcagtgggcgagctgccagtgatgtttctagagggagcagggagctgcatcagccctgccgatcccccaccatgtgggaagcccacctcggcccccttggcagctgtgacctggtgcctgcccagaaagcctcagcttactccaacctcaaagcctgttaggggttgtggaggagggtggagggccgggctaggaatggaaatgcgtgagagacttttcagggtctactggatttttaaaatgcatggcgacattgtggaggtgcgtgcaggaaaataacggtgggtgtggagggaaaatgggacaccggaggaggcgcgggaggactgccgggattcgacggctgggcggtcagatgcgatggggactgaacttttaaaatgagaaagaatgtatgaacgtttgtgtagtgatattgaagagaacaaatcactttatgaataaaaataatgcttcgttcagtggcatatttcctgcccagtctgtttgctgaaattaaacatccgctgtcacctggagcaagtcttcagaaacctttgttctcctggctctgtgagcagatgcctctgtgctgctggggcttctcctcccgtgtctggggacggtggggagggcgcctggcactgtggagacagcaggaccctgaagccagaggtctctgtggatcccggctccgctgcgtccaagctggtgggatcttgggtttcgtctggatcttcccagatggggtggaagagcgttcgggcatcacgagctgggtgctggctggtgtctgctggggtggaggagactgcgggcagtgtgagcctgtctggtggggtggagactgcgggcaacgcgagcctggcgctggtgggtgtctggtggggtggaagagactgcgggcagtgtgagcctgtctggtggggtggagactgcgggcaacgcgagcctggggctggtgggtgtctggtggggtggaggagaccgcgggcagcgtgaggctgtctggtggggtggaggagacggtgggcagcgtgagcctggcgctggtgggtgtctggtggggtggaagagactgcgggcagtgcgagcctgtctggtggggtggaggagaccacgggcagcgcgaggctgtctggtggggtggagactgcgggcaacgcgagcctggtgctggcgggtgtctggtcgggtggaagagactgcgggcagtgcgagcctgtctggtggggtggaggagaccacgggcagtgcgagcctgtctggtggggtggagactgcgggcaacgtgagcctggcgctggcgggtgtctggtggggtggaggagactgcgggcagtgcgatcctggcgctggcgggtgtttgctgtgcagctgctgtcatcacctgcgtcagaaagtggaggcagtggcggactctgtgggtagtgtttgtgaagttctggcgctgtgtccaccctggaattgcactccaggaaaaaggccgtggtgcctggatgccctgggagcaaagccctcctagtcacccactgtagacacatgggctgctgcatagaacgtgggggaccatctggccagccacagcccgagaccagtcacccaccccaggcccctctgagcctggctgtgcagtacctgcctgctgctatggggcctcttccggcctcccccgacctctccctacatggtaggtcagctcaaatcacacacagccaccccatgcaactgagggaggagagggtggcagcagccggtgacttcagcctgccctgtgcactctgccttggcaggtgcggcatcgcctcggcagggctcccgtgtccatgatgcttctgacagaggatgagggctgcagccgcagcatttgcaaacctggaatgggggtgtcttgagaaggggaacctgaaagactaaatcaaccctaaggaacacaaatggggctcctcaagggtcaagaaggccgggcagctcccctcccggcccctgtcccagtggaacaacttacagaggggccagggaagacccccagtggcttgggtgcagccttggcctggggcatggagcctggctttgtgggactgcagtccacccagcaaaggtctctgcgggcaccctgggccctcacctgcaggaacccccttcatcatccagcccagtccctcggtggcccatggccgatcaaggcagccacatccctcggggctgaacatgtgtgaggctgctgaactcctctggaaagggtcgtctgccaggagctctccccgccctgcttcctttacctcccacggcgcgccgcacactcattgtcttccctttttctccctttgggtcaaaactggcattaaactttctgtccttttgattcaagttttaaaattctgaaataatcctcaggccatgctgctaattctaactcctgtatgcttaagtgtgaaataattacacgttccctcccgaactcccaagcagccattgtgtgagccccgcgcttctgtgggctctgtcgtgcgccgtgcctggcgctgctgcgcggaaatgtattatctcctaatcgttaga

SEQ ID NO: 100 - DNA, 34352 bp, Homo sapiens
  source 1..34352: mol_type = genomic DNA
agtcttctcacccatttaggagttttcagtaataacgcacacacttttagtgaagatgttggagtgaagatatgcttctgtctgaattggaaaatgtgttcacttttttgactgagctgaatttatgctgtgctctttggataaataaccttgtttgatttattcaagtgacattgtgtcaggtcttgctatcaatctgcacctagtattgacatttgtaaatgtaatggccattcagtttctagataaccataacatttacttgacaactctgtattgcgcttacgctcattcatttttttttctgcatttgctttgaactttgtccttttgataatcagatgtattaagcctcatatagaaatgccaggatgtgtgtgtgtgtgtgtgtgtgcatatacatctgcaaacatatgtgtacatatatacatgtatgcaaaatccaaaattgacaacttataaactgtcatctgcccatgcaaacttgaagaagctgagcttttcagcttttcaatatcccagacagggcacctatcaagtgtatctttctaggctgctgaacaagaagagatgaacacatgagaaggatatgtttatttacttactcaacaaacgttctaggggttagggatatggagaagaacaagacaatgtttctgccttcatggtatttacattaaattaggggagtgcgacaaccaataaacagaaatgtttttaaaaacctaaggtaataataagtgttaagaaaaaaataaagaggatagaaggtaatagaggaaggaaaggcaaattaaaactacaatgagataccacttcacactcactaaaatgactataataaataagacacacattaacaaatgttggtaaggacgcagaaaaacaagaatctttttaaattgtggaatttccactttctggtggaaatgtaaaatagtgtagccagttggaaaacagtttgtcagtttctcagaaggcaaagcacaaaactaccatatgacccatcatttctacttgtagctgtttacctaagagaattaagatcataaccacacaaacacacacaaatgtccacagcaacttttaaaataataaggactggaaacatcccaaatgcccatcaactggtaaatggattgtttaaaaaatgtatatctaggctgggtgtggtggcttgtgcctgttatcccagcactttgggaggctggggcgggtggatgacttgaggccaggagtacaagaccagcctggccaacatagcaaaaccctgtctctactaaaaataaaaaattagccaggcatggtggcatgcacctgtaatcccagctactctggggccgaagcatgagaatcacttgaaccagggagatggaggctgcagtgagctgagatcatgccactgcactccagcctgggcaatagaacgagactcctgtcttaaaaaaaaaaagagagaaagaaaaaatgtaaatctatacaatggtatactattcattaataaaaaagaacaaactactgacacatgctatgtcatgggtgaacctcaaaaacatgctaaataaaataatccagatacaaatctgtattatgtgattctatttatatgaaatatccagaaaaatttctagagacagaaagtagattaatggttttctggggcttagtgttgagatggggattaatataatgggcatagagatcttatttaagggataaaaatgttccaaaactgatctacgtgattgttgcaacactaaataaaatgataacaatcattgaattttgcacttgaaacgagtgagttttatgatacgtgaaatacagctcactaaggctgttctgtttgtttgtttggttggttggttggtttttttttgagatggaattttgctttcgttgcccaggccggagtgcaatggcgctatctctgctcaccgcaacctccgcctcctgggtttgagcggttctcctgcctcagcctcccaagtagctgggattacaagcatgcaccaccatgcctggctaattttgtagttttagtagagacagggtttctccgtgttggtcaggctggtgttcaactcccgaccttaggtgatacacccccttggcctcccaaagtgctgggattacaggcgtgagccactgcgcccagccaaggcagttttttttaaaaaaaaagtgataaaagggtgagtgatttcaaataggttggttcagggaaggcctctccaaggagctgtcagttgagcagagacctgagtaaatgagggcgtgaatgatgcagtgattagagatgagtgtgcaagcaaacatacaagttcttagggaacttaacaatttagcagtaacagaaggccagtgctattagagtagactgaacaaggggaatggtgatggtagataaggctggagatgaaggcaggtgttgtaggtcatgataagtttaggttttattttgagcatgaaagaaggtcactgaaatgatttttaaccaatttacttttttttaaaaaaaaaaaaaaaaaaacctcactggctgctttgtagaaaatcagtagtattaagcaaaaatagggtgattggttaggagacctcagaggtagattagggtaaaaggtggtttaggctggaaccagtggtggtaatggaggtgctaacgatacaggaactagaagaaattattaggtagatgatgagggcaagagtccttagcaaggtttccctttttaactaaaagcagcccccgagtcatttcttttctaacaaagagtggcctgaaaaatcgagctgcagacagagataagcaagctggaagtttgcacaggtgaatgccggccgctgtgccaacagaaaagggctgcctgagggccaggcatgttcaacatggaggctccatcttcccttttcttagtcaccacgtgcacagtaaagaaccaggcaatatggcaatggccaagtaaaaaacccatccgcataataaaagattagggtggggcagccagcttctttgagtgctatgcaaatggcatacctggtccaaccaatctttcgagccctgtgtaaatcagacaccgcctcctcaagcttatctataaaacttcctgcatttcactgtggaagtggcaatccattttccccaggacccctctctgcacagagagctcttctctttctttcgcctattaaacctccgcttttaaccttacttcttgtgtgtccacatccttgatttccttggcatgaggcagcaaacctcaggtattaccttagatgaatgatgctgcttcagtaagaagaggttggattctggagatatttgaaggtagagcagataggacttacctatatttacatagatataaggaaatatatatatatagagagagatatatatatagaaatatatatatttctatatatctacatatagaaaaaaatatatatttctatatatctatatatatatttctatatatctatatataaaaaatatatatttctatatatctatatatatagaataagacttaccttatttctatagatatatagaaaataaaatatgagtaaaaaataggaatttagaaaggttcctaagttttcagcttgacctgctgggtgaatggagttgccatctaccaagacaccgctaacagaggagcagttttggcatggtaatcaaaagtttcttttaaggctgtcacgtttgaaaagctagacctccagatggacatgtggattacacagttgggtatatgagtttggagtccaagggaagaggtttaagctagataaatacatttggaagtcattagcacataggtggtgtttaaaccaaattatctggacgatatcacttggggacagaagtcaggagaaggagaaggatctagcaaatgtgtttgaggagacattaatgaggtagaaggaaaaccaagaagtaggatgccttggagggcaagtgaagaaagcgttttaacacaagagactgatcgaggtcactgctcaccttgacgagcagtctcagcggggtaacaaagatgatatctttattagagcggacaccagaaagaatgagaggtgaggaaatagaggcagcaagtgcaaaccatgaaattttgctataaagggaagtggtagctgggggaaaggatgtgggttcaggagaaggttttttcctttttttttaaatgatgggaggcattttgaactggaaagaagccaactgggacttgggtgtgatctgaagaagagaagatggcctgtaccatagtctgagagttaaatggcacctttattgattattgatataataccctatggcttgcttatagtacagttacacctgtgttgtgtgatagggagccttgccagtggaagcaaattggtctaagatagaagcttggttttgacttgatagctgcccataagagggcagcagagcagagctaggaaattaaaaacaacaacaacaataataacaacaacaaagaaaaactctgcaaggtgatccctgcagggtaaagactttttagcaaactctttaaagatattaaagaaagttcagcccttcctccccagagcctcagtgctagattcttgcttagagaccccaaaggctccagacttgggaatacaactggtaacatggcagactatgagccctgcaggggagggagcaactgtaaagctgattgagtgtaaaagaatggctagtacagaaggaagatgtagctgttatatcgaagcattaaaaacaaacaaacaacaaactaggccaggtgggggccgggcacagtggctcacgcctgtaatcccagcactttgggaggctgaggtgggaggatcacttgaggccaggagtttgagaccgacctgagcaacatagcaagaccctgtttctaaaaaaaaaaaaaaaaaaaaaaaaaaatttacaagctgattgtgatggcacacacctgtagtctcagctacttgggagtctgaggcaggaggatcacttgagcccaggaactccaggttacagtgagcaatgatcatgccactgctctccagcttgggtgataaagcgagaccctatccctctctaaaaaacaagacaaaacaataacaataaaacaaattagtctggaccattgtcattatgaacagactattttttcaaagtaatcactgcaatttactatcattccataaaagccattgatgctgaattccaatgtgtgtggctaaattttaccaaaaaaacctagtatagaaggacttaatttatgctgggaggaagggagacactcatgctgagattggacctttaatgtgaatattcacagcaggtaatatgtacatagtgctttatagtttacaaaatattttacattttttggtcctttttagttgtgataattactgagacccttgagcaagtatcattgatatttttctcattttcatttttctgatttaaaaaggcttagagaaaggttatctgacttttccaataccacacagcaaaggaatagctaagctattccttcaggctcagaacttttgtcaccatagcattagatctacataaagagatggggatggagaatgtgtaaaaaggcatcacgtttaggttgaatgaaaagccagagagtagttaagtttggtggtaaacagaagatgaaaggaggtagtgaagaactgtcttctattaatattattattatgatttttttaagagatagaatcttgatctgttacccaggctctgtggaatgcactagtatgatcatagctctctgcatccttgaactccaaggctcaagcaatcctcttgcctcaaactcctgagtagctgggactacaggcacatatcaccacacccagctgattaaaaaaaattttttttgtagaaacaaagtcttgctatgttgcccaggctggtctcgaattcctggcctcaagtgatcctagcacctcggcctcctaaagtattgggattacaggcatgagccaacgtacctggccttatattatttttaaacttatttatatagaagaatcaaatttactctgtgcaactttggagagttgactaggacaggagagcccactcaatattagaaaaagagctctacaaaaaagacattgttacgttacattcctgaaatgttgaaataggggctagaggaatatttgacaaagctgtagagagaaatagttgaccttatgacctctaaaattcttttcaagatattttatctgcaaaaacctgaatagcaacaactatagttccacaacactctagttctacagaaggagggtgggatgttacactgtgctttcatgtttcaataattatatatctatccatgcatgtccacttctgcttgatgccactgaagtgggacctgaggagctggggtgctagggcagaaagagtaaggtctgtgcccgatcctagacaaaagtggaagcaattcactgcttcatccatcacggaagggcaactctttagcttagcaaactgagaaattttcaggctcaacaccagcaggaattcaatttgcagcaagatagacctcaggggattgaggcaatgattcagagaggatgggtggggtagggttacacaggaactttagagaaagaatcgtttgtgggtggaagccttgggcagaggtgcactcagtagagaagaaagccatttgttccagaacagcagtttgaaaggggtgtgttttgtgtgggcaatggtgtatgaggaaagggtttgtggggaagaagcgtgtggggctactaacaggcacagaaacacttgttgagaaatgttgttcatagggggattgctttgctggggcccaggagcaggtggtttggtgcagtgaaagaggccagaggggcagaaagaagggtcctagctgtggccttaaacacacacatacacacacacacacacacacacaccaaaaagcaaggaagaaccccttatcctctcagccaagataagcaagcgctgttaccagctaggtgtgcttactatggattttatacattttagagaaaatttctaatgcccatttgtcctgaactttttacttggaatatcgttaagtttacggaaaagtagaaaggatcatgtaatgaacactagtgtacctctcacctaaaccatcaatagtcaataatctgctacatacatttgttttctcctgagccatttgaaagtaaattgctgcagacaatttgcctatcagtccatttttgaatatattggcacgcatctctaagaataaggacattctcttacataatagcattgccattatgaagatcttacctatgaagatccacattaattcataagatctgcatgtgtgttacttatcagtacgtcttataatggattctgaatgctttcccttttcttatttctctagctgtcatctttgaaggtaaaacctcgactgcatatctggccagccaggccaggccaaagtacctgtatactgggtgaggggataagaaagactctctcaaagagcacaggaacctggaagcctgtcagaggtcacctctcacggaagcccaggacgcttccttcctgctgagctaatcttaactgctgacctccacgcattgctcagggctccctccctcccttcttccctatttccttccttccctttcctctcctttcctgtctctttcaccaaaccttaacggacaactcttctgtgctaacttctgtgccagtgtattagtccgttttcatgttgctgataaagacatatcagagactgggaagaaaaggtggtttaatttgacttacagttccacatggctggggaggtctcacaatcatggcagagggtgaaaggcacttcttacttggaggaggcaagagggaatgaggaagatgcaaaagtggaaacccctgataaaaccatcagatctcgtgagacttattcactaccacgaccaaaccatatcagccagtatctgccatcccaagtgaacttagtctgtgaactcaaaatagtgctggccaggcatggtggctcacgtctgtaatcccagcgctttgggcggccaaggcggggggatcatgaggtcaggagatcgagaccatcctggctgacatggcgaaaccctgtctccactaaaatacaaaaaaattagcagggcatggtggcacatgcctgtagtcccagctactaaggaggttgaggcagaagaatggaagaatggcttgaacccaagaggcagaggttgcagtgagccgagatcgcgccactgccctccatcctggcaacagagtgagactctgtctcaaaaaaaaaaaaaaaagttcagaaaaggcagagtttcttctggcgagtcattcctttctttggctctgtgacccgccctttaggagcatcgtgcagatggactggcttgtccacctggtggccctatcagggtatatgggcttggcatggaaaaagcctctgctccttggatcactaatattaccttgatcatcatcattacctgaccagagtactagacacagtttcatgaagagaaagcaaaccctttcatcctgaaattttaacttagttgctcctcccatggggtgattcttggtgcaggggagatatctatttgcaaattgaggggcatttgtgtctaccttcttgacttaggtggtttctgttttgtttctcgttatggttgttggctgtcctttcaagattatttctacgcgtcaaaaagtctgtgagctaattttaacatgtcaggcatcttactggaaaccacacatttactccgaataaagctacaacatgctaactaaaactaagtttgtttgaactattcaaaccattgtggtcatctcattcttactaaaaaccttttctggtaagtttcatttatttatttatttttattagtacaaatgggaaaataaagtggtgattcataggtataaatattatatggcaaaatttcttcaacacttgaaattattagtaccacctgagaattacatcaggtcaaatcagcatttggtaaatagtagtcaccatttgtagaattaaaccatccaaacttctaatctatcacctagggctaaggactcacacacttcagctctggggaccaaaatgctggcttcaggaagcataatgattttagcctcgatacagtgatggcataatcaatcaagttgtatcctgcctcttttctctcacctaaatttgatttgtgtgattatttattgcagacagttttgcaagctgactttaatcctatcttggaatgaggtggagtataaaagaatacaaatcaacaaacatgctaatgtattttaagaaggagataggagagtttggaaattggaaagggaaattctaaattttgagaattgctttctactaaaccatcattgtccaggagtaacacactagctcacttcttaatttcaagtcagaaacattttcccaagcttatcctggcccgaaggaactgtgacgctgctgaccactgatgctcaccaagcaatcatctctttgaggtttggtctcccacttgagtcagggagagaatgtatggggcaggtttattttcactgcacatatttttcaatgtagatcttgttcatagttttaactggggattggttggtgtgagtaactcgcatgaaactgaaaaatgcgctggacacagtggttcatgcctgtaatcccagcactttgggaggctgaggcaggcagatcacctgaggtcaggagttcaagatgaccctggccaaaatggtgaaaccccatgtctactaaaaatacaaaaattagccaggtgtggtggcgggtgcctgtaatcccagctacttgggaggctgaggcaggagaagcttgaactcgggaggtggtggttgcagtgagccgagatcacgccactgcactccagcctgggcgacaagagtgagactccatctcaaaaaaaaagaaactgaaaaactcagataagatcaagtttgcacctgtaagttgtggataggatccaatgtatcttggataattgtgcagcctccacctcctgaaaccctttctgggtgtccatctggtttttttggacatggtcccccagatacatttgctaagttacaactatatcttaacaaatatttatagggacctatgggggctgggaataataaaaagggtctaataggttgggcaaccccatctctacatctctacaaaaaattaaaacattagctggatatggtggtgcccacctgtactcccagctacctgggaaggaatttttaaaattttatttaaaaaaaggaaagaaaaaagaacccatgatgatcaaaagattagaagctaccagtttagctggtacatcttcttcagactttagtggttttgtcatttggattgaacgcagttcccactgaaacttatttggccactatctgaagttgaaatatcacacagtgacaattgtttgaaaatttcagctccccttctcctgcctcctcttcatctctaagtattttcactcccatctactcatggcagtatctggccactgcccattctcagaccagaaagggatcaggaaaaggccagtgtgtggggtgaggctgacttccaacagttgagctagtacagagccactgagcatttccctccctagggctcactcttcctcaaaactgctagtgtcttgcagatcctctctcaaaacaaaagaggaagtcagaggtggagcagggagtggtttgaactactggttttactggaaaaggattcctgttccaaacctcaagagcaagttcttcgatcttgagcaggaaagaattaaggacagggcgcagagtacagtatagttaaaacagttcattagaaactactctattacagagtagggcatcctcagagagcaagaggaggaatgcccctactttaaatgtaatgcttgcttatacaggatattaaggttaagaatagtttactttgggagtccgaggtgggtggatcacgaggtcaggagatcaagaccatcctggctaacacggtgaaaccccatctccactaaaaatacaaaaaattagccgggcatggtggtgggcacctgtagtcccagctactcgggaggctaaggcaggagaatggcatgaatccgggtggcggagcttgcagtgaaccgagattgcgccactgcacttcagtctgggcaacagagccagactccatctcaaaaaaaaaaaaaaaaaaaaaaaaaagaatagtttactttattataaaggcttgtgatcaagttgtgacaggctattagtattgttattctccggtgtaactattgatttcagcaataatttatgagtgtagtattatctttaaagtgaaacccatgtttatttttatgtgtttatttgcttacaccttcaccaccacaagaaaccctcccacccacctttttttttaagacagaatttcactcttgtcgcccaggctggagtgcagtggtgcgatcttggctcactgtagcctccacctccttgactcgatcctctttgatcctctggattctctcacctcagtctccatgcccagctaatttttatttttatttttttatagagataggattctaccatgttgcctgtcacgtgtgtccgtgtgaagagaccaccaacgggctttgtgtgagcaataaagctttttaattacctgggtgcaggcggactgagtccaaaaaaggagtcagcaaagggagatggggtggggctgttttataggatttgggtaggtagtggaaaattacagtcaaaggggattgttctctggcgggcaggggtgggggtcacaaggtgctcagtaggggagcttctgagccaggagaaggaatttcacaaggtaatgtcatcagttaaggaaggaatcgactgttttcacttcttttgtgattcttcagttgcttcaggccatccggatacttacacgtgcaagcttgggctcagacgcctgacattgcccatggctggtttgaactcctgagatcaagcaatctaactgccttggcctcctgaagtgctgggattacaggtgtgagccaccatgccatccaagaaacccatttttaaactaagaatgcctttttccatcaactcatttcctcaaccataaacattttgtgattaacagtgcccaatttcctgggaaagtaacccagcaggtttggcttcatctggcctttattcaagatgagtcactctgattgggacacctcgaatactggtgcaaatacccaaaatgaaacaaaactgcctgaacttactcattacccccttccttacaaagccagcagacttcctttttgtaatttccttccccttcaagtttcctttcctttcctgttctttcttttttttcattcctttttcctttcctttctcctttcctctttcctgtcctttcccctttcctttctttttcttttcttcttttcttttctttcctttctcccttcccttccttcccctccgctcccctccccgcttctcccttttccctcccttcccctccctttcccttgccctttcctcccctcctcttccttcctctccctgctctcccctcccttcctttcccttccttttcctttcctttacctttcccttccttttcctttcctttcttctcctttccattatggaaatttttaaacatgcactgaaattagaaagaagcatatgatttaatccccaagtgcccattacatgcagcttcaacagtaatcaacattttgctcatcttgtttcatctcttctccttattttgttatttttacttatttgtttattgctgcagtattttaaagttaattgtgagtttatttttaatggagtctctgtctccccatggtacaacttgaggctgggcagaggaaaccaagcttgatgagttcagtgcctctgcctgcctccctggctctccattgccgcctcacagttggaatcaggtgcgaaagctatttcacaacctgatatttattcttctcataaatgttgttgactaccttcattgttccacacactttgcttggcactgaggacaagaagagagatggcataggaagctctcagctcagtgtgctggaagataagtaaaagggcaatcctgacggtttggcctgattatttccacaggtggaagagttttatttaccatataggccttcttaagtttgcttcgtaaatctagagccatatactattcacaaggccacagaatgaacttctttctagaagtttccttaagaaatctcagactgacttttaaaagcctctattatttgctgttgtgaggttagaaaaaccaagctcaagaatctctttccactagatttttacccacagtacctatacatttggatgaatttctttcttctcaagtttctcatattttcttgaagtttcttacctgccaagaaggtaaggaaccaagaactaggaagtgaccttcctcacctcctgcaagactgggactctgtaagccagatcccaggtgggtttttctgagaggattttgtaggcattggctcatcaaagctgattaaaggagcaccattctcaaaagtgacattctggcccacaccttggttgtgtaactgtttttctgttatatcctggcaaaaaagagaaaagattcttgctgaacctattcagataactatactgttataaaaagtaagaaaggaggtaagagtttctgaattcttagttggagtatgtgggtcagtaagaatcagatatcatttaaaaatgtttatttttgataaatattttaattttcaaaagctcctaacttatgaattagagagattttaagaagaaaggaaaaaaccttgtttatatgttcagaatagaacattaaaacaacatcaacattaaagcagaactttaaaacaatattccaaacaaataactacaacgtttctttataagttcattcagctttacataattaattcttattctgttgaaacttgagttaactgtcatgaagaggttttttttttaaataaaaaaactaaaatgagttttggaaatctggagtcagtctacaggtttgatataaaaaaaattttttttttttttgagatggagactggctttgtcacctaggcttgactgcagtggtgcgatctctattctctgcaacctccacctcccaagttcaagtgattctcctgcctcagcctcccaagtagctgggattacaggccccccgccaccactcccggctaattttttttgtatttttagtatagacagggctttgtcatgttggccaggctgatctcaaactcctgatctcaggtgatccacccgccttggcctcccagagtgctgggattacaggcgtgagccactgcacccagcctgatctaaaaattgtctaaatgatgttacatcaaaagcctatatccaagtatatgctttgaagtattaatagtttgaaatatctggtacaatcgtttttcatgaggctttgagactgtccttctttattgaagacacaaattgtggcctgtaatttatagcagagtctttaggcaaacattagagtagagcaaaaactatctgtaggtgacagagctttaaaatgactgtggttagtttattaccaataattttcaaatgtgaaaggttatgcaggctcatgataagaataatgcaacttacaggccgggcgcggtggctcacgcctgtaatcccagcactttgggaagccgaggcgggcggatcacgaggtcaggagatcaagaccatcctggctaacatggtgaaaccctgtctctactaaaaatacaaaaaaattagccgggcatggtagcgggtgcctgtagtcccagttactcgggaggctgaggcaggagaatggggtgaacccagggggcggagcctgcagtgagccgagatcgcaccactgcaatccagcctgggcgacagcgagactccgtctcaaaaaaaaaaaaaaaaaaaaaaaaaaagcaacttacaaagaaatttggttatttcttcaacatatacaaccagataataaagtcatctccaataatttttagatgaaatatctctaaagataatgattaagcctatttcaaagaagagagtgaatattacttacactgataaaaatgtttgaattttttttttcttttgagacattctgttgcccaggccggagtacagcagtgtgatatcggctcactgcagcctcaacactctgggctcaggtgatcttcccacctcagcctccaaagtagctgggactacaggcacgcaccaccacacccagctagtttttgtatttttagtagaaacagggcctttccatgttgcctaggctggtctcaaactcctgtgctcaagtgatccacctgcctcagcttcccaaagtgctgggattacaggctgaatgagccactgcacccggcctgagcatgatttttatcgaggatgacacccagaatatcagagagctggcatcttttctagcagaggtataggctgtaaaaaaacaaagaacttcttggcaggagtgattcataaattagatgtgattttggggagctccttttgtagactgttggttctggaagtttctgttgcaccagagtggttgtggtttgtttaacggttcatatgttattagcaaaactcttccaagattgcagaagctgcccaaatcactcagttagaaagaacaagacataatgtggtaactcccccagagatcaatccatggactgaacccatggctatgcagggcctgaacaggtagaaatctagatcagagaactacaatgattagagagggggaacaaggatcataagaataaagtagcaggcagactaagaagggttgggttctatagattgtgagcaggtttgtgtagttcattttacaaatgtgaattgtgattcttaataataactaaaaatacctatcttatatattcaagattgttttcggaatcactggtaaccaattgttctctaggtccatgaggaaatgatttcacctggaacacattatcagggtctaggcagatgctaaaaaagaaaaaacaatgggtggaagtcagcagatcggggcctcattcctgttctgccactcgccacctatgtggcctcaggcgagtcacttaacagcttgaggcctcagttttattgtaaaaccaaagaagtaatttgagaccttcttacttggtggggaagttgtgaggatcacatgaggttacttatgtgaaaatgaactaaaatgtagcaccatctgtttaggtccccagaaagcccaaacagcacttttatatgaatgagaagaaaggctcttcctcctggtgaagtcaactcagcgctagtttgtacagtttgtttacagagtataggttaggttttcatttctatttaccccctttgctggctacccttaagcaaaccataatcttcagaaatgtttctgtaagaagaattatactacataatatcataagaaagccttttctaggaagatgtttaataggctaggtccctctgtgtttggtgggtagactgacgctatgatctgcacacaattgagcactctgggatcctgatggaagaccgtgcttagatattgggtcatctcaaataacatggcagtttctgaaaaagtgccccctctcccaccacagactttgtttatctggtgggcatgtgaacgacaaaaaccgtaggaaaaaagataatggcttctttgggacccacaagaaaagcattgttcagtattccttcccttctgctgttcccatgtctcgcatcccaagagagacctcatacctggaaagcctccatcccacagctgagctggattcttatatccagtcaactggagcagctgcaattgcagaattaaggaaaaactcatgtgtgcacagtgtagcgagacactaaccattactgattgtttcaaaccgctggttctcaaccacgtcaccagatccaacctttcatagcaaacatgttgtttcccttttactatcctgaagtgtaattcatagataacataacacatttacacacataaacctaggtgatctattctcagtcttagcactcaaactattgctctaacaaatattttctttcactcctgcattacgcttttcctctctactgtgtctttactatcaacaaacaagctattatttcccccatcttaaaaacaaacaaaacaaagttaaaaaagaatctctggacactgtcatccagtctcatgtctttagatacataaccatatgcctttatgtctctttatgtctcaaatttatatttccagactagactcttcagaactccagattgctgtatccactatgtccaactaccacttgacatttcagcttgcaggtttttttcttttcttttcttttctttttgagatggagtggagttttgcttttcttgcccaggctggagtgcaatggtacggtctcggctcactgcaacctccatctcccgggttcaagcgattctcctgtctcagcctccaagtagctgggattacaggtgccctccaccaagccagctaatttttgtatttttagtagagacggggtttcaccatgttggccaggcaggtcttgaactcctgatctcaggtgatctgcctgccttggcctcccaaagtgttgggattacaggcctgagccaccatgcccggccaacttgtagtttctatagacatgttaaacttaacgtcaacatggggttgagttgggtggaggaagattgcaaagatacacaccaacgtgtaaataacagtaggatgagggtcttgtgtgtgtatttgtgtgtttctatatactattacataaaacttctataatgagcattaacattttgaaaaactttttattttgaaataattatagattcacagaaagttgcaaagatggtacagagagtccccatgtacctgtcaacagttttccccagtggttatatctcacttaaagagtacaatatcaaaaccaggaaataaacattagtgtggtgtgtgtgtgtgtgtgtgtgtgtgtgtgtgtagttacaagtcattttattgtgtgtttattcctgtaaccaccactgcaatcaagatacagaactattccatcaccacaaggatctccctggtgatacctctttgtagtcacgcgtatatccctatccccatgatccttgaccctgcaactatgaatctgttctccatgttatgtaaatggaatcatacagtacatggctgcttgatgatacatttttttcatttagcataatgcccttgagatgtatctaatttattgtgtgtatcaatagttcattcctttttactgctgagtcatattccatggtacatgtaccatggtttgcttaatgcatcacccattgaagaacatttggatggtttccaggttttgaatattatgaagaaaactgctattttatttctgtacaggtttttatgtgaacatatgttttcatttctctgggttaaatgccaaggagtgcaattgctgggttgtatggtaagcatacacagttagacagaaggaataagttacagtgttcaatagcacagcaggatgaccatagttatcaataatttattgtatatttcaaaatgattagaagatttggaatgttctcaacacaaagacatgataaatgcttgaggtaatggatatcccaattactctgacttgattatcgaacattgtatgaatgtatcaaaaccccacaaatatgtacaactattatgtatcagtaaaaaaaggaatctgacaaactgttttacagagtggccataacatttatattttcaccattaatgtatgcgtgtacccagtttctctgcctccttgccggcagttggtatttgcgctatttattcttttagccattctgatggatgtgcagtgacatcttgtcactccagatctctgaagttctgtctgcaattctgtcctctctggtactgtgctctgtgaactccagttgccttggcttccttggacccccagttttatctcctcagctcaggaagactggcggactctgcctgggtctccctctctgtgccacagcctgaaaactctttctaggaaataagctgggagaattgtagggttcagttttaacatcaatcttttctacccctatctctttacacctatctatctgtctgtctatctatctacctatcatttatccaccatctatttatttatcataaatttttcttaactacaagccaagggttttagtatcagaactgctattagttatctgtagcatttgggacattaacttacttgagccacttctttgttggtgaaatgagggtcatcttatatcagccttctcataattccttctgagagattccaggatactggttgactcttctagaagatacagtgagcagtgttggtagctacggtccttagtatgtgctatttctaaacaggaaaatgatattgattgggtgggtaatgagcatgtgttggtaattgctatgtaagagcaataacaacaacaactaatacatttagccttttacatgcagtgtcttatataatatttacaacagccctgtaaagtaagtgctactattatccaaatttattcattttttatttaaaaaatttttttagtattataaaccactttatgtccaagaacgattcaaatttagaagacgagaaaactgtagcctagaaaaagaaataaaaatgaaaattaaaaacctgtccagtctaaaggttatacttacacagacttaggttctttctttgtatttaattaaaggttaatttcaaatgatctctagtagtaacaaaactctttagttataaagaagcaggtgatgcatggttgttgaatacattacccctgctgaccttagactgctgctgggctcagcagataattcttgattttctcttcacattgcaaatagacctcaccagaataaatgggcagaatagacaccaaagagggatagcgcaagcaaatgtgagggtgaaatgcagtcagtgccttgcaaaaggaagtgctcaatactggtagtcggtgtcattgctcttactgcaaattataaacaccagcactgcaaaagtcagcccagtagactttgtaaatcacagaagtggctcctagaccaccatttgaaaaattctgcctgaaggactaaggaaaacatcttcttttatttttattttatttttttataccacagtttaggaaaacatcttcttaaaagatcgtgtttatgtctacagatgatttttatagtgccttaacagtctccagagtggttttaaaaatattatctcagaatgtcaatttcagctaaagaagtgaaccttaggatcaacattgtaaccctcctggttttattcacccagagtatagggactgataatgataatgctgctttggatagtctcctatctagggctaaatgatcagatttgcaaaatccagatattcttatgggaatgtggttattggctaggggaatggaaagagggagtagagagtggaaaactggataaagttataggtaaagatatgtgaaaactcatgattgtctcaaatactctaaatcttgtcataatacacttgtaaagtaataatcatgttggagagatggccaaataaaggccaaagatcttgacactgcagaaattataggagaggattaaaggaagtacatgtggcagatataagaaaagactaaacttgagattcatgcacaaggtcaggctgcataaaccacaggatagcgggtgtaactcaggagcagaacaattgatccatgaaacaaaactgtctgcagtttcccaggctggagagatttcccgtcttggatgtctggatctgtctcagtgcccagatagcctcacttcaaagtgtttgtgggaacagaaagaattggctgagtgtgtttgttcagtgctaggcggaggaagtgaaacggggagtgggtttaggaagtaagtgtgtgtttaagagcacgtggaccaccagaagataaccatttttcttcagactagcagccagggcactgctcacgaagaaggaaaccctgggagggaagaacttggggaacgagaggacacaagaatctctgcagctgcttatgcatgtacgtaagtcacagaggtgttgggtgcctcaaggaacaacatggaagtcctctctcttttttaaaataaataattttttaataaattttcgagcactttgggaggccgaggcgggcgggtcacgaggtcgggagatcgagaccattctggctaacacggtgaaaccccgtctctactaaaaaatacaaaaaattagccgggcgcggtggcgggcgcctgtagtcccagctacttgggaggctgaggcaggagaatggcgtgaacctgggaggcggagcttgcagtgagccgagatcgcgccaccgcactccagcctgggcgacagagagagactccgtctcaaaaaaaaaaaaaaaaaaaggaatctgtcattacaaccttctctcacaaagaactccaggcgcagacagcatcaccacagcattctaccaaccatttacagggaaagtaatgcacgtccacaaaactcttccagaaagacaagggagcactcaccagctcctgaggccaacgtagcctcagtccctaacccagcaaggacagcagcggagaggagctcacaggccagcccccgccacacgtacacaccactgcgaggctccaaagctcaagcagcgtgtatccagcgaatacaacaagaataatgaaaaagcgttatctgatcaattgctagaggagcagaagtaactctggcaaacctcactgaatgtgaatcctgaaagtgccttgatctgcggttctacaagttatggtgctggaggtctcagccaatgctgtagggtaggacaaagaaagagctccagtgccagacaagaaaaagtaaaactctgattgattcacccatgaaacagtgtctgtgtttagaaaccccaaaagaatatatagacaaatcataaggatgaaaaagtgagtttgctccctctccctctccctctccctctccctctccctctccctctccctctccctctccctctccctccacggtctccttccacggtctccctctgatgccgagccaaagctggacggtactgctgccatctcggctcactgcaacctccctgcctgattctcctgcctcagcctgccgagggcctgcgattgcaggcgcgcgccaccacgcctgactggttttcgtacttttttggtggagacggggtttcactgtgttggccgggctggtctccagctcctaaccgcgagtgatccgccagccttggcctcccaaggtgccgggattgcagacggagtctggttcactcagtgctcaatggtgcccaggctggagtgcagtggcgtgatctcagctcgctacaacctccatctcccagccgcctgccttggcctcccaaagtgccgagattgcagcctctgcctggccgccaccccgtctgggaagtgaggagcgtctctgcctggccgcccatcgtctgggatacgaggagcctctctgcctggctgcccagtctggaaagtgaggagcgtctctgcccggccgccatcccatctaggaagcgaggagcgcctcttccccgccgccatcccatctaggaagtgaggagcgtctctgcccggccgcccatcgtctgagatgtggggagcacctctgccccgccgccctgtctgggatgtgaggagcgcctctgctgggccgcaaccctgtctgggaggtgaggagcgtctctgcccggccgccccgtctgagaagtgaggaaaccctctgcctggcaaccgccccgtctgagaagtgaggagcccctccgtccggcagccaccccgtctgggaagtgaggagcgtctccgcccggcagccaccccgtccgggagggaggtgggggggggtcagccccccgcccggccagccgccccgtccgggaggtgaggggctcctctgcccggccgcccctactgggaagtgaggagcccatctgcccggccagccgccccgtccgggagggaggtggggggggtcagccccccgcccggccagccgcccagtccgggaggtgaggggcgcctctgcccggccgcccctactgggaagtgaggagcccctctgcccggccagccgtcccgtccgggaggggggagggggggtcagccccctgcccggccagccgccccgtccgggagggaggtggtgggggtcagccccccgcccggccagccgccctatccaggaggtgaggggcgcctctgcccggccgcccctactgggaagtgaggagcccctctgcccggccagccgcccagtccgggagggaggtggggggatcagccccccgcctggccagccgcccagtccaggagggaggtggggggtcagccccccgcccggccagccgccccgtccgggagggaggtgggggggtcagccccccgcccggccagccgccccgtccgggagggaggtggggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcctggccagccgccccgtccgggaggggggagggggggtcagccccccgcccggccagccgccccgtccgggagggaggtggtgggggtcagccccccgcccggccagccgccctgtccgggaggtgaggggcgcctctgcccggccgcccctactgggaagtgaggagcccctctgcccggccaggaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggctgcagggtcctctgcctaggaaaaccagagacctttgttcacttgtttatctgctgaccttccctccactattgtcctatgaccctgccaaatccccctctgcgagaaacacccaagaatgatcaattaaaaaaataaataaataaataaataaaattttcaactttacaaacaaatgtgataataattcatggaactcatgaatattctttatccaggtacattatttttttaaacttcccttatttatttatttatttatttatttatttatttatttagagatagattctcactccggttgcccaggctggggtgtagcagttggatcatggctcactgcagcctcaacttcctgggctccaaccatcctcccacctcagcctgcctggtagctggaactgaagacacacgccaccaagccaggctaattttttcatattttttgtagagatggggtttcaccatgttgcccaggctggtctcaaactccgggactcaagtgatccacctgcctcggtctcccaaagcactggaattgcaggcatgagccactgcgcccaggccccctatttattttttatcattttctctctctctctgtaaacacacacatgtatacatatccatatatctatattccgaagcatttgagagtatattgcatatgttgtgctcttttcctgcttaatatttcagtgtgcatctcctaagaagaaggatattttcttaaacaatcagggtacagttttacattcagtatatcaaatacatatatacagtgattctccctacccaaagtttcagttacccatggtcaacgacggtctgaaactattaaatggcaaattccagaaataaacaattcataatttaatgttgcatgctgttctgagtaatgtgatgaaatctctcaccgtctcactccatcctgcctgggatgtgaaccatccctttgtccagcgtgtccatgttgtagacaccacccacccattagctacttagtggccaatatcagatgcaccgtcacagtatctcagcgcctgtgttcacataacccttattttacctagtaatagccgcaaagtgcaagaatgatgatgctggcaattcagacacgtcaaaaagaacccgtaaagtgctccgtttgagtgaaaaggtgaaagtgtctcaacttaataaggaaaggggggaaaaacatgctgcaattggtaaaatctacagtaagaaagaatcttttatctgcaaattttgaacagtatattgttataattattctattttattagttgttgttaatatatattactaatttataaattaaacttatgtagatatgtatgtataggaagagaacagtacatatagggccttagacattcactggggtcttggaacatattccctgtggataagggggactgccataatactcttatctactacagagatcatacttttatcaattgcctcaataatgttcttcatagcaattttttttttttctggcagggaatgtgtctctttgttaaggggatgagactggcctagcaagacaaagatgcatgctcagctctccttaggatcttctttttttgagacagaatctcactccgtcacacaggctgtagtgcagtggcaccatcttggccttctcacgggttcaagcaattctcgtgtctcagcttccccagtggctgggactactggtgcgtggcaccatgccggctaatttttgtatttttagtagagatggggtttcaccatgttggccaggctgatcttgaactcctacctcaggtgatccacctgccttggcctcccaaagtgctgggattataggcagaagccaccaagcctggcctccttagaatctttatgagtaggggaacccccagcaggtcaattgtttgattttctttggtttcattcttattccatttcttccctgagagtataaacctaatcagcaagactactcagatgttaagagatctttaatagtagaaggaatctggcttaacaagatgtagctttagcaggggcctgagatgtaaagttggacatcttccctccagcctcagcttaggagtaagaatggactgtggtactttttctattcctttttatcttttgtggggaaggtgggtaacaagaagagtaatagatatttgaataagcaaaagcaaatttgggttaaaaataaagagatggtcttctgtggtaaatctagtcctatattgacaataaggctttctacaagaatttccctaaaggagagtgtgacactgtacacgcttgtcttctcaatcattctctggttatttggcacaaatttctgtttaagaatcaattgatgtcaggggcatggtggctcacacttgtaatcccagcactttggccaaagtgggatgattaattgaccgcaggagtttgagaccagcctgggcaacatagcgagactcgtctcaaaaaaaaaaaaaaaaagagctgggcatggtagtgtgtgcctgtgatcccagctacttgggaggctgaagcagaaggatcacttgaccctgggagattgaggcttcagtgagctatgatggtgccactgtactccaatctgggtgacagagcaagatcctgtctcaaaaggaaaaaaaaaaaaaaaagaatcaattgatgtcaactttcctcactgatttcccatatgtaaattacctcagaactgcttcccttggtcatctccctactcttcaagagaagaaacatgaggaaacttccacattttattacacagcaacagggaatgtggtagggaggaacaagagaaatgggaatggaaagagaaatcgctgccttgaagagggtagagtaatgtgcagaagacacaggagaccccagatacaatgctgtagggcttagtgagattacagtctctactagagccaattttgatctcaaagtcacgttcttccatttcccgcttcctctccaggcaaaatgaagctgaatctggtgcagatctttttcatgttgctgatgctgctgctgggcctggggatgggcctggggttgggacttcatatggctacagcagtcttggaggagagtgatcaaccgctcaatgaattttggtccagtgactcacaggacaaagctgaggccactgaggagggagacggcacccaaaccacagaaacgctggtgcttagcaacaaagaagtggtgcaacctggctggccagaagatcccatcctcggtgaagatgaggttgggggtaacaagatgctcagagcctcagctctctttcagagcaacaaagactatcttaggcttgaccagacagatagagaatgcaatgatatgatggcacacaagatgaaggagcccagtcagagttgcatagcccagtatgcattcatccatgaggatctaaacacagtcaaagctgtctgtaacagtcctgtcattgcctgtgagctcaaggggggaaaatgtcacaaaagctcccgaccttttgatttgacattgtgcgagctgtcccaaccagaccaggtcactcctaactgcaattacctaacttctgttataaaaaagcacattattataacctgtaatgacatgaagcgccagttaccaactggacaatgaagcaactcatcatcttttttctcttcaccttctcctgttcctcttccttttttacttcttctttctcatatagttctcctgatcttaggtatcatgcagatggaattcttccttgccctatgggtcacccaacttgcattttgttcctaggattagagatggtaggataaggtgatgatgcctagtttctctaagctctctgcctctcctttcccttaccctggaaaggagtaagtgaagagctgctgtagtccgtactgtagtcctggccatccatttgtttcctgctctgctctgagtttgtctctggatgtggactggaagagtttagtgtatcctttacccatgttcttccctgctgcccaccctgagcctctacaacaatcacataagactcttgggttttgcacaactgcacttctctattgcggatgaagttaaagtgattctatctgtaatggcttctggaggaccatgtggaacaggcttccttttccgagcttggaaaaatttagggcctaggtatgggggtctgctggggaggtggtgtggtgctgtagagcaagatagaagatgggctggagcaagaatagaactcttttttcttgacccttcactgcccttttctctttcttcccaccttttactagcagcctccttgcttggcttcttgttttcatctcttacctttgcttttgtcctttgcttctttttctccttactttctctgttctccttttcctcttctttttctttttgggcccgctcttctctttatctggatccttttagagattcagtcagccgatactgatcacttatgctatgttggtcctatagtcagtcatgcaagcagatgttcgtcctatagtcagagtctggcacagggagttagaggggggtgggtcaagagaatgagaaaaagagagaggaaaagagagaaagagaaagagagagtgagaaatcttttttgaattatgtccagaagcagaatagtgctcatatgaggtgcccagtagatgtgggatgaatgggatgggagacagtctttttctcatttagcatcgtttccgctttattgctctaaagaacaagaaagttagtgaaagaataatttcagcagagaaggtatcaaacttaatcaaggagaagagaagctgtgtggctggatacacagaagatgcaagtggctgccctcagcctatttcctctaaattcaaatgagaaatagtgtagttagtcatgcatagggagaagaggaatctgagaacatagctgtaaggattcaccgtgtgactgaattttgagatttccttcccctagagtttttctctgcttcacattcctagactattatagacccaagtcagggacatacataaatgggagactgaagggaagaacggtttgctttactctgacctggcttgcattttcctgttctttctgtctttattctctttatccttcctgttttcacagacaggcaaccactttagtatcctcctagacgtccctgattcaatatatcccttatacctctgactcacttccagcaataacctcttaggaacagtgttgtctcccagggaattctaataatagtggacaggaggtatgtctccatctgtgggctggcctgatgttttagaggtggtaatgaagtggtgaaaggtgatgacccagccaaggcagattcctatgcttcctgagggcgaatccctctccggggaaagagacaaaagattatctaaggtaagggggaaaaaatgagaaataggatgggaagaggggaaagaagaataggtgtcagagaaaatcggccacgttagcaatctgtctggtaggtaaaccaaggatttaggaatgaaatgtgaaagatctccattgtatggagtgaattattaagagaatggaattagccagggattaaagcctatattctctagtattcagatgtggctccatcctcttcagcttccgtccagcttctctccctaagcgttccggcactgtttgatgggcatactcatctcctccgggtcttcactttgggcaaatctcagtgggtcatgtttttcttttgttttgttttgttttgtttttgttttttttgtttaatctgaccacgtagactatcgcaggaaagcaatttacaaaatactccacaggcgcctagtggctcaagcaggaaaatatagcttccatggctgataacagggtgacaaggcattgtggggacctcacctcccaggggcagaaaattaactcactgtagctcaaattctgcctcattcacaagactttcaccgagtcttctaattccaatgtagcttcctctctacacttccaggatctgtgttgagcccatatgacagatcccagtcccttatctacagtacccaaatctctgaagctctgaaaatggaaagtttttttcaaagtggccccaaaactcatttagatatgacacctgactagattgacaatgtgaggctatttatcttgtttatttatgctatgtgaccattacatatttcactgtggaaatatcactgtgttttgttatgagtaggtccttctaagagtgtgttagtcatatatgatataaacatacacacattaacatacaatagtgctttttaaaatctgaaaatgttggccaaaatgcattggccccaaaagtttcaagtaagaaattgtgggatctatatatactatttaattagccttaattaatttgagtatactggatatgatcctagttaggccactagcacctttgtggaaggatctgtattataagtttcttctatattcttcattgacacatttattaatcaatgactatctacctatgggccaagggatgtctcctctactgtttggaagacactcaaatattgtcttcaaaacactctgtacaagtttttggccaggtgtggtggcttatgcctgtaatcctaacactttgggaggctgaggtgggaagaacactagagcccaggagttcaagaccagcctgggcaacgtagggagacctcatctctacaaaaaatagaaaaattagccaggcgtggtggcacatgcctgtaatcctagctatttgggttaggctaaggtgtgaggattgcatgagccccagagattaaggatgtagtgagctatgattgcaccactgcactccagcctaggtgacagagtgagaccctgtctcaaaaaaaaattttttttaagttgttctgagctttgctgcttattaacattactgtccaggaatggtggctcacgcctgtaatcccagtactttgggaggctgaggcaggtggatcacctgaggtcaagagttcaagactagcctggccaacatggcaaaaccccatctctaccaaaaatacaaaaattagcccggcatggtggtgcaagcctatagtcccaactacttgggaagctgagaaaggagaatcacttgaacctgggaggtggaggttgcagtgagccaagatcatgccattacactccagcctgggcgacagagcaagactctgtctcaaaacaagcaaacaaacaaacaacaacaacaaaacattaccttggggagtttaaaaattttttaattaaaaaaaagttacagggccctcttctagcaatattggtttaattagtctgagttggagcctagacatcaggtggggtccagcatcttggagcctaccagttttcctgtgaattaatgtttcaaaactgttaataaagatgttgaactgctcaggttattaactaatatgatgtggtgtgatgtaggagaaaagaaccaattcttgggataaacgtgagaatatctcagctctgccattcaaaaaaaaagcagctgtgactatgggaattgccctcagctctcagaatctgaggtttcttatcagtaaaatgagaaaatgatcatacctactttatagggtggcagtgaggattagatgagattgaacagcccatggtagggttcaatgaatggcagctgcatttggtggtgatgctgcagggctcactgcccacggagaacacataatattttgacggagtccttctggaagcagcactatgacacgaagtgcaataccatcagcacaggtttgagtttcaggtgtgttggcagtatgtggacatgtgggatcttataggatttttaaaatttcattccttggatggccacaaaatttatattctagggccagtagagtccttagacttgagcgagcagggccactgccctcaagggtccctttggagtgccttccatacaggaagttaccccactacagtatctgggactggctgaggccagcagtgccatgtgggtagggtgctctgagcttagactaggactggtgtgggcccgggtcccatttctcccctttggagcactgtctccccactgccatgtgtggggtcaactaggtgctgcaaaagagttctgggacttggtcaggcgtggtggcttatgcctgtaatcccaacactttgggaggccgaggcaggtggatcacctgaggtcagaagttcgagaccaggctggctaacatggtgaaaccctatctctactaaaaatacaaaaaaaaaaaaaaaaaaaaaaaaagctgggcatggtggcaggcacatgtaatcccagctacttgggaggctgaggcaggagatttgcttggacctgggagagggaggttacagtgagcagagattacaggcatgagccaccgctcctagccccaatggggcatttcctgtcaatgttctctcttgcctccaactggtgggtgataacatgctttcttgggttggtcttaatctgtgcaagatgaaggataatcactccttgcatgaacaggatgcttttttcactctgcccacgggtctcttgctagtagcaatgtgtggaaggtaggaatgtggttagttgtaaaagaggtcacgttctaggaatgcagtaattacggcttaaagagttcaagagaaaatatgattggaagatatgttttatgtttatactacaaaactccaaatggcaaattctacatggcctgaaaattaattatcattctcattttctggcatattctggataagacttgcatttgtgatcatcaccaacaacataaagtaataaagtaacctttgagagagtcattggaagttggtatttaggccataaactggataattccctgtcatgagtaacactataactgacattaaatggcattaggaaactacagaggcaagaagatacaaattgtttcaatttaaataggtttcgaagagctgtagcagtgtgatacccttttttcttgtggttggagacatgaaatattcaagaatggtgcatttgacagtaaggagtgtgaagaaatgattcctagatctaacaggaagagatgatatctggacagtccgaagaatctccatatacattgatgggacaataaagaaatatatagtatctctttcttttctcattattctaaaacttcattgacaaatcatgatacttcacttgggctcataaattttgtaatatatttaaacatgaaactgtttatatagatagggccctcttcctcacccttaccccccaaaaaatttagccagggccacacacagtagaggcagctctggttgtggctgtatccaaggtaatgtctcatgtgttatgtccttattaggctctcgacaagaagtcatctcctcgccttcctcaagtgctcagtctaccaagcagggtagcctcagttggttcttttcaagcctctctttcccatgaaatgaagttacgttatccagcagagattcattgctggtggggtcaaaaggaactccagggcacagagtttctgtcattttcagcaatgctttgatttagcgtggaatttgttgatgttcctgcctccatttcctgtatcctacgcagagacctgcctttctctcctcttcacatttttgcaatgggctccagtttgttttcagaaagtgattcacatcccagagacgtcacttccaggagcagctgggctgattctttataagaattatgattcagaaacccagttaagtttggatttaggggaaaggtaaggggaagaggaaaatggtaatattaaggccaagcaacagaggcaatgagggaaatgtgagtctcatgttgagacataatagtccattacctatggaaataggatttcaggaggtactgggatgccccagtgtttgaaaatgtcagctctccagcactagcatgaggttagtgtttggaattatatccttataaacttattgcatatccctatacacaagtatata

SEQ ID NO: 101 - DNA, 55029 bp, Homo sapiens
  source 1..55029: mol_type = genomic DNA
tcgattacagagatcataacagataattttctttaatgttgacttatactttattcctgcttcatataaaacatcttctctcaaaggtcataaatatcaaagtagatcatttgtactacttctgctggcaaatgaaggtagttggaaatgtacgcaggaaatctacacaagggacaatcagaaaaaccttatgagcatgttctgaatgcaatttttatggctgggagcagtggctcatacttgtaatcccatcactttggaaggccgaggtgggcgcattacctgaggtcaggagtttgagaccagcctggccaacatggtgaaaccccgtctctactaaaaatacaaaaattaggcgggcattgtgtcgagcgcctgtaatcccagctactcaggaggctgaggcaggagaatcacttgaacttgggaggcggaggtggaggttgcagtgagatcacgccactgcagtccagcctgggtgacaagagcaagactccgtctcaaaaaaaaacaaaaaacaaaaaactccacaattttaaaggatgaatatggttgcaaattgggcaggttatggtctgcttaagacacttcaataagtctgatatgtcataagcacagatgtcttcaggagccaggcaggtgtcatcactgaacagataggataaaagtcaggagggagagtggagtcagagaacagccctgagctagagccccttccacagacgcagctgttactcagctctaattgatacaacaccaatggtgcaccaaccaccatcatgtgatttttaaagataagacagtaatgaaaacttttagtgaactattccaatgtcaaactttatcttccaaaccaaacatcataaatagcactgtgtatgctgaaaagaagcactgtttagccaagtacctgccctggggctgcagtctatgtcttttgcctcatactatagacacttaagtgcaaatgtttctagccagtgtggctgtcagcatcacagaggggatactctacgtatcattcacctttacattctcatcacctacaaaaatgatctccacacaatatacatgaaaaaataaacttgcctcatgataaagctgctaatgaatgtcggccagaacaggacttcaaggcagagcaatattagctgcgcattgagtcctcaccaggtcaccattgtgtccacatttacctaaggaccccagtgataaaattattgcatttctaaatgacaggaaaattggacggtagtaaaaattaggcagattaactgttggaaggtatattatatcatttaagggtctactttccattttctaatctcaaagctagaccagatttaacatctgttagtacccaggccttacctttgcaattcacttctcacctctgtacaatttccccacatcatcccctgtgcccagaatgctcatctcttctctaaatcccctgaaaatcccctgcttatcctttaggacctgctgaaataaacttttttttgaagttttccttatttctcaagccaagtgatttccttcaccagcagtgtccctatgacaccatgttcacacaaatgctattacctctatcacactgtaatacaattatatgtctacaagtactttcctgtgtttctctgagggccaagaataaatgtatgctttgtgtatcaaactgtacacttgacctctatactttcaggaatacagtgctctgtccttaaatgttcatttgtaaatacagaaccatattcttgttaatatcacaaaatgaaacttaccaggaagatgaatgacaaccccagaacacactgttttgtagaaaataccataggctgaaaagatcacaggaataccgagtgctaggttggaatctttcatgacaccaaatgttcattcatcctctgccagattttacaactgtcctcggtgtgtttttaggttatgtaactttacacaaagtggaatcaataatcagggcaagacttaagagaaagtggatccaatgcaagaggagtaaagaaaaaaattcctcaattgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggtttctcctgggcaaacagccctctgtggctctatttctcctaactactatgcctgccttcgtgtcatttagtcatttaggggcctgccagaggacagttataaaatctgtggtcattctgccggcagcgtatagttttcacccagagtccagatcccaccggcaaaactctgtctaacacaggatgacttggaattagagtccgtatagcagaaagagcagcagggctgtccttgggtatccgttgctcagccaagtcatcaaataaaaaggatgattgcacaagtggaccatgtgtcaatctgtgggtttctgcatggccagacccaccaagggaagctttatttaaacagttccaagtaggggagaccagctgcccctgaaccccagaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggatcggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcacgtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcatctggaagtgtctgtgtgtcttcctcggccgctctgctgtcatttagtgacaatctgctctagagatttgggtttatcatgaatctctccccctcaatatctgaccaaattccttaattcccccatcatccttcatgtgatacctgattccaggcctgccttaaaaaaaaatccaattgagtcaacttagcattggtctccctagccttaatatctcctctaagcaattttccatccactgactcctcccccaacaccaacctataacttgtgtatagatctccacttgttttagttgtattccagaattgagcccaatttgatattgaggtcccatttgatgctttatggtccgactatggtttttattgacatgatttctatcccaagaaaaaaagagctgcagtgaatcagctgaaaatgcacgtgcttcattatgatttatgaatgataaattttgatagaattgaacgttatgatagaaaatagaaaagaagaaagtagaaaaagtcaagaatgctataaataaggtgaaaccaagataaagaaaagtttagcctcagggatatttcttttaaatgggcacatcaagtctccagctattagcaatcgtaatagaggtggaaccagggtttgagtcaaatgtgcaataagataaattgttccgacagcagtaaggacagattgtaatgctgactggaggagaggtggacatctttcccaaaagttccatgtcctggagatggggagccgctggtcacgtgggaaggagaagggggaggaggaggaggaggaagtgggagcactcatgaaggtgagttggctcctgcccattctgccctccatagatgttcccaatggcgagtcaaaggttcattcaacacctgtcaggaagggcacagcctcgagaattcaggatttgtagacccagagagagaagaaatggatgatgagagccgctgccctggactccaacacagggcttcactcaggaatccatgagaaacaggggagaaaaaggggaagccccttcctgcaagttgtggacaggtgcagcattcaagtgattgttccaggaacagagtgggtctttttgaatggcccgactcagaatgcaagagaggtacgatgccatcagatctgcaccttggtccttcagtctgagatttctgacttctatatttctcctcctcttccagaccctgagaaacagcaatttccattcctcagatgactccatgtcagtaatggtgctttaattggcatcagacagcagctgtattgaagtctctcctctggagaagctattgagatcttgcttctccaaggtcgggctgtgaacttaaaagtttgcacagagacactgagtttgggaaatctcagtgctcaacagaatccactgactctaggtaaaacagggcatgtcaggaagtgagtgcagtcttcccataacctcagagtagcagaaggagaaggtgggactctgaaagctggagccacgtttcctgtgaagaaagatggagtggaccttccttgcttcaggtaccagatcacaggtctcttctcagtcggggatgcctcatctctaaaaccacaggatagagggatcagtccccacctgcccccacaccctctccaccttgtgacttcatcctctctcgtcattcattccttcgttcattcattcatccagcagtcatctactgagcagataccttgctccaggcacagtttgagggagtgatgatgcaacacaaaccaagacaggtccctgctcttttgaggccacattatacaaggataaaaataaacatacaaaattgttctaagcatacaaaattttgctaagtgtcaggaggaaaaatacacagcatagtacacagaaaattacacagagcagcacaatatagaggttctgtatgtgccacaaaagtgacagggcagagtgtcaccaggaaagacttatctcagagaatgaaatctgaacaggaggaaaagcagccagtcatgcagacaccagatggagaatcatcccagcaaagagaaagagagttcaaaagtcctgacaaataccaaggctgtaagaagacttttcgttctgtgtttacgataagttgattaaaacatctgaaggagaatgactaccattattcgcatctttgtatgtatttattccttaatgtaataaaacattttcagttttaaaaaatggtcctgaatggatagaggtttggcgtgttagaagcacaaaagttgtttggtcaggacaagatcatcatagccatgagtgttaatgataggagttaatgaggttcagacccttcatgcctgtgaagatggaagaataaagtaagttcctcatggggcacaaatcgagcatgttacatgcaagaataacattgcctaaagatctgtccagctgctgtgcaaaacacaactatttgggagacaagagtggaagcaaggccccaatgaaggaccacaagttgagggagagggaaacaagagtcttccaatctcagtgaatctcaccatcatcctctcatggtgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtggtcacatccgcatgttccaaagacgtgatccttggagtccacttcttttccttgaacctcccatgtctgattttataaaattctcttaatatcaaatcttcaggaagtcttgcaggagtaaatgccgttaattgttctgtaagccggcagggagggtctccaggaattgtaagaatttaatcaacttgagcaatcagcctgttttacaagcttgctggtgggaaccagctcctggcataacccagcaacttacagacaaactggcatgaacattcctcattatcatgctaaagtctccacccaaggaggaggctcattaccataacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtgggcttcttacttgaaccaagtaacaaaacttatttatcaaaatgtacattctcatagagagtctttgttactcaccagggaaacaagccctggttttttcagctaccagctctaacatattctgtaaagtccagcacagaaggaaggttaattcacaatgctattgctttcattttatttcactttttaataattgggtacatatcagggcagatgtctttaggtgggggttgaatggaaggtcaaggagacaaatcatcaaccttggaaagatattcttgcagagattatgactacacttgggattcatgaatatgagaccccaccagcaaagtagcctgcaatgttcaaggatatccaagtagatcaagcattttaatgagaaaacgataggctttgtctttcaagatgtccatgaattgactttccaaaagggaaagaaggacccattttcagggcagaagagagaagaggagaggggtttaggctaaacattgtaatcaattttgcctgataatgactttttgtttcttggttcatttttatttatttatttatttatttatttatttatttatttattttcccaggctggagtgcagaggtgcaatttcggctcactgcagcctctgtctcccaggttcaagcgattctcctgcctcagcctcccgagtagctgggactacaggcatgcactgccatgcccagctaatttttgtattattagtagagacggggtttcaccatgttggccaggctggtctcaaactcctgacctcaggtgatctgccctactcggcctcccaaattacgaggattacagacctgagctgtcgcacccagcctcttagttcatttttagagatgaggtctccctatgtggcccaggatggatttgaagttgtggactcaagcaatgtttttgccttagccagcccagtagttgggtctataaatacacaccactgagcccagatgatactctcattttatgagctgtgtttccactctgattacataaggaagtgaggcaattagtagggataggagcatagaaattctgtctacattcctatttcaaattacctatgaaaaacagacttgtttctaaactaaaactggattttggttaataaatgtttttctttattaaaatgcattagacttatgacagagttgtcacttttgtctcacgtctgatctacaatgatttcaaaagaagatcaattgactacttcaaaattctcattgtttcaaagatattatggatgtaaaactgggtgatctgagataatttagcatatagggccagccaggttacccaaatgaatatctgggaaactgagtacattacatgcttatcacacatctccactgatttagaaaatatgactgtattagtcagagtcatcaagagaaacattgcagatgtaggtagaaagagacagacagaaatatagatacagaaggatttatcatgagaaattggctcaggcaattatggagtcggtgaagtcccacaatctgctttctgcaagctggcagacccagaaaagccagtggtataattcggttcaagtcctaacgcctgaaaaacaagggagccgatgacatagatgtcaacccaagtgtgggaacgatgacacaagatgtcctagcttaggaagtgaggcaagaaaaatgatgaattcctcctttctccacttttcattctattctggcccttaacagattggatgatccccatccagactagcaatgcaaactactttacttaatcaaccaattcagctgctagtcttatagaaacaccctctcagacacacccagaaatcattaattatttaattaattattaatctgggcacccacaggcccaggcaacttgaaatataaaattcaccatcatgatgacctatggtttccaaggtgcaccagtagatgttaccaaaatggcaccaccagccagaacccacatacattcaccaggtcagtgcacttctcaattcgccggagattcattttcttctgtgacatcacgttcacctggagtggagccaagaaccaggccacagctaataatgagaaagaaaggattctttatttgcttttttacaaatgagagaaaaatttgccaaaatcctttggtaataagtagttatctcaaagacaaagagactcaaaatgaaaatgaaaaaagtcagttacccttcccactgcccatgttcttcctccacatataaaaataggtattaagttcaccctttctggtattaaggactagagtctaacccaataactctgaatctgagtgtgcagatgttaccagatttttcattacagaaaatgacagagacgttcttccactacagtagctattttgtggtgacaacttttactttcccaggattcctcggttaagtgacacacacgggcaactggaagtatttactgttttcacccacagcttccacacttcacagatgtgcaggagcttcagtacagcagttcctaggaacatggataggacatgcgtgacttgttaaccacaatgcaatagcaaatatatggggttcggtgttggtctttcattcggaatatacagttcagaattgtttaaaatagtacatttagaaacaaataatatatcctgctgaactggttaaattggattgtatatctttacaatggaattttatgcagcattcttttaaaattatactttaatttctagggtacatgtgcacaacgtgcaggtttgttacatatgcatacatgcgccatattggtgtgctgcactcattaactcgacatttacattaggtatatctcctaatgctatccctcccctctcccgccagcccacgacaggcccccggtggtgatgttccccttcctgtgttcaagtgttcttattgttcaattcccacctatgagtgagaacatgcggtgtttggttttttgtccttgggatagtttgctgagaatgatggtttccagtttcatccatgtccctacaaaggacatgaactcatccttttttatggctgttatacagcatttttttaatgcaaaaaagtacggttgatcccttgctactggcatggaatattaccaaaatatattgttaatgagaaagaggaatgctgtaggccactgtagtaatctgctcaggctgctataacaaaataccacaaatgagtagccgaaacaacagaaatttctttctcccagtcgaggaaacatcagctcttctcctccatactcacactcacacttccggccaccaaatacgggagggtgctttcttacaggaactgattccagctgcgtatcctacaattcaattcgattgtgacactaactggagtgaatgcagaccccacaggttaagggctccgtcccacaagactatcagtatcaagaagcagatcattatctgtgcttttgaccaatgaactatagtttggaggatcccgtgacttcctcctcagtttgatcatttgctagaatggctcacagagcccagggaaacactttacttaggtttacacatctatcataaaggtatactaaatgtacacacagggagataatggggcaaggcttggaagggtcctaagtgcagaatcttctgtccctgtggagttggggtgtgccaccctcccagcacagggatatgttcttgtgtactgtattgatctgttgtaacactgctataaagaactacctagggctgggcatggtgctcatgcctgtaatcccggcacattgggaggctgaggtggacaattcataaggttagaagttcaagcccagccttgccaacatggtgaaaccctgtctctattaaaaatacaaaattagctgggagtggtggcacacacctgtaatcccagttacttgggggtgctgaggcaggagaatcacttgaacccaggaggcagaggttgcagtgagccaagatcatgtcattgcactccagcctgggcaaaaagagcataactccatctcaaagaaaaaatagaaaactacttgagacgaaataatttatgaagaaagaagtttaattgactcacagttctgcaggctgcacaggaagcatggctggggggcctcaggaaacttataatcatggcagaagggtgatgggaaagcaagcacaccttcacatagcagcaggagagagtgaagggggaagagctatacacttttaaacaatgagatctcatgagaactcactcactataacaagaaattgtatagtagggggaaatctgcccccatgatgcaattacctcccaccagttccctcccccaacattagtaattacaatttgacatgagatttgggtggggacacagagccaaaccatatcattcaccaaatccggaaacttaccaaagtctctctctctccttttggggtttatggaggtgtcattacgttggcatgactgatgaaattattcgccactgctgatcaatttaaccttcaatcccctttccagggggttagctagggtgggaatggatgttctaaccctctaatcacttgctagagtctgctggcaaccagcccccatcctaatgctacgcaggtgccactcgtctcattaacgtacttcatgaggcacttattcagaaattagacacttattcagaaattttaagagttttaggggctctgagtcaggaaacaggcaggaacattaaatatatgctttatatttttttagagatgggatttcactcggtcacccaggccagagtgcagtggtgccatcataggtcactttagcccccacctcctgggttcaagccatccttccgcctcagtcttccaagtagctgggattataggctgcagccaccatgcccagcagttgcatttctcattataaatcacaatatcacaatcacagctctggacactgggaagttcaagatgaaggttctggcaggttcaatttgcagtgaggtctcccttcctggcttgctgacagttgttcccccaccactgtgtcctcacataggcaaggaaggagtaagctctctggtgtgtctcttgtttttttgtttgtttgttttttgttttttgttttgttttgtagagatggcatcttgctatattgctgtattaggctgctctttcattgcaatgaaaaaattcctgagattgggtaacttataaagaaaagaagtttaattggctcatggctctgtacgatgctcaggaagtatagccctggtatcagcttctaggaaggcctcaggaagcttataatcgtcgcagaagatgaagcagcaacaggcacttcatatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaagaggttaaattagctctcagttctgcagaatttacagaaagcatagcagtttttgcttctggggaggcttcaggaagcttccaatcatggtggaaggcacagggggaacaggggtctgacatggcaggtgctggggcaagagagcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactgggaattatattccaatatcacatatggatggggcaaatatccaaactgtcccagttgcccacaatgatcttgagctcttggcctcaagtgatcttcctgcctcaggtgcccaaagtgctgggataacaagtgagagtcaccaacccagctggtggtgtctctttttataaggatactaatcctcttgaatcaaggctccacctttatgacatcatttaacattaagtttatccttataggccctccctccaaatacagtgacactgggggttaggacttcaatatatgaatttttaagggacataattcagtccacagtaaacactatatatagcatattactgtctgacagggaaaaaagaggaattaacacagaaatctatgaaaatgagaaaaagccttatacgtattattcatatatgcttagactcagcatatgcattatagaaagggtactaaaaaactgaataattattcttcctagaatacaaatctagcttccataaagaaaggtaaatgaagacatccttttcactagataccatttttaattattgaatttacattttcaccatatgaatgtatatgcattctatatatgcacttacatatgtatgcacgtacttatgtgcatatatctatatatgtagagatgtatacatttgttaaccacagactccctactactagaacattcaaacaaaggagatgtaatcaagtaaaactaaaagaaccataacaaggcagcactggatgacctggaaggctgagggtcactcagctcgccacccctcaccccccagctgggaatcagagagtgatggagctatccctcactccacctcctgctctcttccttctgcagtccagccacctggtcacagagtgaggctctaaactggcccgtattacatgtgtctgtccctccccttctcactttggaggaagagtgtgactatcccaagtcagcacgtagagtgagacagagcgtgagacctgctagctgaggaaccgtaagaaccttgtgctttgaaagccgatctgctttgtgatattgaaatcctccgagtccattctctcattattacaggaaaggtgtgtaaaatatccaggtcatgtcactacaggacaaaagctctggatgttcagccataatcaaagctcttgagatccagcaatttccttgaacaatttttctaccacacacacttctcaaaatatagtgcatacccatatttaggattgtggtagagggccattacatgatcttgactgtatcaataaaagtctcagggcaaaactctgggggattcatgcagatggcctaccatttggatgtggaatctgagcaaatcatcctaacattctgctacccatctccaaaaatgggcttcaataaaatggctatctcagacactttgcaatctatgagtctgcaatgaagaatgaatgtgtgtgtgtgtgtgtgtgtgtgtgtgtgtgtgtgtgtgtgttttaaagaggcatatatgtggtttacttggtttatgtatatgagttacttgattacttataagggagtattctgaataatggattaattgaataaatgaaatataattacaccatgtacaaaactttacatagttttttctgcttgatcattattcctgtaagtctccatagtaatatctaattgtatttttagtgaagaagctattttggtctgaccttcaaaactgtctttgcatttgggtaggacaaaagactagcaaaaaaaagcctgagggattatcttaagtattcttaggatttagtgttcttcagactatctgggttagctgacttgtgaaaaaactaatagttcactcctcagtatttctggaacaggaaggatttttcctcatgcccccaactgcctctagccaaataaaaaagcaagaggacaaaattctttaaatattaaaaggaagttatgggtaagcagtgacatatagagacatatagagacatatagatgagcacgtagttcatcaattttgtctccctgggatattcataattaatccctaatgactaatagccaatcttctataataataaactatataatcaaatattatacacaaattcattcataatgttctctgccagcatgtaagtggcacacctaaaaaacttcaaacattaagtattttccatttggatcacatgggggaagttttgcactatggattcgtgagctccattccagatatactcacacagaatgtctgcacatggagctcaggattctgcatttccaatcacatcctcaagtagttttccaacaacctatctccagcccaactttgagatccatttgttaccaaacattgacttcagaagccttcatgtgcatcggaagtaatcttggcgtagggaaattccgaagcacaggaggcagcgataccatttgcattattcctgagatgattctagctacatacacctattatccagcatttatgtcttgatttgaggcttctattcagttgaccctattgatatccaagtgtacacaactgacctgtcaggctatagcaacactcttcacttatatgtagggagaatttgtacagggcttaactgaagctcatcatggggtatgaattgacttggtctcattgctgtaacccttgggttcagaagacactgagcaaatgcttaaaaaactcttttgggttaatacatgaagagatattaactcctcagatagccaaagaatcaaggggaaggggtaaaagaggatggccatatagaagtatccattgatttcacccccacacataccagcagaaacaccacatttaacaactatctacacacaaaaaaggacctacataggaaataaaaatcaggtcaaccatcattgtacctgattttaacttcgtatcactgaaaaaggcactgaagagatgaggaaagacaattttgaatcactgaggccaccactcccccatgtcccagtagctgccactggagctgagacagaaactcagtgcatgggggagggagagtgcagcaattgtgaaaatctgcattgaactcagtgctgccctgtcagagcccacccacagagggagcattcagaccaaccttagccagaggggaatcaatcgcctatccaagcagtcagtatgtgagtttgggaaagccttgccaaagcaggctaaagtgctctggggtcctaaatgcatttgaaactcaatctaggccacaagaactacaactacaaggcaagtcccagtgctgtgctgggctcagagccagtggacttggacaccactagtgtgacacttgtcagggcagctaagggagtgcttgcacaaccactcctccaaccccaggcagcacagctcacagcagtgaaagtgactgcttccttctgcttgaggaaaggagaggaaagagtaactaggacattgtcttacatcgtaaatgtcagttcagccacaataggatagggcaccagtcagagtcatgaagccaccattccaggcactcgctcctgaaggacatttctagacacaccctgcaccagaagaaaacccactgcctagaaggaaaggacccagtcctgccaggattcatcacctgctgactgaagaaccctcaggccctaaataaccagcagcaatacctagtagtacactccatgggccttgggtgagactctgagatatgctggcttcaggagagacccaccatattcacagctgtggtagtcatgaagagagaatccttctgcttgagaaaagcagagggaaaataaaggggactctgtcttgcagcttagacagcagcttagctacagcggggtagagcaccaagccagctcttggagtccccagttccagatcttggcttttggttggcatttctggacatgccctgggtcagaggggagcctactgccctgaagggtgagtcccaggccaggcagcattcaccacaagctggctaaagaactctggggccttatgggaacactggcatcatcctgtcagtattccccttgagcctgcggtggaggtagctgcagggagaggctcctctgcctgtggaagagtaagggaagagtggaaggactccagctcagccacagtaaaacagaacaccatgtaaacctcccaggttgtttacttcagtccctggctctcagacagtacctctggacatgcctgggcctagaggaactcatcaccctgaagggaaggacacaagcctggctggtattgccacctgctctagggccttgtagagctctagggccttgagtgaggccctcacttccaagaaagaaataaactcttttccactgcagctaaactgtaaagctcataacacaagtagatcctctgtgcatattcacttcctttccttcttacgcaaggtgctacagtgtgaatctgaatgtggcaagttcaacactaaagtcctggagtgcaggaaagttatggtagactcagaaatctgttcttcaacatttagactgtatttatgatggctgaattttctgtctagtcacctatggtcctctacctgggcgacagagtgaggctccgtctcaaaaaaaaaaaatagtttagcatgccaaagtaccatcctttggagtatagtgtgctgagccccaacaaaagccatgagattagatatgatcatgaagagagtgcatgagtccatagaaaagaaagaatagctaacccctaggaacctccaccatcaagatgctggagagaaaggggaagaattaatgaagcagactgagaacatgagtccagggacttagaagaaatgatcaggaaagggtggggtgttgtaactcagcacacatccttgacaagactgtctgccttgagggcaccaggcctgatctcaccagacttttcattctgtttctgtcacaagaagatcattctcaggtcagcttcatcaaggagcagggagaaatcaactctgtcaaatgctgctgagcatggaaagttaacactgtcaggggagaaatgtcttactccaagtgcaaaccttccctcatgaccactgctgatggggtggaagagtctgggcaattcattgaagaggtatccaaatttctgggtctaaggaaagacaatcttaccaggaggtgaacaggaagagggtccacatgtgagtcacgttttcatctcagtggagggaataaggcaaaggagagtagggtttctgtgtctcaatgcccggagatattgttctccttttaaccatatcccagacctcagtacttctcacatttgtctccatctctctttgctcctgtaaggacccatctgagcaactcacttcaccacatcatccttcattcatctccatatcactctcttttcttttctttttcttttcttttcttttcttttcttttttttttttttttttttttttttttttttttgagactgagtcttgtcttctcacccaggctggagtgcactgacgtgatctcggctcactgcaacctccacttcccagattcaagcgattctcatgtctcagtctcctgagtagctgggattatagttgccccacatcatgcccagctaatttttgtagagacagggtttcaatatgttggccaggctggtctcgaactcttgacttcgagtgatccacctatctcggcctcccaaagtgctgagattacaggcgtgagccaccatgcctggccgcaaaaagatattttctaacattcagttctatcaatttgtttagtgtgcttaacagatgactctaccattactcttcctcagctggaaagtgaggggtgtggtataaatgtctttaggagtgccttacagctcagactatttagaaatctgatactctggagcataggtatgggtgtatgcctgtgtgtgtgtttgtgtgtgtgagtgtgtgtgtgtgtgtgtgtgtgtgtgtgtaggaaaagatgtaaaggaaatttggttgacatctgtgcatcatctgtctatgtaaatctgattttcctaaatcattattaatttaggcagaaaaaagcataattctctgaaacaaaattattatatacaattacatcattatttttaaactatgcaaaaaaacatgcctataatcgattttattgtagagaagatgtgaggtcttgttatttagaactgttatttaatggagcaagataaaacactagcacaaagactatgtgataatttcaagcccctgagagctagattagaggactaattttgtgttcagtttcatgtagagctataaattaaacaattctaccttgaaaaatattttcacagaagaataaaggatccaaggacagtaggaaaaaaatgaagctcaaggtgaatgatttggctaaattcatcaaattctgtacaaaaaagagactaaatcatgcaggaactatatttttatcatgaaaatgctctaattatttgctaagacagttcctcaaatttagcaccaaattgatggaaaatataatttttatgataatctatttccctttgttctgacttcacaagtaaatgcaagatgttaaaaggtgatttattctatctcagattgggaagggtccctgagaaacagcggtcctatcaaaatgacttgtccacctaagcagcacttggtcaaaaagagataaaaccctgagttctatttcttatgccttcactttgaggagtaaggaaaagaaacaagcatactgtcttattgtaaataccacagagaggatagtgcagtaatggatactacattaacaccttgatgcataagactgatcatccttatcaagatttctttttctttttgcaatgttttatgctacatattttgttatttcatacacacacacacacaaattaccacattaaatttctcctacaaaccaatgtatgtgttgttgttttttacagattataaaacagaggcatagagaggacgaataaccgtgcaacttttttttatttgtttgttttttttaagagacagagtgttgctctgtctcccaggctggagggcaggggaatgatatcagctcactgcagcctctgactcctgggttcaagagatcctcctacctcagcctcctgagtagctgggattacaggtgcaagtcaccatgcctgactaatttttgtgtttttggtagagatggggtttcatcatgttgggcaggctggtttcgaggtactcgcctgaagtgatccctctgtctaggcctcccaaagtgctgggattacaggcttgagccaccacgcttggccctggactactgttatagtaagagtgtcaaatagaaaaagtcagagctggtatctggacaagactatacaaaatctacacctgacatcactgtgacacaaaacttatataataactgcatttacagagacactaacctatataataattcatttcctataagccctgaaatctcagcaaatgcatctatgtgctcaaaatgcaatgaggatgaagagaggttgattaatgagtataaatataagaagtgatataagaaataagacctggggtttgatagaacaggaggatggctatagttaatgataatctactgtacacttcaaaatagcttgaagaccaaaattcgaatgtttctaaagtaaagaaaagtcaaatatttaaggtaatggatatcccaatttccctgatataatctttacacattatatgactgtattaaattatcacatgtaccctgaaaatatgtacctctcttatgtatcaataaaaagaaataaggccaggggcagtggctcatgcctggctgaggtgtgcggatcatcagaggtcaggagttcaagaccagcctggtcaacatggtgaaaccctgtctttactaaaaatacaaaaattagctgggcatggtgacgtgcacctgtaatcccagctactcgggaggctgaggaaggagaattgcttgagcctgggaggtggaggttgcagtgagctgagatctcaccactgcactccagcctgggtgagactccatctcaaagaaaaaaagaaggaaagaaataagaaagaaagaaagaaagaaagaaagaaagaaagaaagaaagaaagaaagaaagaagggagggatggagggagggagggtagggtaggggaggggaggggtgtggagaggagaggagaagagaagagaagagaaatattctaaaaacatgcagtggtacatgaacgcaactttccaatttattcggaaacacactttatttcatctcttctaagacacacctctccataattccatctgagctctatttccatttcttccctttccagagagggagaggactttatagttgaggagaaagaagaaagccttagttctttcctctttcatgccagaaacttgatcaaagatgtcagatctacttattcaatggctttcagaggagacatgcaggaggccccacgcaagaaggaaggcctagggccacctttctgaggttcaagagaccaggaagagctcagtacaccaaatatctttagaacttaggtaagttaaatattacttcatttgctacaatttaattaacctgcaccatattattatggaaatcttgtgttacttttaaaggcaaaaatctcaattacttttgcaccaacctaataaatagtgtgcattgtctttcccatagataaccactgctgcattagggaaatctgtgtgcaggaaggtattgatggtgtggtacctccctgtcagcaggttaagagcaaatattgcaagggtaccctggggctgaagaaattgcaagcattgaacactatatttttgcacataaatgctatgcaaaaaagacattgatcaatgcagtgtactcaacagtggtttttaccataaatgcagaattctttgtctgggacaatattttaaaatgttcatcagtttcccaaaaaaagacttaatactgggacataattccaactattcctctcagtggaagtgtggatcaggtctgaaaatgtgtcattaaattaggctgcaagacaacttatactaataaaataaagagcccaggtgtgttaaagacaaaatcgtgggggccgaataggaacagctccggtctgcagctcccagcgtaagcgacacagaagatgggcgatttctgcattaccatctgaggtaccgggttcatctcactagggagtgccagacagtggggacaggacagtgggtgcagtgcccagtgcgcaagccgaagcaaggcgatgcattgcctcactagggaagtgcaaggggtcagggagttccctttcctggtcaaggaaaggggtgacagacggcacctggaaaatcgggtcactcccacccaaatactgtgcttttccgaagggcttaggaaatggcgcaccaggagattatatcctgcacacggctcggagggtcctacgtgcccacagagtctcgatgattgctagcacagcagtctgagatcaaactgcaaggcagcagcgaggctggggcactggcgcccgccattgcccaggcttgcttaggtaaacaaagcagccaggaagctcgaactgggtggagcccaccacaggtcaaggaggcctgcctgcctctgtaggctccacctctgggggcaaggcacagacaaacaaaaagacagcggtaacctctgcagacttaaatgtccccgtctgacagctttgaagagagcagtggttctcccagcacacagctggagatctgagaacgggcagactgcctcctcaagtgggtccctgactcctgacccctgagcagcctaactgggaggcaccccccagtaggggcagactgacacctcacatggccgggtactcctctgagacaaaacttccagaggaatgatcatacagcagcattcgcggttcatgaaaatctgctgttctgcagacaccactgctgatacccaggaaaacagggtctggaggggacctctagcaaactccaacagacctgcagctgagggtcctgtctgttagaaggaaaactaacaaacagaaaggacatccacaccaaaaacccatctgtacgtcaccattatcaaagaccaaaagtagataaaacgaaaaagatggggaaaaaacagagcagaaaaactggaaactctaaaaagcagagcgcctctcctcctccaaaggaatgcagttcctcaccagcaatggaacaaagctggacggagaatgacattgacgagttgagagaagaagtcttcagatgatcaaactactccgagctacaggaggaaatacaaaccaaaggcaaagaagttgaaaactttgaaaaaaatttagatgaatgtatagctagaataaccaatacagagaagtgcttaaaggagctgatggagctgaaagccaaggctcgagaactacgtgaagaatgcagaagcctcaggagccgaagcaatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacgtctgattggtgtatctgaaagtgacggggagaatgcaaccaagttggaaaacactctgcaggatattatccaggagaacttccccaatctagcaaggcaggccaacattcagattcaggaaatacagagaacaccacaaagatactgctcgagaagagcaactccaagacacataattgtcagattcaccaaagttgaaatgaaggaaaaaatgttaagggcagctagagagaaaggtcgggttacccacaaagggaagcccatcagactaacagcggatctctcagcagaaactctacaagccagaagagagtgggggccaatattcaacattcttaaagaaaaaaattttcaacccagaatttcatatccagccaaactaaacttcataagtgaaggagaaataaaatactttacggacaagtaaatgctgagagattttgtcaccaccagacctgccctaaatgagctcctgaaggaagcactaaacatggaaaggcacaaccggtaccagccactgcaaaatcatgccaaaatgtaaagaccatcgagactaggaagaaactacatcaactaatgagcaaaattaccagctaacatcataatgacaggatcaaattcacacataacaatattaactttaaatgtcaatggactaaatgctccaattaaaagatgcagactggcaaattggataaagagtcaagacccatcagtgtgctgtattcaggaaacccatctcatgtgcacacacacacataagctcaaaataaaaggatggaggaagatctaccaagccaacggaaaacaaaaaaaggaaggggttgcaatcctagtctctgataaaacagactttaaaccaacaaagatcaaaagagacaaagaaggccattacataatgggaaaaggatcaattcaacaagaagagctaactatcctaaatatatatgcacccaatacaggagcacccagattcataaagcaagtcctgagtgacctacaaagagacttagactcccacacaataataatgggagactttaacacaccactgtcaacactagacagatcaacgagacagaaagttaacaatgatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattcagaaattcactcaaaactgctcaactacatggaaactgaacaacctgctcctgaatgactactgggtacataacgaaatgaaggcagaaataaagatgttctttgaaaccaatgagaacaaagacacaacacaccagaatctctgggacacattcaaagcagtgtgtagagggaaattgatagcactaaatgcccacaagaaaaagcaggaaagatccaaaattgacaccctaacatcacaattaaaagaactagaaaagcaagagcaaacacattcaaaagctagcagaaggcaagaaataactaaaatcagcagaattgaaggaaattctgacagaaaaaacccttcaaaaaattaatgaatccaggagctggttttttgaaaggatcaacaaaatagatagaccactagcaagactaataaagaaaaaaaaaagagaatcaaatagacgcaataaaaaatgataaaggggatatcaccaccaatcccacagaaatacaaactaccatcagagaatactacaaacacctctacgcaaataaactagaaaatctagaagaaatggataaattcctcgacacatacactctcccaagactaaaccaggaaaaagttgaatctctgaatagaccaataacaggttctgaaattgtggcaataatcaatagcttaccaaccaaaaagagtccaggaccagatggattcacagccgaattctaccagaggtacaaggaggaactggtacaattccttctgaaactattccaatcaacagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaagactggaagcattccctttgaacactggcacaagacagggatgccctctctcaccactcctattcaacatattgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaactgctgctcaatgaaacaaaagaggatacaaagaaatggaagaacattccatgctcatgggtaggaagaatcaatatcgtgaaaatggccatactgcccaaggtaatttatacattcaatgccatcctcatcaagctgccaatgactttcttcacagaattggaaaaaaatactttaaagttcatatggaaccaaaaaagagcccgcatcgccaagtcaatcctaagccaaaggaacaaagctggaggcatcatgctacttgacttcaaactatactacaaggctacagtaacaaaaacagcatggtactggtaccaaaagagagatatagatcaatggaacagaacagagccctcagaaataacaccgcatatctacaactatctgatctttgacaaacctgagaaaaacaagcaacggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggtcttcatgtctaaaacaccaaaagcaatggcaacaaaagccaaaattgacaaatgggatctaattaaactcaagagcttctgcacagcaaaagaaactaccatcagagtcaacaggcaacctacaaaatgggagaaaattttcgcaacctactcatctgacaaagggctaatatccagaatctacaatgaactcagacaaatttgcaagagagaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccacttagaatggcaatcattaaaaagtcaggaaacaacaggtgctggagaggatgtggagaaataggaacacttttacactgttggtgggactgttaactagttcaacccttgtggaagtcagggtggcgattcctcagggatctagaactagaaataccatttgacccagccatcccattactgggtatatacccaaaggactataaatcatgctgctataaagacacatgcacatgtatgtttattgtggcactattcacaataacaaagacttggaaccaacccaaatatccaacaatgatagactggattaagaaaacgtggcacatatacaccatggaatactatgcagccataaaaaatgatgagttcatgtcctttgtaggaacatggatgaaattggaaatcatcattctcagtaaactatcgcaaggacaaaaaaccaaacaccgcatgttctcactcatagatggaactgaacaatgagaacacatggacacaggaaggggaacatcacactctggggactgttgtggggtggggggatgggggagggatagcattaggagatatacctaatgctaaatgacgagttaatgggtgcagcacaccagcatggcacatgtatacataagtaactaacctgcacattgtgcacatgtaccctaaaacttaaagtataataataattttttaaaaaaagacaaacgatcatgctgaagttacagagaattttgtttaatgttggcttacactttatttctgcttcatataaaacatcttctcccaaaggtcataaatatcaaagtagatcatgtgtactagttctgcagataaatgaaggtagttagaaatgtacacaggaaatctatacaagggagaatcagaaaaatcttatgagcatgttctgaatacaattttagtgatcaggagcagtgtctcacacctgtaatcccatcactttgggaggccaagtggggcagatcacctgaggtcaggagtttgagaccagcctcgccaacatagtgaaaccacatctctactaacaatctgaaaattagccggatgttgtggcagatgcctgtaatcccagctactcaggatgctgaggcaggagaatcacttgaactcgggaggcagaggtggcagtgagccgagatcgtgccactgtactccagcctgggccacaagagcaagactccatatcaaagacaaacaaacaaataaaaaaaactcgcacaattttaaaggatgaatatggttgcaaattgggcaggttatggtctgagttatttcttaagacactgcaacaagtctgacgcgtcataatcacagatttctccagaagccaggaaggtgtcattactgaacagacaggatgtaagtcaggaggcagagatggagtcagagaacagccctgagctagagccccttccacagaggcagctttacccagctctaattgataccacacagcaacggagacacagtgcaccaaccaacatcatgtgatttttaaagataagacagtaatgaaaacttttagtgaactattccaatgtcaaactttatcttccaaaccaaacattataaataacactgtatatgctgaaaagaagcactgtttagccgagtacctgccctggggctgcagtctatgtcttttgcctcacactatagacacttgagtgcaagtctttctacccagtgtgcctgtcagcatcacagaggggatactctacgtatcattcacctttacattctcatcacctgcaaaaatgatctccacacaatatacatgaaaaaagaatttgcttcatgataaagctgctaatgaatgtcggccagaagaggacttcaaggcagagtactgttagctgtgcattgaatcctcacctgatgaccattgtgtccacatttacctaaggactccagtgataaaattattgcatttgtaaatgacaggaaaattggatggtatatgatatcatttaaaggtctgatttccatttactaatctagaagctagaccagagatttaacatctttttgtacctaggtcttacccctgcaattcactttccacctctgtacaattttcccacatcatcccctgtgcccagaatgctcatctcttccctaaagtccctgaaaaccacctgctttgcctttaggaccctgctgaaatgaaactttttttttttgaagtcttccttgtccctcaagcgaagtgatttccttcaccctcggcgtccccatgaaaccatgttcacacaaatgctattatctctatcatactgtaatacaattatgtgactacaattactttcctgtatatctctgaggtccaagaataagtctatgcttggtgtatgaaattgtacagttgacttctatactttcaggaatacagtgctctgtccttaaatgttcatttgtaaatacagaaccattttcttgttgatatcacaagatgaaacctaccaggaagatgaatgacaaccccagaacacactgttttgtagaaaataccataggctgaaaagatcacaggaataccgagtgctaggttggaatctttcatgacaccaaatgttcattcattctctgccagattttacaactgtcctcggtgtgtttttaggttgtgtaactttacacaaagtggaagcaataatcagggcaagacttaagagaaagtggatccaatgcaagaggagtaaagaaaaaaatccctcaaatgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggttcctcctgggaaaacagatctctgtggctctatttgttctaactactatgcctgccttcatgtactttggtcatttaggggcctgccagaggacagttataaaatctgtggtcattctgccggcagcatatagttttcatccagagtccagatcccaccggcaaaactctgtctaacacaggatgacttggaattagagtccgtatagcagaaagagcagcagggctgtccttgggtatccgttgctcagccaagtcatcaaataaaaaggatgattgcgcaagtggaccatgtgtcaatctgtgggtttctgcatggccaagagccagaccctccctcctggctctgctggcccaacccaccaagggatgctttatttaaatagttccaagtaggggagaccagctgcccctgaaccccagaacaaccagctggatcaattctcataggagccacagcgcggagactgtgtaagtcaacaatccccagagttgggacaggaggggcagcgacagggcagcaactgagggagaagggagctgacgttagtgcttaggagatgtggcacactttggggacaggaaggaacaggaaatgggacccaagagtggcagcagattggcctgtggggtgagacactatggtgtgtgtcacaaccgagacagaatcggggagtagttacttctcttcttttctcacaggaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctggataccatcatctaagctcctgtatcagcactcctcgtcatcactcatctgccaagctcctcaatcatagccaagatcccatccctccatgtactctgggtgtcagcatctgtcctcttcagtctctataccccttccacttgcctgagctgaagtgccttgtgaagcctgcaataaactgctttgcaaattcatctggaagtgtctgtgtgtcttcgtcggccactctgctgtcattgagtgacaatctactctagatatttttccttcctccaacccgagacttgtgggaaatggagagatttgaggataagagactctttctgtcatgaagcagcacagacttatccctctccctgctttaggctgagaagccgaggtctcaactgatacctaccaactgttgaagactcttcccttgaccaaatttagtcatctcccctggcctcttcacaagtaggtcattctgttgggtttcctagtccttccttgtagagtcaggtttgtatttatatttacatttatatttatatttatatttatatttattcattttttgagagagagtctcgctctatcacccaggctggagtgcagtggcacaatctcggctcattgcaaactgtgcctcccaggttcaagcgattctcctgcctcagcttcctcagtagctggggttacagtcatgcaccaccatgcctggccaatttttgcaatgttagtagagatggggtttcaccatgttggccaggctagtcttgaactcctgacctcaggcaatccgcctgcctcagcctcccaaagtgctaggattataggcgtgagccaccagtgcccaacctagggtcaggtttaacagaagtcttcctaacctggtttatcattaatattcaccctcaatatctgaccaaattccttaattcccccatcatcctccttgtgatacctgattcctggcctgccttcaaaaaaaaagaaaatccagttgagtcgacttagcattggtctccctagcctcgatggttcttctaggtaattttgcatccagtgacccctccccccacaccaacttataacttcagtatacctctccacttgttttagctgtattccagaattttgctcaatttggtgctgaggtcccatttgacactttatggtctaagtctggtttttattgacatgatttctatcctaagagatatagaggctgcagggaataaggtgaaaatgtacatgtttgattatgatttatgaatgataaattttgatagaattgaacattgagatagaaaacacacaaaaaaagaaagtagaaaaagccaagaatgctataaatatggtgaaaccaagataaaaagtttagcctcagacctatttcctttaaatgggcacatcaaatctccagctattagcaatcgtactagaggtggatccacggtttgagtcaaatatggaatgagataaattgttcagacagcaatatggacagattgtaataaatattgcctgaaggagaggtgcgcatcattcccaaaacttccatgtcctggagatagggagtagctggtcacctgggaaggggaaggggaacgagggagactggggagtgggatcactcatgaaggtgaattggctcctgcccgttctgccctccacagttgtccccaaaggtgagtcaaagggttcattcaacacctgtcaggtagggcacagcctcaagaattagggatttgtagacccagagagagaagaaatggataatgagagcccttgccctggactccattacagggcttcactcaggaatccatgagaaacaggaaggggaagccctttcttgcaagctgtggacaggtgcagcattcaagtgattgtgccggggacagagtgggtctttttgaatggcctgactcttggccatacaacagagatacaatgccatcagatctgcaccttggtccttcagtctgagagttctgacttctatatttctgctcctcttccagaccctcagaaatagcaatttccattcctcagatgactccatgtcagtaatagtagctctcattggcatcagacagcagcagtattgaagtctctcctctggagaagctattgagatcttgcttctccaagggtgtggcagggctgtgaactttaaagtttgcacagggacacagatttcacgaaatcctggtgctcaatagaatccactgactctaggtaaaatagggcatattaggaagtgagtgcagtcttcccacaacctccaagtagcagaaggagaaggtgggactctgaaagctggagccacgtttcctgtgaagagagatggaatggaccttcctcacttcaggtaccagatcacaggtgtcttctcagtcagggatgccccgtctctaaaaccataggatagagggatcagtccccacctgcccccatgccctctccaccttgtgacttcatctcctctcctgtcattcatccttcactcattcattcatccagcagacatctactgagtagataccttgctccaggcacagtttgagggagtgatgacgcaacgcaaaccaagacaggtcactgctcttttggggccacattatacaaggataaaaataaacatacaaaattgttctaagcatacaaaattttgctaagtgtcaggaggaaaaatacacagcctagtaagcagaaaactacacagagcgacacaatatagaggttctgtatgtgcctcagaagtgacagagcaaagtgtgaccaggaaagacccatttcagagaatgaaatctaaacaggaggaaaagcagccagtcatacagacaccagatggaaaatcatcccagcaaagagaaggagacttcaaaattcctcacaaatatcaaggctataagtagacttcagttcagtgcttacaataagttaattaaaacatctgcaagaaaatgactacaactatttgcatctttgtatgtatttattccttaatgtaataaaacattttcatttttaaaaaatggtcctgaatgaatagaggtttggcatgttagaagcacaaaagttgtttggtcaggacaagatcatcatagccatgagtattaatgataggagttaatgaggttcagacccttcatgcttgtgaagatagaagaataaagtaagttcctcatggggcacaaattgagcatgttacatgcaagaataacgttgcctaaagatctgtccagcctctgtgcagaacacaactatttaggagacaagagtggaagcaaggtcccagtgaaggaccacaggttgaggcagagggaaacaagagtcttccaatctcagtgaatctcaccatcatcctctcatgctgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtagtcacgtcagcatgttccaaagacgtgatccttggattccacttcttttccttgaacctcccatgtctgattttataaaattctcttcatatcaaatcttcaggaagtcttgcaggagtaaatgcagttaattgttctataagcaggcagggagggtctccagggattataagaatttaaccaacttgagcaatcagcctgttttacaagcttgctggtgggaaccagctcctggcataacccagcaacttacagacaaattaggatgaacattcctcattaccatgctaaagtctccacccaaggaggagctatagcctcattaccatgacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtggccttcttacttgaaccaagtaacaaaacttttatttatcaaaatgtacgttctcatagagagtctttgttactcaccagggaaacaagccctagttttttcagctaccagctctaacacattctgtaaagtccagcacagaaggaaggttaattcacaatgctattgctttcactttttaataattgggaacatatcagggcagatgtctttatgtagggttaaatggaaggtcaaggaggcaaatcatcaaccttggggagacacacttgcagagattatgactacacttgggattcaagaatatgagaccccaccagcagagtagcctgcaatgttcaaggatatccaagtagatcaagtattttaatgaaaaaacaacaggctttgtctttcaagatgtccatgaattgactttccagaagagaaggaagaagacctcattgtcagggcagaagagagaagaggagagggatctaggctaaatattgtaatcgattttgcctgatattgactttttgtttgtttcttagttcattttattttattttattttatttttttgccaagactggagtgcagtggtgcagttttggctcactgcagcctctgcctcccaggttcaagcgattctcctgcctcaacctccagagcaatttttgtattactagtagagacagggtttcgccatgttggccaggttggtctacaaactcctgacctcaggtgatccgcccacctcagcctcccaaagggctagtattatagacatgagccatcgcgcccagcctcttagttcatttttagagatgaagtctccctatgttgctcaggctggacttgaagttctagactaaagcaatgctctcgccttagtcttgccagttgttgagactataaatacacaccactgagcacagctgatactcacattttatgagctgtttccactccaattacataagggagtgaggcaattagtaaggataggagcatagaaactctgtctacatctctatttcaaattacctctgaaaaacagccttgtttttaaactaaaacttgattttggttaataaatgtttgtcttaaaatgcacttagaattatgacagagttgtcacttttgtctcagttctgacctatagtgatttcaaaagaagatcagtagactacttcaaaattctcattattcaaagttattttggatgtaaaattggctgatgtgagataatttagaatatagggccagccaggttacccaaatgaatatctgggaaactgagcacattacatgcttatcacacatccccactgagttagaaaatatgactgtattagtcaggatcatcaagagaaacataaaagatttaggtagacacagatagatagaaatatagatacagaaggatttatcatgagaaactcgctcacgcaattatggagtctgtgaagttccataatctgccctctgcaagctggcagacccaggaaagctggtgggataatttggttcgagtcccgatgcccaaaaaccatggaagctgatgatgtaaatgtcaacccaactacaggaagatgacataagatgtcctagcttaagaagtgaggcaagaaaaagtgatgaattccgcctttctctacttttcaatctattctggccgtcaacagattggatgagccccatccacactggaaatgcaacctactttacttaatcaaccaattcaactgctagtcttacagaaataccctcagagacacagccagaaataatgttaatctgggcacccacaggcccaggcaacttgaaatataaaactcaacatcatgatgacctatggtttcccaggtgcaccagaagatgttaccaaaatggcaccatcagccagaacccacatacattcaccaggtcagtgcatctctcagttcaccagagattcattttctttgtgacatcacgttcacctggagtgcagccaagaatcaggccacagctaataatgagaaaggaaggattcttcatttgcctttttacaaatgacagaaaaatttgccaaaatcctttggtaataagtagttatctcaaagacaaagagactcaaaatgaaaatgaaaaaaagtcagttacccttcccactgcccatgttcttcctccacatataaaaataggtattaagttcaccctttctggtgttaaagattttagtctaacccaatacctgtgaatctcagtgcacagatattaccagatttttcattacacagaaaatgacagagacattctcccactacagttgctattttgtggtgacaacttttactttcccacgattctttcgttaagtgacacacacgtgcaactggaaggatttactgttttcacccacagctcccacacttcacagctatgcaggagcttcagtacagcagatcctagcaccctggatagtacaagcgtgacttcttaaccacaatgcaatagcaaatatatggggttcagtgtcggtctttcattcagaatatactgttcagaattgtttaaaatagtaaatttagaaacaaataatatatcctgcagaactggttaaaataggattgtatatctttacaagggaattttatgcagtattttttaatgcaaaaaaagtacggttaatctcttcctactggcatggaatattaccgaaatatattgttaatgagaaagaagaatggtgtaggccactgtaagaatctacccaggctgctataacaaaataccacaaatgagtattccaaaacaacagaaatttctttctcccagttgaggaaacatcagctcttctcctccatactcacactcacacttctggccaccaaatgtgggagggtgctttcttgcagcaaccgattccagctgggtatcctaaaattcaattggattgtgacactaactggagtgaatgcagaccccacaggttaagggcttggtcccacaagactgtcagtctcaagtagcagatcattatctgtgcttttgaccaatgaactatagtttggaggatcccgtgacttcctcctcagtttgatcatttgctagaatggctcacagagcccagggaaacactttacttaggtttatacatctatcattaaggatatactaaaggtacagacagggagataatggggcaaggcttggaagggtcctaagtgcaggatcttctatccctgtggaattggggtgtgccaccctcccagcacagggatatgttcttgtgtactgtattcatttgttctcacactgctataaagaactacctgacgctgggtacggtggctcatgcctgtaatcccagcacttcgggagaccaacgtgggcagatcctaaggtcaggagtttgagcccagccttgccaacatggtgaaaccctgactctactaaaaatacaaaattagctgggtgtggtggcacaggcctgtaatcccagttacttaggaggctgagggaggagaatcacttgaagccgggaggcggagtttgcagtgagcctataacatgccatttctctccagcctgggcaaaaagagtgaaactccatctcaaaataaaacaaaacaaaacaaaacaaaaaaaactacctgagactggataattgatgaagaaagaagtttaattgactcgcagttctgcagtctgcacaggaagcatggctgaggggagctcaggaaacttacaatcatcgcagagggtgaagggaaagcaagcacatcttcacatagcagcaggaaagagtgaagggggaagtgctatacacttttaaataaccggatctcgtaagaacttactcactatcacgagaacagcaagggggaaatccgcccccatgatccaattacctcccaccaggtacctcccccaacattagtaattacaatttgacatgagatttgggtggggacacagagccaaaccatatcattcaccaaatccagaaacttaccaaagtctctctctctcctcttggggtttatggaggtgtcactacgttggcatgactgatgaaattattcgccactgctgatcaactcaaccttcaatcccccttccagggggttagctggggtagcaatggatgttttaaccctctaatcacttgctcagctctgctagcaaccagacccctcctgagactacacaggtgccactcgtctcattaatgtacttcattagacacttattcagaaattttaagagttttaggggctctgagtcaggaaacaggcaggaacattaaatatatgctatatatttttttagagatgggatttcactcggtcacccaggccggagtgcagtggtgccatcatagctcactgtacccccacctccggggttcaaggcatccttctgcctcagtcttccaagtagctgggaatataggctgtagccaccatgcccagaagttgcatttctcattataaatcacaatatcacaatcacagctctggacactgggaagttcaagatgaaggatctggcaggttcagtttgcagtgaggtctcccttcctggcttgctgacagttgttcccccaccactgtgtcctcagatagtggaggaagaagtaagctctctggtgtgtctcttgtttttttgtttgtttgttttttgttttttgttttgttttgtagagatggcatcttgctatattgctgtattaggctgttctttcattgctatgaaataattcctgagattgggtaacttataaagaaaagaagtttaattggctcatggttctgtacgatgctcaggaagtatagccctggtatcagcttctaggaaggcctcaggaagcttataatcgtggcagaagatgaagcgggaacaggcacttcacatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaggaggttaatctagctctcagttctgcaggctttacagaaagcatagcagttcctgcttctggggaggcctcaggaagcttccaatcatggtggaaggcacagggggaacaggggtctgacatggcaggtgctggggcaagagggcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactggggattatattccaatatcacatatggatggggcaaatatccaaactgtcccagttgcccacaatgatcttgagctcttggcctcaagcgatcttcctgcctcaggtgcccaaagtgctgggataacaagtgagagtcaccaacccagctggtggtgtctctttttataaggatactaatcctcttgaatcaaggctccacctttatgatgtcatttaacattaagtttatccttataggctctccctccaaatacagtgagactgggggttaggactacaatatatgaatttttaagggacataattcagtccacagcaaacactattattttagtttttaaatagagcatgttactgaggggggacatagaggaattatacgaagaaatctgtataaatgaggaaaagtgagtatgcttatatgtactaccacatatatgcttagattcagtatatatattatagaaagagtactaaaaaactgaataattattcttcctggaatacaaacctagcctcgataaacaaaggtaaatgaagacatctttttcactagatacccttttttaataattgagtttacattttcaccatatgaatgtatatgcattctacatatgcatatgcacttatgtgcatatatctatattcgtaaagatgcatatatttgttaaccacagactccctactattacaacattcaaacaaaggagaagcaatcaagtaaaactaaaagaaccataataaggcagcactggatgacctggaaggctgagggtccctgagcccaacacccatcaccctacagctgggaatcagacagtgatggagctatccctcactccatctcctgctctcttccttctccagtccagccacctggtcacagagtgaggctctaaactggcccgtattacatgtgtctgtccctccccttctcacctcggaggaagagtgtgactatcccaagtcagcaggtagagtaagacagagcgtgagacctgctagctgaggagctctaagaaccttgtgctttgaaagccgatctgctttgtggtattgaaatcctctgagtccattacctctttattacaggaaaggtgtgtgaaagacccaggacgtgtcactacaggacaaaagatctggatgttcaaccacaatcaaagctcttgagatccagcaatttccttgaacaatttttctaccacacacacttctcaaaatatagtgcatacccatatttaggattgtggtagagggccattacatgatcttgactgtatcaataaaagtctcagggcaaatctctgggggattcagtgcagatggcctgccagttggatgtggaatctgagcaaattatccttatattctgctactcatctccaaataacaggcttgcatcaaacggccatctatctcagacactttgcaatctatgagtctgcaataaagaatgaatgtgtctgtgtgtgtgtgtgtgtgtgtgtgtgtgtgtgtgtgtgtgttttaaagaggcatatatgtggttcacttggtttatgtatgtgagttacttgattgcttatatgggaatattctgaatacttgattaattgaataaacgaaatataattacatcatgtacaaaacttttcatagtttcatctgcttgatcattattcctgtaagactccatagtaatatctaattgtatttttagtgaggaagctattttggcctgaccttcaaaactgtctttgcatttggtaggacaaaagactagcaaaaaaaagcctgaggggttattttaagtattcttatgaattagtgttcctcagactgtctgggttagctgacttgtgaaaaaactaaagggacaggatactcagtaagtatgaatgtaacagttcactcctcagtatttctggaacaggaaggatttttcctcatgcccccaactgcctctagccaaacagaaaagcaagaggacaaaattctttaaatcttaaaaggaagctatgggtaagcagtgacatatagaaactagcacataggtcatcaattttgtatcactgggatactcataatcaatccctaatgactaatgaccaattttcgataataataaactatataatcaaatattatacacaaattcattgatagtgttttctgccagcctgtaagtgccacacctgaaaaaacttcaaactttagtgtagtttccatttggatcacctgggggaagttttgcactatggatccgtgggctccattccggatatactcatacagaacgtctgcacatggagctcaggattctgcattttcaagcatttcctcaagtggttctgaaacaacctgtctccagcccaactttgagatccattttttaccaaactctggcttcagaagccttcatgtacatcggaagtaatctcagtgtggggaaattccaaagcacaggaagcgatgataccatttgcattattacccagatgattctagctacatacacctattatccagcatttatgtcttgatatgaggcttctattcagttgaccctattgatatccaagtgtacacaactgacctgtcaggctatagcaacacttcacttatatgtagggagaatttgtgcagggcttagctgaagctcatcatggggtatgaattgacttggtcttattgctataacccttgggttcagaagacactgaacaaatgcttaagaaactgttttaggttaatgaatggggatatatttaactcctcagatagccaaagaatcaagaagaagggattgagctggatggcccaatagaagtgtccattgattgcacccccacacataccagcagaaacaccacatttaacaacaactatctacacacaaaaaagcacctacataggaaatgaaaatcaagtcaacaatcatagtacctattttaacttcatatcactgaaagaggcactgaagaggttaggaaagacaattttgaatcactgaggccaccactcccccatctcccaacagccaccacatggagctgagacagaatctgagtgcatgggggagggagagtttagcaattgtggaaatctgcattgaactcagtgctgccctgtcacagcccatccacagaaggagcatttagaccaccttagccaaaggggaattgcctatcccagcggtcagacactgagtttgggaaagctttgccacagtaggctaaagtgctctggggtcctaaatatatttgaaactcaatctaggccacaagaactacaactacaaggcaagtcccagtgctgtgctgagctcagagccagtggacctagacaccactagtgtgacacttgtcagggcagctaagggagtgcttgcacaaccgctcccccaaccccaggcagcacagctcacagcaatgaaagtgactccttccttctgcttgaggaaaggagaggaaagagtaactaggactttgtcttacatcgtaaagatcagctcagccacaataggatagggcaccagtcagagtcatgaagccaccatttcaggcactcgctcctgaaggacatttctagacacaccctgcaccagaagaaaacccactgcctagaaggaaaggacctagtccttccaggattcatcacctgctgactgaagaaccctcaggccctaaataaccagcagcaatacccagtagcacactccatgggccttaggtgagactctgagatatgctggcttcaggtgagacccaccatacttacagctggggcagtcatgaagggacaattcttctgcttgagaaaagcagagggaaaagtaaaggggactctgtcttgcagcttagatagcagctcagctacagcggggtagagcaccaagccggctcttggatccccaattccagatcttggctcttggctggcatttctggacctgccctgggtcagaggggaatccacttccctgaagggtgagtcccaggccaggcagcattcaccacaagctgactgcagagctccggggccttaagggaacattggcagtagcctggcagtattcctcttgagcctgtgttggaggtagcagtggggagaggctcctctgcccatggaaaggtgaaggaagactggaaggactccatctcatggcttgagtgcaagctcagccacagtaaaacagaacaccacgtaaacttcccaggttttttactttggtccctggctctcagacagaacctctggacatgcctgggcctagaggacctcatgaccctgaagggaaggacacagcctggctggtattgccacctgctctaggaccttgtagagctttagggcctgaggcccttacttccaagaaaggaataactcttttctagtgagctgaactgtaaagctcataacacaagtaggtcctcagtgcatattcacttcctttccttcttacctgaggtgctgcagtgtgaatctgaaggtggcaggttcaacactaaagtgacggactgcaagaaagttatggtagactcagaaatctgttcttcaacatttagactgtatttatgctggctggattttctgtttattcacctattattctctacccctgtcagcaaccaagaaactcgcagcccatctcacgctgtcttaaagggaaccaagaagttttggactcttggcctgcaggaagcatgcagcgcggcgccccctgccggccaatacaacggccacgggaactggcagaccactgaggctctgggcggggcggagttgccccttctcctcccacttctctagcagcggcttcttctggtgacaccccgggagccacagggatttggttccctaaaggaagcggtttcccaccagggtatcgtccctaataccctccgaaggagtccattgaggagaaaggaacagaacgtctggcagaatgcagaaggaccctatgatccaggacatgtagcgccagccatcaggaggttttatgagagcagctggtgggaagatcagtcccaggagaaggggtttgtctagcagcttggttggagcaagccttttccagagaattatttccgtaattcaggctccctcccaaccctccactgccaccttatcctccaccaaaagccctgacactgtggcagggataggggacgtggggttggtggggaacaggctgtaagaaagacgcgggagcctatatgtgtctgggaaaaatgaggggtccacgtgcaagggaagaagcatttacaaagaagactttgacagtgctgcaaagatttgaaggcgcagggtgcaagtcattcaggtgccggtgtcaggaggaacctagccatccaggtgaacagatgcccccttcttgcagcccactcgcatgggcctggtggactccttcttatttttggtagtggcagtgaagaggtcgggtccctgcgctggcaaagcagtcagtgacattgacatcatgagtactgttgcggcagctgcacatggaggggctgttggtacagggcagtggtggagttctgcagaaatctgctatggtggtcagattctatgaatgaatgtgtggatctgctcgcatttacccctatagatcagccaactgcgcctcatcatcacatcacagtatcggtggtgtcctctagggacccacgacctggggttgtctatatgtcgtgttaagaagggcagggctggagtgaagacagttaggtccaaaaggaggaagaggaggagggtccatatcagattcatgtttcttgtgaaagcatttcaaagaagagcagagtcaaaagagcaagccatggtcccttgtcctgttcctaagaagtcttggcccaacacttagtgttcgcagttctcccctcctgccatttctacacttattcttcgtgtactcatggcaacaagtgttctcacatccttcttccacctccttgtcaataacggagatggctaccaccctctcaaccctttatgggattatcctatgtacaaggttatttccaaaccccaaagtgattcttgctccttacctaagcagaccagttaaactaaaaactttcatctctgaggtgtttgcatctatcagttcaactgccactcacccatagccttgagatgaggcaggcatgattgccaacccctttttagagtgacttaactcagaagggaattgacagattcatatgacctgcatcttagaaaatattttcacttccttaaatacaaatgtctgtttaaacgctgtttttaaaaatgagagcatttcaattttaagggagtagagtttatgtttcccccacatatttctctgcctcaaaataaagattcccaactcttccatgtatagagcctatcttccagaaatgttctaattcttggtgctcagggattctgggtgactgtgtgtgagccttctgtctctagctctaatatctgactctttttttaaatacctgggagttccaggaaagggttttctgcagagcagatgacatccacagagatggatatttttctctcagaggttgatactcctagtagaaatggaatccccgttgcctctctccttcctctaatcttgtagaaatttcattgtggatattttcttcccagaggttagggtgcaggccgtatggaaaactctcaggcctgtcaatgattttaaacagattcccaggtaatgctaattttatgcttactatttcacacctgaaatattcaccagcatcacacagagtgcctatgacatcactgcaaatatgcagaaacttggggtttagtgtctatcataagcttgctactggagcttggcaaatcaccttatccttctactcctcatcactaaagtgaagattatagacaaaagatctctttcagctctgacattctgtatttttctatacattactgtgtgtttgggttcatgtgtgattttgtatatatgcatattggtttatacatgttcaggttaggagaaatacttagtttgcaaattgagtttccatttcagaattgttaatttaattaagtgtagtttttccttaaagcagttattagcaaggtcaaaaaaattgaatcactattatgtaaagattacagcataatctgtttttgtctccaccattaaagttatacgggttttttggtgtttgtttatttgtttttgagactgagtctggctctgtcactcaggctgaaatccagtggcgcaatcttgactcactggaacctccgcctcccaggttcaagcagttctctgcctcagcctcccgagtagctgggattacaggcatgggccaccatgcctagctaatttttgtatttttagtagagtaggggtttcaccatctttcccaggctggtcttgaactcctgacctcatgatccaccagcctcggcttcccaaagtgctaggattacaagcatgagccaccgtgcccagccatattcatttatttatatttatttttatgtatttatttattttgagatggactttcactcttgttgcccaggctggagtgcaataatgctatctcggctcaccaccacctccgcctcccgggttcaagggattctcctgccgcaccctcccaagtagctgggattacaggcgtgtgccaccacgcccagctaattttgtatttttagtagagacagggtttctccatgttgctcaggctggtctcgaactcctgacctcaggtgatccgtccgcctcagcctcccaaagtgccgggattacaggcgtgagccactgagcccagctgaaattatatatgtttttattgaaggagaagctacttggaactccagtctgtatttcagtaaggcaagggaagaaattagtacgtacgtttctcagaactccaaaatcagctaaatttagggacctgttaatgaaggcaataggaggagttgcgtatacagtctatcaacaaggtgtgatgcagtagatttcatagtttttctgtcttaataggtctcctgagcagaaaggcctcaaaagccttttatataattaagcaaaactgactaatccatggcaagaagctgagttgagatctaatacctagattttaacatccttgacttctatctgctttataattggccaagttgccaagaaaagagaaatgaattcttttttttttttttttgcttttgagatggagtcttcctctgttgcccaggctggagtgcagtggcgtgatctcggctcgctgcaacctccgcctcttgggttcaagcaattctcctgcttcagcctcccaagtagctgggattacaggaaccccccaccatgcctggctaatttttgtatttttagtagagacagggttacactatgttggccaggagggtctcgatctcttgacctcgtgatctgcccacctcagcctctcaaagtgctgggattacaggcatgatccactgcacccagccagaaatgaactctttttgaacttcatgctcagttattcttgtttaattcacacaaccattctgacaggtatttattattatgaccacttctgtggatttcataatttcttgtgtttatagcctcacgtaacaggccatgtgtttataatatccagtctgctggtgatatggtttggatctgtgtctccacaaaatctcatgtcaaattatcgtccccagtgttggaggtggtacctggtgggacatgattgcatcgttggggtggatttctcatgaatggtttagcaccatcctcttggtgctgttcttgtgatagtgagttagttatgagatttgattgttcaaaagtgtgcagcacctcctccctctctctcttgcttctgctcccaccacgtgagacacctcgctccccctttgccttccactatgattggaagtttcctgaggcctcactagaagcagaaaccactatgcttcctgtacagcctgcagaacagtgagccaattaaacctcttttctttataaattacccagtctcagatatttcttaatagcaatgcaagaatggactaatacagctgttatgctctgtttgtccgagtactatgaaaaaagtcttattactcataagcagtagagctgtaatgcaaaacgatgtcctgtatcttaactttttgaagagaatatgtcgcagacagcaggataaggcaagatgcagaaatttattctgcaaaaaaaagtgtccttattctgaagagacagatgccttcatagtgtgagagactaacctagtcctccaaagataaccaggaagaaaaaaaccacactacctaaagtaataagtagttgtgattagtggcagttatggaagaatgtatagctcagccaacaaatatttaccacatgaggagatttagtttaaggcaaatacatttgcttaactgacaatgtattctaataaattgaacacagtaggatgtttttacggaaagatgaaaacttgccacgaaagcagaaatgagactatatagagcagtttcacaggatttgcccaacactgtctggaggagagagaccctgtatctgacagcctttagctttctggtcattgtggcatgggctagttcataaagctcttctggggcattgatgaaacatccctcaagaccacttgcttctctttactctgattaaataatcttcatacagcattttgataactggtctatcctcaccagtactactgtgtattactagcacagaagacaaaatattgaaatagagagtcttcagaagtaaactatgaacaatggcgatttagtaaatctcataatgctggcgtttctaactggtgaggaaataatgaattgttcaatcaatagcacttagaatattggtgatccatttaaaaaaataagactatatccctctctgataacacagagtttttttgttctgttttgttttgttttgttttgctttcttttttgagactgactctcactctattgcctaggctggagtgcagtggcttgatcttggctcattgtaacctctgcctcctgggttcaagagattctcatgcctcagtcttccgagtagctgagactacaggcatgagccaccatgactggctaatttgcatttttggtaaggatacgttttcaccatgtttgtcaggctggtctcgaactccttacctcaggtgatccatcccactcggtctaccaaagtgctgggatttacaggcatgagccaccgtgcctggccatcatagaattttaaaattggaaaagaggaaacaaaactgtcactatttacagatataatagtgtacattgaaaaatctaaaaacaatgtgtcgggactcagaaacaatacttcaaactgtggtgctttggaatgaggagcactctgggctttttctgttgcttgtttttaaattttttaacaatatttgtgtgggtacaaatttggtgtatatatttatggagtacatgagctattttgatacaggcatccagggcctaatcacatcagggtaaatggggtatccatcccctcaagcatttatcctttatgttacaaagaagccaatcatactcttttagttattttaaaacgtacaataaaattattattgatgaatgtcaccctatatttgtgctatcaaatactaaatcttattcattctttttttttcttttttttattttaattttttttgagacagagtcttcctctgtcacccaggctggagtgtagtgccgtgatctcggctaactgcaacctctgactcctgggttcaagtgattctcctgcctcagtctctcaagtaactgggattacaggcatgtaccaccatgcccagctaatttttgtatttttagtaggaacgatgtttagccatgttggccaggctggtctccaacacctgacctcaggtggtctgcccgcttcaacctcccaaagtgctgggattacaggtgtaagccaccacgcccggcctaatcattctatttttttactcattaaccattcacttccctctcaccctccaatgctaaggtctttgaactaaagaaaatgaaagggtgttagaatcagcctcagaaccacggactttcttaacttctcctgttttgcccccaagtgcaggatgaaactcttcctctctgaagttaccttatccgaagctcctccagaaagaatccagtggtctttggtcagctccctgagactttcttaaccagggaagattaaactcatggcagaaggtaagactgagggatgtcaccacacctaagcagactttgtcagaagctgttgtctattctttgtcataatccaaagagtttccaaagagaataattcacaaactatggtcaattctttgggcccattcaactctcctaaaaacaatttcctactcctcaaaattgcctacattcccccatctctctctctcctgtgaagaagggtatatagattctgaacctcgctgggttactgggtagtcactctctcgtcattcccccatgaatacaataaacttgcctttttctccagtgaatctaccgtcggttaatttcagcaaactcaaaccttaaagggaaagggaaattcccctttgcccctaacatgcaaattaattatttagattaataattgctagatataaaattggcatatggtttatttatttttatatttcagcacaggggagggaaaaatgacttccttccacccttttaggttttttgtggctgggctacaagttaaattacataagacggattaacacaagaaaaactgtattaaagtatgtgtgtatacataggagtcccacaaaaatataagactcaaagaaaggccagatgaataaagcttatatagcatcttaagctacagaaagaaacagaggcttggggcttctggagggtggtggtgcaagttaccggagcgtgagaggaggaaacatatagtaaatacatggtaaataaaggttgccttgttatgcagataagagtctctcaggggataaaaattgccttggagcagctctcttcctgatcaaaaacacctttaccagtgaaaatttattgtatacatctgaatttcttttacaaaagggcagcttttcagagctaactcctgtgcaggcagtttttctaaataaatagttaataatcaatatgctagagaggaatattttggagtggtgcattctgagccctaaccccagcaacaggcagaaactgaaatgttaaaatgatacaatttgcaatactattaaaaatattaagttcataaggagaaaaattgggaaaagataaagaactttatggacaaaagtacaaaactttattgtgagacattaaggtaaatagaaaggtatagcatgtttatagattgtaagactcactaatttagatacatcaatttttctgcaaatcgacctatagattggtaattgcctgatgggttgttcctgcctgctgcacagacaaaatcagttcactgagaccacggagacagagtttttactcaaatcactctcccagcagtcttggagactaggggttttttggttttttcctttttcgttttttgtttttttttttttttgagagaaagtctcactctctcaccaggctggagtgtagtggcatgatcttggctccctgcaacctccccctcccgggttcaagtgattcccctgcctcagcctctgaagtagctgggactacaggcacgcaccaacacacctggctatttttaggtattttagtagagacggggtttcatcatgttgaccaggctgatctaaaactcctgactttgtgatccacccgcctcggcctcccacagtgctggaattataggtgtgagccaccacgcccggccaggaagttagggtttttcaaggatagtttggtgagcaggtggctagagaatgggtgctgctgactggctggggatgaattcatagggatgtgaaaaacaatcctcgtgggctgagtctgcctctgggtggaaccacaggactggttgagttatgagccctggttccataggttgccggaatgcaaaagtctgaaaaaaaatctcaaaagaccaacctcaggttccacagtagtgatgttacctataggagcaattggagaagtgacaaatcttgtgacctctggccatgtgacccttgagcagtaagggattatagaaaatacattttataagaattcaggcacatctcataatcctaactttgcagactttcattagttttacaaagttttgggaagtgctactatcatcctcactttaaatttgaactataacttccacccgaagtagcttggcctatgcccaggaatgaccaaggacagcttggaggttaaaagcaagacagagtcaactatgtcagatttctcttactgtcataatctttgcaagggcagtttcagatttagaacaattccaatcaaattctcaaccaagtctttgtttacttattttgggaacttactgattctagaggatatatagatgtataagaatagcaaagacacctccaaaaaaacaaactaaaaaacaagctgagagagtttgttctaccagaatatatataaaatggaaaacaatatcttgttacataaaagcctagtattgctcgttgacgggcagccttgttccatgtgttattcagagacacagattacttccatcttctgattctgtcatctcctcatccatttcatatagctggcaaacagaatagaaggtggagaagcacactttcttaactgccttggccatttttcactggcatcaccttcaggtagggaactatagttcctacctgagctgtcgcttctcagcatcaactctacaccatgcaagggtgagcataagcctgagggcagctagttactacagctacagcaatgtaaatggtgttgccagtttcatctttgtcacagatgagataagaacagatgcaatacagttgaaatatgaaagtagagagaaatctaacacagagtttcccaaaaatgagttagatgagacccaggaacttgtacaaactctcatcagtgattgacaccagtgtcaacaaacttgcaaggagaaaaaatggtcagtcccaaaactggacctaaaacactttatcttcttattagaaaacagcagcagcattaataatactatactgcaatatcatatttagacttatgggccagagaagtgggatgtg

SEQ ID NO: 102 - DNA, 59320 bp, Homo sapiens
  source 1..59320: mol_type = genomic DNA
agaattgaacgttatgatagaaaatagaaaagaagaaagtagaaaaagtcaagaatgctataaataaggtgaaaccaagataaagaaaagtttagcctcagggatatttcttttaaatgggcacatcaagtctccagctattagcaatcgtaatagaggtggaaccagggtttgagtcaaatgtgcaataagataaattgttccgacagcagtaaggacagattgtaatgctgactggaggagaggtggacatctttcccaaaagttccatgtcctggagatggggagccgctggtcacgtgggaaggagaagggggaggaggaggaggaggaagtgggagcactcatgaaggtgagttggctcctgcccattctgccctccatagatgttcccaatggcgagtcaaaggttcattcaacacctgtcaggaagggcacagcctcgagaattcaggatttgtagacccagagagagaagaaatggatgatgagagccgctgccctggactccaacacagggcttcactcaggaatccatgagaaacaggggagaaaaaggggaagccccttcctgcaagttgtggacaggtgcagcattcaagtgattgttccaggaacagagtgggtctttttgaatggcccgactcagaatgcaagagaggtacgatgccatcagatctgcaccttggtccttcagtctgagatttctgacttctatatttctcctcctcttccagaccctgagaaacagcaatttccattcctcagatgactccatgtcagtaatggtgctttaattggcatcagacagcagctgtattgaagtctctcctctggagaagctattgagatcttgcttctccaaggtcgggctgtgaacttaaaagtttgcacagagacactgagtttgggaaatctcagtgctcaacagaatccactgactctaggtaaaacagggcatgtcaggaagtgagtgcagtcttcccataacctcagagtagcagaaggagaaggtgggactctgaaagctggagccacgtttcctgtgaagaaagatggagtggaccttccttgcttcaggtaccagatcacaggtctcttctcagtcggggatgcctcatctctaaaaccacaggatagagggatcagtccccacctgcccccacaccctctccaccttgtgacttcatcctctctcgtcattcattccttcgttcattcattcatccagcagtcatctactgagcagataccttgctccaggcacagtttgagggagtgatgatgcaacacaaaccaagacaggtccctgctcttttgaggccacattatacaaggataaaaataaacatacaaaattgttctaagcatacaaaattttgctaagtgtcaggaggaaaaatacacagcatagtacacagaaaattacacagagcagcacaatatagaggttctgtatgtgccacaaaagtgacagggcagagtgtcaccaggaaagacttatctcagagaatgaaatctgaacaggaggaaaagcagccagtcatgcagacaccagatggagaatcatcccagcaaagagaaagagagttcaaaagtcctgacaaataccaaggctgtaagaagacttttcgttctgtgtttacgataagttgattaaaacatctgaaggagaatgactaccattattcgcatctttgtatgtatttattccttaatgtaataaaacattttcagttttaaaaaatggtcctgaatggatagaggtttggcgtgttagaagcacaaaagttgtttggtcaggacaagatcatcatagccatgagtgttaatgataggagttaatgaggttcagacccttcatgcctgtgaagatggaagaataaagtaagttcctcatggggcacaaatcgagcatgttacatgcaagaataacattgcctaaagatctgtccagctgctgtgcaaaacacaactatttgggagacaagagtggaagcaaggccccaatgaaggaccacaagttgagggagagggaaacaagagtcttccaatctcagtgaatctcaccatcatcctctcatggtgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtggtcacatccgcatgttccaaagacgtgatccttggagtccacttcttttccttgaacctcccatgtctgattttataaaattctcttaatatcaaatcttcaggaagtcttgcaggagtaaatgccgttaattgttctgtaagccggcagggagggtctccaggaattgtaagaatttaatcaacttgagcaatcagcctgttttacaagcttgctggtgggaaccagctcctggcataacccagcaacttacagacaaactggcatgaacattcctcattatcatgctaaagtctccacccaaggaggaggctcattaccataacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtgggcttcttacttgaaccaagtaacaaaacttatttatcaaaatgtacattctcatagagagtctttgttactcaccagggaaacaagccctggttttttcagctaccagctctaacatattctgtaaagtccagcacagaaggaaggttaattcacaatgctattgctttcattttatttcactttttaataattgggtacatatcagggcagatgtctttaggtgggggttgaatggaaggtcaaggagacaaatcatcaaccttggaaagatattcttgcagagattatgactacacttgggattcatgaatatgagaccccaccagcaaagtagcctgcaatgttcaaggatatccaagtagatcaagcattttaatgagaaaacgataggctttgtctttcaagatgtccatgaattgactttccaaaagggaaagaaggacccattttcagggcagaagagagaagaggagaggggtttaggctaaacattgtaatcaattttgcctgataatgactttttgtttcttggttcatttttatttatttatttatttatttatttatttatttatttattttcccaggctggagtgcagaggtgcaatttcggctcactgcagcctctgtctcccaggttcaagcgattctcctgcctcagcctcccgagtagctgggactacaggcatgcactgccatgcccagctaatttttgtattattagtagagacggggtttcaccatgttggccaggctggtctcaaactcctgacctcaggtgatctgccctactcggcctcccaaattacgaggattacagacctgagctgtcgcacccagcctcttagttcatttttagagatgaggtctccctatgtggcccaggatggatttgaagttgtggactcaagcaatgtttttgccttagccagcccagtagttgggtctataaatacacaccactgagcccagatgatactctcattttatgagctgtgtttccactctgattacataaggaagtgaggcaattagtagggataggagcatagaaattctgtctacattcctatttcaaattacctatgaaaaacagacttgtttctaaactaaaactggattttggttaataaatgtttttctttattaaaatgcattagacttatgacagagttgtcacttttgtctcacgtctgatctacaatgatttcaaaagaagatcaattgactacttcaaaattctcattgtttcaaagatattatggatgtaaaactgggtgatctgagataatttagcatatagggccagccaggttacccaaatgaatatctgggaaactgagtacattacatgcttatcacacatctccactgatttagaaaatatgactgtattagtcagagtcatcaagagaaacattgcagatgtaggtagaaagagacagacagaaatatagatacagaaggatttatcatgagaaattggctcaggcaattatggagtcggtgaagtcccacaatctgctttctgcaagctggcagacccagaaaagccagtggtataattcggttcaagtcctaacgcctgaaaaacaagggagccgatgacatagatgtcaacccaagtgtgggaacgatgacacaagatgtcctagcttaggaagtgaggcaagaaaaatgatgaattcctcctttctccacttttcattctattctggcccttaacagattggatgatccccatccagactagcaatgcaaactactttacttaatcaaccaattcagctgctagtcttatagaaacaccctctcagacacacccagaaatcattaattatttaattaattattaatctgggcacccacaggcccaggcaacttgaaatataaaattcaccatcatgatgacctatggtttccaaggtgcaccagtagatgttaccaaaatggcaccaccagccagaacccacatacattcaccaggtcagtgcacttctcaattcgccggagattcattttcttctgtgacatcacgttcacctggagtggagccaagaaccaggccacagctaataatgagaaagaaaggattctttatttgcttttttacaaatgagagaaaaatttgccaaaatcctttggtaataagtagttatctcaaagacaaagagactcaaaatgaaaatgaaaaaagtcagttacccttcccactgcccatgttcttcctccacatataaaaataggtattaagttcaccctttctggtattaaggactagagtctaacccaataactctgaatctgagtgtgcagatgttaccagatttttcattacagaaaatgacagagacgttcttccactacagtagctattttgtggtgacaacttttactttcccaggattcctcggttaagtgacacacacgggcaactggaagtatttactgttttcacccacagcttccacacttcacagatgtgcaggagcttcagtacagcagttcctaggaacatggataggacatgcgtgacttgttaaccacaatgcaatagcaaatatatggggttcggtgttggtctttcattcggaatatacagttcagaattgtttaaaatagtacatttagaaacaaataatatatcctgctgaactggttaaattggattgtatatctttacaatggaattttatgcagcattcttttaaaattatactttaatttctagggtacatgtgcacaacgtgcaggtttgttacatatgcatacatgcgccatattggtgtgctgcactcattaactcgacatttacattaggtatatctcctaatgctatccctcccctctcccgccagcccacgacaggcccccggtggtgatgttccccttcctgtgttcaagtgttcttattgttcaattcccacctatgagtgagaacatgcggtgtttggttttttgtccttgggatagtttgctgagaatgatggtttccagtttcatccatgtccctacaaaggacatgaactcatccttttttatggctgttatacagcatttttttaatgcaaaaaagtacggttgatcccttgctactggcatggaatattaccaaaatatattgttaatgagaaagaggaatgctgtaggccactgtagtaatctgctcaggctgctataacaaaataccacaaatgagtagccgaaacaacagaaatttctttctcccagtcgaggaaacatcagctcttctcctccatactcacactcacacttccggccaccaaatacgggagggtgctttcttacaggaactgattccagctgcgtatcctacaattcaattcgattgtgacactaactggagtgaatgcagaccccacaggttaagggctccgtcccacaagactatcagtatcaagaagcagatcattatctgtgcttttgaccaatgaactatagtttggaggatcccgtgacttcctcctcagtttgatcatttgctagaatggctcacagagcccagggaaacactttacttaggtttacacatctatcataaaggtatactaaatgtacacacagggagataatggggcaaggcttggaagggtcctaagtgcagaatcttctgtccctgtggagttggggtgtgccaccctcccagcacagggatatgttcttgtgtactgtattgatctgttgtaacactgctataaagaactacctagggctgggcatggtgctcatgcctgtaatcccggcacattgggaggctgaggtggacaattcataaggttagaagttcaagcccagccttgccaacatggtgaaaccctgtctctattaaaaatacaaaattagctgggagtggtggcacacacctgtaatcccagttacttgggggtgctgaggcaggagaatcacttgaacccaggaggcagaggttgcagtgagccaagatcatgtcattgcactccagcctgggcaaaaagagcataactccatctcaaagaaaaaatagaaaactacttgagacgaaataatttatgaagaaagaagtttaattgactcacagttctgcaggctgcacaggaagcatggctggggggcctcaggaaacttataatcatggcagaagggtgatgggaaagcaagcacaccttcacatagcagcaggagagagtgaagggggaagagctatacacttttaaacaatgagatctcatgagaactcactcactataacaagaaattgtatagtagggggaaatctgcccccatgatgcaattacctcccaccagttccctcccccaacattagtaattacaatttgacatgagatttgggtggggacacagagccaaaccatatcattcaccaaatccggaaacttaccaaagtctctctctctccttttggggtttatggaggtgtcattacgttggcatgactgatgaaattattcgccactgctgatcaatttaaccttcaatcccctttccagggggttagctagggtgggaatggatgttctaaccctctaatcacttgctagagtctgctggcaaccagcccccatcctaatgctacgcaggtgccactcgtctcattaacgtacttcatgaggcacttattcagaaattagacacttattcagaaattttaagagttttaggggctctgagtcaggaaacaggcaggaacattaaatatatgctttatatttttttagagatgggatttcactcggtcacccaggccagagtgcagtggtgccatcataggtcactttagcccccacctcctgggttcaagccatccttccgcctcagtcttccaagtagctgggattataggctgcagccaccatgcccagcagttgcatttctcattataaatcacaatatcacaatcacagctctggacactgggaagttcaagatgaaggttctggcaggttcaatttgcagtgaggtctcccttcctggcttgctgacagttgttcccccaccactgtgtcctcacataggcaaggaaggagtaagctctctggtgtgtctcttgtttttttgtttgtttgttttttgttttttgttttgttttgtagagatggcatcttgctatattgctgtattaggctgctctttcattgcaatgaaaaaattcctgagattgggtaacttataaagaaaagaagtttaattggctcatggctctgtacgatgctcaggaagtatagccctggtatcagcttctaggaaggcctcaggaagcttataatcgtcgcagaagatgaagcagcaacaggcacttcatatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaagaggttaaattagctctcagttctgcagaatttacagaaagcatagcagtttttgcttctggggaggcttcaggaagcttccaatcatggtggaaggcacagggggaacaggggtctgacatggcaggtgctggggcaagagagcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactgggaattatattccaatatcacatatggatggggcaaatatccaaactgtcccagttgcccacaatgatcttgagctcttggcctcaagtgatcttcctgcctcaggtgcccaaagtgctgggataacaagtgagagtcaccaacccagctggtggtgtctctttttataaggatactaatcctcttgaatcaaggctccacctttatgacatcatttaacattaagtttatccttataggccctccctccaaatacagtgacactgggggttaggacttcaatatatgaatttttaagggacataattcagtccacagtaaacactatatatagcatattactgtctgacagggaaaaaagaggaattaacacagaaatctatgaaaatgagaaaaagccttatacgtattattcatatatgcttagactcagcatatgcattatagaaagggtactaaaaaactgaataattattcttcctagaatacaaatctagcttccataaagaaaggtaaatgaagacatccttttcactagataccatttttaattattgaatttacattttcaccatatgaatgtatatgcattctatatatgcacttacatatgtatgcacgtacttatgtgcatatatctatatatgtagagatgtatacatttgttaaccacagactccctactactagaacattcaaacaaaggagatgtaatcaagtaaaactaaaagaaccataacaaggcagcactggatgacctggaaggctgagggtcactcagctcgccacccctcaccccccagctgggaatcagagagtgatggagctatccctcactccacctcctgctctcttccttctgcagtccagccacctggtcacagagtgaggctctaaactggcccgtattacatgtgtctgtccctccccttctcactttggaggaagagtgtgactatcccaagtcagcacgtagagtgagacagagcgtgagacctgctagctgaggaaccgtaagaaccttgtgctttgaaagccgatctgctttgtgatattgaaatcctccgagtccattctctcattattacaggaaaggtgtgtaaaatatccaggtcatgtcactacaggacaaaagctctggatgttcagccataatcaaagctcttgagatccagcaatttccttgaacaatttttctaccacacacacttctcaaaatatagtgcatacccatatttaggattgtggtagagggccattacatgatcttgactgtatcaataaaagtctcagggcaaaactctgggggattcatgcagatggcctaccatttggatgtggaatctgagcaaatcatcctaacattctgctacccatctccaaaaatgggcttcaataaaatggctatctcagacactttgcaatctatgagtctgcaatgaagaatgaatgtgtgtgtgtgtgtgtgtgtgtgtgtgtgtgtgtgtgtgtgttttaaagaggcatatatgtggtttacttggtttatgtatatgagttacttgattacttataagggagtattctgaataatggattaattgaataaatgaaatataattacaccatgtacaaaactttacatagttttttctgcttgatcattattcctgtaagtctccatagtaatatctaattgtatttttagtgaagaagctattttggtctgaccttcaaaactgtctttgcatttgggtaggacaaaagactagcaaaaaaaagcctgagggattatcttaagtattcttaggatttagtgttcttcagactatctgggttagctgacttgtgaaaaaactaatagttcactcctcagtatttctggaacaggaaggatttttcctcatgcccccaactgcctctagccaaataaaaaagcaagaggacaaaattctttaaatattaaaaggaagttatgggtaagcagtgacatatagagacatatagagacatatagatgagcacgtagttcatcaattttgtctccctgggatattcataattaatccctaatgactaatagccaatcttctataataataaactatataatcaaatattatacacaaattcattcataatgttctctgccagcatgtaagtggcacacctaaaaaacttcaaacattaagtattttccatttggatcacatgggggaagttttgcactatggattcgtgagctccattccagatatactcacacagaatgtctgcacatggagctcaggattctgcatttccaatcacatcctcaagtagttttccaacaacctatctccagcccaactttgagatccatttgttaccaaacattgacttcagaagccttcatgtgcatcggaagtaatcttggcgtagggaaattccgaagcacaggaggcagcgataccatttgcattattcctgagatgattctagctacatacacctattatccagcatttatgtcttgatttgaggcttctattcagttgaccctattgatatccaagtgtacacaactgacctgtcaggctatagcaacactcttcacttatatgtagggagaatttgtacagggcttaactgaagctcatcatggggtatgaattgacttggtctcattgctgtaacccttgggttcagaagacactgagcaaatgcttaaaaaactcttttgggttaatacatgaagagatattaactcctcagatagccaaagaatcaaggggaaggggtaaaagaggatggccatatagaagtatccattgatttcacccccacacataccagcagaaacaccacatttaacaactatctacacacaaaaaaggacctacataggaaataaaaatcaggtcaaccatcattgtacctgattttaacttcgtatcactgaaaaaggcactgaagagatgaggaaagacaattttgaatcactgaggccaccactcccccatgtcccagtagctgccactggagctgagacagaaactcagtgcatgggggagggagagtgcagcaattgtgaaaatctgcattgaactcagtgctgccctgtcagagcccacccacagagggagcattcagaccaaccttagccagaggggaatcaatcgcctatccaagcagtcagtatgtgagtttgggaaagccttgccaaagcaggctaaagtgctctggggtcctaaatgcatttgaaactcaatctaggccacaagaactacaactacaaggcaagtcccagtgctgtgctgggctcagagccagtggacttggacaccactagtgtgacacttgtcagggcagctaagggagtgcttgcacaaccactcctccaaccccaggcagcacagctcacagcagtgaaagtgactgcttccttctgcttgaggaaaggagaggaaagagtaactaggacattgtcttacatcgtaaatgtcagttcagccacaataggatagggcaccagtcagagtcatgaagccaccattccaggcactcgctcctgaaggacatttctagacacaccctgcaccagaagaaaacccactgcctagaaggaaaggacccagtcctgccaggattcatcacctgctgactgaagaaccctcaggccctaaataaccagcagcaatacctagtagtacactccatgggccttgggtgagactctgagatatgctggcttcaggagagacccaccatattcacagctgtggtagtcatgaagagagaatccttctgcttgagaaaagcagagggaaaataaaggggactctgtcttgcagcttagacagcagcttagctacagcggggtagagcaccaagccagctcttggagtccccagttccagatcttggcttttggttggcatttctggacatgccctgggtcagaggggagcctactgccctgaagggtgagtcccaggccaggcagcattcaccacaagctggctaaagaactctggggccttatgggaacactggcatcatcctgtcagtattccccttgagcctgcggtggaggtagctgcagggagaggctcctctgcctgtggaagagtaagggaagagtggaaggactccagctcagccacagtaaaacagaacaccatgtaaacctcccaggttgtttacttcagtccctggctctcagacagtacctctggacatgcctgggcctagaggaactcatcaccctgaagggaaggacacaagcctggctggtattgccacctgctctagggccttgtagagctctagggccttgagtgaggccctcacttccaagaaagaaataaactcttttccactgcagctaaactgtaaagctcataacacaagtagatcctctgtgcatattcacttcctttccttcttacgcaaggtgctacagtgtgaatctgaatgtggcaagttcaacactaaagtcctggagtgcaggaaagttatggtagactcagaaatctgttcttcaacatttagactgtatttatgatggctgaattttctgtctagtcacctatggtcctctacctgggcgacagagtgaggctccgtctcaaaaaaaaaaaatagtttagcatgccaaagtaccatcctttggagtatagtgtgctgagccccaacaaaagccatgagattagatatgatcatgaagagagtgcatgagtccatagaaaagaaagaatagctaacccctaggaacctccaccatcaagatgctggagagaaaggggaagaattaatgaagcagactgagaacatgagtccagggacttagaagaaatgatcaggaaagggtggggtgttgtaactcagcacacatccttgacaagactgtctgccttgagggcaccaggcctgatctcaccagacttttcattctgtttctgtcacaagaagatcattctcaggtcagcttcatcaaggagcagggagaaatcaactctgtcaaatgctgctgagcatggaaagttaacactgtcaggggagaaatgtcttactccaagtgcaaaccttccctcatgaccactgctgatggggtggaagagtctgggcaattcattgaagaggtatccaaatttctgggtctaaggaaagacaatcttaccaggaggtgaacaggaagagggtccacatgtgagtcacgttttcatctcagtggagggaataaggcaaaggagagtagggtttctgtgtctcaatgcccggagatattgttctccttttaaccatatcccagacctcagtacttctcacatttgtctccatctctctttgctcctgtaaggacccatctgagcaactcacttcaccacatcatccttcattcatctccatatcactctcttttcttttctttttcttttcttttcttttcttttcttttttttttttttttttttttttttttttttttgagactgagtcttgtcttctcacccaggctggagtgcactgacgtgatctcggctcactgcaacctccacttcccagattcaagcgattctcatgtctcagtctcctgagtagctgggattatagttgccccacatcatgcccagctaatttttgtagagacagggtttcaatatgttggccaggctggtctcgaactcttgacttcgagtgatccacctatctcggcctcccaaagtgctgagattacaggcgtgagccaccatgcctggccgcaaaaagatattttctaacattcagttctatcaatttgtttagtgtgcttaacagatgactctaccattactcttcctcagctggaaagtgaggggtgtggtataaatgtctttaggagtgccttacagctcagactatttagaaatctgatactctggagcataggtatgggtgtatgcctgtgtgtgtgtttgtgtgtgtgagtgtgtgtgtgtgtgtgtgtgtgtgtgtgtaggaaaagatgtaaaggaaatttggttgacatctgtgcatcatctgtctatgtaaatctgattttcctaaatcattattaatttaggcagaaaaaagcataattctctgaaacaaaattattatatacaattacatcattatttttaaactatgcaaaaaaacatgcctataatcgattttattgtagagaagatgtgaggtcttgttatttagaactgttatttaatggagcaagataaaacactagcacaaagactatgtgataatttcaagcccctgagagctagattagaggactaattttgtgttcagtttcatgtagagctataaattaaacaattctaccttgaaaaatattttcacagaagaataaaggatccaaggacagtaggaaaaaaatgaagctcaaggtgaatgatttggctaaattcatcaaattctgtacaaaaaagagactaaatcatgcaggaactatatttttatcatgaaaatgctctaattatttgctaagacagttcctcaaatttagcaccaaattgatggaaaatataatttttatgataatctatttccctttgttctgacttcacaagtaaatgcaagatgttaaaaggtgatttattctatctcagattgggaagggtccctgagaaacagcggtcctatcaaaatgacttgtccacctaagcagcacttggtcaaaaagagataaaaccctgagttctatttcttatgccttcactttgaggagtaaggaaaagaaacaagcatactgtcttattgtaaataccacagagaggatagtgcagtaatggatactacattaacaccttgatgcataagactgatcatccttatcaagatttctttttctttttgcaatgttttatgctacatattttgttatttcatacacacacacacacaaattaccacattaaatttctcctacaaaccaatgtatgtgttgttgttttttacagattataaaacagaggcatagagaggacgaataaccgtgcaacttttttttatttgtttgttttttttaagagacagagtgttgctctgtctcccaggctggagggcaggggaatgatatcagctcactgcagcctctgactcctgggttcaagagatcctcctacctcagcctcctgagtagctgggattacaggtgcaagtcaccatgcctgactaatttttgtgtttttggtagagatggggtttcatcatgttgggcaggctggtttcgaggtactcgcctgaagtgatccctctgtctaggcctcccaaagtgctgggattacaggcttgagccaccacgcttggccctggactactgttatagtaagagtgtcaaatagaaaaagtcagagctggtatctggacaagactatacaaaatctacacctgacatcactgtgacacaaaacttatataataactgcatttacagagacactaacctatataataattcatttcctataagccctgaaatctcagcaaatgcatctatgtgctcaaaatgcaatgaggatgaagagaggttgattaatgagtataaatataagaagtgatataagaaataagacctggggtttgatagaacaggaggatggctatagttaatgataatctactgtacacttcaaaatagcttgaagaccaaaattcgaatgtttctaaagtaaagaaaagtcaaatatttaaggtaatggatatcccaatttccctgatataatctttacacattatatgactgtattaaattatcacatgtaccctgaaaatatgtacctctcttatgtatcaataaaaagaaataaggccaggggcagtggctcatgcctggctgaggtgtgcggatcatcagaggtcaggagttcaagaccagcctggtcaacatggtgaaaccctgtctttactaaaaatacaaaaattagctgggcatggtgacgtgcacctgtaatcccagctactcgggaggctgaggaaggagaattgcttgagcctgggaggtggaggttgcagtgagctgagatctcaccactgcactccagcctgggtgagactccatctcaaagaaaaaaagaaggaaagaaataagaaagaaagaaagaaagaaagaaagaaagaaagaaagaaagaaagaaagaaagaagggagggatggagggagggagggtagggtaggggaggggaggggtgtggagaggagaggagaagagaagagaagagaaatattctaaaaacatgcagtggtacatgaacgcaactttccaatttattcggaaacacactttatttcatctcttctaagacacacctctccataattccatctgagctctatttccatttcttccctttccagagagggagaggactttatagttgaggagaaagaagaaagccttagttctttcctctttcatgccagaaacttgatcaaagatgtcagatctacttattcaatggctttcagaggagacatgcaggaggccccacgcaagaaggaaggcctagggccacctttctgaggttcaagagaccaggaagagctcagtacaccaaatatctttagaacttaggtaagttaaatattacttcatttgctacaatttaattaacctgcaccatattattatggaaatcttgtgttacttttaaaggcaaaaatctcaattacttttgcaccaacctaataaatagtgtgcattgtctttcccatagataaccactgctgcattagggaaatctgtgtgcaggaaggtattgatggtgtggtacctccctgtcagcaggttaagagcaaatattgcaagggtaccctggggctgaagaaattgcaagcattgaacactatatttttgcacataaatgctatgcaaaaaagacattgatcaatgcagtgtactcaacagtggtttttaccataaatgcagaattctttgtctgggacaatattttaaaatgttcatcagtttcccaaaaaaagacttaatactgggacataattccaactattcctctcagtggaagtgtggatcaggtctgaaaatgtgtcattaaattaggctgcaagacaacttatactaataaaataaagagcccaggtgtgttaaagacaaaatcgtgggggccgaataggaacagctccggtctgcagctcccagcgtaagcgacacagaagatgggcgatttctgcattaccatctgaggtaccgggttcatctcactagggagtgccagacagtggggacaggacagtgggtgcagtgcccagtgcgcaagccgaagcaaggcgatgcattgcctcactagggaagtgcaaggggtcagggagttccctttcctggtcaaggaaaggggtgacagacggcacctggaaaatcgggtcactcccacccaaatactgtgcttttccgaagggcttaggaaatggcgcaccaggagattatatcctgcacacggctcggagggtcctacgtgcccacagagtctcgatgattgctagcacagcagtctgagatcaaactgcaaggcagcagcgaggctggggcactggcgcccgccattgcccaggcttgcttaggtaaacaaagcagccaggaagctcgaactgggtggagcccaccacaggtcaaggaggcctgcctgcctctgtaggctccacctctgggggcaaggcacagacaaacaaaaagacagcggtaacctctgcagacttaaatgtccccgtctgacagctttgaagagagcagtggttctcccagcacacagctggagatctgagaacgggcagactgcctcctcaagtgggtccctgactcctgacccctgagcagcctaactgggaggcaccccccagtaggggcagactgacacctcacatggccgggtactcctctgagacaaaacttccagaggaatgatcatacagcagcattcgcggttcatgaaaatctgctgttctgcagacaccactgctgatacccaggaaaacagggtctggaggggacctctagcaaactccaacagacctgcagctgagggtcctgtctgttagaaggaaaactaacaaacagaaaggacatccacaccaaaaacccatctgtacgtcaccattatcaaagaccaaaagtagataaaacgaaaaagatggggaaaaaacagagcagaaaaactggaaactctaaaaagcagagcgcctctcctcctccaaaggaatgcagttcctcaccagcaatggaacaaagctggacggagaatgacattgacgagttgagagaagaagtcttcagatgatcaaactactccgagctacaggaggaaatacaaaccaaaggcaaagaagttgaaaactttgaaaaaaatttagatgaatgtatagctagaataaccaatacagagaagtgcttaaaggagctgatggagctgaaagccaaggctcgagaactacgtgaagaatgcagaagcctcaggagccgaagcaatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacgtctgattggtgtatctgaaagtgacggggagaatgcaaccaagttggaaaacactctgcaggatattatccaggagaacttccccaatctagcaaggcaggccaacattcagattcaggaaatacagagaacaccacaaagatactgctcgagaagagcaactccaagacacataattgtcagattcaccaaagttgaaatgaaggaaaaaatgttaagggcagctagagagaaaggtcgggttacccacaaagggaagcccatcagactaacagcggatctctcagcagaaactctacaagccagaagagagtgggggccaatattcaacattcttaaagaaaaaaattttcaacccagaatttcatatccagccaaactaaacttcataagtgaaggagaaataaaatactttacggacaagtaaatgctgagagattttgtcaccaccagacctgccctaaatgagctcctgaaggaagcactaaacatggaaaggcacaaccggtaccagccactgcaaaatcatgccaaaatgtaaagaccatcgagactaggaagaaactacatcaactaatgagcaaaattaccagctaacatcataatgacaggatcaaattcacacataacaatattaactttaaatgtcaatggactaaatgctccaattaaaagatgcagactggcaaattggataaagagtcaagacccatcagtgtgctgtattcaggaaacccatctcatgtgcacacacacacataagctcaaaataaaaggatggaggaagatctaccaagccaacggaaaacaaaaaaaggaaggggttgcaatcctagtctctgataaaacagactttaaaccaacaaagatcaaaagagacaaagaaggccattacataatgggaaaaggatcaattcaacaagaagagctaactatcctaaatatatatgcacccaatacaggagcacccagattcataaagcaagtcctgagtgacctacaaagagacttagactcccacacaataataatgggagactttaacacaccactgtcaacactagacagatcaacgagacagaaagttaacaatgatacccaggaattgaactcagctctgcaccaagtggacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactgtctctcagaccacagtgcaatcaaactagaactcaggattcagaaattcactcaaaactgctcaactacatggaaactgaacaacctgctcctgaatgactactgggtacataacgaaatgaaggcagaaataaagatgttctttgaaaccaatgagaacaaagacacaacacaccagaatctctgggacacattcaaagcagtgtgtagagggaaattgatagcactaaatgcccacaagaaaaagcaggaaagatccaaaattgacaccctaacatcacaattaaaagaactagaaaagcaagagcaaacacattcaaaagctagcagaaggcaagaaataactaaaatcagcagaattgaaggaaattctgacagaaaaaacccttcaaaaaattaatgaatccaggagctggttttttgaaaggatcaacaaaatagatagaccactagcaagactaataaagaaaaaaaaaagagaatcaaatagacgcaataaaaaatgataaaggggatatcaccaccaatcccacagaaatacaaactaccatcagagaatactacaaacacctctacgcaaataaactagaaaatctagaagaaatggataaattcctcgacacatacactctcccaagactaaaccaggaaaaagttgaatctctgaatagaccaataacaggttctgaaattgtggcaataatcaatagcttaccaaccaaaaagagtccaggaccagatggattcacagccgaattctaccagaggtacaaggaggaactggtacaattccttctgaaactattccaatcaacagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagaaccaaagacaaaaaccacatgattatctcaatagatgcagaaaaggcctttgacaaaattcaacaacacttcatgctaaaaattctcaataaattaggtattgatgggacgtatctcaaaataataagagctatctatgacaaacccacagccaatatcatactgaatgggcaaagactggaagcattccctttgaacactggcacaagacagggatgccctctctcaccactcctattcaacatattgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaactgctgctcaatgaaacaaaagaggatacaaagaaatggaagaacattccatgctcatgggtaggaagaatcaatatcgtgaaaatggccatactgcccaaggtaatttatacattcaatgccatcctcatcaagctgccaatgactttcttcacagaattggaaaaaaatactttaaagttcatatggaaccaaaaaagagcccgcatcgccaagtcaatcctaagccaaaggaacaaagctggaggcatcatgctacttgacttcaaactatactacaaggctacagtaacaaaaacagcatggtactggtaccaaaagagagatatagatcaatggaacagaacagagccctcagaaataacaccgcatatctacaactatctgatctttgacaaacctgagaaaaacaagcaacggggaaaggattccctatttaataaatggtgttgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggtcttcatgtctaaaacaccaaaagcaatggcaacaaaagccaaaattgacaaatgggatctaattaaactcaagagcttctgcacagcaaaagaaactaccatcagagtcaacaggcaacctacaaaatgggagaaaattttcgcaacctactcatctgacaaagggctaatatccagaatctacaatgaactcagacaaatttgcaagagagaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccacttagaatggcaatcattaaaaagtcaggaaacaacaggtgctggagaggatgtggagaaataggaacacttttacactgttggtgggactgttaactagttcaacccttgtggaagtcagggtggcgattcctcagggatctagaactagaaataccatttgacccagccatcccattactgggtatatacccaaaggactataaatcatgctgctataaagacacatgcacatgtatgtttattgtggcactattcacaataacaaagacttggaaccaacccaaatatccaacaatgatagactggattaagaaaacgtggcacatatacaccatggaatactatgcagccataaaaaatgatgagttcatgtcctttgtaggaacatggatgaaattggaaatcatcattctcagtaaactatcgcaaggacaaaaaaccaaacaccgcatgttctcactcatagatggaactgaacaatgagaacacatggacacaggaaggggaacatcacactctggggactgttgtggggtggggggatgggggagggatagcattaggagatatacctaatgctaaatgacgagttaatgggtgcagcacaccagcatggcacatgtatacataagtaactaacctgcacattgtgcacatgtaccctaaaacttaaagtataataataattttttaaaaaaagacaaacgatcatgctgaagttacagagaattttgtttaatgttggcttacactttatttctgcttcatataaaacatcttctcccaaaggtcataaatatcaaagtagatcatgtgtactagttctgcagataaatgaaggtagttagaaatgtacacaggaaatctatacaagggagaatcagaaaaatcttatgagcatgttctgaatacaattttagtgatcaggagcagtgtctcacacctgtaatcccatcactttgggaggccaagtggggcagatcacctgaggtcaggagtttgagaccagcctcgccaacatagtgaaaccacatctctactaacaatctgaaaattagccggatgttgtggcagatgcctgtaatcccagctactcaggatgctgaggcaggagaatcacttgaactcgggaggcagaggtggcagtgagccgagatcgtgccactgtactccagcctgggccacaagagcaagactccatatcaaagacaaacaaacaaataaaaaaaactcgcacaattttaaaggatgaatatggttgcaaattgggcaggttatggtctgagttatttcttaagacactgcaacaagtctgacgcgtcataatcacagatttctccagaagccaggaaggtgtcattactgaacagacaggatgtaagtcaggaggcagagatggagtcagagaacagccctgagctagagccccttccacagaggcagctttacccagctctaattgataccacacagcaacggagacacagtgcaccaaccaacatcatgtgatttttaaagataagacagtaatgaaaacttttagtgaactattccaatgtcaaactttatcttccaaaccaaacattataaataacactgtatatgctgaaaagaagcactgtttagccgagtacctgccctggggctgcagtctatgtcttttgcctcacactatagacacttgagtgcaagtctttctacccagtgtgcctgtcagcatcacagaggggatactctacgtatcattcacctttacattctcatcacctgcaaaaatgatctccacacaatatacatgaaaaaagaatttgcttcatgataaagctgctaatgaatgtcggccagaagaggacttcaaggcagagtactgttagctgtgcattgaatcctcacctgatgaccattgtgtccacatttacctaaggactccagtgataaaattattgcatttgtaaatgacaggaaaattggatggtatatgatatcatttaaaggtctgatttccatttactaatctagaagctagaccagagatttaacatctttttgtacctaggtcttacccctgcaattcactttccacctctgtacaattttcccacatcatcccctgtgcccagaatgctcatctcttccctaaagtccctgaaaaccacctgctttgcctttaggaccctgctgaaatgaaactttttttttttgaagtcttccttgtccctcaagcgaagtgatttccttcaccctcggcgtccccatgaaaccatgttcacacaaatgctattatctctatcatactgtaatacaattatgtgactacaattactttcctgtatatctctgaggtccaagaataagtctatgcttggtgtatgaaattgtacagttgacttctatactttcaggaatacagtgctctgtccttaaatgttcatttgtaaatacagaaccattttcttgttgatatcacaagatgaaacctaccaggaagatgaatgacaaccccagaacacactgttttgtagaaaataccataggctgaaaagatcacaggaataccgagtgctaggttggaatctttcatgacaccaaatgttcattcattctctgccagattttacaactgtcctcggtgtgtttttaggttgtgtaactttacacaaagtggaagcaataatcagggcaagacttaagagaaagtggatccaatgcaagaggagtaaagaaaaaaatccctcaaatgtatggagcagattgttttaattatctacagaatcttgtgccccaagaaattaatagctcaagtttccagcaagagtggtggatgagatggagagcatttatgtgagagagaaccaaggatattactaaaaatggaagggaagctgggttcctcctgggaaaacagatctctgtggctctatttgttctaactactatgcctgccttcatgtactttggtcatttaggggcctgccagaggacagttataaaatctgtggtcattctgccggcagcatatagttttcatccagagtccagatcccaccggcaaaactctgtctaacacaggatgacttggaattagagtccgtatagcagaaagagcagcagggctgtccttgggtatccgttgctcagccaagtcatcaaataaaaaggatgattgcgcaagtggaccatgtgtcaatctgtgggtttctgcatggccaagagccagaccctccctcctggctctgctggcccaacccaccaagggatgctttatttaaatagttccaagtaggggagaccagctgcccctgaaccccagaacaaccagctggatcaattctcataggagccacagcgcggagactgtgtaagtcaacaatccccagagttgggacaggaggggcagcgacagggcagcaactgagggagaagggagctgacgttagtgcttaggagatgtggcacactttggggacaggaaggaacaggaaatgggacccaagagtggcagcagattggcctgtggggtgagacactatggtgtgtgtcacaaccgagacagaatcggggagtagttacttctcttcttttctcacaggaaacatggttccaaaactgttcacttcccaaatttgtctgcttcttctgttggggcttctggctgtggagggctcactccatgtcaaacctccacagtttacctgggctcaggggtttgacgtccatcagtaggaaccagctccaatgcaccaatgcaatgcgggtaattaacaattatcaacggcgatggaaaaaccaaaatacttttcttcttgcaacttttgctaatgtagttaatgtttgtggtaacccaactataacctgccctcataacagaactctcaacaattgtcatcatagtggagtccaggtgcctttaatgtactgtaacctcacaactccaagtccacagaatatttcaaactgcaggtatgcgcagacaccagcaaacatgttctatatagttgcatgtgacaacagggatcaacgacgggaccctccacagtatccagtggttccagttcacctggataccatcatctaagctcctgtatcagcactcctcgtcatcactcatctgccaagctcctcaatcatagccaagatcccatccctccatgtactctgggtgtcagcatctgtcctcttcagtctctataccccttccacttgcctgagctgaagtgccttgtgaagcctgcaataaactgctttgcaaattcatctggaagtgtctgtgtgtcttcgtcggccactctgctgtcattgagtgacaatctactctagatatttttccttcctccaacccgagacttgtgggaaatggagagatttgaggataagagactctttctgtcatgaagcagcacagacttatccctctccctgctttaggctgagaagccgaggtctcaactgatacctaccaactgttgaagactcttcccttgaccaaatttagtcatctcccctggcctcttcacaagtaggtcattctgttgggtttcctagtccttccttgtagagtcaggtttgtatttatatttacatttatatttatatttatatttatatttattcattttttgagagagagtctcgctctatcacccaggctggagtgcagtggcacaatctcggctcattgcaaactgtgcctcccaggttcaagcgattctcctgcctcagcttcctcagtagctggggttacagtcatgcaccaccatgcctggccaatttttgcaatgttagtagagatggggtttcaccatgttggccaggctagtcttgaactcctgacctcaggcaatccgcctgcctcagcctcccaaagtgctaggattataggcgtgagccaccagtgcccaacctagggtcaggtttaacagaagtcttcctaacctggtttatcattaatattcaccctcaatatctgaccaaattccttaattcccccatcatcctccttgtgatacctgattcctggcctgccttcaaaaaaaaagaaaatccagttgagtcgacttagcattggtctccctagcctcgatggttcttctaggtaattttgcatccagtgacccctccccccacaccaacttataacttcagtatacctctccacttgttttagctgtattccagaattttgctcaatttggtgctgaggtcccatttgacactttatggtctaagtctggtttttattgacatgatttctatcctaagagatatagaggctgcagggaataaggtgaaaatgtacatgtttgattatgatttatgaatgataaattttgatagaattgaacattgagatagaaaacacacaaaaaaagaaagtagaaaaagccaagaatgctataaatatggtgaaaccaagataaaaagtttagcctcagacctatttcctttaaatgggcacatcaaatctccagctattagcaatcgtactagaggtggatccacggtttgagtcaaatatggaatgagataaattgttcagacagcaatatggacagattgtaataaatattgcctgaaggagaggtgcgcatcattcccaaaacttccatgtcctggagatagggagtagctggtcacctgggaaggggaaggggaacgagggagactggggagtgggatcactcatgaaggtgaattggctcctgcccgttctgccctccacagttgtccccaaaggtgagtcaaagggttcattcaacacctgtcaggtagggcacagcctcaagaattagggatttgtagacccagagagagaagaaatggataatgagagcccttgccctggactccattacagggcttcactcaggaatccatgagaaacaggaaggggaagccctttcttgcaagctgtggacaggtgcagcattcaagtgattgtgccggggacagagtgggtctttttgaatggcctgactcttggccatacaacagagatacaatgccatcagatctgcaccttggtccttcagtctgagagttctgacttctatatttctgctcctcttccagaccctcagaaatagcaatttccattcctcagatgactccatgtcagtaatagtagctctcattggcatcagacagcagcagtattgaagtctctcctctggagaagctattgagatcttgcttctccaagggtgtggcagggctgtgaactttaaagtttgcacagggacacagatttcacgaaatcctggtgctcaatagaatccactgactctaggtaaaatagggcatattaggaagtgagtgcagtcttcccacaacctccaagtagcagaaggagaaggtgggactctgaaagctggagccacgtttcctgtgaagagagatggaatggaccttcctcacttcaggtaccagatcacaggtgtcttctcagtcagggatgccccgtctctaaaaccataggatagagggatcagtccccacctgcccccatgccctctccaccttgtgacttcatctcctctcctgtcattcatccttcactcattcattcatccagcagacatctactgagtagataccttgctccaggcacagtttgagggagtgatgacgcaacgcaaaccaagacaggtcactgctcttttggggccacattatacaaggataaaaataaacatacaaaattgttctaagcatacaaaattttgctaagtgtcaggaggaaaaatacacagcctagtaagcagaaaactacacagagcgacacaatatagaggttctgtatgtgcctcagaagtgacagagcaaagtgtgaccaggaaagacccatttcagagaatgaaatctaaacaggaggaaaagcagccagtcatacagacaccagatggaaaatcatcccagcaaagagaaggagacttcaaaattcctcacaaatatcaaggctataagtagacttcagttcagtgcttacaataagttaattaaaacatctgcaagaaaatgactacaactatttgcatctttgtatgtatttattccttaatgtaataaaacattttcatttttaaaaaatggtcctgaatgaatagaggtttggcatgttagaagcacaaaagttgtttggtcaggacaagatcatcatagccatgagtattaatgataggagttaatgaggttcagacccttcatgcttgtgaagatagaagaataaagtaagttcctcatggggcacaaattgagcatgttacatgcaagaataacgttgcctaaagatctgtccagcctctgtgcagaacacaactatttaggagacaagagtggaagcaaggtcccagtgaaggaccacaggttgaggcagagggaaacaagagtcttccaatctcagtgaatctcaccatcatcctctcatgctgcagccccatgctattcccctccctgttgccatggcctctctccagcccctccatgccttccacatcatcttcctgccatccccatgctgatgactgggctgaggtcagaggcagctcccctctcccaggacgtgagacgattcaaacaagaccaaggaggattctgtgcttgaccatcaggaaaccctggctggactcactgccccttctgcagtagacatccaagattttctgattgccctggacccaaggccagcaccacagagactaccattagagaagttaagtagtcacgtcagcatgttccaaagacgtgatccttggattccacttcttttccttgaacctcccatgtctgattttataaaattctcttcatatcaaatcttcaggaagtcttgcaggagtaaatgcagttaattgttctataagcaggcagggagggtctccagggattataagaatttaaccaacttgagcaatcagcctgttttacaagcttgctggtgggaaccagctcctggcataacccagcaacttacagacaaattaggatgaacattcctcattaccatgctaaagtctccacccaaggaggagctatagcctcattaccatgacatgtgaactatgtgctggcagaatcactcactgtgtatgggcaactgggactcctcctctacaagtgatgatacaccctctgccctctccatcaccacatagaatgttcttctcactttccatcaggaagacactgctttggagaatactcccagtggccttcttacttgaaccaagtaacaaaacttttatttatcaaaatgtacgttctcatagagagtctttgttactcaccagggaaacaagccctagttttttcagctaccagctctaacacattctgtaaagtccagcacagaaggaaggttaattcacaatgctattgctttcactttttaataattgggaacatatcagggcagatgtctttatgtagggttaaatggaaggtcaaggaggcaaatcatcaaccttggggagacacacttgcagagattatgactacacttgggattcaagaatatgagaccccaccagcagagtagcctgcaatgttcaaggatatccaagtagatcaagtattttaatgaaaaaacaacaggctttgtctttcaagatgtccatgaattgactttccagaagagaaggaagaagacctcattgtcagggcagaagagagaagaggagagggatctaggctaaatattgtaatcgattttgcctgatattgactttttgtttgtttcttagttcattttattttattttattttatttttttgccaagactggagtgcagtggtgcagttttggctcactgcagcctctgcctcccaggttcaagcgattctcctgcctcaacctccagagcaatttttgtattactagtagagacagggtttcgccatgttggccaggttggtctacaaactcctgacctcaggtgatccgcccacctcagcctcccaaagggctagtattatagacatgagccatcgcgcccagcctcttagttcatttttagagatgaagtctccctatgttgctcaggctggacttgaagttctagactaaagcaatgctctcgccttagtcttgccagttgttgagactataaatacacaccactgagcacagctgatactcacattttatgagctgtttccactccaattacataagggagtgaggcaattagtaaggataggagcatagaaactctgtctacatctctatttcaaattacctctgaaaaacagccttgtttttaaactaaaacttgattttggttaataaatgtttgtcttaaaatgcacttagaattatgacagagttgtcacttttgtctcagttctgacctatagtgatttcaaaagaagatcagtagactacttcaaaattctcattattcaaagttattttggatgtaaaattggctgatgtgagataatttagaatatagggccagccaggttacccaaatgaatatctgggaaactgagcacattacatgcttatcacacatccccactgagttagaaaatatgactgtattagtcaggatcatcaagagaaacataaaagatttaggtagacacagatagatagaaatatagatacagaaggatttatcatgagaaactcgctcacgcaattatggagtctgtgaagttccataatctgccctctgcaagctggcagacccaggaaagctggtgggataatttggttcgagtcccgatgcccaaaaaccatggaagctgatgatgtaaatgtcaacccaactacaggaagatgacataagatgtcctagcttaagaagtgaggcaagaaaaagtgatgaattccgcctttctctacttttcaatctattctggccgtcaacagattggatgagccccatccacactggaaatgcaacctactttacttaatcaaccaattcaactgctagtcttacagaaataccctcagagacacagccagaaataatgttaatctgggcacccacaggcccaggcaacttgaaatataaaactcaacatcatgatgacctatggtttcccaggtgcaccagaagatgttaccaaaatggcaccatcagccagaacccacatacattcaccaggtcagtgcatctctcagttcaccagagattcattttctttgtgacatcacgttcacctggagtgcagccaagaatcaggccacagctaataatgagaaaggaaggattcttcatttgcctttttacaaatgacagaaaaatttgccaaaatcctttggtaataagtagttatctcaaagacaaagagactcaaaatgaaaatgaaaaaaagtcagttacccttcccactgcccatgttcttcctccacatataaaaataggtattaagttcaccctttctggtgttaaagattttagtctaacccaatacctgtgaatctcagtgcacagatattaccagatttttcattacacagaaaatgacagagacattctcccactacagttgctattttgtggtgacaacttttactttcccacgattctttcgttaagtgacacacacgtgcaactggaaggatttactgttttcacccacagctcccacacttcacagctatgcaggagcttcagtacagcagatcctagcaccctggatagtacaagcgtgacttcttaaccacaatgcaatagcaaatatatggggttcagtgtcggtctttcattcagaatatactgttcagaattgtttaaaatagtaaatttagaaacaaataatatatcctgcagaactggttaaaataggattgtatatctttacaagggaattttatgcagtattttttaatgcaaaaaaagtacggttaatctcttcctactggcatggaatattaccgaaatatattgttaatgagaaagaagaatggtgtaggccactgtaagaatctacccaggctgctataacaaaataccacaaatgagtattccaaaacaacagaaatttctttctcccagttgaggaaacatcagctcttctcctccatactcacactcacacttctggccaccaaatgtgggagggtgctttcttgcagcaaccgattccagctgggtatcctaaaattcaattggattgtgacactaactggagtgaatgcagaccccacaggttaagggcttggtcccacaagactgtcagtctcaagtagcagatcattatctgtgcttttgaccaatgaactatagtttggaggatcccgtgacttcctcctcagtttgatcatttgctagaatggctcacagagcccagggaaacactttacttaggtttatacatctatcattaaggatatactaaaggtacagacagggagataatggggcaaggcttggaagggtcctaagtgcaggatcttctatccctgtggaattggggtgtgccaccctcccagcacagggatatgttcttgtgtactgtattcatttgttctcacactgctataaagaactacctgacgctgggtacggtggctcatgcctgtaatcccagcacttcgggagaccaacgtgggcagatcctaaggtcaggagtttgagcccagccttgccaacatggtgaaaccctgactctactaaaaatacaaaattagctgggtgtggtggcacaggcctgtaatcccagttacttaggaggctgagggaggagaatcacttgaagccgggaggcggagtttgcagtgagcctataacatgccatttctctccagcctgggcaaaaagagtgaaactccatctcaaaataaaacaaaacaaaacaaaacaaaaaaaactacctgagactggataattgatgaagaaagaagtttaattgactcgcagttctgcagtctgcacaggaagcatggctgaggggagctcaggaaacttacaatcatcgcagagggtgaagggaaagcaagcacatcttcacatagcagcaggaaagagtgaagggggaagtgctatacacttttaaataaccggatctcgtaagaacttactcactatcacgagaacagcaagggggaaatccgcccccatgatccaattacctcccaccaggtacctcccccaacattagtaattacaatttgacatgagatttgggtggggacacagagccaaaccatatcattcaccaaatccagaaacttaccaaagtctctctctctcctcttggggtttatggaggtgtcactacgttggcatgactgatgaaattattcgccactgctgatcaactcaaccttcaatcccccttccagggggttagctggggtagcaatggatgttttaaccctctaatcacttgctcagctctgctagcaaccagacccctcctgagactacacaggtgccactcgtctcattaatgtacttcattagacacttattcagaaattttaagagttttaggggctctgagtcaggaaacaggcaggaacattaaatatatgctatatatttttttagagatgggatttcactcggtcacccaggccggagtgcagtggtgccatcatagctcactgtacccccacctccggggttcaaggcatccttctgcctcagtcttccaagtagctgggaatataggctgtagccaccatgcccagaagttgcatttctcattataaatcacaatatcacaatcacagctctggacactgggaagttcaagatgaaggatctggcaggttcagtttgcagtgaggtctcccttcctggcttgctgacagttgttcccccaccactgtgtcctcagatagtggaggaagaagtaagctctctggtgtgtctcttgtttttttgtttgtttgttttttgttttttgttttgttttgtagagatggcatcttgctatattgctgtattaggctgttctttcattgctatgaaataattcctgagattgggtaacttataaagaaaagaagtttaattggctcatggttctgtacgatgctcaggaagtatagccctggtatcagcttctaggaaggcctcaggaagcttataatcgtggcagaagatgaagcgggaacaggcacttcacatggggaaagcaagagcaagagagagttggaagtcgtagggggaggtatcacaacttttaaatgaccagtctcagaagaactcactcattttctccaggacagcaccaaggatttggtgctaaaccattcatgagaagtttgcccctgtattagttctttctcacattgttacaaagaaacacctgaaaccgggtaatttataaagaaaggaggttaatctagctctcagttctgcaggctttacagaaagcatagcagttcctgcttctggggaggcctcaggaagcttccaatcatggtggaaggcacagggggaacaggggtctgacatggcaggtgctggggcaagagggcaagggggaatgtaccacaatttgaacaaccagatctcacgagaactcactcactatcaggagaacagcaccaagggaatggcgctgattcacgagaaatccagccccaagatccaatcacttcccaccaagcctgcctccaacactggggattatattccaatatcacatatggatggggcaaatatccaaactgtcccagttgcccacaatgatcttgagctcttggcctcaagcgatcttcctgcctcaggtgcccaaagtgctgggataacaagtgagagtcaccaacccagctggtggtgtctctttttataaggatactaatcctcttgaatcaaggctccacctttatgatgtcatttaacattaagtttatccttataggctctccctccaaatacagtgagactgggggttaggactacaatatatgaatttttaagggacataattcagtccacagcaaacactattattttagtttttaaatagagcatgttactgaggggggacatagaggaattatacgaagaaatctgtataaatgaggaaaagtgagtatgcttatatgtactaccacatatatgcttagattcagtatatatattatagaaagagtactaaaaaactgaataattattcttcctggaatacaaacctagcctcgataaacaaaggtaaatgaagacatctttttcactagatacccttttttaataattgagtttacattttcaccatatgaatgtatatgcattctacatatgcatatgcacttatgtgcatatatctatattcgtaaagatgcatatatttgttaaccacagactccctactattacaacattcaaacaaaggagaagcaatcaagtaaaactaaaagaaccataataaggcagcactggatgacctggaaggctgagggtccctgagcccaacacccatcaccctacagctgggaatcagacagtgatggagctatccctcactccatctcctgctctcttccttctccagtccagccacctggtcacagagtgaggctctaaactggcccgtattacatgtgtctgtccctccccttctcacctcggaggaagagtgtgactatcccaagtcagcaggtagagtaagacagagcgtgagacctgctagctgaggagctctaagaaccttgtgctttgaaagccgatctgctttgtggtattgaaatcctctgagtccattacctctttattacaggaaaggtgtgtgaaagacccaggacgtgtcactacaggacaaaagatctggatgttcaaccacaatcaaagctcttgagatccagcaatttccttgaacaatttttctaccacacacacttctcaaaatatagtgcatacccatatttaggattgtggtagagggccattacatgatcttgactgtatcaataaaagtctcagggcaaatctctgggggattcagtgcagatggcctgccagttggatgtggaatctgagcaaattatccttatattctgctactcatctccaaataacaggcttgcatcaaacggccatctatctcagacactttgcaatctatgagtctgcaataaagaatgaatgtgtctgtgtgtgtgtgtgtgtgtgtgtgtgtgtgtgtgtgtgtgttttaaagaggcatatatgtggttcacttggtttatgtatgtgagttacttgattgcttatatgggaatattctgaatacttgattaattgaataaacgaaatataattacatcatgtacaaaacttttcatagtttcatctgcttgatcattattcctgtaagactccatagtaatatctaattgtatttttagtgaggaagctattttggcctgaccttcaaaactgtctttgcatttggtaggacaaaagactagcaaaaaaaagcctgaggggttattttaagtattcttatgaattagtgttcctcagactgtctgggttagctgacttgtgaaaaaactaaagggacaggatactcagtaagtatgaatgtaacagttcactcctcagtatttctggaacaggaaggatttttcctcatgcccccaactgcctctagccaaacagaaaagcaagaggacaaaattctttaaatcttaaaaggaagctatgggtaagcagtgacatatagaaactagcacataggtcatcaattttgtatcactgggatactcataatcaatccctaatgactaatgaccaattttcgataataataaactatataatcaaatattatacacaaattcattgatagtgttttctgccagcctgtaagtgccacacctgaaaaaacttcaaactttagtgtagtttccatttggatcacctgggggaagttttgcactatggatccgtgggctccattccggatatactcatacagaacgtctgcacatggagctcaggattctgcattttcaagcatttcctcaagtggttctgaaacaacctgtctccagcccaactttgagatccattttttaccaaactctggcttcagaagccttcatgtacatcggaagtaatctcagtgtggggaaattccaaagcacaggaagcgatgataccatttgcattattacccagatgattctagctacatacacctattatccagcatttatgtcttgatatgaggcttctattcagttgaccctattgatatccaagtgtacacaactgacctgtcaggctatagcaacacttcacttatatgtagggagaatttgtgcagggcttagctgaagctcatcatggggtatgaattgacttggtcttattgctataacccttgggttcagaagacactgaacaaatgcttaagaaactgttttaggttaatgaatggggatatatttaactcctcagatagccaaagaatcaagaagaagggattgagctggatggcccaatagaagtgtccattgattgcacccccacacataccagcagaaacaccacatttaacaacaactatctacacacaaaaaagcacctacataggaaatgaaaatcaagtcaacaatcatagtacctattttaacttcatatcactgaaagaggcactgaagaggttaggaaagacaattttgaatcactgaggccaccactcccccatctcccaacagccaccacatggagctgagacagaatctgagtgcatgggggagggagagtttagcaattgtggaaatctgcattgaactcagtgctgccctgtcacagcccatccacagaaggagcatttagaccaccttagccaaaggggaattgcctatcccagcggtcagacactgagtttgggaaagctttgccacagtaggctaaagtgctctggggtcctaaatatatttgaaactcaatctaggccacaagaactacaactacaaggcaagtcccagtgctgtgctgagctcagagccagtggacctagacaccactagtgtgacacttgtcagggcagctaagggagtgcttgcacaaccgctcccccaaccccaggcagcacagctcacagcaatgaaagtgactccttccttctgcttgaggaaaggagaggaaagagtaactaggactttgtcttacatcgtaaagatcagctcagccacaataggatagggcaccagtcagagtcatgaagccaccatttcaggcactcgctcctgaaggacatttctagacacaccctgcaccagaagaaaacccactgcctagaaggaaaggacctagtccttccaggattcatcacctgctgactgaagaaccctcaggccctaaataaccagcagcaatacccagtagcacactccatgggccttaggtgagactctgagatatgctggcttcaggtgagacccaccatacttacagctggggcagtcatgaagggacaattcttctgcttgagaaaagcagagggaaaagtaaaggggactctgtcttgcagcttagatagcagctcagctacagcggggtagagcaccaagccggctcttggatccccaattccagatcttggctcttggctggcatttctggacctgccctgggtcagaggggaatccacttccctgaagggtgagtcccaggccaggcagcattcaccacaagctgactgcagagctccggggccttaagggaacattggcagtagcctggcagtattcctcttgagcctgtgttggaggtagcagtggggagaggctcctctgcccatggaaaggtgaaggaagactggaaggactccatctcatggcttgagtgcaagctcagccacagtaaaacagaacaccacgtaaacttcccaggttttttactttggtccctggctctcagacagaacctctggacatgcctgggcctagaggacctcatgaccctgaagggaaggacacagcctggctggtattgccacctgctctaggaccttgtagagctttagggcctgaggcccttacttccaagaaaggaataactcttttctagtgagctgaactgtaaagctcataacacaagtaggtcctcagtgcatattcacttcctttccttcttacctgaggtgctgcagtgtgaatctgaaggtggcaggttcaacactaaagtgacggactgcaagaaagttatggtagactcagaaatctgttcttcaacatttagactgtatttatgctggctggattttctgtttattcacctattattctctacccctgtcagcaaccaagaaactcgcagcccatctcacgctgtcttaaagggaaccaagaagttttggactcttggcctgcaggaagcatgcagcgcggcgccccctgccggccaatacaacggccacgggaactggcagaccactgaggctctgggcggggcggagttgccccttctcctcccacttctctagcagcggcttcttctggtgacaccccgggagccacagggatttggttccctaaaggaagcggtttcccaccagggtatcgtccctaataccctccgaaggagtccattgaggagaaaggaacagaacgtctggcagaatgcagaaggaccctatgatccaggacatgtagcgccagccatcaggaggttttatgagagcagctggtgggaagatcagtcccaggagaaggggtttgtctagcagcttggttggagcaagccttttccagagaattatttccgtaattcaggctccctcccaaccctccactgccaccttatcctccaccaaaagccctgacactgtggcagggataggggacgtggggttggtggggaacaggctgtaagaaagacgcgggagcctatatgtgtctgggaaaaatgaggggtccacgtgcaagggaagaagcatttacaaagaagactttgacagtgctgcaaagatttgaaggcgcagggtgcaagtcattcaggtgccggtgtcaggaggaacctagccatccaggtgaacagatgcccccttcttgcagcccactcgcatgggcctggtggactccttcttatttttggtagtggcagtgaagaggtcgggtccctgcgctggcaaagcagtcagtgacattgacatcatgagtactgttgcggcagctgcacatggaggggctgttggtacagggcagtggtggagttctgcagaaatctgctatggtggtcagattctatgaatgaatgtgtggatctgctcgcatttacccctatagatcagccaactgcgcctcatcatcacatcacagtatcggtggtgtcctctagggacccacgacctggggttgtctatatgtcgtgttaagaagggcagggctggagtgaagacagttaggtccaaaaggaggaagaggaggagggtccatatcagattcatgtttcttgtgaaagcatttcaaagaagagcagagtcaaaagagcaagccatggtcccttgtcctgttcctaagaagtcttggcccaacacttagtgttcgcagttctcccctcctgccatttctacacttattcttcgtgtactcatggcaacaagtgttctcacatccttcttccacctccttgtcaataacggagatggctaccaccctctcaaccctttatgggattatcctatgtacaaggttatttccaaaccccaaagtgattcttgctccttacctaagcagaccagttaaactaaaaactttcatctctgaggtgtttgcatctatcagttcaactgccactcacccatagccttgagatgaggcaggcatgattgccaacccctttttagagtgacttaactcagaagggaattgacagattcatatgacctgcatcttagaaaatattttcacttccttaaatacaaatgtctgtttaaacgctgtttttaaaaatgagagcatttcaattttaagggagtagagtttatgtttcccccacatatttctctgcctcaaaataaagattcccaactcttccatgtatagagcctatcttccagaaatgttctaattcttggtgctcagggattctgggtgactgtgtgtgagccttctgtctctagctctaatatctgactctttttttaaatacctgggagttccaggaaagggttttctgcagagcagatgacatccacagagatggatatttttctctcagaggttgatactcctagtagaaatggaatccccgttgcctctctccttcctctaatcttgtagaaatttcattgtggatattttcttcccagaggttagggtgcaggccgtatggaaaactctcaggcctgtcaatgattttaaacagattcccaggtaatgctaattttatgcttactatttcacacctgaaatattcaccagcatcacacagagtgcctatgacatcactgcaaatatgcagaaacttggggtttagtgtctatcataagcttgctactggagcttggcaaatcaccttatccttctactcctcatcactaaagtgaagattatagacaaaagatctctttcagctctgacattctgtatttttctatacattactgtgtgtttgggttcatgtgtgattttgtatatatgcatattggtttatacatgttcaggttaggagaaatacttagtttgcaaattgagtttccatttcagaattgttaatttaattaagtgtagtttttccttaaagcagttattagcaaggtcaaaaaaattgaatcactattatgtaaagattacagcataatctgtttttgtctccaccattaaagttatacgggttttttggtgtttgtttatttgtttttgagactgagtctggctctgtcactcaggctgaaatccagtggcgcaatcttgactcactggaacctccgcctcccaggttcaagcagttctctgcctcagcctcccgagtagctgggattacaggcatgggccaccatgcctagctaatttttgtatttttagtagagtaggggtttcaccatctttcccaggctggtcttgaactcctgacctcatgatccaccagcctcggcttcccaaagtgctaggattacaagcatgagccaccgtgcccagccatattcatttatttatatttatttttatgtatttatttattttgagatggactttcactcttgttgcccaggctggagtgcaataatgctatctcggctcaccaccacctccgcctcccgggttcaagggattctcctgccgcaccctcccaagtagctgggattacaggcgtgtgccaccacgcccagctaattttgtatttttagtagagacagggtttctccatgttgctcaggctggtctcgaactcctgacctcaggtgatccgtccgcctcagcctcccaaagtgccgggattacaggcgtgagccactgagcccagctgaaattatatatgtttttattgaaggagaagctacttggaactccagtctgtatttcagtaaggcaagggaagaaattagtacgtacgtttctcagaactccaaaatcagctaaatttagggacctgttaatgaaggcaataggaggagttgcgtatacagtctatcaacaaggtgtgatgcagtagatttcatagtttttctgtcttaataggtctcctgagcagaaaggcctcaaaagccttttatataattaagcaaaactgactaatccatggcaagaagctgagttgagatctaatacctagattttaacatccttgacttctatctgctttataattggccaagttgccaagaaaagagaaatgaattcttttttttttttttttgcttttgagatggagtcttcctctgttgcccaggctggagtgcagtggcgtgatctcggctcgctgcaacctccgcctcttgggttcaagcaattctcctgcttcagcctcccaagtagctgggattacaggaaccccccaccatgcctggctaatttttgtatttttagtagagacagggttacactatgttggccaggagggtctcgatctcttgacctcgtgatctgcccacctcagcctctcaaagtgctgggattacaggcatgatccactgcacccagccagaaatgaactctttttgaacttcatgctcagttattcttgtttaattcacacaaccattctgacaggtatttattattatgaccacttctgtggatttcataatttcttgtgtttatagcctcacgtaacaggccatgtgtttataatatccagtctgctggtgatatggtttggatctgtgtctccacaaaatctcatgtcaaattatcgtccccagtgttggaggtggtacctggtgggacatgattgcatcgttggggtggatttctcatgaatggtttagcaccatcctcttggtgctgttcttgtgatagtgagttagttatgagatttgattgttcaaaagtgtgcagcacctcctccctctctctcttgcttctgctcccaccacgtgagacacctcgctccccctttgccttccactatgattggaagtttcctgaggcctcactagaagcagaaaccactatgcttcctgtacagcctgcagaacagtgagccaattaaacctcttttctttataaattacccagtctcagatatttcttaatagcaatgcaagaatggactaatacagctgttatgctctgtttgtccgagtactatgaaaaaagtcttattactcataagcagtagagctgtaatgcaaaacgatgtcctgtatcttaactttttgaagagaatatgtcgcagacagcaggataaggcaagatgcagaaatttattctgcaaaaaaaagtgtccttattctgaagagacagatgccttcatagtgtgagagactaacctagtcctccaaagataaccaggaagaaaaaaaccacactacctaaagtaataagtagttgtgattagtggcagttatggaagaatgtatagctcagccaacaaatatttaccacatgaggagatttagtttaaggcaaatacatttgcttaactgacaatgtattctaataaattgaacacagtaggatgtttttacggaaagatgaaaacttgccacgaaagcagaaatgagactatatagagcagtttcacaggatttgcccaacactgtctggaggagagagaccctgtatctgacagcctttagctttctggtcattgtggcatgggctagttcataaagctcttctggggcattgatgaaacatccctcaagaccacttgcttctctttactctgattaaataatcttcatacagcattttgataactggtctatcctcaccagtactactgtgtattactagcacagaagacaaaatattgaaatagagagtcttcagaagtaaactatgaacaatggcgatttagtaaatctcataatgctggcgtttctaactggtgaggaaataatgaattgttcaatcaatagcacttagaatattggtgatccatttaaaaaaataagactatatccctctctgataacacagagtttttttgttctgttttgttttgttttgttttgctttcttttttgagactgactctcactctattgcctaggctggagtgcagtggcttgatcttggctcattgtaacctctgcctcctgggttcaagagattctcatgcctcagtcttccgagtagctgagactacaggcatgagccaccatgactggctaatttgcatttttggtaaggatacgttttcaccatgtttgtcaggctggtctcgaactccttacctcaggtgatccatcccactcggtctaccaaagtgctgggatttacaggcatgagccaccgtgcctggccatcatagaattttaaaattggaaaagaggaaacaaaactgtcactatttacagatataatagtgtacattgaaaaatctaaaaacaatgtgtcgggactcagaaacaatacttcaaactgtggtgctttggaatgaggagcactctgggctttttctgttgcttgtttttaaattttttaacaatatttgtgtgggtacaaatttggtgtatatatttatggagtacatgagctattttgatacaggcatccagggcctaatcacatcagggtaaatggggtatccatcccctcaagcatttatcctttatgttacaaagaagccaatcatactcttttagttattttaaaacgtacaataaaattattattgatgaatgtcaccctatatttgtgctatcaaatactaaatcttattcattctttttttttcttttttttattttaattttttttgagacagagtcttcctctgtcacccaggctggagtgtagtgccgtgatctcggctaactgcaacctctgactcctgggttcaagtgattctcctgcctcagtctctcaagtaactgggattacaggcatgtaccaccatgcccagctaatttttgtatttttagtaggaacgatgtttagccatgttggccaggctggtctccaacacctgacctcaggtggtctgcccgcttcaacctcccaaagtgctgggattacaggtgtaagccaccacgcccggcctaatcattctatttttttactcattaaccattcacttccctctcaccctccaatgctaaggtctttgaactaaagaaaatgaaagggtgttagaatcagcctcagaaccacggactttcttaacttctcctgttttgcccccaagtgcaggatgaaactcttcctctctgaagttaccttatccgaagctcctccagaaagaatccagtggtctttggtcagctccctgagactttcttaaccagggaagattaaactcatggcagaaggtaagactgagggatgtcaccacacctaagcagactttgtcagaagctgttgtctattctttgtcataatccaaagagtttccaaagagaataattcacaaactatggtcaattctttgggcccattcaactctcctaaaaacaatttcctactcctcaaaattgcctacattcccccatctctctctctcctgtgaagaagggtatatagattctgaacctcgctgggttactgggtagtcactctctcgtcattcccccatgaatacaataaacttgcctttttctccagtgaatctaccgtcggttaatttcagcaaactcaaaccttaaagggaaagggaaattcccctttgcccctaacatgcaaattaattatttagattaataattgctagatataaaattggcatatggtttatttatttttatatttcagcacaggggagggaaaaatgacttccttccacccttttaggttttttgtggctgggctacaagttaaattacataagacggattaacacaagaaaaactgtattaaagtatgtgtgtatacataggagtcccacaaaaatataagactcaaagaaaggccagatgaataaagcttatatagcatcttaagctacagaaagaaacagaggcttggggcttctggagggtggtggtgcaagttaccggagcgtgagaggaggaaacatatagtaaatacatggtaaataaaggttgccttgttatgcagataagagtctctcaggggataaaaattgccttggagcagctctcttcctgatcaaaaacacctttaccagtgaaaatttattgtatacatctgaatttcttttacaaaagggcagcttttcagagctaactcctgtgcaggcagtttttctaaataaatagttaataatcaatatgctagagaggaatattttggagtggtgcattctgagccctaaccccagcaacaggcagaaactgaaatgttaaaatgatacaatttgcaatactattaaaaatattaagttcataaggagaaaaattgggaaaagataaagaactttatggacaaaagtacaaaactttattgtgagacattaaggtaaatagaaaggtatagcatgtttatagattgtaagactcactaatttagatacatcaatttttctgcaaatcgacctatagattggtaattgcctgatgggttgttcctgcctgctgcacagacaaaatcagttcactgagaccacggagacagagtttttactcaaatcactctcccagcagtcttggagactaggggttttttggttttttcctttttcgttttttgtttttttttttttttgagagaaagtctcactctctcaccaggctggagtgtagtggcatgatcttggctccctgcaacctccccctcccgggttcaagtgattcccctgcctcagcctctgaagtagctgggactacaggcacgcaccaacacacctggctatttttaggtattttagtagagacggggtttcatcatgttgaccaggctgatctaaaactcctgactttgtgatccacccgcctcggcctcccacagtgctggaattataggtgtgagccaccacgcccggccaggaagttagggtttttcaaggatagtttggtgagcaggtggctagagaatgggtgctgctgactggctggggatgaattcatagggatgtgaaaaacaatcctcgtgggctgagtctgcctctgggtggaaccacaggactggttgagttatgagccctggttccataggttgccggaatgcaaaagtctgaaaaaaaatctcaaaagaccaacctcaggttccacagtagtgatgttacctataggagcaattggagaagtgacaaatcttgtgacctctggccatgtgacccttgagcagtaagggattatagaaaatacattttataagaattcaggcacatctcataatcctaactttgcagactttcattagttttacaaagttttgggaagtgctactatcatcctcactttaaatttgaactataacttccacccgaagtagcttggcctatgcccaggaatgaccaaggacagcttggaggttaaaagcaagacagagtcaactatgtcagatttctcttactgtcataatctttgcaagggcagtttcagatttagaacaattccaatcaaattctcaaccaagtctttgtttacttattttgggaacttactgattctagaggatatatagatgtataagaatagcaaagacacctccaaaaaaacaaactaaaaaacaagctgagagagtttgttctaccagaatatatataaaatggaaaacaatatcttgttacataaaagcctagtattgctcgttgacgggcagccttgttccatgtgttattcagagacacagattacttccatcttctgattctgtcatctcctcatccatttcatatagctggcaaacagaatagaaggtggagaagcacactttcttaactgccttggccatttttcactggcatcaccttcaggtagggaactatagttcctacctgagctgtcgcttctcagcatcaactctacaccatgcaagggtgagcataagcctgagggcagctagttactacagctacagcaatgtaaatggtgttgccagtttcatctttgtcacagatgagataagaacagatgcaatacagttgaaatatgaaagtagagagaaatctaacacagagtttcccaaaaatgagttagatgagacccaggaacttgtacaaactctcatcagtgattgacaccagtgtcaacaaacttgcaaggagaaaaaatggtcagtcccaaaactggacctaaaacactttatcttcttattagaaaacagcagcagcattaataatactatactgcaatatcatatttagacttatgggccagagaagtgggatgtggaaattagcaatgagtcctagaaggactatgataattggatattggctgctcaagagatgctgagtaaccaaaagaagagctaacatgcgggacagcctaaaaatatcatgtgagcacacatttaaggaagtctaccctgtgccacaacggtgctgggagatggacacaaagataaccaagacatagcccctttctctcaggaactgtcagtccagtggttctggtaccagagggggaggacccccccttagcaggtgcaaaggtgggtaaagtgatgatggagctgtggcccactagaggatgttgcaagtacagacatcgggatggggaatactggttgtgtggagatgagctagtctttttgaaaatcatattcctgttttatttgaaaaaccaatcctccaccttgctcccgtctgtggcttggatggactggctccaccccagctccagtaatgagctactcagtgtgtgtgtctcattagatgagatgggcacttgtcccagtcagagacctttgctaggaatattgggggatgaaggcaggacttcatcttgagagaatggaagatgtggagttgctgctgtcatcttacagatatacaaggaacatctgcctgatagtgggactatgatagaggagaaagaaacaggaaaatatagagaaaccatgtactgttttcatcatctaagttctgataagctgctcattaagccataacagtgtgttatggcttaggatagtttaactgtacattcaggttcttaggccctcagaagagatcaagttctcgggggtaaggggtttcagttgtgctaagtggccgaaagaagattctagagaattttgtcttagaaatccatgagtgtcatttattcatttccatactggtagcctttaatttaatataatttttatttatttattattattattatttgtagagacaaggtcttgctatattacccagaccattcttgaactcctgggctcaagtgatcctcccaacttggtcgcccaaagtgctgggtttacagcatgagccaccatacctagccatgggtaacattttaaaataaagtagtcaaaatagatctccttgagaaaattattattattattattattattattattattattattatttgagatggagtctagctctgttgccaggctggagtgcagtggcgcgatctcggctcaccacaacctctgcctcccaggtacaagtgattctcctgcttcagcctccggagtagctgggattacaggcatgcaccaccatgcctggctaattttgtatttttagtacaacaggggttccaccatgttggccggatgatctccatctcctgacctcatgatgtgcccaccttgctctcccaaagtgctaggattacaggcgtgagccaccgcacccagccgagaaaattatttttaagcaaagacttagagagagagaggaagttagctatgcacattgtgggtgcggtgtggttagggtggccctgagatagggatatgcctggtgtgtttacggaacagctaagaggccagggaactagaggaaattgagtgggaaggggaagagtaggagattagttttgaaaagcaaatggtttgggaatatggatcatgtaagagcacatgagattttataaggatttcattttactcagggtgaaatgaagaagcactaaaagattttgagtagagtttcatgatctgacttatgttttaaaaggaccctctagctgcttgggctatcagtggtggaagcaggaaggccaatgagaatgcttttccagtaattctagcgaaaggtgatggtggctcagaatggtggtagcagtgaaggccatgagaagtggccagattctgtgtgtgatttgaaggcagaaaaagacttccctgacaggttggatgtgggatataagagaaaagaaggttattcaacaattagagaaaatggacttaccttctcttgagatgaggaatactgagggaggaacaacttcgggggaagagtaggaaaagatgatcagtgtttcctggggacatgctaggtttgatatacttattagacatttaagaagaaatgtcacatagaaagttgctgtacaagtatagggttcaggagagagaggtgtactgaagatttgggcattgttagaaaattaatgatattaaaagtgtagaggtagaaaaagtatgatatctctcctctcccctcataagggtctgacactcctatagcaaaagacaggttaacaagagaaaaacataacaaatttacttaaagttttatgtgactcagaaaccttcagaatgaagacccaaagacccaggcaaaactgtctagatttatgctcaggttcagtgaaggatggacagccatgtagcaatgtaattggacaaaaagggtatgagttgatagtaataggctgagggaggaacccagcacggcctgtctgtttagatttttcttggactctctgtataggaattctccctcccagctatacagcaagaccccctctggaatcagtcttatgacctactatcagacaaggtaggtcaggtaatttctttatggccagctcctacacagaatggcagagggaagactagagtaatatttctagattttatgggtgatttggggagaggggagcaagagactggaagacaggagaaggtcagagagaccttggttctggaggctacttcacggaaagttaagcctgttggggagaaatgtcttactccaagtgcaaagcttccctcatgaccactgttgatggggtggaagagtctggggaattcattgaagagatatccacattactggatctagagaaagaaaatcttgtcctggaggtgaacaggaagagggtccacatctgtgtcacgttttcatctcagtggagggaataaggagaaggagagtagggcattggtgtctcaatgcccggagatattgttctcctcttaagcataccccagacctcagtacttctcgcatttgtctccatctctcttcgctcctctaaggacccatctgagctattcactttaccacatcctccttccctcttacacattcatctccgtatcactctcttttcttttctttctttttttttttttttttttgacatggagtctcgtcctcttgcccaggctagagtgcactggcgtgatcttgggtcactgcaacctccaccttccgggttcaggcgattctcctgcctcagcctcccgagtagctgggattacaggcatctgccatcatgctcagctaatttttgtatttttagtagagatgggatttcaccatgctgaccaggctagtatcaaactcctgacctcaactgatccactcaccttggcctcccaaagtgctgggattacaggggtgagccaccatgcccagcccctctctcttttcttccttcccatttcactactctggccctgcaggttttcttggaagtttagagagattacagacacactcatcacattttttacagctttaattgaggtataatttacaaataaaacttgtatatatttaagttttacaacttcatgttttgatatacaaaagcactgtgagataatcatcacaatcaagctaattgacatatctgtcatctcacatagttaccattttcttttctttttcttttttttcgtggtgagaacacttgtggtctatccttttagtaaatttcaaatgtgcaatacaaaattgctaactctattcatcttgctaaacactgcatctcctgacccatctcagttttgaattgtactaatagaatacacatagtactaatataattctcaaagcaaaaatatattttctttttttttctttttctttcttttttttttttttatgagactgagtgtctctttatcacccaggctggagtccaagggcgcgatctcggctcactgcaacctccacctcccgagttcaagcaattctcgtgcctcagcctctcgagtagctgggattacaggcacccactaccatgcccggctaatttttgtattattactagggaagggtttcaatatgttggccaggctggtctcaaactcttgacctcaagtgaacacctacctcggcctctgaaagtgctgagattacaggcatgagccactgcgcccagccacaaaaagatattttctaatactcagttctatcattaatttttttagtgtgcttaacagatcactctaccattactcttcctcagctggaaagtgaggggttggtataaatgtctttaggagttccttccagctcagactatttagaaatccgatactctggagcataggtatgtgtgtatgcatgtgtatgtgtgtgtgtgtgtgtgtgtgtgtgtgcgtgcatgtgtgtgtgtaggaaaaaatgtaaaggaaatttggttgatatttttgtattgttggtctatgtatatctgattttcctaaatcattatgaatttaggcagaaacaggcataattatctgaaataaaattattatatacagattacatcattatttttaaactatgaaaaaaaaccacgcttgtaatctatcttattgtagagaagatatgaggtcctgtcatttagaactgtcatttaatggagcaagagaaaacattagcgcaaacactatgggatgagctcaagcccctgagatctagattagaggactggttaatagcctgggagataacactcagtcaacaaacaataatgtagtcattcctcttcttggctatctcccttcccttcacctacctgtagtctaataggtgatcgggggcccaaaactcattacatccaagaggaagctttgtttggcaggtgctatctagccaagaaaatctcagcatcactgaacatttacatacattgtaatttttccctaagcattggaaaaaagaaagaacccaacaccacatgggggtcgccatttcattcaaggcatttttattaaggctcaaaacaggactgtcttgtaggtaaccctcgcttctactgttttagagacaccgtagactttcacctgtgctcaggatgcagggtgtcccaccaccagacttactaagtttgtgtatttgtgatataagaaacaaagaatgttagcatttccctggtagaaaagagaagataagtgccttgtttgaggtcccgtgttggtgaatagcagagtttgtgaagtgaaactctaatctttttttaagtccattactttagatggacaaccaagcttgttcctcttaagggaaggatgtgagccaaataggagattcaaagagatggagtaagggatgatgctccatgaaggaaaatatctggtttcaaaggaagagcatgtcttgacagggtaagagaccaagaatccctttgaagaaaaggtaccatttactaaaaaatatcagtcatagtgactatagttgagaaataaatgaacgctcacaaattgagaaatgtaggcaagtaggctattgacttcggcaagcccgactctctatctcagggtttcccagacatcaggcatccctggaccatgcccccattccatttgtactattgactaatattatctgttttattcactcttgcatttatacaacatggtcctaagcaataatatgcataacattatggactaatgtgttaattattcactcccattaaaagaaatgcataacagtgaacaatttttactatttacatgtactttctaacatcagtaacttcactttccacctgttgtacatatttcataattttgtgttcagtttcatctatggctgtaaattaaacaattctaccttggaaaatattttcacagaagaataaaggatccaaggacagtagaaaaaaatgaagctcaaggtcaatgatttggccaagttcatcaaattctgtataaaagagactaaatcatgcaagtactgcatttttatcatgaaaaggtgctctaactgtttgctaagacagttcctcaaatttaccaccaaattgatggaaaacctagttttcatgatgatctagttccctttgttctgacttcacaactaaatgcaagatgttaaaacgtgatttcttctatctcagattgggaagggtccctgagaaacagcggccctgtcaaaatgacttgctgtccacctaagcagcacttgatcaaaaggagacaaaaacctgagctctagttctaatgccttcactatgggaaataaggaaaggaaacaagcatactgtctcatcgtaaataccacagagaagatagcgcagtaatggaaactacgctaacaccttgatgtataagactgatcgtcctcatcaagacttttttttccttttgcaatgttttatgctacatatttaattatttcatacatacacacacacacaaattaccacattaaacttcccctacaaaccaatgtatgtgttgttgtattttacaggttataaaacagaggcatagcaaggatgaataaccgtccaactcttttgttgttgttgttgtttctttttaaagagacaggatcttactctgtctcccaggctggagggcagtggcgcagtatcggctaactgcagactctgactcccaggttcaagtgatcctcctacctcagcctcctgagtagttgggattacaggtgcactccaccatgcctggttaatttgtgtgtgtgtctgtgtgtgtgtgtgttttgtttgtttgtttgtttgtttgttttgagatggagtctcactctgtcacccaggctggagtgcaggtgatctcggctcactgcaacctctgcctcctgagttcaagcgattctcctgcctcagccacccgagtagctgggactataggcccgtgccaccacgcctggctaattttttgtatttttagtagagacagggtttcaacatgttagccaggatggtctcgatctcctgacctcatgatccgcccacctcagcctcccaaagtgctgagattacaggcatgagccaccgcgcccgacctaatttttgtggttttggtagaggcaggatttctccatgttggccaggcaggtctcaaactcctcgcctgaagtgacccctctaccttggcctccgaaagtgctgggattacaggcatgagtcacagcacctggccctgtacaactcttatagtaagagcctcaaatagaaaatgtcagagctggtatctggacaagactatacaaaatctatacccgacatcgctgtaacacaaaacttatataacaacttcatttaaagagacactaacctatataataattcattttgtgtgagctctgaaatcttagcaaatgcatctgtgtgctcaaaatgcaatggggatgaacagaggatgtttaaggggtacaaatataagaaatgatataagaaataaggcctagtgtttgatagatcaggaggatgactatagttaatgataatctactgtatgcttcaaaatagctagaagagaataatttgaatgtttctaacataaagaagaggcaaatatttaaggtactcgatatcccagtttccccgatgtgatctttacacattatgtgaatatattaaattatcacatgtaccctgaaagtatgtacctctattatgtatcaataaaaagaaataaggccaggcgccgtggctcacgcctgtaatcctagcactttgggaggctgaggtgtgcgaatcacctgaggtcaggagttcaagaccagcttggccaacgtggtgaaaccctatctctacaaacatagaaaaattagctggacgtggtggtgcacgcctgtaatcccagctactcgggaggctgagaaaggagaatcatttgaacccggtaggcagaggttgcagtgagctgagatcttgccactgcactacagcgtgggtgacagagtgagactccatctgaaagagaaagaaagaaagaaggaaagaatgaaagaaagaaagaaagaaagaaagaaagaaagaaaggaaggaaggaaggaaggaaggaaggaaggaaggaagaaagaaagaaagaaagaaagaaagaaagaaagaaagaaagaaagaaagaaaaagaaaaagaaagaaagaaagattttaaaaatatgcaatgggacacgaatgcaattttccagtttcttaggaaacacactttatttcatccctcctaagacacacctctccataattccatcggggctctattcccatttcttccctttccagag

SEQ ID NO: 103 - DNA, 8923 bp, Homo sapiens
  source 1..8923: mol_type = genomic DNA
atattagatattttttatctgaacgtcatgctgttgctacagattcagtggagttggacagtacttttctcttcccgtcctttcccttccatagggtagcatttgctggcttacaaaggaaaagcagaagctttgctccactatcttgtcttgtcttgtcttgtctcttttctttttcttttttttttcgtcttctgttcagatagtctcactctgtcacccaggctagagtgcagccgtgttatcatggatgggttactgcagcctctaattacctggcttgagcaatcctcccacctcagcctgctgagtagctgggactacaagtgcacgccaccatacccggctaattttactttttttttctttgagacagagtctcactctgtcactgaggctggagtgcagtggcatgatctcggctcattgcaaccgctgcctcctgggttcaagagattctcctgtctcagcctccagagtagctgagattacaggtgcgcaccatggcacctggctaatttttgtatttttagtagagatggggtttcaccatgttggtcaggctggtcttgaactcctgacgtcatgtgatccacccgcctcggcctcccaaggtgttgggattacaggtgtgggccactgtgcccggcctttctttttttaaagacaggttgcaaggtggtggctcatgcctgtaatcccagcactttcggaggccgaggcgggggtattgcttgagctcaggagttcgagaccagcctggccaatgtggcaaaaccccatcctatgaaaaaatacaaaaattagccgggcatggtggcaggcgcctgtaatcccagctattctggtggctgagtcaggagaatagcttgaacccaggaggcagaggttgcagtgagaggagatcaagccactgccctccagcctgggtgacaaagtgagactgtctcaaaaaacaaaaacaaaattataaaaaagagaagaagctcaacaactgatatgtttttcccggcatgaatatttttatattgaggaaaaataaatcacttaaaatttttttaaaagaaagagggtatactaaaaatacaaaaattagctgggtgtgatggctctctcctgtagtctcggctactcaggaggctgaggtgggaggactgcttgagcctgggaggtggaggctgcagcccacaacattccagcctgggtgagaaggaagaccctgtctaaagaaaacaaaaacaaacaaacaaacaaaaatgagtggaattggccgggcacggtggctcatgtctgtaatcccagcactttgggaggctgaggcaggcggatcatgaggtcaggagatcgagaccatcctggctaacacagtgaaaccctgtctctactaaaaatacaaaaaaattagccgggtgtggtggtgggtgcttgtagtcccagctactcgggaggctgaggcaggagaatggtgtgaacccgggaggcggagcttgcagtgagccgagattgtgccactgcactccagcctgggcgacagggcgagactccgtctcaaaacaaaaacaaaaacaaacaaacataaaaagagtggaattgttccctttaaccctcaattcatatgttgaagccctaacctccaatgtgattgtatttgaagatagacctttaaggaggtaattaaagttaaatgatgtcatgagggtagggccttaatccaatttgattggtgtttcttttatttgtttgtttgagacagagtcttgctctgttgcccaggctggagtgcagtggcacaatctctgctcactgggtttgtgtgattctcctgcctcagcctactgagtagctggaactacaggcatacaccgccacacccagctaatttttgtatttttagtagagacggggtctctccatgttggtcaagctggtctcgaactcctgacctcaggtggtccgcctgcctcagccttccaaagtgctgggattacaggcgtgagccactgtgcccagcctgattagcgtttgtatttatttttattttttgttattttttaaaataatttttttttaaatttttgagactgagtctggccgttgtcgcccaggctggagtgcaatggcgtgatctcagctcactgcaacctcagcctcctgggctcaagcaattgtcctgtctcagcctcccgaatagctgggattacaggcatgggccaccacgcccggctaatttttgtattttttagtagagacggggtttcaccatgttggccaggctggcctccaactcctgacctcgtgatctgcccgcctcggcctcccgaagtgctgagattacaggtgtgagtgaccgcacccgatgtggttagcatttttataagaagagaagaaacaccaggaatatgtggtcacaaaggaaaggccacgtgagggcacaaggagaagctaccatctgcaaactgtgacaagaggcctcaggttggtttccaatcctgctagcacattgctcttagccttccagcctgcagaactctgagaaaataagtttctgttgtttaagtcaccctgtctgtgatattttgttatagcagactaatacctggccttccataccataagctcctttccctatataatttgcaataaacagaggcctggagaatggagacaaagctattctggagacccaggggtctaggctaccttgcctttgcctcatttcacacttcaggctatatgagctctatccccaggaaaattcagctcttgctatttggattcattaagtggagaatagaatgagatctgttttgggtatcaggccagaaattatcagcatcttggaacgtcagaaaataatggatcagtacccaagttacttagtctcaccccatacagtcttccaccacctacagctgggtactataacaacacatcctaagagaaaagaggctcagagacttctttagcctaagaacctctaggacctaactccccagaagccttagcgtcaggtcaagtaaaggagcacacacaggatagagagtggaaatgtttctgtttttttttgtttttttgagagggagtctcgctctgtcacccaggctggagtgcaatggcatgatcttggctcactgcaacctctgcctcctgggttcaagcgattctcctgtctcagcccccgagtagccgggactataggcacacaccacaacgcctggttaattttttgtatttttagtaaagatgaggtttcaccatattggccaggctggtcttgaactcctgacctcaggtgatctgcccgcctcggcctcccaaactgttgggattacaggcgtgaaccaccgtgcagccgggaagtgtttctttcactggaggggcagaggtagttgtgatgaccctactgtggccctggggagaagagtgagaggataacagtgaacaaggggctaagtgaagttcttagaagtagggtggaatgagtgtgagagaaagggggaagctagtgaggcttttctcttatgctgatgtaaagtaggtttccaatagaagaaatttataagtaatacagaggataggatgattaatctaaattggaccagagcagagttttgttggccccagaggttttaagattttgtttaggtaagatttgtgtttagtcccagcaatttgggatgctgaggtgggagaatcacctgagcccatgaagtcgaggctgtagtgagctgtgattgtgccgccgcactcctgcttgggcgacagagcgagaccctgtctcaaaaacaaacaaacaacaaaaaagaaaagataaataaacctagattcttattgcacaccatatgcgaaagtaaatttcagatggaataaagatataaatgagcataacaaaactataaaaacgttagaatcaggccaggcatggtggctcatgcctgtaatcccagcactttgggaagccgaggtgggaggatcacctaaggtcaggagttcaagactagcctgaccaacatgacaaaaccccatctctactaaaaatacaaaattagccgggtgtggtgacgggtgcctgtaatcccagctactcgggaggctgaggcaggagaatcgcttgaacccgggagacggaggtggcagtgagccgagatggcgcattgcacaccagcctgggcaacaagagcgaaactccgtctcaaaacaaaacaaaacaaacaaacgaacaaaaacggttagaagaatatttaggactctataaaatcttgggatggggatgtgcttcatttttttttttttttttttttgagacagagtcttgctctgttgcccaggctggagtgcagtggcgccatcttggtctcgatctcttgacttcgtgatgtgcctgcctcggcctcccaaagtgctgggattataggagtgagcccctgcgcctggcctggggatgcgcttcttaaacaaaatagcccagaatctataaagaaaatattattacacaaaaataaaatctttgggatgaaaaaaggcagcataaacacaaataatacagttggtagaaaatatttgcacccataccaccaattgatgaattttctaatatacaaagacctagtattggaagaaaaagttgacaactcagtagaaaaataggcaattgatataaacagacaaaaggcagacgagcaattctgaatggtaaataagtctttttttttttttttttgagacagagtctcactctgtgagcccaggctggagtgcagtggcatgatctcggctcactgcaagctccgcctcccgggtccacaccattctcctgcctcagcctcccgagtagctgggactacaggtgcccgccaccatgcccggctaattttttgtatttttagtagaaacggggtttcaccatgttagccaggatggtctcgatctcctgaccttgtgatccgcctgcctcagcctcccaaagtgctgggattataggcgtgagccaccacgcccagccttctgaatggtaaataagtctaataaaagctacccaggcagcctccccacccctcccgcaatgctcgaccccaggattgccccggcttgcctgcccgccatggccgtcaaggaagcagccttcgatgatggagtggaagacgagtgatcaacgatgagtacaaaatacggaaaaaaaacaccccttttctttaccatttggtgatgacccatgctctggagtggccagcctaactgtccagtggcttccagatgaaatcagaccagaagggaaagatttcagcattcatcgacttgtcctggggacacacacattggatgaacaaaaccatcttgttatagccagtgtgcaacccctaatgataatgcttagtttgacgcgtcacactacgacagtgagaaaggagaatttggaggttttggttcagttagtggaaacattgaaatagaaatcaagatcaaccatgaaggagaagtaaatagggcccgttacatgccgcagaactcttgtatcatcaaaacaaagactccttccagtgatgttcttgtctttgactatacaaaatatccttctaaaccagatccttctggagagtgcaacccagacttgcgtctctgtggacatcagaaggaaggctatgggctttcatggaacccaaatctcagtgggcatttacttagtgcttcagatgaccacactgtctgcctgtgggacatcagtgccattccaaaggagggaaaagtggatgcaaggaccatctttacggggcatacagcagtagtagaagatgttttctggaatctgcttcatgagtctctgtttaggttagttgctgatgatcagaaacttatgatttgggatactcgttcaaaaaatacttccaaaccaagccactcagttgatgcttacactgctgaagtgaactgcctctctttcaatccttatggtgagttcattcttgctacaggatcagctgacaagactgttgccttgtgggatctgagaaatctgaaacttaaggtacattcctttgagtcacataaggatgaaatattccaggttcagtggtcacctcacaatgagactattttggcttccagtggtactgatcatggactgaatgtctgggatttaagtaaaatcacagaggaacaatccccagaagatgcagaagacaggccaccagagttgtttattcatggtggtcacactgccaagatacctgatttctccttgaatcccagtgaaccttggatgatttgttctgtatcagaaaacaacatcatggaagtgtggcaaatggcagagaacatttctaacggtgaagaccctgaagggagtgtggatccagaaggacaagagtcccagacgtatctttacttcttgtgattttagactccccttttttcttctcaatgctgagagtgatttaacactggttttgagacacaaactttgttcagctatccctctatataataggtaccaccaataataccattagccctaacagtgggtgttttctaaatattaatggtggggcttgattcagcaaagccacagacttattacactgaagttttcttcaggaattttctagtaacaaaaccaggtctaaagtagctacagaaacgggaatattatgtgtgattatttttcttcttatgctatatccgcaagtttttcagactcatttaagtaaaggctagagtgagtaaggaacagagccaaatgaggtaggtgtctgagccatgaagtataaatactgaaagatgtcacttttattcaggaaataggggagattcaagtcatatagattcctactcgaaaatcttgatacctgactttccagcatgcacatgaagaccagtagaccaggaaacaggtagacgagtttcctcttggttccttcagttaagtcagaactacacgttcctctttccccatatatttttgcttgttcgtgtatttcttaagctgttttcatgctgtttctttcctttctgtggaatggttttttttttttttttttaacttaggactaccaagttgtaaagatgtatgtttttacctgacagtaataccacaggtagactgtcaagttgagaagagtgaatcaataacttgtatttgttttaaaaattaaattaatccttgataaaagttgcttttttttttttgagatggagtctcgctctgttgcccaggctggagtgcagtggcgcgatctcggctcactgcaacctccgcctgccaggttgatgccattctcctgcctcagcctcccgagtagctgggattacaggcgcccgccactacgcccggctagttttttgtatttttagtagagatggggtttcaccatgctagccgggatggtctcgatctcctgacctcgtgatccacccgtctcaccctcccaaagtgctgggattacaggtgtaagccaccgcgcccagcctttttttttttttttttaggagttagtccttgaccactagtttgatgtttgatgcatctccattttgggtgacctgttttaccagcaggcctgttactctccatgacgaactgtgtaagtgcttaaaatggaataaattgcttttctaccttaaaaaaaaagctacccagtctctttattcatcaggagaaattaaaacaaaaatgaactgcccattagattggcaaaaattagttgataagattcagtgtgggtgagagtgtgggaataggcattcatacagacacacacaaacacacatatatatgcctcttgggtgtatgaattaggggtgggtgtatgaattaggagcatgaattgctacaattttgggggaagaaacatagtaatatctacaaatattaaaattatgtatcctttggccaggggctgtgactcatgcctgtaatcccagcactctgggaggccgcggggcggagggggtggggtgtagattgcttgaggtcaggagtttgagaccagcctggccaacatggtgaaaccctgtctctactttactaaaaatacaaaaattagccaggtgtggtggtgtgcacctgtagtcccagctacttgggaagctgaggcaggagaatcacttgaacccggaggcagaggttgcagtgagctgatatctcgccattgcactccagcctgggtgacagagtgagactccgtctcaaaaaataaataaaaagtcaaaggcatatacattgttctgcaccttactttttcagttaagtatatgtcttaatttttttatttttatttatttatttatttatttatttaattatttttgacacagggtcttgctccgtcacccaggctggagttcagtggtacaatttcagttcactgcagcctctgcctcctgggctgcaatcctcccacctcagcctccagagtagctgggactacaggtgtgcgccaccacacctggctaatttctttgtatgttttgtagagatggggttttgccatgttgcccaggctgggttccaactcctgagctcaagtaatctgcccgccttggcctcccaaagtgtgagaccctgtacatggactgctgatttataaatctgtgagctaataaattggatattgtttcttttttctttttttgagacggagtttggctcttgttgcctaggctggagtgcaatggtgcgatctcagctcactgcaacctccgcctcccgggttcaagcgattctcctgcttcagcctcccaggcgtgcgccatcatgtctgggtaattttgtatttttggtaaagatgcagtttctccatgttggttaggctggtctcgaactcccgacctcaggtgatccacccgccttggcctcccaaagtgctgggattacaggcgtgagccactgcgcccggctggatgttgtttaaggcgctaaatttctgct

SEQ ID NO: 104 - DNA, 4764 bp, Homo sapiens
  source 1..4764: mol_type = genomic DNA
tggaaagtaaaaaaatacaaactactgaaagccaaattgcctagacaaacaggatctgcagtagagctgggcctcatgaagatggactggtcaggaacagggaatgaatcagaatatagggcagctctggtgactgggatattttgttgtccctatcagaagaagacatcatttggtccaaattgtgtgttgccttgttatggtaactcaataggtctccatctctgcttcttccagtactcctgtgactgacagaccaattttttttttttttttttgagatggagttttgctcttgttgcccaggctggagtgcagtggtgcgatcttagctcactgcaacctccacctcctgggttcaagcgattttcctgcctcagcctcctgagtagctggaattacagacacgtgccaccatgcccagctacttttttgtatttttagtagagatagggtttcatcacgttggccaggctggtttcgatctcccaacctcaggtgatccacccacctcagcctcccaatgtggagggattacaggcgtgagccactgtgcccagccgctttttgtttttttatgtatctctttggtttggttggtcaccttccgtagaatggctcacactgcctcttgtaggggattgtggccattttcatcaaataatttttctgattccacagtcatccatacttggcaatctaagcttatgatccttgttctcaaatttccgacacatcttttttaagactctttatttatgctactactaataatacagtatggatgatgatgtttattattatttgttggatacctcccatgtttaagagctttacaagtgttaatttattcaattcttgttgaggtagatatgaatatccttattttatagaagaggcaactaagttcagagagtttaatttgaatttggcacaaggccatatttccagtagatggaaaagtcaggattcaaatccagtgtattttttttaatacctatgctctttctactccactatatcatgatgtctctctaaaggacataccaggatttaatcagagaatactttgtttaaaggcgtgtatatttaccagataaaacactgggtccctccagtgaagcctttctctagcacccattagcaatatgatgctcaaatatcttttttttcccctgtcccatgtcttgccttgtcttttatttttatttgtttatttatttttgagacagtctcacctgttgcccaggctggagtgcagtggcgcgatctcagcgcactgcaacctccgccttccaggttcaagtgattctcctgcctcagcctctcaagtagctgggattacaggtgcgcaccatcacacctggctaattttgtatttttagtagagatggagtttcactacgctggccaggccggtctcgaactcctgacctcaggtagtctgtgcgcctcggcctcccaaagtgctgggaggtgtaagccaccgcgcccagcctgccttgtctttaatgcaagaaacagaatgcgagtaatcagaaagccctagaaggcatcagttaatacaagatattaatttcttaattccaaaagcacttgcaaagaaaaacttttaagggggaggggagcagggggattgaagcacatcataactggaatcccatgagtgtgccaagtctcatgaggctattttttgaatttatcctttacttgttcatttttttctctcaaataataagtattatttttctttgatatttcccctcaaaggataaaacatatgaaatataaaatataaacgaactcttgtattgtacagttagaagttatagaactatccggctgggtgcggtggctcatgcctgtaatcccagcactttgggaggccaaggcaggtggatcacgaggtcaggagttcaagaccagcctgtccaagatggtgaaaccccgtctctactgaaaatacaaaaaaaaattagctgggcgcggtggcaggtgcctgtaatcccagctactcaggaggctgaggcaggagaattgctggaatctgggtggcagaggttgcatcgcgccactgcaccccagcctgggcaatagagtaagactctgtctcaaaaacaaaacaaaaccaaaaccaaaacaaaacaaaaaaatgaaacaaaaacaaaaacaaaaagaagttatagatctacacactgataaactgcataaaatcttggataactcgtgaatatacaaaatatcagggcacagaaagaagtaaacccactttatttttgtcacacataagattcaaatattcaatctgaagaaaagcaatcatttttgctgtgttctaggttgcatgttgatacatttattaaaatattcctgcataatcacatttggtattactatttcaagtcagatataaaacttcaaaatctgccagccagacaaaatgggtaatcagaaagattatctctgccccacctccctaacctcgataagtataaactcaattttatgacatgactccaaaccctagattgtgatgacaaatgctaggtccgatttctttataatccttttcggggtggcatacttgatagaactcaagcatagaagtctgcattggtcctccaaaccaaattgcatattgctctacgtggtgtgtaatgacttgtacatcaatagcttctggcttcaatctactgctacttaattcctcacttaaggtcagcctgacatctacagttcttttcatatctcattgcaagtgatgtccaaagtccctgaacacagttgaacctccatagacaacaatattcttgttgagaggatgtctcacatcaataggacaattctgaattacttcatctgcaacatctgagatgggatgtataaagtctggattagcaaacctggatgagaaaagatttcaggtcccaagaatctctcatgtccaatatcggtggaaaattatttatttgagatggcattgattcttatacactgtttaaatccactgcgacccatctgcaccttactttttaaattcttttactaaatctgagctaacataactatagtgatcctctactgccttagcagtttccagggattgctctggagggattcctacttcttggtctctcagtagttgctgagtaagatatgttatagctcatcctgcaattggaatgtgtttaatacagctgccaatcacatacccttcaggcgcggaaatgccatgagtgacaccgtttcaacttgtctataacctaccagtcaacatgtattctcctatttgtcttgtggtccaggatgtagctacagcaagaacaacctgcacagcaatgtacaaacctgaacattgaaggacccaaacactatttcaggaatatattccctgctttctggagtattcagcggaggtccagtcaaaagaaaataatggtcttcaggttctgcccttaaatatttaaagatcacttgctctataaagccttccattgagttccaatctttaactagaccatgatggatgggctctttgttgtatatgtagattttccaatgcttcatcgccagtaaagacgtctaggtcatcagcatgtttcatcaccctccttttgaacttgaccacccacttttgttgagttttttttttcatggatgaataatttattggtagaataatacagagtttaccttcaattctatatctgttttgttgagttgttaatggcagtacaggaagggatggtaaacggagattctttattttggacatatcctggttttgtatacctggtaccacagtctgctatgtaggctgtcagctgtcaggtcatctttcctccttttatcctgctgctgctgctgcagcggctgccacttgctccatgctggtaggggccagaaattggcagtgggagatggggcatctgaccatccacagctgagctgccttctctgtggggggtgggtgggatggggatctgtgaaggcaaagcaatagcaagaaagcatcaggctcagtcagcactattcaccacccagcactatccacaacccaggcaggcaggccatacctcccctgtcccactgtggcctcctcatcctctcccttccctcctcgtcactcctgctcccaccctacaacttggtgtccttgtgctgcttttccccaggtagccaagatgcccaggcaccctaaatacctttgaaatggttagagtgtgcatcagttattttcacctagtgtggctcagtttaatcagttccttagtaatgctacttgagatcctgccagtaagatggaagccattttagtatggatgaaaggaaaaagggaaggaaaagaaaagaactggggaagggaggaggtttcacttgaagtaggtttcagaaaggaaattgtatatattatgggaccaggtttgtatgtggcaaccagagtgtgtgtgaggaggtactttatgaagtgggatatgaataggtgcaggtttatatatcattttaaaagttgttcacaccttggtctagtttcatgttgaagctagctgagtccctgctggcagctctgttccacaaaagtcatgctgtattctacaaaaatatgtttattgatgaaatttgtaatgatacatatactcctaaaagagtagttaggttttatggattaaacttacatatgaacccaagatctcacagccttaacagcatctcatttccactgacaagaacaataaggttttccagcttaggtgctatataaaa

SEQ ID NO: 105 - DNA, 7857 bp, Homo sapiens
  source 1..7857: mol_type = genomic DNA
aaacttcattttggtgtttgagaacacagtagataggtgtgtgtcctaaatgttttgagccatatgcaggggcaggtataggatagtgtatctgaagatgctgttgggattctattgtcatttatttatgatgtggtaaaaagtctgactttgtgtctctttaaaggaaagttttgacaatgaatataacttataataatacttttatgtatttacacttttcaaagtcatttcataatgtttgctattcagtttagtttagtggctctgggtaatctatttaaagtccattttcagtttgttagtttctgtagactacaagtgtagagggaaaatgtatttcacgtatttcactgggtaagagaatggattattagcaagaacttaaatctaaaatttaagcagtttctagtgctgagggacacgatagatttatgctgaattgtatatttctgtatttgatttttttttaaactgcaggcatctgtgtcttccaaggtgagaaaaaacgttaaaacatatcatgtattttctggcctcctactatgtaccaggtggtatgaggacataaagaggcagaagatacgattcttgcccctagatagcttcacatttagctgaagaaacaagacataaacacaggaaaagttagctaatcatgcagggtttaaatagcaaggcatgacatgactaatggggagatgcattgtttaggcagtaattcctacaggagttcagaagaaagagattattttaggctgtgacagtaaaggaagggtgtaaagacttaaaaggagaaaagagaaaaggcttatgtagaggaactgaaacttgggaatgactgaagccttgttctaccacttatgccttaccttgtgcctcaatttcccaatctgtataacataatgatgatgtgttacctcccagactgtcagaagatgagacagtgattgcagaaaagctctttgcaaataatgcctggtccctccatactgtgtagacagtaaaaatcgtacactttttgaaagtctttgaaaatttaggttactagggtataatttctgtcgttcaagtttgccaagtaggattttttaaattagcatattgccagaagtttgactttcttctttttcccagtaaggagagatttgtaagactctgaaaaaattttaagcaagcaattagacacattattactttgggaaaattgcttttatggccaggcatccttttctgtttctttatttccttgagcaaagataatgattgataaggaagtaaaactagaaagaagccagatccaaacttagaaggaaaatattttgtcacgtatggaagttcagtggaggttgcaggttggctgatgaccactttgggtgaacccagcctgacactcagcattttggagatgatagtctcagagttcacaggtttcctgtgtataaggaaatggatgtcggtcatttcaactgtactgttaattgctttgggaaaatgagtggtattcattaggcaaggaagcttgtagccagccctgtaattaatgtgaaaccttttcatacagccagtggctcttcagcatctctgtactttatgtttatgtgtatacttaggcttgcttcagtggccagaggcttcaaggcattcagggctctgggggctcttattataatggtaatgaaaattggaccctagaactttggacctccccagccttaaatccactgagaggagctctctgtctagggatgtggctccttctgctggcttcttcccttctctaagatagcagtgagatgcactaaacatgagatttctaaaacaaatacttcgatgagtaggaaagtctgttttcctgaatatatccactttcctacatattccattgcttgtggaagcaatgacccaagggttatatgcaggactttttcttactttggcagactggagacccagagctcagagaaggcagaaagtgtgttaaagaacaataggaaaagtggtgagagacaggcagatgaaggaagcatgaactaccatcacagagaaagggtagagtcagcaggtaattctcaaagggatgtgcatctgcccctaacccaatctaaatgcctgactcaatgtcctcagaggacacgaaccctggaaaacaagtatgagatgatactactcaggtattgcgtgtgtgtgtgtgtatgtgtgtgtgtgtgtgtgtgtgtgtcagaggtcagccctgatgtaattgccaccgaggtcaccgtggatgaggtcattgtgggtgaggttacagtgcaagagctgtcttttggtgctgttctggtcttgtgatttccctattttcagcacccagtaggtaggtgctcaataaatgtttgttggaggaatgggtgctggggccagccccctaactctggcctctgttggacgttttgtgacctggaatcattctagaaggaaagagactgcccagagtggatttgtgtcctgcttgtgactttcttggtaacaactacaatgaatatgctccccaggctcttaatctggagaactcctttttttttttttttttttaaacagtctcgctctttcacccaggctggagtgcagtggcgcaatctcggctcactgcaagctccgcctcccaggttcacgccattctcctgcctcagccttccaagtagctgggactacaggagcccaccaccacgcccggctaattttttgtatttttagtagagacggggtttcaccttgctaaccaggatggtctcgacctcctgacctcgtgatccgcctgccttagcctcccaaagtgctgggattacaggcgtgagccaccgcgcccagcctggagagctcttgatctgtaggtgaatcttagtatgagggccttggaggagcttccaagtgtctgagagcctcatgaaatgggatgcaaagttaggaatttctaaggagaaagtcagaggagcctctgattcccagccggctgctaagcccttccttaaccaaggttcaccctcccatgttgcctgctgggctgccttacagcagcctctagttccaacatctgctgtagatttctgacactcacagtctacccttcacctcttctctggctattaccagtacttcctcactatccctagtcatgggaaaaaaaaaaaagagaaccgtgtccccaagatgatcttgcctttgagccttgtgtgtttcctgacagggaaaaggccctgtactgccatgtcctcccctctggctgcttcatgccgggtcttctgcctaatacctgacacaaggagactcctccagactgaactgcgaggaaaggctttacaggcagaacaggctctgcagagttgctgctcagtaggccaggggtcagcagacttcatgctgtgtgccttaggccacatgagtgatcctcctgtagatatttcccatcagtgaaaacagagctggcactgatcacctcctctcttacagactgcggagctaaagtgggctgctggttggaatgtgctgtgaaagttggaatgtttttgcaaattttattttattttttgaatttgaagtagaaagctgtttgattataaatggtgacttttcccttctaaaatcatttaaaatttttgtaccctttgaaaatgacatttaattataggcactcaaagtgcagttgacaattattgttatttttggggaattgtttaaaggatgttcattcatgcatgcatttttttcattatttacttattcagaaagatgtggaagtctaatatgtgccaggcactgggaaacagtgatcctgctgctcatatttccattctacacccaagctgtgtacttggtcatgtggcttggatctttgtaaatctcctttaccctctttgccctgaagaacgttattagaacttggtatgcaaaatacaccattggctgattgttggaatacttttgagcaggtttgtaaccactttcagtggatgctgtgtgaagacccactaaagcagtggttctcaaggtgtagcttgcatcagtatcaccgggagggtttgttaaaacagcttgctggacccccatgcccagattctgtttcagtccctgactgcatttctaacaagttcccaggggatacttatgctgctggtcttggggatcacactttgagaacctctgcattagagacatttctttagacctaagggctttgaagtctcttctcctgagaaattggtgtggtttcattagggtttatcgtgaaccttgtttgtgaacctggttttctttttgtttgctttgcttcgcgtcagaaattcagattcaaatttgtagctcaactttaagaaaattttaacagttacatcttaacttttcccagccttgatttcctatttcattttccccattctgattttacatgtttacacaatataagttcctgtatactgactgttttgtggaatgtagtatatattgagaaatatgattgcagtcagtgttcttttcttggacatttgtctttcgaatcaactctaaagtattacatgttttgactgtttaatgcattagttatgggagtagattccccagaagaattatattattaatagcaactaaccaaaggattggaaagaaaaaattgggaagaaagtgacagaaagttcttggtaaaaaacagaactttatttttaaactattgatgcatagatagtatctacaagcagtaatacatatgcatatatctgtatgtttatatgtgtatatatatgtgtgtatgtatggttttttatttttatttttatttctttttgagacagagtcttgctctgtcacccaggttggagtgcagtggcgtgatctccgcctcccaggttcaagcgattctcctgtctcagcctcccaagtaattgggattacaggcgcccatcaccacacctggctaatttttgtatttttagtagagacaaggtttcaccatgttgctcaggctgcctcgaactcctgacctcaagtgatccgcctgcctcggcctcccaaagcgttgggattacaggcgtgagccaccgcacccggccatgtgtgttcttttaaaaactgagaaccctaatacataaacaatatactttctttggttgttggagaaaaagcgaagggatgaggtggtgatgagaacagtgaaggcaaactacagtggttgcccaactttactggagtcacctggagtttgttaagtgcgatgccagtttgctaggcctgggggtggggcctgcatttgtaataagtgtatcaggaaattctgacccacgagaggtgggagaggtttagcactgggtagaaaaatgaaaggcccaatctgtattaaacctgctccaaatctttgtatccatttttggatgaggagttcctgttcagattttctgcaacttttcctgaaatcagagtgtaatgggcacaatatcattcatattagtcagtcttagctccagaaagtactcattatgttagatgttcattggaagtagtttgtagctgatttttttctctttcttcgctctctgtatttctgtcttctacttctgtttttagttgaagagaagatactttaccaacagcttgtctgaaaacaatttgcagataggagtactcatagaaaactcttggggttctcactgtgggtcttctccaggggtgtggataacaccaaacactgcagtatggaaactagcgcaaaatgggatgtgctgtgacactggccagctggagacagttgggacaggggatgacttaacgttaacatgggaatgttacatacacagtctagaaaggccagatattcttttgcactgctgcctctggctctcttttcatctatttagtgaataaccaaatttatcacctgtagtaatcagttactaatttagaatttaatttctttaagagttacctggatttagggctcagtgaaggcagtttttatttaaaagcattttcttgaataaacattttagaacagttttagtattacagagaaactgtgaagatagtgcagagaattcccatatacccaacagtcagttttctgtattattaatgtcttaggttagtatgctacattgtcacagctaatgaatcaataatgatacattattactaattaaacttcatagtttatcagatttccttagattttacctactgttccatttctgtgttaggatcccattcaagataccacatcatgtttatatgtctgcttaggttcttctagtctgtgacagtttctcagactttccttggttttggtgagcttgacagcttgacaagtcctcgtcaggtattttatagaatgtccttcaaattgggtttgtctaatgtttttcctgtggttcaagggttttgggaggaagaccacacaggcaggcatagtaccacatttcattccatcatgtcatatcaattgcataattagcttttacatgcatacatgctatcaaaacgacctatcactgttgatgtgaaccttgattgcatggctaaaattatgtttgtcagatttctcacataaagttcctcttccccttctttccatactgtactcttgggaaggaagtcactgtacatagctcacactttagttgtggagaattatgctctacctccctgagggaggtagtatttagagaaattattgggaattcctctgcttgggagatttgtctattctcccccatttatttattctatcatttatttgtatcagtatggactcatgcatattttatattttaggttataatctaatatcacatgattgtgctcctcaaattgtttcagatttggtttttgggagctgtttcaataggctcctgtgtccctttgtgacatgccacccatcctggtgggtttttgttgttgcatgtgtgctttttaaaatcacatccttattctttctggcactaaaagatgcccctggctcactttgtatattctttgccccatccctagaatcagttatttctccagggaccctggttccttttgttggagaatggttttagaaaccaagttctgggcactgcgtgtccttgttgctactgaggtgtcattgcttttaggtctgttcagctgacggaacagagaaataggtgtatactcacccttgtatatacacatatctgtaaatatttctatatgtatccatctgtatctatattaagttgaacatgagttcatgctaatgttttcaactccgatacagtgttacagacctttttttactagcctttctcccttgtctgcaaactcctgctctaacagtgaaaaactggttcctaccacccaccatccatttacttacatgtatagtggtttcagaattgttaacttgtatcccttatgagaaagaactttattggctagagttcagtggttatgtgaaattcgttatgtaaaattcattttgcccttagatctagagtccatactcatttctgaaggtccttaagccagcatcttttccctcacttctttcagtgaggttatttcatgcattttgatacagttgattctcatgtcatagtctgcatttcatattccaccccaggatctcttgataccctaactttttaaattgcatatattcaagttctgtgtgctataaagttctatgggttttaacaaatgcttagtgttctctgtctaccattatagtatcatagagaacaatttcactgccctaaaaaaaattctctgataggcctcaactcatcatttggcttaacagtcctgctgagagagtcctgccagttgcatctgagagacagtcctgccagttgcacctgctgagagagtcct

SEQ ID NO: 106 - DNA, 8396 bp, Homo sapiens
  source 1..8396: mol_type = genomic DNA
ttaagtttcaggtcccatttatctttttgtcacacatttctaatctccctacaaatcagtatttttaaaaaccagagtcatcccaaaccaactgaccctctagattgccttacttcttgcagatttagtcttaccgtcttccagatactacagctgcctttgggcttttcatcatcccttatccttagccaccaagtcctgctgagcttcttttgtaatacttctctcctgcctcctccactgcacacttgtaccactgagacagtctcttaattctgcccagcacctccagccccatctacacccctctagtttgtcctccagcatgttgttttaggactgttgctagcctaattatttgaaatgaaatttcagttcttaacttggcatccaaacctttcgtccattgcatttctagctttaccttctaatttctagctttaccttctaattcacttaaatgagatacaatttaattaaaccatgtattccttgcagcttctgtgctgttttccacatctgtctctttccccatgttggcagggtaaattttagaggtgtaatgaaatttgcaggtggaagttatggggatatagattgtctttagcttaatgtaaggatgacctttccaacagaattgctaatgatggggtgggtatcatggaagaagtctacctgtcatctcccaggtcatctactgtcatctcccctttaaagacctcatcttccatatctgcacatttggcttctcctctcttttgaagctgcttgtttccatgtcccatgatgctaaacttggggactcctcccacctctcagattgtattttctctggttctttctttcactcctttagtgaatttgctttttcttttcttcttttcctgtgctctttcttgaaaaatttcactgctcttagacttagtgtttaccttttgagaaaaattcccaaatgataaccccagccgtatgtttaactacatgatttgtctttatttccaacatcttgccagatatttctatttgagtacttttgtgtccaaatttaaactcatttctttccctttaaaacatgttctttccctgagttccctggctgattagtggcaacagagatgggcagatctttctgtaaagggccagagagtaatatttttgtcttcatgggccataaggtctcaatcacagctactcatcttgtagataatatgtaactaaagggttgtgactgtgtttcagtaaaactttacttatcaaaataggcagcagctggcattggcctttgggctgctgtttgctgaccctgatctaggatacccaggccccaaactccatactcctttggcctttccactgcttttgtttgctctcttcacatgattattaattttcactgatttcacccttagcaaaccattcatacttctagaccatagctgtctgtctattcattcatctagtagacaaaatcttccttttacatgttaatctctatcattttacataatcaaaaacctctagtggctccccttggcctgcaatctaaggttacagttctctgggtgtagctctttctgtgttttgcctccagccttctctcttactcctgtatggacattcctccaatgacactgatcaagtgtgtgttctgatattagttctatcacttctcacaggttgctcctgactcagaatggtctcacttcccactaattgaaacttgccttcaggcctcaattcagggtctcacttcccaggtaaagcttcgccctagcccagtgattgctcctctcctagggctttttttttctttttctttttctttttttttttttgagacagcatctctctctgtcacttaggctggaatgaagtggtgtgatcactgcagcctccaactccagggctcaggtgatcctcctgtttcagcctcccaagtagctgggattacaagcatgtaccaccacatctggctaattttttttatagagatggggtcttattttgttgcttaggctgttctggagctctggcctcaagtgatcttcctatcttggcctcccaaaatactgagattacagatgtgagccgccacacccagcactgaatagtgcttttgatgttgccactgacctattcagttgagaccgcattgggttgtaatttgtggtgttcctccctctccatctgaattttcagaagctgttaaggacagcccagtagatgctcagatgtcataggtaaaggtcatacattgaactctttgtctttcctccagttctgcttcccccttggagtccctgtctcagttaatggcaccagggatcatcattgccttgtgattctgactccttctctttcacctccaccctacctgcatcagttacgaaaagtccagctgctgctccctcctatgtctttctcctatctgccctctcctctccatcccttctactgctgccttagctcaggtcaccactgtctttcactcagaccattggacttgccttgaacatgaattcccaccaccagcttctctcctcttataatcccaacagttatgtatcgggatctgacatgtaggtatgaccttgtaactttcctgattgaaacccctcagtggctccccattgccctgggataaggaccagcctgccagcatgtcgtgaggccattattgattggatgcactttcctctgcagtcctatttctgacttgtctcatttacacagcttacatttgatcatctgtaacccctatacatcttctgtgcatttgcacactccccgtctctgtgtagatgccccccctccccaggtccacttggaaaaccatcacctgaatttctaggcattgtacaaacgttccctcttttgtggagctttcgtctccttccctccagaagaccaagaggagtaaaggtgttatcatagaataactgttgggatagagatataggcttcatctattttctaatgcctcctcagattcagagtcttccaaagtttccctgcagactgagcaatgaataattaagcaaacaagtctctaaaacatcttgaaatgcttatgtatgctaaatatgtagttttgagttcttgttttggttttgctggagcttttgccttcttcctccattacaatggatgatgagaatcaacaatgtagaattattctcggttagtttatatcttgtttttaacctggtatcttcagtgtgttaagacatttttcctttcttgtgggggttcccctgcaaagaaggaggctcacttgtggggccgatgaccactgtctctaggcaacccagagaggtgtgaaagaaagaagggggctgtgaggctgcagggagtatattccccatctccagccagggtcacacctgtcacttctgtttagtacctcttcctagtaaggagaacgtatgctccctttctggaagggtctacttagcagaaacgaggagtggcgagctcatgtggaaagtgcttttttgatgtgttctttcatgtaggggacacacggtgtggaggggatgcacaattactcttctgtggttcctctttcttactccagggtctcctttgccatgaggtccctagggacgtcttatcagaggagaagaaaagtaccttcttagttcttttttgttttgttttgttttgttttattatggggtttcactttgtcacctgggctctccggggtgcagtgttggaatcgtggttcattgcagccttgacctcccaggctcaagtgatcctcccacctcaacctcccaagcagctgggactacaggtgcatgccaccacacctggctattttttattttttatagagatgagatctccctgtgttgcgcagactaatcttgaactcctggactcaagtgatcctcctgccttggcctcccaaagtgttgggatttcaggtgtgccttggcctcccaaagtgttgggatttcaggtgtgagccactgcagccaaccccttcttagttctggagagcagagtcttgcctggcatcctggtgctataccaagagtcctctcctggtttccagagaggacatttgacttcttcaggagaactcaccccactccttttggtccattaggagcaccagaagctttggacctgatgggctgggcttggtctcttcagagcctctgtcctcattcacagaggaggtatcaggtaggccttccagcacagaattacattacctgggaatttaagtgggaggaattgcagtggagtattttgaagatcctaaggcatccttcatttaatttacattttcgattcttcagatattggaatcaaagattgagacacacacataacactagagcacacagtagaccatttctaccttgagctatctccttgttagagaaaaaatagttttgactgtttgtgattttttactacgggcagaaaaactttgaaaaattaatttcaatgtaaaagagttttacttttgccagatgataacacttcctatgctagaacctgggggtactgggatctgacttgaagtaattctaagtttaaatttatagcaaccatgtgggtctgttcagctgggaggggagaaatattgcgagccataaggatgtattttagagagtttctttagtagtcttcagatgtctacttgccctgtacaaagttcagaaactgtttaggacttggaaccttagaatatcagatagaaaaggattgacaggcttagtctactctgtttttgagatgccgaagccaggtgacttcccctagtggcaggtaggcaatgtcagagttgtgatcatggcctggggctcttttccaacctgctctctgacctcacataggatccggattgagcagggtaaagggtggaccagtaaaggctttaatcagtaaagtaatgacagtgttttccttcatttgaaaccagtcagatttgatactacttttctgttcagtttttgccatcattgttttctggaagtttttaatctgtaatacctcttagtatgctttaacacataacacctagtgtcattgttatagagatgaaagtagaaaattagcagggatgtagtatttgcctattgcaacttcttttcctttaaaccccttcccatgtcggggggataccttgtgtgtctgcagcatgtgatgctgactcggactctccaggcagctgactaacggcacctaaactgcctgctgcattttccctgccccagcacagacttgcttagcagctcccgcctcgggccctcattgagaaccatccagcggcacatcaggctggtgccactcccagtggccttggcagtgaggaggtgaggcgagagcaccctcaggtgctagtggcacgagtcttgcccaggctcccaggggaatgagtggtgtgatgacctcatgtgccagaagccagggcaggcatgcttgaggctgagagaaagcaacagatggacctcaggcagaagcagtcagagcagcctcaagggaggctggtgcggcaccagcgtggcatcttcccagcatctgaatgttggcttgaccttcgctgtttgtgtgacctcacccaattcagtaacctcactgagcctccctttttccatctgtgcaacggtgatggtagtacttcactctgcaagcggtggaggtgagagataatataggtcaagcatttagcagttggccaagctaaagacatagctgttgtttttgttattagaaacacagcctcagccaggcacagtggctcacaccagtaattttagcactttgggaggctgaggcaggtggatcactggagctcaggagttcgacaccagcctgggcaacataatgagacctatctctacaaaaaatacaaaaattagctgggcgtggtggtgtacacccataatcccagctacactggaggcttagttgagaggttggcttgagcccaggagatggaggtttcagtgagctgtgattgtgccactgcactctagcctgggtgacagagccagactctgtctcaaaacaaaaaaacaaaaacaaacaaaaaaaaacaagaaaaaccaatacaatctcatttttcctgttaggttattcatacaaacctgttggaattttttttctttaggaatttgaatgctcatttttaagccagacagtttcaggtggaagagaatcatgaaatgctttatcatgtttttgttatttatcgctagagtaagacttaggaaagctatagaaaagagccatccagccaagaatttgaattttgtcaacttctctattacagaggtttgctcaaagcccatagagtctagatgaaccttctacctttgcccccaaaattgcttttttcttttaatatgctagatccctttgcttattccaggctgaaatgaatgttatgtagctagaagtttcctgtctgtgatcaattctaatggcttttgtgaagggaaatggttgtaaattattaccagttaattaaatgagtgtttctcttgagtcctttgtgtaggcttttatccaagcctgtttagaatcatggaacattacagctagaatatttttagacaactcttgtttcatggacaaggagacttaaccagtgatataagtacttgcctaactcctgcaaagtgatgccaaggaaaagcaaactttggctgagggtgtaggagtggctgtgctggggatccggtgggtacatcaagctaacagagtataatttctaagcagtgagcccttgtcatccatatgtcaccggtattccttggagccatcttggagtgcttttattttttacaaagtgctatcttgtaggactattctatagtaaatattacctttcctatttttataggtgaggaaattgaggtggtcagatgaccttatttagctcttagatcaactcagcagatatgtattgagtgtttacttggttcaaggaactctgcgaggctccttgggaacataatgtcagatcctgctggaatggaggttacagacttattgcaagtgatgagatatgtgtatgaaaatgtaagtaattgttcaaggtatagataagtgttaataatagttgagatgtgaattttgagaccggagggatcaatgtgaatatcaaatcctggcaccagtttcttccttctgctgctcatgaagctgtgtcatcttctgtgctcggtaacccatccaacctgtagccctaggagctcctctggggagtcttgagtaccttgcagttgtcccgaccctgggagtcattcaataaaggttcaaatgaatgaatagataggtgcggtgaagagagacaggttttccaagcagagaacacggcatgagcaaatgtgtggctgagtgatagagccaggagaggggcctgactaggacagcaggttttaaaaagtgatttttttcttctttttgtattttaactttctaaagtgacaatggaaggaagggaattttgaaaacaaagtttggatagattagtgggaaggcagcaaaaggggagcccaagtggtcctgaaagccaggtggagcagggtgttttattctgaagactctcggagaccagcggaggctttagagggggaagttgatgagatcagcactttagaaaaggctgctttgtttttggtggggtgttccatgactgcaggagaaaggatgagggaggaggcctgcagtgacagggatcctagaatgatggagggaacgaagggaaaaacagatggtcacggtgcctcaagtcggagtggctccaggattttaagcctgggaacgcagaagaacagtggttctagtgattcagtgatgaccactggaagctttaggaggaaacatgggattggagccctttaaagctggaattggccccttagagagaatctggctcaggcttcccagatggtggtccgtggtctggctatatcagagttacctacagaacttttaaaaacagcagatgcctagaccccgttcccttgccccagaaaatttaaaatcagtagatcacctgtggggtctgggaatcttatatttaatccctttctgtgattctttggcaaagaagattgaatggccttcctgatgtcgcagattggtcaggacagagcaccaggacccaggtcttctctagcattgctattactcagccacaatgtgggagataggggataagttcagatggggaggtatagtatttgaggcagcgctgattcatgtgagttcaacactgatggctctttgaggaaggggttacttggcatgagaactcaagggttagatggctctgagggtgcacgttgggaatcattcagtcaagaaatgctttcccgagtggctgctgcaaaccaggcataggatattttcagtccacttcgggg

SEQ ID NO: 107 - DNA, 7268 bp, Homo sapiens
  source 1..7268: mol_type = genomic DNA
atctaataatctgcatcacttatttgtgcttgaaacattcagtgttaaccccaccctttcctttttctctaggcaaataagggcgagactgaaaaatcaagtcactcagttgaaggagcaagtacctggtttcacaccacgcctggcaatattacaggtattatgatagtgtattttcattaatgttgtctttgcttgatttctcagtatcatttcagacctctccctctactttcctcctttttttttggctgttgtgtaatctcatgccttttcagtctctcttggcaggctcccccctttggctcagcttctaaatgttggcatatcctggccctctgctcttctctgtggataccctttctctaggccagtgtctcttaacctttggtcttagtagggcccctttacaatcttttttttctttaatttaatgtatttatttatttatttacttttgagagacaaggtcttactctgttgccaggctggaatgtagtagtgcaatcatagctcactgtagcgttgaactcctggcttcaagcagtcctcctgcctctgcctgccaaagcatgggtattacaggcgtgagccactgtacctggccccgtttacactcttaaagatgtaagacctcaagaagctattgtttatacagatttatccattaatgtttactatattagaaattaggaagttttggccggacacggtggctcctgcctgtaatccagcactttgggaggccgaggtgggcagatcacctgaggtcaggagtttgagaccagcctggccaacatggtgaaaccccatctttattaaaaacacaaaaattagctgggcgtggtggtgggcgcctgtaatcccagctactctggaggctgaggcaggagaatcacttgaacccgggaggtggaggttgcagtgagccaagattgtgccactgcactccagcctgggcgacagagagattccgtctcaaaaaaaaaaaaaagagaaattaggaagttttaaaaatgtttattcatttaaaaatgccaatagtgagctcatttattatatgttaacataaataacattttatggaacaaaaacttttttaaaaagaaaatttagtgaaaagaggggcattattttatatttgtgcacacctctttcctgtatggcttagtagaagagagctggagtcctatctgcctctgcattcagtcttttgctgtgtgctggtttgattgaaatatatggagaaaatttggcttcatacagatgtgtagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcacattttatcattggcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatctcccaggctcaagtgatcctcccactcagcctccagagtagctgggattacaggcatgcgccaccatgcctaatttttttttttgagacggagtcttgctctgtcgcccaggctggagtgcagtggtgcaatcttggcttactgcagcctccgctcccagattcatgcaattctcctgccttggcctcctgagtagctgggattacaggcacctgccattgcaccctgctaattttttttttttgaaacagaatctcgctctatcccccaggctggaatgtaatgacataatctcagctcactgcaacctttgcctcctgggttcaagtgattctcatgcctcagcctctggagtagctgggattacaggtgccacgcccagctaatttttgtaattttagtagagatagggtttcaccattttggccaggctggtctcgaactcttgacctcaggtgatccacctgcctcagcttcccaaagtgctgagattacaggtgtaagccactgcgcccagccttaattttttgtatttttttgtagagtttttttttgccttgttgccctagctggtcttgaactctgggacccaaagtgatcctcccattttagcctcccaaagtgctgggattacaggcatgagctactgcgcttggccttaattttttgtatttttttgtagagacggttttttgccttgttgcccaggctagtctccaactcctgggctcaaagtgatcctcccgccttggcctcccaaagtcctgagattacaggcatgagccactgtgctcggccaagttgaagtttaagaaaattaataatgtatatttcttcatcaagggtggtcctagtgaaactggcatttagttttactgggagtgtgtggtagtgaaggataccttgactactagtccaaagccattgtcttgatttgtgctggttcactagtagtcttacacaccattgcttttgcaccatcggtacagacgttaacacaatgaaaaaggcaaacaacattgtagtggtattattatgaagctagtctggccctcataaatctttgaaaaggtcttggggtccctcaagagtgtgtgggccacattatcagaaccattattttaggcagtttcatctatcaggccagtgacttctaaatctagatttcttctgagctccaggctcttggtctgggacaccactggtttccttcccaccttcaagtctcctttgcttgttgttgctcatcaccctaatacctaaaccatttgaatgccttgggctcacccttgagatctcttccccatcttattctttccctaagtaacctcacccagtcccatagcttcatgagggaatgcttccaaatttaggtctctatccagtatttcttccctgagctccagattcacccagtagggagatattcaatacatatttttacggacaaatgtatgaaggaatgtttgcaatcttgatttggatgacaggaaactcacggctttcatttgaaactcccatcagagtttcacccaagttggacatagtctccttctcaatctctttatttgtatgtctccaatagatcatttaatcccttgctaaatttctatcccttgttcatcaagaatgtcaaggtgggcatggtgcggtggctcatgcctataatcccagcactttgggaggctaaggcgggtagatcacttaaggtcaggagtttgagactagcctggccaacatggtgagaactcatctctactcaaaatacaaaaattagccaggtgtggtggtgcacacctgtgatcacagctactcaggaggctgaggcaggagaatcgcttgaacctgggggacagaggttgcagtgagctgagattgtgccactgcactccagcctaagactccgtctcaatttaaaaaaaaaaaagtcaaagtgaatagtacttaaatattcccctctcctcctctgctgtttgtctaagagggcttagctgagaagaaaagcacagaaggcctgtcactctctgcctggcatgttctctgctgtggtggattttcccttttttgcaaattactaagaatcaaaagtatatattgtgggtgtatactggtacatttggtggctggttatttcttggcttatttttgcaaattgtttgttgtagaaagagtaaatgtcataggcaagaagtataccctttttaaagcaacattgggggtgttttttttcctccattttaaaaactgacttccaaccttgttttttaaatttattgattacaaatgtttttattacataaacactgttctacagctcgtctcctacgtccttgctgataaaacagtggtagaatcttttaattttgtactttagcaccagagtcaacagctttctgtgatacaaggtttatataatatgttgtaatcacatctccctgcctcagacctctagtctttttcgctgtggtgctggcaccaccatcttcccacattccctgagctagaagcctgaggccgtctccttaggagctctcttcctcactccctgcatccagttaggggctattgtcctattgattgtgcctctcatcaactcttggaatctgttgcctccccttgattcctatttctcccaaccctggggccactatagttacctgcttaatgatttggggttctatctatatacctcctgtctgtcctcctgactgcaattgcaatccttgttaaaatgcaagtctgatcacaatctatccagccacactcactctccatcctttaccagaatgatagtacaagttgagtatcccttatccgaaatgcttgggacaagagtgttttagatgttggaatctgtatatacatagggatgagatccaattctaaagcaaaatttatttgtgtttcattatataccttatacttgtagactgaaggtaattttatatatatgtgtgtgtgtgtatatatatatataataataattattattattattattttttttgagactgagttttgctcttgtcacccaggctggagtgcaatggcacgatctcggcgcactgcaacctccacctcctgggttcaagtgattctcctgcctcagcctcctgagtagctgggattacaggtgtgttccaccacgcctggctaatttttgtatttttagttgagatgagatttcaccatgttggtcaggctggtcttgaactcctgacctcaggtgatccgcctgcctcggcctctcaaagtgctaggattacggacatgagccactgctcccggccaattttatatatttttaataatattttgcatgaaatgcacttttaactgtgttttgactgtaagccatcacatgaggccaggtgtggaattttctacttttggcgttgtcagtgctcaaagtttctgattttggagcattttttatttgtggttttttttttttttttttttgagacagggtctcactctgttgtccaggctggagtgcaggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatttttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggaaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctcttttttttttttttttgagtcagaatcttgttctgtcatgcaggctggagtgcagtgatgtgatctctgctcactgaaacctctgccctcccctgtcccccaggggatcctcccaccttagcctcccaaatgagctgggactacaggcacaccaccatgcccagataatttttgtattttttgtagagatggggtttcgatatgttgcccaggctggtctttaactcctgggctcaagcaatccacacaccttgacctcccaaagtgctgggagtataggcatgagccactgcacctggccaaaaaactgatttttaacagtattcgggaactattcagagtgctttatgtatagtaactcattcagtcctcacaaaatacatggacagaatacagttaataaactcaactagcctgtatcttcataaggttttctgaaaca

SEQ ID NO: 108 - DNA, 4522 bp, Homo sapiens
  source 1..4522: mol_type = genomic DNA
ctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatctccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaagcctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcagcaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccaacttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacttccctgcgttcaccaactcggaagctctcccaatcctgtcttttagggattttgatggaggcttcatcatataggcatgatggataataaattcaatctccagcccctcttcccttcctggaggatgtggggtgaaagttccaagctttgtatcatggcctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgcaatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccg

SEQ ID NO: 109 - DNA, 16494 bp, Homo sapiens
  source 1..16494: mol_type = genomic DNA
tgacacccatgaagaaattagagaacaaaataggtatagtcagatgccatattgtgtggtttaaattctgagtgctgagggggaaaagaaagatgacatctttggggtgctagagggggctttggggatgtgaacccccaaggtgtgggatgaagttcccccctgtagtaggttccatgatagctatgcaacagcattagttgctcaaataaattgaagaaaggctgtttctttgatacattgatgggcagagtgactctcaatgggaccatggaatcttagaccctttagtaagaaggataataaaaattgttttgccaaacaaaaaaggaaggggaagcccagagaaattcacctctgttgatttcaaccaatgttctttttgtaaaatttaatttgtgtaaaatgtttaaatgcatgatttaatttttaatgcatgatttaagttttaatgcatgatttaaattttaataattaataactttaatgtctatgattgaaggttaaaatttgataagcaatttaatttctaagcctgatatttctattttctcataaagtaaaatatgatgggattaaaggcaggacagactcacccttcctggtttgtgattgagaaggtcaccgatggtcataattgcctccttttttatgtgctgttgccctgctaagacatttcttgaaacacttcatactgtactcacccaaggtttctaaagctgtcaatgtcaattgcttttgttcttaccctaacacatgttgtcacatgagaaacataaagcctttcttgtgaagataaggtgagctattatgggtgcctaaaaagacttggagattaaggataccctctatgacagtcaggtcatggcaagaagcagaatgcaccctagatggatcaaatgaagacacttgaaagaaaaagatacttacacatgagccgataatagggcaccaacagtggatgttagggcactcagagactagcatctgagggatggggggagggaagctgttattacccttatatctgaaggaacaaggagagtaaatagtgttactggagcccagtatgagctgcaccaggaagaaaggaaccacccaagaggagctgtaggtatggggggtggcaaatactgccaaagacaggcatgacatcagggagacggagagggagaaaaagatttgatctcactctcttcctgtccccagtctcctgctaatgtcccctctggccatacccaaccagaaatgagctgtcaagggaggccaggaggtgcatccacagaggtcaggctttgtggcatggagcagggcagagaagagcagagaatagatctgagtagggtgtgtgtgtgtgttgccagggagcagggggtggccagccaggatgttctgagagcccaactagaaaaagccgcacatgatggatgccatcagctactctgaagcaactctagtcaggtaaccaaaggttgagcagacccaggattccactcacagtgctttggatattattcttgggaagcagaactggaatataatttcagttaaggaactctgattgaaaattaattgcattgtacccaatctgggagttgtaagaactctcggagtttggacagctggggtgagaaggctcggagagcaagaatttggccatgtgtctccaacactatccaggggagaaggtaggctcactataaatccccttcaagccttcccccaaaggggagtgaatgcattagactgtcatagctcagtgatatctgccatgaagaccattcgtttcttctcatggctctgattccagagtccccagaagccttgtgtttcgcatttgacttctcataaagctctgtgctgattagcccacaaagggttctgattctcttgacagctataactcattgtaaattaataaattggcgtctggtgtatctgatgaactagagcattctgaatcagggctttacatctcctcagtcacctcctgcttcatcttcagggaacagtcacacctagagtcaataactcagtgtctgaagctctgatgaggagtaccacattttgaagtgaggactttgcctttctgcacaacctcgccaggcagcctcaccagaacatgtctttacttcacttttccagctgtagtgggaagctcacagtacatactccacctgccttttcgatgcttgttcctaggaaagttgagaacccaaggttgtaaggggactgtgagactagccattccattcccctctatccccccgcccagatcattttttagaataggaaggagcatgatgagtggatgaatgcacgcatgaacggatgcctggatggatacagtgcatggatggagatatggctgcgtggctgcgcagatgaaggcgtggatgcacggatgtatggacggtgctgtggccagggctgctcttcaacacacactctgttcttgttgtggcagaggcttgggtgccctgtgccactgctgcagccatgttgttgtatatttccatgcatattattagtgccccacctcgggcatctcctttttctgcttcaggtcattctccaaagctgcagaaactcagcctaagtgcagagcaagcaggaagtgcagaggggtcaacatcctcaggggtaaccctcaacccatgatggatgaaaatccatgcttaaatgttccagcctcccatccttcaaaggaacaattctgagatacattctatatgattcctcagaggttcgccagcaggactgacctgtccacaacagtaaccaactcagcatcacgccctttactggcttttcctccttccctgcctcactctccccactccctcactcctgcttcctgggatcatctccccccaaatgctcaaatccttgtctaaggctctgcttccaggagaaatgaaacactggtcaaactggtctatttctcttcctctggaaggaagatgctggtatttattcatgcatatatgcattcctcctttccagatgagcaaatcaaggctgagaaagattaaggaactttcccaacttcacaagacaataagtgacattgctgagctaggtggataccaacctataggacaatccttagttatgggcctgcagaatctcacagctggaaggactgaggactcagaatcacctagtgcaatgtttctcaacctattatgaccttcccaaagagccttttaagacttttttttcctaattacccccatgacattttaatactaaaactgtattgcatatctaactatggacactctctctctctctctctctctctctctctctctctctctctgtgtgtgtgtgtgtgtgtgcttagctagatattctttgtaatgttgacaattttaaataattttcagcagttgacataattactggtgggttgactcacttagaagaatgaaatagtaaaatataaattatttttatttatttctcaaggcttaagttacacacaaaagcactgaggatcaaacataagcaacacccacaaggcagctaatggcagccaataggcacacacaaaccagctgtcatgatggaactttctcatgcagcaagcaatgaaaagaaagtccccgcatcccaaccatctattcaccatagctttgcagcactgatcttgcatgcattttgcgtatctcccatgaacttaacatcgatgctgttcatttaatacccaagaaaatccaattagagaaataagcactaaggaataagatttttttgcctggtatggttgcactttggcaggctgtaaactattgtaatatctaagattttttttgcctccacaagaatcatgttttacccccttgggtgagctgagaatatatgatttagtccaacaccatcattttccagattagagggacactgaaggctaaaggtgcagtcacatgatgagacaaagccgaatggagtgaaaatcagatcttcagactccaggcacagagctcattttaaattacccaagaggcggagtgtggtggctcacgcctgtaatcccagcactttgggaggcctaggcaggcagatcacctgaggtcaggagtacaagaccagcttggccaacatggtgaaaccctgtctctactaaaaatacaaaaagtagccaggcatggtggcgggcgcctgtaatcccagatacttgggaggctgaggcaggagaattgcttgaacctgggaggcagaggttgcagtgagctgagattgtgccactatccccaagcctgggcgacaagagcaaaactccatctcaaaataaataaataacccaagaaccttgctcaccagtcaatatgaattaggcctaggctcagctagtcttggtgctttccggccctcaatttttgttggggaataaaaaatcttcatttcactgtggaaggtatggtgagtattaagctgtgttatggtgtctccctgaccccatttccactggagcatacaaaagcagagagctaattatatgatagtaattacctggaagttgtatgtttattggttttccattagtggatactattttcgaactcttcgttgttatgctctagcgacaggagtcacactgtctctactccaaatgtcccctccaatctcatgattagcaggctttttacatggggccattgctggcagcatgagacacccccagggtagggaagggaggtttgactcagtccatacaggaggccccagaggtctccacccacattcacgggcacctcacttgaaaagagcctttaataataaagtactcaacatctggtctaaatgaagcatattcctccttgcccttggatactgagaatcgtatccaataggaaggggcctcccctgtcaccagatatatttatgtatccttcattatgtgccttggttaattgtccctttcctttttttttttttttccttgagaaggggtctcattctgtcacccaggctggagtgcagtggtgtgatcttggcttactgcaacctctgcctcccgggttcaagcaattcttttgcctcagcctcccaagtagctgggactacaggcgcgtcccaccatgcctggctaattcttgtatttttagtagagacgaggtttcaccatgtttggccaagctggtctcgaactcctgaccttgtgatccacccaccttggcctcccaaagtgctgagattaccggcatgagcccctgcagcctggcctaattgccccttttctaccagctcttcttacaacagagaaatcctgagcctcgcttgtaattatagtgaggaaatatttctatgagcttttaaaagggaagcctaaactgggtcaaaatgttgaaggtgataggtcagggagcaagggtcaatactagctttactctgatgagttgattgctaggggctttgagtgtcttttgccaaatttgagggccctctcctagaattccactatcagcacctcatcctattgttattattgttacaactgagattgatagacatctgtggaggattttacagtctgcaaagtgccttttacatgaagtacatcacttatcttcactgcaaatgctgagggcaagttagattacttggccctacttactgcactgttaaaatgcatctcttcactcctccagaagggccacagggcacttgtttccagtcatatttatgtttgttgtgggtaaaaagctagcttgggctgggcatggtggctcatgcctgtaatcccagcattttgggaggccaaggcgagaggccaggagtttgagaccagcctgatcccatctctatttaccaaaaaaaaaaaaaaaaaaaaagctagcttacagtactagtagctcctgccttgttcataggaggatctcagcacctagcaaaatgcccaacacgtagaatacaggaaatgtttattgagagaaagaatgcatgcatctagcctaggagtttttttcctttttattttttatttcaatagcacttggggtacaagaggtttttggttacatggatgaattgcacagtggtgaaatctgagattttagtagcataggaattcaagtgactattgctcatttataggccctctccctgttcagtacattctcacatccatgcctttgcagattccacgtacttgaaactccctctaaaaatgtccatcagctttggcgtggatgctactaatttagagaccctcccggggctacggacccacagtgatcctttcttttctgaaatccttcagccctcctcacccaaatcatcagtgccactcagccttgacatcagattggaaccaattaattacctgctaaactacctcatgtaagaaacaggtctaaagatgtaaacagccttgcccagtgagtcagtggcaggcagggtcagacccagaatccaggtcttttattagctgcccagtgtacttcccattacatcaagaacaggaaataggtttcaccatgactatcacctttgatcaagctgtggtggccgcccagagtgatagactgagaatgcctgtgagagagcagcccaggatggtgggaaagagtgctgcaatcgcttgatcatgtctgccaggctgtggaaatgaagagtttggtgtggagagtggctcacattgcaaaagttgggacccccatttaatctgacctgaatcctccactgtaaggatgttgttggctgtcccttcactctcccaactccaagagaattgattcagggcaactcccttttgctcacattaaaaagaaataataagcttttttttcttctcagacagagtctcgctctgtcacccaggctggagtgcagtggtgtgatcttggctcagtgcaacctctgccccctgggttcaagcaattctcctgcctcagcctcccaagtaactgggattacaggcacatgccaccatgcctgactaatttttgtatttttagtagagatggggtttcaccatgttggccaggctggtctcgaactcctgacctcaagtgatctgcttgcctcagcctcctaaaatggtgggattacaagcgtaagccaccacacctggccaagaaagcataatctgaaggtcagtcctggggttaggtcagaacttccctcctaccctgcttggagttaaggatatagtgcttgttacttgtcccccaactccagagtcagcttcaaagatttgactgtgtatttgtacaattagaagagtaatctctaggaaacaagcagctcagtaatgaaatgttacaatcccagcagggccaagcaagcctattgtggtgctttctaggcagaaggaggcttaaggaaaggatcaagcacattgctgctaagaatgtgcaataccaactccactgagagagaagcacggttgcaaactaggggacaattagatgttttccttctttgtggatttggaagagtggttgcaaacacagatgcctctaagggcaacacagataatataaataagtgaatcagcctgggtgtagggcagcagggagcagtggggactgtggctgagagtgcctgtcctacctaaaggatttccaattctcaggtatttttaaaaacgtagtactggccagccggacgcggtggctcacacctgtaatcccagcactttgggaggccgagataggcggatcatgaggtcaggagatcgagaccatcccggctaacacggtgaaaccccgtctctactaaaaatacaaaaaaattagccgggccgtggtggcgggcacctgtagtcccagctactcaggaggctgaggcaggagaatggcatgaacccaggaggtggagcttgcagtgagccgagatcacgccactgcactccggcctgggcgacagagcaagactcagtctcaaaaaaaacaaaaccaaaaccaaaaacaaaaaaaaactcataatactggccaaatagaagatgtttgcaggcttcgtttggttttaggactttagactgaaaacattacagatatgtgtgtatccaatctatctaatttatccattacttaatggcaaaaactgaaattacttttgcaccaacctaataaaagttatgcactggtggccgggcgtggtggctcacacctgtaatcccagcactttgggaggccgaggcaagcagatcacttgaggtcaggagttcaagactagtctggccaacatgatgaaaccctgtctctactaaaaatacaaaaattagccaggtgtgctggcacacacctgtaatcgcagctacttgggaggctgaggcaggagaatcacttgaactcgggaggcagcgcttgcagtgagctgtgattgtgtcactacactccagactgggtgacagagcaagactccatctcaaagtaaaataaaataaaataaaagttatgccctggttaatcagaaaaataaagaagcatacctgatcctccggatggtagttctgttttatggaacagtgtgcctctgctgactgtgatcagtcctgctgaccctggatatcatcccagactcaataactcagacttaaagaatggtattgaggagaaggagatgctttggggtaagatcaagccctagactttgaaggtgagatttcctgaaaagtgggagaagatttgcaagccagagtaaaaagatgtgcaagtcagatctgtaaggcagaagcacaaaggaggaagctttctcagagaagcctgaggctggggcacaggattagagactggtagggccccaggtaggactgagttgtgcaacatggcagccctggggagggtttaacttattgatgtgctccgtcaaactatgaaaaattatatagcacgcaagcttaaaatgtttcccactactacacagagattcccctagatatcttatcctcctagtttcgcctcatatgacattgctgtggagataaagaggtcaggcagaggaggagagtggcctctccctcctgtgagaaaaggcacttgctcccaacaggatcaggagtgaggactcagatggtcctcgcaagccatcagggggagcatgtggtgttgaagagaccctgccgttcaaacctccttgctggtagtgacactgagggactggaaccccttaaggggaagcagctgaggtttgggccagctcaggtgaagcaggctggctgccctctgccctaatcctctgaaggagctggaggtaagaaatgctctgactctctcacaggagggctggaagacccagttcagtgggaactgtaaaatgcttgggaaaacagagacccctattaatgcaaaatattattatgaaccctccctccccacatacttttcaacctcatgaggtgttgtctttaaggcccagtctggtttaaattataagatgaataaactcacctgacctgacaagcaaatgttctgctggacccacagagccttggaaagagcagcctttgcttctccgcccgtttaggaggagcaaccctgtgggcctgtgggaaatgcatggactgggtgtctggcaggtctgggtttgaagctcagcttcatgagcagtgggccttggccttgctgcgcctcattttccccccctcacagggctgtcttgaggctgggtggagtagtcctctggaagccctgaaggtttgaccgttctaaagcagtgtttcaggtgaatttatacattgatgggaaggaaagaaagtctgttggatttttagacgatgcttatgctttggatacaatcaagctctttccccaagggccagaccagggacaaatgagctgtatccctagtaagctagctttcttttaatatgaggatgtattatttgccacaaaggacaaatgtgaaactacctcttgatcagtcacagactgtgggcctcttgggagtctgggaggtcacaggtcaaggcctagagaaatggctgtgtcctaggattagggacagtggaactgctttctctcctgaggcctctttggtgtggtcatggggtgctgctgatgtctgcagccctctgggcactctctcaaagctgccctgtagctggaacatctatctgcatccctactcagcgcagaggcagtgaaatggcagcaaacaactcccttctatttcctggtggcttgttctctgggacacggagaagagcatggtgactgccaggtttcaggcctatctagcagggcaatgagagctcctgggcacctgaggattcagaaccacttctttctttctttttaattttttttttttttttttttttgagacaaagtcttgctctgtcgccaggctagagggcagtggtgcgatcttggctcattgcaacctccgcttcccaggttcaagcaattctcctgcctcagcctcctgagtagttgggattacagacacacacaaccatgcccagctaatttttgtatttttagtagagacggggtttcaccgtgttggccgggattgtctcgatctcttgacctcatgatccgcctgccttggcctcccaaagtgctgggattacaggcatgagccaccgtgcccggcccagaaccacttcttaattgaagagaacatcttccttctctttgtctatgggataaagtcctatacctgtaaccaaggccatacccaagggtcccccaaatagctcaactcaactggctgatgctcatgggtagccatgacccctccagcccattgcccagcctgtcacacgcttcctgcctttacacatgccactccctcacttcctatttctaccagatgaacacctgcctgtttatcagtgtctctgagaaaacatccccctttccccccaagagcaagggcaaggctctgccttcattgcatccttagccctccaagctagctgatctactctcacatcactcccctgaccagcatgtagaagcaatccacacagaagcaggcctggcatgaagtgtggtcctggggcccctgttgggccatcttaactcattggttgcttgatcatgaggtggggcccaaagaagtgacagggctgctgggactgagggaattactcaggcaattgatgctgactctacctttttgtgatcaatctggtctccttggttccaggatttggagctctgtgctccagcaatgcaagctgcctctgaaccatttgtcttgtcctcctgccctaggactttccttctgcctttgactttaattttctgcatggatcctggacatggttcaaacttctggttctagtggcccaactctctatgaagaagaattccctgtctcagccccagaatctcaggttttcacccagcttgctatcctcaagggataaatcagactctttcctctctgcatcccatctttttgttgtataacttattttgggttttgcttgtttgttttttgagacagggtctcgctgtgttgcccatgctggggtacagtagcatgatcacagctcactgtaggttcaattttctgggcttcagtaatccttctgccttagccttcccagtagctgggaccacaggtgtgtgccaccatactcggctaatgtatttttattttttgtagaggcaaggtctcactatgttgtccaggctggtcttgaactcctgggctcaagtgatccacctgccttggcctcccaaagggctgggattataggcatgagtcatcatgcctgacctaacttatcattttgtcttctaactatttgttttcatgactaagcccctccctggactgtgagctatttaagggcagagtggatgtcataacatatttcataaattaatgcatgaatcaatgatgatcagtgtctgtagtattacaatcacttgtaatgctacagatgatattatagccctatgaattacatagaaaatcatttttatcatccatgacttccatttcaagtctcccaagagggaggaaaaagaatctctgcctgtctggccccacgtggagtccaaggaatattatagttcttttccttgtatttttctaacgccactacattttggggggcttatccaccttagtacctactaagttcaaatttggactaagtctgtagctcggttgtgcattttgaacttcatcttaaattggtcatggcccattgctactgcttcacatttcctccgtcgtgttttctcttttattgcttctataggttgtgagttaggataataaagtcaagataaaattgctccaagccatttgcagctctgggaagctggcacagggctgccaggagctggctgggtgccaccaagaggaaaaaatattcttccgtgttgccagccttatcaggactcctcacagtttcttgccaaaattttaggaaaacgatgatctactcccctgcagctattctgtatgtttctataggtggggagtctttcaacaaggattttcactaaaaatacctctcatgtttttcccctggtttaagactgtaacttgagctccatattgtgaaatactgacattgagatattaatcactgtgcatagttgaggcatcattgtcatcatcatcagccactcacactaactgaaagtttataagctatggaatcccactcaggacgtgctcatgaaagaataattggagattattttttaactgtgaaaaatgttcttttggaggaatgaggaattgggaaaataggaacagattatagaaagctggtaggaaatcacaattctattcttttattttctttctgtttgtttttccaagataaagggtctccttatggtgcccatgctggccttgaactgggctcaagtgatcctcccacctcagcctgccaaagtgctgggattataggcatgagccactctgcctagcctaaaattttcaatttttttatggaggtgtggtctcactatgttgtccaggctgttcttgaactcctccctcctcggcctcccaaagtgttgggattacaagcatgggccactgtgcccagcccacacaactctactcttttaaatatttgctctacatctgtttgatgccacaacaatgactcaattccgacaattcaatttatttatatgggtgtggcttttttttcttattcgatgggggagtttgtctatctggcatagacagacaagccaaatttcaaattcttgtttaagtgttgagaagatatggccataagcatgtctttactcagtcaatcaattgaacttcaatcaacagtgcctactgagcactaactatgtgcatgcccagtcctgtgtttggaaggatacagagaataaggtaccatttctcccttttctttattaatttatagtctagtcagaatttatagactagtcaggcagtcctgggctcaaatcccaatgctataacttagcagcaaagtggaattttggcaaatgatctaatatctctgcacttctgtctcctcctctgtcaaatggggtgatgataacacctaattcacagggctgctgtaggaatcaagggagattgtgggtgtattctgtggggtgtatctataagtattggctttcttccccttcccttagcctttagcctggggtaacctcagtggagaggattcctagaagccctgtgtaaaagccttcttcttaaggctaagggcaattacctccatggccacgtgaaaatgggcgcatagtggctggctttaagtgaaggctgcaaactggctgcccactggccaaagccagagttagacacttccaattagtcctatatgatgttaaaaaaaaaaaaagtaatctgcgggcacagtggctcatgcctgtaataccagcactttgggacgctgagctggggggattacttaaagtcaggagtttgagaccagcctgattaatgtggtgaagcctcgtctccactaaaaacacaaaaattagcagggcatggtggtgcacgcctgtaatcccagttactcggaaggctgaggcaggagaattgtttgaatctgggaggtggaggttgcagtgagccaagatctcgccactgcactccagcctgggtgactcagtgagactccaactcaagaaaaagaaaaagaaatctgttgcaagcatttaaatatcaaaagctattcattaaaaccccaatttggggattctcttgaaaatcggaagattctggcttttgacatttggatggagctgaccacaagctactttctttggatgggtcaagcactctccagagtgcttgtgacttcccacagggagatcagatgtggtaaaaggacaccattagttcagatctagccaaagttcaaagcttaagaaaaagaaccaagccaagaatgatgagccagggcagccctgataggacccaccagaagagtaaaggcttagttcatttaacaaatattattgagcaccttgatgtgcaagtcactgcattgggtgcaagtgggaaagagaaagaacatgtgttgggagcctactatgtgtcaggctctgacatgagctcatctaatccatcaacttcttgaggtaggtattaagattttttttttttttttttgtaaatgagaaagtaggattaagtggctaaatggatcagctgctaagtgctggagtcaggatccctgtactctgagggcctaggtttgtcctctatacctcaagcctgcgagagcaggatggaatgcgtcatatgttcctctgtactgttccatgtgcaaactgggcacatgactgtggattgtgtgaattttctggtgaacgataggacagtttttcctctggctcctgctctcaagaagattctagaagcaaaggagacgatgattgccagacaatgaccaaccaaaggctgtggggctcaaggctctgggaggaggcagcgtgtgaactgggccttaaaagtcaggaagtttttgataggcggaggaggcaggaaaggatatgcaaggcatggggacagccccagcagagacacgaggagtaatctggagtatgtggggcacaaggtggtgcatggatggggcccaaaagtcaggatgcagtcaggtcctggatgaccctggtgcagctaaacaatccagacttcctccatttccttcctggggccattcctcaggcccatccttttctctgtccctcttgtccaccggatctttctgctccctgccatggcttctggagcacaagagagatgagggaactcaagcaaatgtataaatgattgaaggcattgagagctcatggtatctaatagggatctgttttaaagaactaaataatatcattatataaagctgaccatctcatacgaaatgactctgaaatgttacccctggatatatattccagtctagagaaactcatgctcaaaactaattatggcagcatgatttgtaatagccaaaaagtaaaaacaacccgaatgcccaacaataggaaactggataaataaatggagtattgtcatagaatggtatgcttaacagctgtgaagataaatggattccagttacagcagtggttctcaaacaggggtgattttatcctccacccgggggacatttggcagtgtctggagacattttcagttgttacaactggagggatgttactagcacctaatgagtaaaggccagggatgctgttaaacatcctacaatgtactgcacagcccctcataacaaacgattatccagcccaaaatgtcatagcatccaggttaagaaaccttgagttacagtcattaaaatggatgaccctcataatgttgagcacagaaagcaagttgcagaagaatatatatacagtataatactattttttaaaattcaaaagtaagcaaaaaagaaagaatacattgtttaggaattacacatatacagtaaaattatgctgtgatttcagaatccacattgcaactatcctttaagaaagtatcacttaatgagttttagtgtgatatcaaagaggaatatccacaattatttgaaaaagctgttaaaatactcctccttgtccctctacagatctgtgtgaggctggattgtcttcatgtacctcaatcaaaacaatatagggttgcaacagattgaatgcagaagcagataggagaattcagctatcttctgttagccaaacattgaagatatttgcaaaaatctaaaacaatgccactcttctatatttttgtggaaaatatagttattttccataaaatatgttatttatgttcaacatgtgatgagtttgttgtttttagaagaataaataataaatgttctgttttaatttctgatactgtaaatgttgacagatatagcccacgtaaacaaagtttctaggatcctcaataaattttaagagcttaaaaggatcctgagaccaaaattttcagaacagttgccctagtctaagacagatctatttcctttatctcctttcccattttgtacgctggaagagttccatttagtgagcgccatattgagtttgctttccattaataata

SEQ ID NO: 110 - DNA, 10391 bp, Homo sapiens
  source 1..10391: mol_type = genomic DNA
gcacagggagatgaagacaactctcccaggattcttaaaaagccaatctgtgactgttctcagggtcgctctctccctaaatgctccccacctctataaatgaccataagcagccaccttcccagagagcaattgtccaacgccagcctaatacaactgtcccaaacaccactcagcctacaaattctggattttcctgttaacatagtttattttcttcaaagcagtgtggcctcaaggtcattactaaatgatgactcagggggaccaaattacagtgattccaaacagaccaaatctaccaaaccagttttccactcacatctcctcttccatttctactggggctatctcaagccaccaggatcctaaggcaaaacaagatttttctaggattctcaatattgggatccaaccccagagatgaaaaaggagccctttttgagggtccacacttactgtgccctcagcagatttccaaacaagctggctaaaagtctccagacctaggaagatgtagagaggcagagtaaagactcagggagtggaaaaagagatgtctctatttggaaggttctcaatgtagcagagcataacatttgggtacacagggaaaatggatgtagtgtaggcttgacgatttttaacactgatgaaaaggggatattaggaagccactatccatctttacttctgtatttcattttgggagatgtcagagtaagggttttagtgcccttccttacaacatactaaccttcaaaacccacatacctcttatctatatttcctgtgccttcacaagaatattgagaagagaggccaagacatatactcatgaggacagacacagagacaactcagcctgcaagagttggacttttcatggataacccctatcaggagctaagagagctgagaaaaggggtcccagaataaattgtgagaaagtgatcataagcttgggtttccaaggagcctgggttcatggctggacctagaagataaaaaaaatcatccactcttcctcttcagagtctaagaagagacccagctatagggagctgaggtgtggtggacagcaactgccccagaaggactcccctagtccactgacactgtctcctagagtctagcaaggcccacacacaggtatgttgaacccagagtattgtatgttctcaacagctggggcccctcttctggaaaccctgcagaagccccatgaaaattatcagagtccccagtttcaaagtgaaagaatccatgagacctcagcagtcactcagcacctgatttgagcagactgctagtgtactgttttggcttctccccactctgactctgacacccagcattctggagttccaggtcctcccttacctctagcctgactcaccatcagcacctgcatgaaaggtacaagagggcaggaaggggaggcagcatgctgttgctccaagcatagaagtggagcaagggaatgaagacaaactaaagcaaggtgtggaattccgagagagtttcccacatcattcaccagcagagggtttaccaaaagtgggagagatatttggctaagtctgtatctaggcaccaaatgccttctcagtaaacccagaagaagggcaagggccaatagtttagccagtaaactcattttctccagaaataatgtagttctaaatatttcactactatttatctttttttttgcatgtatctatttcttttgttatagttttccttttaaaaaaacctttccaattacatgtctttagcaagagctggacagacagtgtctgtggtagcatcattccccctgcccccagctacctgtcccctgctggcacctagaacatcagcccacagactctcctactgcttcccagagcccctgactagggcagcagcagttgctgatgctgcacagggtaaaacctgtcaacttccagggacaattccacagagacgggaaaacacgccaattgttcccataaaaaaagcttcctggctgggcgcggtggcacacacctgtaatcccagaactttgggaggccgagatgggtggatcacttgaactcaggagttcaagactggcctgggcaatatggtgaaatcccatctctactaaaaatacaagaattagctgggcatggtggcaggcacctgtaatcccagctacttgggaggctaaagagggaagattgcttgagcctaggaggcagaggttgcagtgagcagggactgggccactgcactccaccaacaccaaccttcccacatcatcctttctctctctcttttaatcagccccaatttgttacctcggagagctccccagacagtctcagagaggagtaaacactggtcatcatttatggtcagggtatctgaaatgacagaaatgaactcatttagttggttaaggttttctattctcagattatagaccagatattctatataaatcactggactaaaaaaaaaaaacagtaagaccatatattttaaaaaatctttcaatgaggagatgtccccagagcaagacagctgtaggatggcctggtctggggccagagtgggagggtggtcaccacagtgactctgtagaccctggatgatgatgtacagcaagagtcaggctggagtggaggtctgtacaaagcaccacctacctcatgggtcagtttccacagcagaaagatgaaagaagtcttctcctggcaaagggaacagggatgcctgcaggggtgagtgcagcacgcgatgctcccaatgcctttgtaatcaccctcctttccccttcctctatgcttcagctacttcctccaagaatgtgaggaaggagccaaactcaactgttcactttggagactgagaagtccccaaatgctgctcagggaagacaggaggcagtcactggactaatgacttaacttcatctcagtataagtgaccagaacccctgctttccccagtgtagggtctattagagaaaagtagcaaagtatacactttcctaaaatagaaatgtattcagtacaccaggtagaagtcctgtgggactcagtgaagagccagtgtgatgttccacagccaacctttagcactggttaagtttctgcataggaaaaactcatcttccatggctctcagcacttggtgaccctcggtccccagggtcaagggggactccaggccgagcatcagcagtttaggccaggccatccagagttacagcttcagacaagtgtttgctcttctaagacagggaacaggatggtacttacaattctccactgactccaaagtaggaagctggttacatccaggtgtgactacagagacaaccaacacattcttctccagtgtatgccgtttccctaggaagacagggtaagcttggtgcggccaacctgccattagaagcaacaggcaaaaccaagaccctagctctagtccctcagctcacacgcctgtggtaaaggaaagggaggacatggcatttacccttggcataggcagtgcctgatcatctgttcagctgtctcactctcgttgtgcccctcttctcctcagtagctgccctgacccatgtctgaatgctctgggtgacagctcttcttaaccagggctctatatttctgactgcccttggcctgtaccaaacaaacaactccatgacctcaacaactgcttctgaatgaaaggcagctctagagcactgctactccaagtatggtctgcagattagctgccaatttgcaaactgtgttactggctggtcactatatagaaaacttatatgaagcctgaatgtaaatcaattatgtcagagtaaacacactgtctagttctaacattttttcatacaagattttcttgatgaagagatcagtcttacattctggtacatatgcttcttatctcattgaagattggcatattaagtagtactgctcttgagggctccagatgaagggtttccagttttgcaaaagcctaggagctaatggagcagatgacagaaggatcaggcagaggaggcctgagatgatgcaactgatacctcagagaagatcagggtcacccacccatcttgcttccttccttcctcttcccaaacaggttctctatccaaggtagattttaccctaatagtggagggttgaaccaacatagtatctaatatagctttacagacccttgtctatgcagaaaaaatgccaaagccaaaatatgaatacactgtctcttctcaccctcctgctggttcttccctgtgattttcagggtggctctggtgttatagccccaagccttaacttaatgaacccctctctattctattctttcctggagccatattcatcccactggcatcacaacatccatgacttcttatggcactacaatgtcagggataggatggcctggcagaaggcaatgagagaattcagaaccaaactggaatctcaaatgttacccatctccaggcagaaggaatccaagcgctcagatcatctcacggaagcctgctcagacctcttgagcactaccacatggctgtatctcagctctttggtctgccaagaagcaagccaataagggggcctttcctaccatcatgaacaacacattctttcccttaccagtaaataccctggatccccacaccaatacctgcctacattctgcaaagaggagggaatctgaggcaactctgggccaggtcaattcacagctccatacttgaaccctaaaactacattgttacaacacaaaaggacaagcagaccttcaaggcaaagaccacactcaaggcagaatctgcagggccatccaagcagacaggctacaaacccatctccacaggagactctacagggagaccaatgaggacttaacctaggagcaagggtgaggaaaaactataccccatcctctgacttcttgcccccactcccaaccccacacatcatggagccccaatatcattgtgtggagaattcatctgcatatctacccaggcagccatccaaaagacagccgaagtcctgagctttagttctaatcctctggggctcagcctgccacataaggagaaatcacaactaatccatatgcaactaccatggctcgctgccctcatgacaaaataagagaggccacacaaacaccaggtttatctgaactattacttggaagacagaaaaatacctaatctttcgatttttaaaaaatttatttttctaaaagacacctgcactgtactccctaaatctgtagtcttttggagagtcacagactcctttgcagatctgctgaataggaaaacactttttttcccagaacaatgcccctaatttaagggctgtttctccagaattacaattcttccactccctgccatcaatctcatggtgaagaatccctgtccgaagttctctcagtgactcatctgggtttgggctgaaagaagtagatacgggggcatggctgctgtttaaacaaattatgagagggatgtttgggggaggcagcaacatgagagctggcaaaacaggagggacactaggtcattgtaaaggatgtaaatagggtatcaccactgtggttttccgcctccaagttgctactttgcctggctatgaagagggcaggaaataggcaggggacagtagtacagccgcctctacacacacccgcccacaccctgaacactgagaagcaccaacgtgtgggaagcacagtatggcaaacagcccggtcagccagcaatgtcatgagcacatgtgccatgagtctggctggaacagcaggaaattgagaagcctccagggcttaggaggtagcatgaaaaacagaccagagggctgggaaatcaggacaggttgcttctggttctggttttgctgctgccaagctgagcaagtctcagggctcccatttccttccctgtaaacaatggcagggtgggaccagattccagctactcctcttcagatctaagaccttgtgattccatagacagataatacactccagggtcccattccaggaccacagcctgctacctctgcagctcactcatctccctgctttcatgtaaacctactcttctctttgggttcactgaaaactttgtatctttttttaaaatcaaaacagttgtataggcctggtgcggtggctcaggtccatgatctcagcactttgggaggctgaggcaggcggatcacttaaggtcgggagttagtgaccagcctggccaacacggtgagaccctgtctctactaaaaatacaaacaaattagctggtcatggtggtgggccctgtaatcccagctactcaggaggctgaggcaggagaatcacttgaacccaagagacggaggctacagtgagcagagactgcaccactgcaccccagcctgggcaatagagtgaaactgtctcaaaaaaaaaaaaaaaaaaaaaaaaaagagtagtacatactggttaaaaaaaaaatcaaacagtactaccaaacagtagaaaatatttacgattaaaaaaaaaaagtatctttggtacccttccttagtcccctcagtaaagagacaaacatcactggtagttttctacccctgtagtaccttatagagtaattttgccttattcatcacagacaggtcacctctggacatggaattctaataacaaggacgctctatcaccaaagtcctactgttgaaccttctccagactccagtactatgacccctccatttcccttctgttctcagtcttctctcattcttgcttccttccctgctggcctacatgtagtgattcatcacctcaaacgcaatctagccaatactcccaacgatctgtctcttttcttctgtcacaaccaatgggcaaaactttcaaccctggatcaatctaacatctgcctgctgtgcccctgaccccggctactgtaccctactggagggaagggagaaaaatcacaaaacagcaggactggaccactgcaaaataatggtctccatcttggctgggcccttgatgctaccctgaaaatcttctatctccatcattgcttcattctattctctacaccttcctcaagtctacttgatcaccacctcccttatgctcagcagacaatcagaagagaactttcaactatccctaccctcttcccctctcctcgctgacaaaaatatctgcaacacacacctgcctgtaccctctcctggacctccaccttgatggaaggggcttccttttacctgtgctctggagctcttctcagtctcctcttgtataaattatttccccttttcccaaagccttcaaattatttctttcaactctcatcagcattaaaatgtttgcaatcttcctggcctcacttactctttcttttgccttcctgccacaaagactccctagaggaaatgtagcctgggcagctaaggacctgaactccaaaggaagacagatctggattcaaatcttggttctaacactttctagctgcaggccttctctaggcaagttatttaccctctctaagctgcagtttcctcaactgtaaaatagggatcataatacctatataattgggctgctgggaaggttaaatgagttaatacatgtaaagtgcttagctcagtgcctggtacctcctatgtgctcatgatgttggtcatacttagtattttgtagctgcttccttacaacctatctattcctcaatccactataatctggcttccttcaccaccacttctctcaaaatggcttcaccaaagtcctgtggttctgtaaccaaattcaagggactcttttcaattcattcattcattcaacagtaatttactgaatgcttactatgtgccagggtgttgtaagtgctggggatacagcagtggtcaaaacagacaaaaatcccagctgtcagagagctaatagaaaccactcactccttctgggacctcttgacagcatcagacatctctgaccttcttgaaactaaactcccttagcttaggggacattgctctcttggttttccttctaactccttgaatatgcttcttcattcaacttctcctttaccaatcccaatgtactaatgttacccagggtatccaaggttccaaacttctctttttcccttcgcttacactctccctagacaatgtcatccactcccacagcaggccaatgactcccaaatctatctttccaagccaactcttcttctggagctctagacttgtacacctccactcaaatgtctcaaaagccacttgaatcttaaacataaaactaatctaactcttcattcctcctcctggctgatcctctctctcactttgataacagccccatctattcacctataccagaaatctccttcttctacaccttccatctaactgagtagatcacaagttcatcaactcaaaataacatttacagactgtctgatatctcaaacattgtgttaagcactgagattacaacagtaaaaatactttttaaaagtcttacaattacacaatccttataatctcttaacacatcgccattttcccagccccactgggccaaagccttaattcagcctcttgtaatttctcacctggatgactataaaaaatctcccaggcagtcttcccctgcctccaggaatacccatgtcaatctactatcctcagagatattagaatatgaagataagagcatgacagtctccgcttaaaatcttccaatggctcccatagctttcagaatacagtccagaattcactgggtaatcataagaaaatgccttgtctttttctgctcctgtgcaggaactctcacaatgaacaatgaactcttaacagaaccctgaaaatgccatattttctccatatttttctttgcacatattgcttcctccaattgaaacaaactttgccttcccgccacatctcccctaattaagaaacagctctattttccttttaggaaacttttctgttattccccccctctttcctaagaaaccctcctatgtgatcatgcagcaatgtatacatacatttttcaaaacacttttcttaagatatgctgtttatttgtctatctcctcacctaggttgtgagttcctcaacaggagggaccaatctcagtgtctttgtattcccagtgcctgacacacagcagtcattcagtacatgtttgctgaaaaaatgaatgatgttggaattcaaaaaatgcatattttatgattgtgctatgtgataatcaggcataaatagcaagtagttaatgtagagattacttttatatccccaaacctagtatttctgaaatcctgagactggggtgggcgatgctaagaagacgcccagacttacacaaagtgccttttcagacactgctctgaagacctctggatccataaattctaagatttaggtctttccacttctctgagaggaagaactcgttgctgtattagggtcactaataactattagggtaacctggaaactatcaatctttacctcagtgcacaatagcctttccctctaccacccgttccctcctgaatcaaaacacttccatcgtatcaatgtgtttgattcacagaatcccagcactatggaaaaaaaacacattggtttcggttataaagtggtagctgattttgcttctggattgaaaactaagaaaggcaacccagactttgccaccttcccactctttaatgtctactctgctcccatatcccctggtaccctcctaggctggtgccaaagtttgttcccatgcccactttcttctcttccccctcccacctttatacacatcatatccaggtttcatctcccccatattctgcctaataaaagcccattatatcattcatttcccactcatttcttcattccaaccaagatatattgtgcatttaatgtgcatcaggaactgtgctaggtgctggggcagttaaaaagaaaaacaaaccctggtccctgcccttgaggagatcacagtctagcaggagagatgaacacaaacaataattacaaacattgtgataagggctatggtagatttaatagccacgtccaggaaaggtggaaggcttgacgttgaaggggacctctgagtgggatcttgaaccctgaattggtgttcaccaagctaccaagaggagaaaaggtattccaagcctgggaagtgaattggtgtagctaggagagaagtcaaggccaaccttgtcaaacttcttatcccagtaaagtgggagtctgtgaagccgactgccctgagctggggccttctccttagtgctgctgaatttagtctagatcatggtacctcctcctgt

SEQ ID NO: 111 - DNA, 32623 bp, Homo sapiens
  source 1..32623: mol_type = genomic DNA
ggcactgttggggcaatttatgccattgctacccctacttcagattcttcttagaccttggagaataccttctccttccagcacctgactcaaatgcctcttcctgcagagagctctcctggatttcgactccatccctgttcccctcacacccctaaggtggcatttgaggggagacatgggtcaggggaaggagtaccaggctttacctgagtcatgtgtgtgcgaccctggagtgtgcgtgaccttggagactgtaatgtgtgtggtcaggggagctgggacttcttcctccagtctctgaggctttaggggtcctcagggatagaaaggaagacagactaggtgcggaatgtcaggcctgccttggtgcagttggtgacaaaaatcctgtctccccagcacctctcaagctcccctggagtaagcctgcgtgcagtgcctgggagagctcagggggttgtggcggggatcctggccccgggacccactccccaagcctgggaatgtcctgggagacctctgttccttcatagtccttaaagactacctccctcccccaacttctcacacccagcttcccacaccagcagctcagacacacacctggaatccactgcacagtgagaaaggagaattgggttggccaggaacaacagccagggcaagcagggcaagtgccaggcagcagagggtagctgtccctggagagttctctgaggctccccaccccaccccagtccagaggtgaatgtagggtgtgcttgcgcatgctctgacctggactgaagtcaccctccatgcccacctccctggatctccgtgagggggggtttcctgagcccacagagagcccagcgcagcatctggcacatggctggtgcccaagaaaccgcaattgctgtgatggtcatggagactgcacagtgctgaggtgaagggcagggaccccagccagacagcctggggttcaaggccaggccagccactttccagctgggccgctctggatacgatcacatgtcaccctcctacacctcggtttccccacttagctgagatagggatattggaagggtggcactgtgagtgagtgaatttcaggcctggctgtcatcagggggacttaagggtggctcttcccatctgctatctcatgctgatgtgtgtcctgtcctgtgagctctccagatgccaggcccggcacccccggccctgtcagctgggtggggctcacttatgtacctgtcacctctgcagatgtgaggggacctcctgtgtgcctgtgtaaagccaggtctggagtcccaagagcttgccctgagcaggggagatggaggcaggagggaggctgttcccagagatggtgggagggtccccacagggctgtgctcagtgtcgcctggtcgtggccctcatgtgtccttctgtcctgtgtcacagtgcagggacttcacagcccacacgggctacgaggtgctgctgcagcggcttctggatggcaggaagatgtgcaaagacatggaggagctactgaggcagaggtgagctgctgggcaggccatggggagcgcaggcaggaagcaggtggcttccgctcggctcctgggacagtggacgaggcccccatcccagccaaactctgtcagaacacgccctgctttaaaaaactcttctgtgttccctcaaacctgggcctcccccagaggtggcaagtcactgatgatctttcaaatgcccttttttttgcagggcccaggcggaggagcggtacgggaaggagctggtgcagatcgcacggaaggcaggtggccagacggagatcaagtaagatctcccgggccctggggctcactcctctcctctgctggcagtttctgggcctttagatgaggtttaggtcttcctggcatgggggaggctgggcagaaccagggtaggtctggattgctccttggtgcctggttattgggcattcagggtgaggccaggttctgtgagggaggaagcccgagggtctgagttctggaaagggtctgggcaggggagacaggaggccatccatcctcagtcatttgcagcgcagtctgcaccagcctgggtggcctccactgaagtcctgaggggcaggtgacaggcgtctccactggtggctcaagtcccctgcagcactggctcagcatgggcttcaaggatggagatgtagccagagacaggggtccaggaggggacacacctgggttccggtgtcagctcctcaccccccagctgtctgaccatgggctggctgctgacacactctgtggctccgtttcctcatcagtgatgggaaagtaacgcagccctcctcaaaggaagaagtgggcccatgggcttagctgaggcctggttagagggcaggccgtcagggaagtggctctgatgaagcgggagtctccagccccacaggtctctgcacgcagactgctggggtgggaggccaggtgaggagatgaaggtgagttcaggacacagccaccctaacagtggagtggaggggctgctctgggaaggcccagactgtccccctgggtgaggacagagccaggccaaggggcagacagaccaccggcctccaacttcttgaaagggctctgcagagtcctcctgccgaggggccctgagcctgaccctgcagctgctgtggaaccccttcccttcctgccttctcccccgagagaggaactgaatgtgccatactctgaaggtcccccaaagacaccaggcaccctggcggctcctgcttccaaccaggagccagagatcacaggaaggcttagatgtggcatgagccgtgtgtgaggccagaaagttgcacacagccctgggaggacggagggctctgaggagcccttggagctctggtcccggctcggccaatctgagctgtgggactgtgggccagtcgcctagcctctccaagtttgtttctcacctcccactccagcgagctgccgtgcaaatcaacaagaacatggtctgagggcctcccaagggaagggctgagggccgggtgcaggctgggcacagaggagggctcaggacatggtgaggagtgaatggacgtatgcagggaggtgttttctgcaggaagcagtgcccagagctctcagccaggggaggagcagctgtgggggcctggcagcatgaccaggggagcccctcctggtctcctggcctcccagcctccaggccagctggaagagaactttcccagaaagagagggtacctcatggggagaactcagagactcaggagaggtggagagggtggccccagcagggcacaatgggagccaggctggagtgggtctgtgtgatgcaggctcaggggattgtgagtcacaggggatttacagcagggaaagagaagctacccacagaaaatacaatgggggtggggagcagggtgggcctcaggaagcaggaggtacgcaacatcttgctccatttgtagaactaggaaggggccaggtggaggctctgggcggccctgattgcgccatggttattcaaggccaggtggggcagggtctgccctgacttatcctttgtgtggccctggatggtcctccctgtctctgagtccagggtctgtacctatggaaggggatggtcacttggagaggtgttctgggcagtcacaaggacaagcagagagtgccaagccacaggggttcactgcacacagtggggctccatagtgttgctcttgacccatgtggcatgaagtactgttgatgaggccatgcagctgttcctttcggtgtaggccaagcatccatcctccatccatttagtcaccatttaattgaggacctactatgtgccatgccctggatgggtcaggaggattcactaatttaaaataaaataaagggctttgccattccttagccagagtccagcacagtgagggtgacttccttctccttcctagtcctttgcattagggcccatttatgcgccacctcctccaggaagccctcccagacaccttgccttgccttactgtcagagtcttggcttagacccaattacccctccccatgccaacctgaagggcttttggtggggaagtgtgagcagtggccgtggacctgtttcctcatcttagactcctgtggggggggggggtgtgtgtgttggccctcaggaaaggtgacccggctcttcaacatcggggctggtggcccaccctccagggcccatccctgagtaggggaagcccctggcctccctgaggcccacagctgccccccaggtctatgggatgctcattccctgccccttgcagaacgggcaggggactgggggatgggaaggctaggaacagggtgcagaacgaggacaaaagccaggtggttaagtgaccctataaatagcctagtgagccctgagggcagaactgctgcctgaaggtactgcatttctgcagtcccctgacctcaaaccagccgggagccaccctcaggcctggaggctcgggccactgaaattaacaggaggttacatcttaagtgatttttgacatgtacctccttcacatgttaactcagcaaacatccgtggggcagtggcaatggaggatggacaagtaagacccagtccccaaactccagggatccccaccagcgctttcagtgcattttaaagacagcattagggccaggcgccgtgcctcacgcctataatcccatcactttgggaggctgacctgaggtcaggagttcgagaccagcctggccaacatggtgaaaccccgtctctatcaacaatataaaaattagttgggcatggtgacgcgagcctgcagtcccagctactcaggaggctgaagcaggagaatcacttgaacctgggagacggaggttgcagtgagcccagattgcaccactgcactccagcctgggctgcagagcgagactccatcttaaaaaaaaagatagtgttagtatttgcagggggcttaccaacattgctgacatcacatgtccagccctgcagagactttgcctgactctcctttccagcctctgggcctttgctcctgctgttgccctgttgctcccctgcccagtcccacccatccctcaaggcctgcctgaaatgtcacctccctcagaaagctgtcacctccactcccctattgctcatcctgcgtcaggtaaggtgctgggggtgctgcatgcccccagaagctgcacagggcaggggtttgggaaacaaaggaaaaccaaggcaaggccagcttcctgtagcccctctgtggttaccagtgggcaggtacagcccccaaggggtgcaagtttgaatcctcacgtccctgcctcacccccagttgtcacaaaccaaaaatgctgtggttttcctgtcagagagatttttaaaatttttttcatggtctctcttcctctgaactcagagagaatgacgacattgctgaggatattggcgggagagagccaggccctgttcctgtcagatgtcccctgacgctggctcatcgtgggcacagcctcagcacagggagccgagagggctactcctgtcagctggtgggcaggcagcagggacacagtggggtcagagcaggaaacacactggaaatctggactgtatttgagcacagaatttcagactgagcttcctgagagccgagtcaaaaagggcaatgggatgagttacacatgaaggcactggtgacagatggcagtaggcagaggcctgtgcaggaccctgtcttcaacatgcgatggagacacagtagaggtgctcagggagatcttgacagtttccctgcacagacggtgggaggaagcaggaatttcatggggcagagaatgactttatgtggcccccagatcctccccaagatcagagctcaaggctgttcactttgggggttctggggcaaagctgggctcctcctctcatccacagagctgaggctgcctccttgaaatttcatctggggccaagaaagggaggagtgttctgggccttgttgtgtgagctgaactagggtggcctgatggttccagcaacggggacaggggacctggggcaggaaggcctgcagcccaggggacaggaagaggggcctggaggggccaaagcctgcctgcccaggtaccccagacagaggtagcaccagtatctatgcagtacccaaggcctagccaggtcatggggacaaatgggagttcaaggtgagcacagaccatcactgtcaagactgtcccaggggtgggacagaggctgaatgtccacctggcagtgctgtacgttcaggcaggctcccagctttcaggtgggggctgggaaaagggccagcagctcccagaacctgcgattccttacagcacccctcagcctgagaccatgaaccggggtggcccacaggtgggtttggggttgagaaaatttagattatgagcctggggacaatgaggaggagagccaggcattgcccctgtcctcaagggctcatggttcagctgcgtgacagacatccgctgggccagcccaaagtgacatcagtgctcagaaaggacaaaagaggatgccaggcaaagatgcagcaatggagatgggcacgtgcaaaggccctgaggcaagatggagcctggcacctggaagcaacgggcggaggggcagagagcagggctgacaggtgggaggtggaggtggtgcggcaggggctgcagcggtggtggcagctagcgtaggacagtcacgagatttaggagataaaatagaaggtggcggcaaggaagggagaggacagagcctggtgtgactcctgggtttctggtgtgtatagctggtggacagtggtgtctttgccaagaggggagccctggaagaggagaggtttgcagggcaggtgctgagtccggttttggacacgctgaatttgaggtatctgtcagatatgagacccaaaaggtgagggcggggaagtggatgtgcaggccctgagctctgggaggggtctgggtatgctgtggtcatgaaggaggcggggctggagggtggtgtgcgtaagggctgggttgggggtgcggggaccacgctgtgcctggaggcctctaactgaatgagtgggactgagctgaggggtgaactgacaggaagcagagggattggaggtgccactgctggtgaggagtcagagaagagtcctgagccccacaagggaaggtggggtcaccacacagccacccctctccttcttcctctccctggttccgcctcttaccgcagggtggccacgggcgcagctccttcactcctctgacccttggcttctcatctgtgaaatgggataataaaggcacctgtgctggcagagttgtgagcagttctgacgtctggatgggcatcagcagcgcttggggccgggccccaccccgaagcctcagcctcaggaggtcggggaggagcctgagaatctgtatttctaacaggctccgcggatgctgatgccgctggtctgtggacctcactttgggatccacgagtttagggcgaggggcctggcccccaccgatctcccccaggcctggatccccaggctcctgccaggctactgctcctccttggcctctgcttccccaggtgtctactgagaggagaagccccctgagaagcctgcctggtgcgctgccccctccacccagggctgtccggtgggcgtcatgaggccatatggccgccagggggcagccgagctgctccacagagaggctgcagggagagccagataaaatactggatgcccaggtgaacgtgaatttcagataaacaacaaatactttaaaaataaaagtccgttttaaatactacaaggggcatactatactcaaaaagtgctcgttcatctgagattcacattgcactgggtgtcctgtttttatgtgttcattctggcagcccccgcccatcattccctgcctcctatgcgcagtgctgggcccttccctccctccctccctccctccctccctggcagacagtgcccacctctcaactcctgcgccctgccctgctagcctctcccacggccatccaacctcctccaaacatcccccgggccacctgctgagagcccatctgaacactgtcccctcccctgtagcctcaccctggggccatttggtacctgccgaggagagagggctgtgaatgtgggagaggagttcaggggagggagggagggtcctgaagacaatcccctcttctctaagaatgcagctaggagcacagatggtgggggccttcggtacctcctccttctgccacattgcagagggttgattgctttaatttgcagagagctttgtcttccagaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagcgtaagtcccctaccctggggcaatgggatcttttgggactgcgaggctggtggagggtttggggggacagaagatgaggtgttggggctggggctgggctggcccacacgggtgagttgtgggtggctgaggcccatcagatctgacactggggaccagtatccatgctctgcccccagaaatggagaatgtgggcagctcacacatccagctggccctgaccctgcgtgaggagctgcggagtctcgaggagtttcgtgagaggcagaaggagcagaggaagaaggtgaggcaggtgcagggggcgggggagctgctcccccattgccagcctctcagttgctgtgggggtagggggctgaccttcctggtagagccagtggagggcggcaggggtggtggtgggacagcactccaggctttggggcttgagggtgatctgaagtgggtagggagggcagaggcctggccgctggcactaaggccaactcttagtcccagagccccatggaaggtccttcctgtcgagctgcctcacgcctaggaggatcctactacagcagactctagagggtctgtggcaacttggcagtgtccagaggaggcagtctgagttgtgggggtcactggaaactggtcttgagtccaaggatcagggctgattgtcctggaaaaaggcagacttgcagccagtcaccccacaggactgcccaaggctgaggggtcagacacagactggggtgggagagttgtatggcattgcttagcatccaaaggtacttctcacccatatgtagggcatggctgtcccgagacagagtgactgcatggaagtgaagtccccatcatgggaggtgtgtaagcagaggctggcagatgcttgtcagggaggctgcagggctgaagttggatataggttccctggagggcaggcaggacgcagactggcctggaggctgggcttgggcctgtgaggatgggggctgagcctctcagggccttagtgatgagggtggtgccctgcacagggtggcagggcagcacacagatccgcttcttgcctggggaggaaggatcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggccagaatgagtcttgctatcgtgccaggattgattttctgatgtccatagggtgaggatgaaccaaggcagccacagggcagctatgagagtcctttctgctccctgcttgaggggaagaatgcatagccagacctcacatccacctggactgaggccaagcacccccacatagccaggcaggctgggtgtggactccactgatgaggccagggctcggggaggcagggaagccaggccaggagagtgatggggtacttggatggcagtggctagctggggctggggaccgcaaaggggaggcttgtggtaagcttaggcatgagtgtgccctgggcttggggtatgatgagcacccgtgacccctgacatgctccagtcactgcgtctccagaatgggagaggggaggtgaggctgggaagaaacccaggttgggggagaactatgatgacaaactgagggggatgggaggcccggtccgttgggttacccccatcctgtgtccccaaggggctgcccctgcccaccctgggagacatgccgcatttactgctgggtgggggaacgccaggcccctccctgcaggcccttccctgcaggcccttccaacgtcatgcgctttcaatctcttggccagaacccagatgagctggacctgtccgcgggagacatcctggaggtgatcctggaaggggaggatggctggtggactgtggagaggaacgggcagcgtggcttcgtccctggttcctacctggagaagctttgaggaagggccaggagccccttcggacctgccctgccagtggagccagcagtgcccccagcactgtccccaccttgctagggcccagaaccaagcgtcccccagccccgagagggagcctgtcgtctcccagggaataaaggagtgcgttctgttctccttggtgtgctggggtcccgttctctttttctcctgctccagtgtccgagtgctcagttcagaggaggcaaaggaacaagggaaggagcctggatgtggagctccccaactcagccgaggcttcagctatagttggagaagaggcctggccccagttgctaggagctcccagactgccaaggagacacattcacacctggacagaggacacaggggtgcaggaggatgtggcaggggcaagaaggggctcagcagggctgcaatggggagagcaggcttcttgggggcggagggttgagcaggtccatggctgggcagcagtggccaggccagggcaagtgcgtgggcaaaggtgaggttgggggtacacccaggaatattcggaggactcagtttggaaacaggaagctggtgatggatctgttggagaggccatggtgggagcccaggaagacaggcttgtggcttgtgggtgcaagtggggcctggggaagccactgctgcccatgacactcccctcaacatggcaaccccggccgagcaggggtccacagcccaggcacgttggccccgggcacagagggagctgttcttgaaggccttcagccccttctctttttagtcccaggaacataactttcactgctggccaagccctgctccaaccatgataggcttcatccatgccaaaggcattgggagtgggtgtggaggagagggcccctggccattgaccactcctcagtcctgggagtggccaagccggcccacctcacaccctcctgggatccccacccggcttcggagccaggcaggcccaggactgtaaggggcgggatgggggacacagtggtcctcctctgctgggaccacactgatgagctgctgcagggcactgctgttccccatggggaggggggagagagaaaggagggaggggggagagagagaaaggagggagggggggagagagagagagagaaaggagggggagaaaggagggagggggagagagagagaaaggagggagggggagagagagagaaaggagggagggggagagagacagaatgcccatctttataccctgatctttacttgagcaaaaaattgggttcagttaagcaagcatgagacatggacattctaatgactcatgtgtggcccacactgtacctgatgatgggggtgtggtgctaaaaggggcctcaaagagctcactcagcccaggaggacagacagccaccctctaggccctgagatgtgaggcagtaagtggggggagtggttccaggggctggtgcaggccatccagcagaggggagggtggcttgtctgggaagtggtgactgggctggagagcaactctggaagaacacagggagcagatggacaggacttggtaacttacgggatgggagatgggtgggaagagagggaaagtgaggaggtgaggagtgacttcggagcccagacttgaagatgggctcctccccaggtggaggagctggaggggagtggtgcgggaacaaagcctgggcgagggctgggagaggcgggacagccgcgtaggcttaccactgggtggggccatgtgtgggcagggaagggaaaggaaagagtaaaaaggtatcaatactttacttattccttgaagatgccttgtcatcttgattgaacattccattccactgcaaagattttttaaaaaacctttggcctagatatttatcatcatctctgacaggtgccgcagtgtctgtgggccccagagcgtgatgggtaacaagtgctagataacagagtctgttctccagtcattcgggtggccagagaatagaactgaaagcaactcttgggtcacaatttatgccagggggagaatgcccacaaatgaatccaagtcagattcactgcttctgcagctttctccgttctcccatcactgggcaccacctcagctgctgggaaccaactgcatggatggatggccttcccagcagagacggtgccagataaagagggagttagcgtgtaattgggtgtataaataactgcagcctcttcctgaccgagggccactcaaagacagcaaggagcaggaggacaagcatggtctctgaatcacaacatcagggcctgaatccaggctcacgctttcttgggtggtcttaggcaagtcacaatttctctgggcctgtttcagcatcagtaagatgggtgcaatatgcccccatgcaaaatctcctaaggttcaaattaaacaatgattaggtattacttaccagcaagggataccacttttaaggaaaagacccacaacctctgaatcttggctacactcaacagcagctttgcgcttggcataatccccctcgctcagcacaccctctgggacagctgtggttatgtcagtgaatccttcgcaatgatgacaaaaagcagcaactcacgtttggccaaactggaagcacgcgccactggtgtccaacacctaattccaaccactctcacagcctttcctaggccaagaaacctcagcataagggtcacctgcttgccttggtctgactacctgggtgtctgcctatttctccatcccggcttttgagccaacacaagcccaggacaaggtcgcaccagcaactgggctcgctgccctcagcaccctcacgggattatcaaactgtgctcagtagagccctcttaggggccagtgggaggagaaagggggcacccactccacttcgagatctacttggagagtttacatattgcacgtgcagtggttctcaacccagctgctcaacggagtcacctgagcagattttcaaatgctgatggttgggtcccacctcagacaaactgaaaccaaatccctgcaaactgagcttgcgcataaatatttgaaacattctcctggtgattctgatacgcagccggagctgagaaacccctggctaacaggatcttcagctaaacatttttaaaagtttgaaaaacagttatggcaccatagtgacttatctcaggtgatagtgcccactacctgccagatggtgggataacaaagatcagcaagtaggccgggcacggtggctcacgcctgtagtcccagcactttgggaggcggaggcgggcggatcacgaggtcaggagttcgagactagcctgaccaacagggtaaaaccccgtctctactaaaaatacaaaaattagccaggcgtggtggtgcgcgcctgtaatcccagctatgtgggaggctgaggcagaactgcttgaacccaggaggcggaggttgcagtaagctaagatcgtgccactgaactccagcctggatgacagggcaagactctgtctcggggaaaaaaaaaaaaagatcagcaagtctcttttctaccctataatttctacatctgtcttactttcttcattggataaactcaggggagcaggatttatgtatgactcaacttccccacaaatagcaatgcagcagcaccattcagtagatacgaggtttctgccacgtcactgtgttacaccctcaggagacctcacagatctcacaggcactgcaatagaaagccacgtgcaacacacaagttattttcaagaactgcaaggatgcacccaaaaagcaggtgctgttacacaccaacaaccaccaactcggaaataagttaggaaaaccattgcattcacaatagctacagacattaagcttcacagaaaagtttcctaagtaaactctgttaagatccgaaagaaaaaaacccaataaccaatcaaaccgggcagaggacagaagcaaaattcagaagatacaaatggctgaaacacctttaaaagcatcctggccctagctaacagtcaaataaacacatattttcatctctcagaatggaagaaaagatgaaggctgatcacaccaaaagtgtcaacaagggtgtaaagaaatgcacatttcattcactgctggtgggaatagaaattgatataagctttctggagagcaaccagatgtatccatgaaaatgtttaaacgtgactttttttttttttttttttgagacagagtcttgctctgtcacccaggctggagtgcagtggcataatctcggctcactgcaacctctgcctcccggttcaagcgattctcctgcctcagcctcccaagtagctgggattacaggtgcatgccaccaggccctgctaattttttgtatttttaatagagatgggtttcaccatgttggccaggctggttttgaactcctgatctcaagtgacccacctgtctcgacctcccaaagtgctatgattacaggcatgagccactgcacccagccaaacatgacttttccatccagagtaaatccaactaacaagaatccacccttggagttcatgtaaaaatacatgacacagggtgatgaaagtgctttgaaactagatacaggcagtggttctatagcatggtgaatgtactcaaggcaacttctttactttaaaatcgttaattttatgccatgtgaattgcatctcaataaaaattgttttcattttaaaaattgtaaatgactgcagtgtgtgtatagagatgatcactgtggcgagtagtggaggcactggaggcagcctgcaggcctgccctttatacaccttggttaatcatggtactaatgtacccacacagctaacacaatggaatgacaaatcctacagttagacatggaaggagcatcagactatgttgtgaagacagaaagaggatcttgtaggataaaattcctattagcaaaaagcaaaaaccaaaacccaataccaagtctgtttctgtgtatgtagtctgcaaagacacatgccattgctgaactgctgaacttgcttccctgtgggtacttctttacagatgtctgtattgttcacattttttaaagcaccaattacttttgtttaaaaaaatacacttaaaaaaggcagtaagacaagctctgtcaatcatctataggacaagaagcaaagacaccccagctgcaataagcacacctagtgccagggaccagggctcctgggacaaacactgatccatggctggtgcccaggggcctggaacatcttgttagatcagaaattaggggagtgcttccaaaaatgctgggatataggaggcactcgaaggggctctcgctggccaagtcgggaactatctgaggaactcttcccccatccccaaaggtcaatgatgaagtcgacttttgaaaaaatgggaatccatagtggatatatgaaaataaatgaaggagaagggagggatgactggcaaatgaggaaggagtgctgggctgcagaaacgtcgcttggcagtcatcataaagattgaatcaggccagaatcagcaacatttgctgaacctggtcggggaatgggggaagagtctcatgaggaacagggtatgtacatggagacagtgtgtctccagagatttcttattagttgaaaagaaaaaaacagtaaccatgctatggagaaagtggacacacctcgactaggtgtgccaggtactcatttattgcctcttaactccaaatttccctgaccttgcccttccttgtcacactgaagagggggctctgaaaactcctttaccctttgccagcctgacccacagtgggctctgaaggggctaacaaggctagaggaggaagatggcctttttcttctgtctcctttcgtcctgcacgggtcccagcagcattccccaccgtgacagctctctgctcctgtggcttggcgggggggcacctccagtaagttgattctccagcatgggacaggcagcatatcccaggcaaccacagccacccctcggaggtctctccaccttggggaacctcctctgagtttccacgttccttctctgttttctcttcccttagccctaggggtgatggctgttctctgctaagctgctttagagctcttttttatcccttttagtagttaactaccttctacacagttaacaattacttatattaaaaccttcctgttcacatttcctcctccttggactagatgatcaaaacgaacatccccactgtggggcagatgggcattgtgtgcctcgagatgcgatgccctgagaggccgcgtgacgcaggtagtggttcagccacctggaatgcaaaaccaaatctaatcacgaggaaatcgcagacaaacacagataagcagcaccacctaaaacgaactgtatccttacaaactgttcctatcatcacagacaaagctatggaaatgatccagattaaagaagaccaaggagacatgacaactcaactgattacctgatccagaccagatccagcaccgcagagggaaaggtgctatagaggacacgatgcggccaatgggaatatgagtggtgaggtattctatcagtgttagatggacggaatttgacaactgtactgcagtcgtcagagagtatcttcttcttggtaagtacccactgaggtattaggggtaaaaggccatgacaggtgtggaggcagcaggagggagggagagggagagacagggggttggcgcaagggagagagaacgcacacacatttgagaacacacatgacagatagaatgggacgaaatgttaataggtgtatctgggcaaaggatatttgagcctcatttgtacagtttttattcttgcaacttttctgtagctttgaaatcatttccaagtaaaattaacttttttaaaagaggccatacaatatagcagtggtcctcaaccagggctgtgtcctggacacaccctagagcaccttagatgctctgggacccaggcatctgtagttctcaaagtgccccggtgcttccaatgtgcagccacgggcaggaaacaccagcctagtgggtgagctcactcactaaatttcagacatgacgagcagtgcttttgctctctgaagaacaagcactgggtaatgccaacacctagcctcagctacacgggggaagggcagaaacaagatgttgaatttgcatggccctggccaacacagacaacatccccttctagtggttcccaggcaagagaaaaaggcatttccaggacaactgtgccaggaattaaacacaagttaaaactggcaggagctggaatggtttcccagacctcagagctacctccccacctccatctttttggtctcactggtaatatggccagtctgggtccagctggcagagcacacgggaggaggctgctctctcaccaggcaaactgaggactgagtacaggaagggtgtggagaattatcctcttgggcaagttgaagaacaaggctactgcttggcatatttcccaaagccatttcccactctagaggccctgttctgtcctgtagaaagagtggagaacaaccaacatcacagtccaaatattgctcacctcagggccagcctgtgacagggtacccacaggatggttcatattgaaaactggggggaccatgctcgggggaggtggtggtagtgaaaggtcacaaacattcttgcccactgtgcaacaggcaggggcaagaggtgggatgggtcagtagtcacatgataaatcccccggggcctctgaaatcacattctggtaacttccactttgtgaaaaggagttagtttttactcctctcctttcccgtgtcttctccattttcaggtgggacagatctgcatgatatttgggcatctcaaaactgacgagcccaaaactgaccatgagtcacacccccagatgtgttctctaactactccctagctctgtgactttgtttccccagttgactgagccagaaacctgggactcatcctagatgagtcttctcttctcccttctctgtcccacgtccaatcaatgatcgaattccaccactgtcctgcctccaaacagccagaatccaccgctcaccaccgcccccaacagtgccctgctgcccactgctaagctctctcaactgctatgccagcctaactgaagcccagtcacaccaattcatcctggcttcagcacggccggcttgcatcaccaccttcttctcagttcaccttccaaatcaaacctccaaagagctgcttccacctacaagtcagctctcacctccacaggatgttccgtaagacactagagggcctgggctttcctgcttctccaacttctttccccagccttgtattttaagctccctgcacacacaattttgtttcacactcttgtgtaccatctttcaacaaagcctatccagcctccaagcttgggcatctcctccaggaagtcacccctgacctctccggaactcccctttggactcccattctattactacaaccactgcagtgtgaaaattatcttctcctatgtatgtctcctatactaggactccgaactccttgaagacaaggacagtatcgccactgtatccccagtgcattgcacaaagtagagctctatatttctaggatatactggactgaaagcatctgtggttttttgaatatcaagccctttagaatctggcaacagctataacgaaaacacacgtaaaccatgatgaactatagacagcaccaacaaagaaaacatgatactgctgctctggaactgaaatatcccccaaataatgaaaaataatatgttgggggctgatacagagtttattgaattagatttttctatttacaactgagatcacatctacatactattttgctagtctacatgggtacattatttccaacaagcttaagacttaccatgaatgggctcattcatacaaaaacacactcacactaattcttttaaaacagtagtgcatacattatactcctcctataaagccaactttgattaaaaaccactagtttcaaagctcagtctctgattttgaagatgaaccaagatatacgccatatgatcctacaatctattttagtcattttgtacagctgctatcttattggactacagtaaatattttttaaaaggacaccaatgaggggcaccatctggtgttaaccttaaccagaaagctggtttcctcctcctccccgcaaaaacctttggccaagagttctccactgtgaagactgaaaggacctggtgacatttcggcatcagtcctgttaccacttggaggtaacagaagcaggctcgtgtcctcctttaattctaccacactacatgactcgcaattggttctgaaattagaacgttcaccatcgtacttaaaatcttaggggcatgaagagtcagctagaacaaggaaaaagaaagtcgcaggtagtaggtaagtaggtgggcacatgaaaagccaagctgctctgtccaacaccagtgtacatgtgctttaactaaatgaactccagaggccaacagcagcagacctgctcaattcaccttccaaatcagaacaagaccaaaaagctcaggcttgagttgtcaactatgcataggttccgccagtgatgaggagctcgtaagcaggatctctactccttctgcacaacacgatgcaagcacacagcatgcccagcagctgttgaaagaaaacaacaatggggaaaaaaggctgaaaaccctctcatggcaggtgtgtatttctttgttggtaaaagagctgtttcaaagttcaatgacttcaaatcatcaaaaaggcagtaacaacagtgatagaaggaatttcttatgagtacattattttttaaggaactaagtcctaagcttcagcttccctcccaggaactcttcgtaaagccagcagggaatcaagtctctcttatttggcatccccactactagtctagcgagtgctgtccgaaagaactttctgcagcgatggagacataccacatatgcactgtcatgtggcctcatgtgactactgagcacctgaaatatagttactgcaactgagttgcacttttaattttatttaaattaatttaaatgtagacacatgtggctagtggctaccattctggacagcaaaggcctggggagtagaatgagcaagaatgtgtgtgtttaatagtggtcttttcaggtcttttggtttttggaaaacgaaattcagtatgtgaatagccctatggtagaaaacaaattctgatgccaaaaaaaatgtagttggaaggttttttgtttccttcacattcactatttttgaaatccacggttctgtggtattacatacatattacttttgaaaggtcactcttccgtcatcattttatttcaataagtcctaaaccttctgtggtagcatattggaatagtaataaagtcatgccatgttattttggataagcaaaaggattaagctggattaaagagaaaatgattctagaatttttgacctaccttctcccaaaatataatttttttgtgagataatttgctgttctaacttctcattgatgaggaaaagcctcagttatttgattttaaaagacagggtcctctgtacatttgggggtcaatctaatttccgcaaaatgtacccaatccataaacagactctcaaagtttgaagtggaagattaaccactactaagacacacatacacataaggatgtcctcaatctgaattctccatggtataaagtcacccactccaatttctaccctcacattaacctatattctgcccattcgggatatatatttcctgctcaaatccatcagtttcactatttcaccacttgcaccatttgcaccatttcaccatttgcaaagcaccttaaacacacttaagaggtgaatattatttaaagtttactaaacaatttaagtcaattctagaccgatgaagtacctaattcctagagaaatacatttctgttctctgtacatcaaaacattgttagaacagctataaactcaaatgcaattatgttctcaggcaatgttaaattgagcaataaaaatgctaagctcagaaatgactggtttgctaagggaaaaaaaatctctcttcccacccccacctccccacactcctttcaattggttaacttctattagagaagccagcattctcaaaatgaggtctgaaataagtatttctttcccaatttgtttatttcaatgaaatcaacttgtattgattttaaaacaaataaacttgataaaattctactcatgcttgggaatcagtctgcttaagaatattaagctctacataataatttcttatcctcaccattaactattacaggctcatttccaaaggcctgctatactgaaattccattgatttttgaaacattccaacaacatacttggaaacattacacaaatattttatctccaacattatttcttgcaatgaaatactctcttgcaatattcaaggcatgagaattaaacttcacttagcccaaatataacacccagcaactgcaaaaattgaaaaaaatgactagtggtgattaaaaaaactgactggcaaagtaaaatgttctatgatataccatgttgctggtggtatggggaaataggcattcttatacaaaaataagaacttttgcacattagaaacactcttttctgagaaaaaattggaaatacctatcaaaattcattcatacattctgatactgtaatttcatagttacaaatttttgctataaacagcccatcaatattgattaaagtatgcctataaaatggaatactatgcagacatgaaattaaaaaggcagatctatatccaaaatacactaatttgtttttaagaaggtacaaaaggttgcaaactatatgaattcatttatataacattttgcaatgttggccagggtgtgaggggaaggaggaggaagtttctcattttaacgaataactggtaattgaggaggaggaggaaagagcagtctccaccggcttcacatgcggcacagagaccagaaaaaaagcaacatggccttgggaaa

SEQ ID NO: 112 - DNA, 14283 bp, Homo sapiens
  source 1..14283: mol_type = genomic DNA
ttttaaaatttttttcatggtctctcttcctctgaactcagagagaatgacgacattgctgaggatattggcgggagagagccaggccctgttcctgtcagatgtcccctgacgctggctcatcgtgggcacagcctcagcacagggagccgagagggctactcctgtcagctggtgggcaggcagcagggacacagtggggtcagagcaggaaacacactggaaatctggactgtatttgagcacagaatttcagactgagcttcctgagagccgagtcaaaaagggcaatgggatgagttacacatgaaggcactggtgacagatggcagtaggcagaggcctgtgcaggaccctgtcttcaacatgcgatggagacacagtagaggtgctcagggagatcttgacagtttccctgcacagacggtgggaggaagcaggaatttcatggggcagagaatgactttatgtggcccccagatcctccccaagatcagagctcaaggctgttcactttgggggttctggggcaaagctgggctcctcctctcatccacagagctgaggctgcctccttgaaatttcatctggggccaagaaagggaggagtgttctgggccttgttgtgtgagctgaactagggtggcctgatggttccagcaacggggacaggggacctggggcaggaaggcctgcagcccaggggacaggaagaggggcctggaggggccaaagcctgcctgcccaggtaccccagacagaggtagcaccagtatctatgcagtacccaaggcctagccaggtcatggggacaaatgggagttcaaggtgagcacagaccatcactgtcaagactgtcccaggggtgggacagaggctgaatgtccacctggcagtgctgtacgttcaggcaggctcccagctttcaggtgggggctgggaaaagggccagcagctcccagaacctgcgattccttacagcacccctcagcctgagaccatgaaccggggtggcccacaggtgggtttggggttgagaaaatttagattatgagcctggggacaatgaggaggagagccaggcattgcccctgtcctcaagggctcatggttcagctgcgtgacagacatccgctgggccagcccaaagtgacatcagtgctcagaaaggacaaaagaggatgccaggcaaagatgcagcaatggagatgggcacgtgcaaaggccctgaggcaagatggagcctggcacctggaagcaacgggcggaggggcagagagcagggctgacaggtgggaggtggaggtggtgcggcaggggctgcagcggtggtggcagctagcgtaggacagtcacgagatttaggagataaaatagaaggtggcggcaaggaagggagaggacagagcctggtgtgactcctgggtttctggtgtgtatagctggtggacagtggtgtctttgccaagaggggagccctggaagaggagaggtttgcagggcaggtgctgagtccggttttggacacgctgaatttgaggtatctgtcagatatgagacccaaaaggtgagggcggggaagtggatgtgcaggccctgagctctgggaggggtctgggtatgctgtggtcatgaaggaggcggggctggagggtggtgtgcgtaagggctgggttgggggtgcggggaccacgctgtgcctggaggcctctaactgaatgagtgggactgagctgaggggtgaactgacaggaagcagagggattggaggtgccactgctggtgaggagtcagagaagagtcctgagccccacaagggaaggtggggtcaccacacagccacccctctccttcttcctctccctggttccgcctcttaccgcagggtggccacgggcgcagctccttcactcctctgacccttggcttctcatctgtgaaatgggataataaaggcacctgtgctggcagagttgtgagcagttctgacgtctggatgggcatcagcagcgcttggggccgggccccaccccgaagcctcagcctcaggaggtcggggaggagcctgagaatctgtatttctaacaggctccgcggatgctgatgccgctggtctgtggacctcactttgggatccacgagtttagggcgaggggcctggcccccaccgatctcccccaggcctggatccccaggctcctgccaggctactgctcctccttggcctctgcttccccaggtgtctactgagaggagaagccccctgagaagcctgcctggtgcgctgccccctccacccagggctgtccggtgggcgtcatgaggccatatggccgccagggggcagccgagctgctccacagagaggctgcagggagagccagataaaatactggatgcccaggtgaacgtgaatttcagataaacaacaaatactttaaaaataaaagtccgttttaaatactacaaggggcatactatactcaaaaagtgctcgttcatctgagattcacattgcactgggtgtcctgtttttatgtgttcattctggcagcccccgcccatcattccctgcctcctatgcgcagtgctgggcccttccctccctccctccctccctccctccctggcagacagtgcccacctctcaactcctgcgccctgccctgctagcctctcccacggccatccaacctcctccaaacatcccccgggccacctgctgagagcccatctgaacactgtcccctcccctgtagcctcaccctggggccatttggtacctgccgaggagagagggctgtgaatgtgggagaggagttcaggggagggagggagggtcctgaagacaatcccctcttctctaagaatgcagctaggagcacagatggtgggggccttcggtacctcctccttctgccacattgcagagggttgattgctttaatttgcagagagctttgtcttccagaaatcagtctggggccccagtggatggtcaccatctggctaaagggtcccttggttctagagtgacccagggtcttcccaccaaaataaaagtcctccccactgcccaccccgccgggaggcagcctggactgtaggttcccgctgtgctctcctcctcctgacctggacccatctgttttgcagctccctgagggcctcctttgactccttgaagcagcgtaagtcccctaccctggggcaatgggatcttttgggactgcgaggctggtggagggtttggggggacagaagatgaggtgttggggctggggctgggctggcccacacgggtgagttgtgggtggctgaggcccatcagatctgacactggggaccagtatccatgctctgcccccagaaatggagaatgtgggcagctcacacatccagctggccctgaccctgcgtgaggagctgcggagtctcgaggagtttcgtgagaggcagaaggagcagaggaagaaggtgaggcaggtgcagggggcgggggagctgctcccccattgccagcctctcagttgctgtgggggtagggggctgaccttcctggtagagccagtggagggcggcaggggtggtggtgggacagcactccaggctttggggcttgagggtgatctgaagtgggtagggagggcagaggcctggccgctggcactaaggccaactcttagtcccagagccccatggaaggtccttcctgtcgagctgcctcacgcctaggaggatcctactacagcagactctagagggtctgtggcaacttggcagtgtccagaggaggcagtctgagttgtgggggtcactggaaactggtcttgagtccaaggatcagggctgattgtcctggaaaaaggcagacttgcagccagtcaccccacaggactgcccaaggctgaggggtcagacacagactggggtgggagagttgtatggcattgcttagcatccaaaggtacttctcacccatatgtagggcatggctgtcccgagacagagtgactgcatggaagtgaagtccccatcatgggaggtgtgtaagcagaggctggcagatgcttgtcagggaggctgcagggctgaagttggatataggttccctggagggcaggcaggacgcagactggcctggaggctgggcttgggcctgtgaggatgggggctgagcctctcagggccttagtgatgagggtggtgccctgcacagggtggcagggcagcacacagatccgcttcttgcctggggaggaaggatcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggcca

SEQ ID NO: 113 - DNA, 10018 bp, Homo sapiens
  source 1..10018: mol_type = genomic DNA
atcgttgtgaagtggccaaagaattgaaaatgaaaagtcacaactgagccttgaaggggaagaagctgtacctgaggctggggccaggctaggcctgggtgtcctggccataccacttcccatctctgtgcctcagtttccctctcacaggatgggacacatatgtctacctcccaagtgctgggagctcagcccaagccatgcgcccctcagtctccacagacagggctccagctctggttagcagctctgctggcagaaatgtagcgtggctgcccgtgccacctgcccatctgccagctgggctttcaggattctaaatgtggggttctgagcagacagggggtccccagaagccagcccaggcttgaggtgccggagcaggcaccctctctgagctgggacgtgcccgcagagcctgcagagaacctgccaggaaggagggaccccggccctgctattttgggccctcctgtggccagaggagctgcactggctgcaaaggctgttttggacagagcattctttctccaagtggccagggccccgcaggcagagcgctgtgttgtagtgtgtgccatgtgtgtctgagcctgtgtgtgtatgtgcgtgtgccacagagcaaggacatgtgcttacaggatggtgcacacgtgcctacgctcccctgcatatgcctgtgagcatgtgtccttgtccagccctgtgcacttgggtgttttgtgctgtgtgtgtgtgagtgcctgtgcctcgctggtctcccagctggcacagaacccctcccctgagaccccaggcacaaactggctcagttctcctcctacctcataacccagtcgctgtcctggctgttttgccttctctatcagaacaggaagcctgggaggtgaggggaggctttggccccagacctcggcacaggggcccagtggccactgtgcctgcatgtggcctgtggttgtgtgtgggtgactgtgggagtgtgtacttgtgagtggcatctgtgggtgtgcacaggaatgcctgtgatcatgcgtgtgggcagctagggatggggcctgtgtgcctccgagttaatgtggaactctgcatgtatgtgtgtgccagagtgtacacacacgtgtgagcgactgtgatgcctgcagaggctcagggatgcaggatgaacgactgtgtgcgcacgtgtgttggggtgggaactccccagctggagacgaagctctggccaaggtctgcagcaaggacctcacggcacacccatgccctgtgattctctgtggccttccattgtgagggtcactgtgaagcagcaggctctgggggagggagggcagcctgtcaccctctctccagagccaggagaggtgctgcgcctcatcccagggacactccgtcctcttggcctaggggagcctcccgaggccgcggccctcggctcagaacctcgtgtcccctgcagtatgaggccgtcatggaccgggtccagaagagcaagctgtcgctctacaagaaggccatggaggtgagcgccagggcctggggccgcggccttccctcgaggagcagcgcaggtctcagggtgcgatcctgggctgtggccccgggcagggcatttggaacaggctgacctcagccttggtcctcggacctcggccttgggcgcaccagcctgcggggcgcttgggcccgtgctgggcgctatggccccgtggggatggtcccgggcccttcccttgtggggctcgtgaatgaagggcagatgaagtcagctggggactccaggggtggagggaggagggacccctgagcttgatcctgcgagacgctggacaggaagggagaggggctcctaagagggcgcggcgtggcgaggggcgtggcgaggggcgtgccctcgccgaagagcacagcccaggaggcggggcccggggcaggccgcgctgtcctcagtggggagggcctgagagcaggactaccagcagcccccacgccttctctatctccttccggacccccagatccctgtccctggtgaggatgcccccactccacccgcaaccctcgccagggaaaaagggaggctgggctaagggagcctcactcccggggaccacagaacagggctgtgcagcccccaagtcacgcccctccacacccccagtccaagaagacatacgagcagaagtgccgggacgcggacgacgcggagcaggccttcgagcgcattagcgccaacggccaccagaagcaggtggagaaggtgcgctgggctgctgggccgtgtgggtcgcccagggctgggggcagtgggggaggcaaggaaggggtgccgtagacacccccaggcaagatctgcatctggggatgctgcttagccctctctgacccccaatctccccatctgtgaaatgggtttcctggagagaacctcaggccatggacaggcaggtcagctggatcccctttgccaccgtcaggcggcactcagggacccattcctcggtgcaggcccactgaggcccacagggtgatgagagcagacgccaaccctcacacaaccttggagaagggctcagtaggcccatgtcacagagaggaaactgaggctcacagtaagtgacttgtctaaggtctcagagccaggaagcagcagaaaagggacccccaactcaggtggtctagagcccatgctcctgatgctgtggcccctaggccagagtgggggtatcagagctcccagagcccaggaaacacatcactcattgcacagacaggaaggctgaggcccagagagggaagtggcctgagggtgagctgggggcagtcagtcaggggccagagcccaagtcccagccagggggctcagcagtagttgcacctctcctgtgggttgtggtctcactcttcacaggcatcctcctgggctcggttcctgtcttcgttctctttccatggagctagcctgtggtcctctgtgggcggaggttgcttgtggatgatggcatctgcccatagttggctcctgaatgttccccccagggtggccggggaagcttgacagtcacttcaggtctgctggggtgggccctggctcctggggcaggggcttagcgctgcttcccctctgtttcctcagagtcagaacaaagccaggcagtgcaaggactcggccaccgaggcaggtatgtgggcctggctgccccgtccgaccagggcggaggcctgggcggtactccccacacacacctcctcaccctggggacacacacactccccctggctgcacaatcatgggcgcggcgctctcattccagatatgtgccgtcaaagtaaacgctgtgttcccccattcgccagcccttcttggcgcttcatgtgttcagtcctcacagctgccctccgaggtggctgctgttactgttccctttcttaacagatgaggaaacagaggcactaaaaggtccagtacttgccccaggttacagctgcatttgaacccaggccatcgggcttcagagcccaggacttgtgcacatagccttctctgggcctctgtccttcacttgatgcccgaatcctaccaacactcttgtccctgctggtgccccacccaccagacacagcacccaccctcctcccttcccctgggaaggcctctcccttctgctctgcctttactgggactcagctactccctcggctgggggacaggtgacctccagagatctgggcacagaagttgtgacccaagcctgtgggactccacccctcctccagcgccctctcagctgccttctctgaacctcagtttcccctctggaaagtgaggtggggcgcccagagatgcccagaggccaatactctggacttgcatatatgaggctccactccagccctcaggcagctcagagcacagttggggagcagcagcagcaccagcgtgggtggccctgacgggcattcagatgaggccccgccatctgctagggcaggtcccatgggggaggcggggctcccagtgggaggaggcatccaggatgggacctgctggagtacaggggtggaggagctcgtgtcagggccctccctgaggctgcctgcgctttcagagcgggtatacaggcagagcattgcgcagctggagaaggtccgggctgagtgggagcaggagcaccggaccacctgtgaggtgagtggcccacgtggagcctcgttttccccagctgggaagtgtgagacgcccatccctactccagctgcttaaaggggcccaagtgaggcagttggggaaggtacctgttactcactcgtttattcagcctcctgctcacaggcctgtgctgggccctggccctgttgcttgtcgcctggccttgagtcctgggccccttcgttgcaggcaggcattcttccaccctctttgttgaagccaaaactgggacttggactaaacccacagcctctctgggtgctgccgatggacagggcctggggaacagggctcaggactcccgtccgaggtccctctcactacccttctgcctcggtgtggtgcagcctgaagggaggctggggcagggaccccctgggcatctccacctccctccctgcagcctcagggctggcccggagtcgggatggggaccccagggcactctctcctttggactgggcttccagcagagagggctggcctggtcagctccggctgagctgtgaatggggcccagcctggccgggccctgcagccgcctcctcactgctcacctccctcccactgcccccaggcctttcagctgcaagagtttgaccggctgaccattctccgcaacgccctgtgggtgcacagcaaccagctctccatgcagtgtgtcaaggatgatgaggtgggggctgagggccttggtgtggggtaaggtagggcagcctctaggcagcaaagcacccaggtccatctgagccggtcaacaagcacctggtcctctgtgatccaagcctggccccaggggtctcaggcctcagcagctcagcctttgcccccagaaccccaagacaggagctcagtaccacacagggccatggcttctctgcctggaagatgatgactctgtggttcccctgacttcctccttatgcctcagagccacagagcacctgccccctctgccggggatgggaggggaggtggacacagctgtcagaggttggcagaagctggaggaccgtggctgctctgctctaggcctggtgcttgcaggagccgaggcgcagtccttcctctgctccccacatctccagggtgtcctggttccccttactgagcccaacctgctgggtgggtcctccccagcagagagggcccccagccagggtccctgagctctgtggatggatgcagcccagcacacggctctcccgggcagccctggcccccttgcctgctgtgtttcctgcctgacgctcctgtccggggctgtgggggttgattttcttgttgtttttgcccaagtgactcgagccccctgctgcctcctcgcctccttgaggtagaagggcgagctctggacccactctcctagccccaaggcctggctgtgctgcattctcgctgtgaccttgggcaagtcactctcctctgagtttcctcatctatccaatgggaaaagtggggtctaccttagaggacaggtgtgagttaagtcccttgcacagggccttgcacacagaaggtgttcaggaaacaggaagctgtcagccagggccgtgacccctcaggatcaaagaccccgagccgcgcacaatggcctgtgaggaggccggtgggtgggggccgctggtcagagttcaggcccacagaggggcagagtgggcatcgggctgcggcctctgctctttcctgccccagctctacgaggaagtgcggctgacgctggaaggctgcagcatagacgccgacatcgacagtttcatccaggccaagagcacgggcacagagccccccggtgaggtccggcttgcggacagcgcagcctctaggtgcattgagcccctgggaaggcccggccctgagcctcaagtgccaggaccgggctggggtagctcacagctcccttcagggcagagaagccctagcaggggttgtggggagttgggtcccaggcctgctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggatgggccagggccagattgggaatgtagggccccagctgagtctggcagggccagaatggggtgttgggggccgccctggggctcacggcttgctgtctgcagctccggtgccctaccagaactattacgatcgggaggtcaccccgctgaccagcagccctggcatacagccgtcctgcggcatgataaagaggtgaggccccgacagacggagggagggcctaaggctgggccaggaagtgggtcgagcccctcctctgcacctggcccttcctcgttcactgagcacctactatgtgtctgtatctggtgcccagtttaggtgctgggcactctgtggagacaagataggctcagttcagcctatggaaccctcagcccaagggacccagacactagaataatcacaccccaattattcactaggggaggtgctccgagctctggggaggcccctatgctggcttccttgtccctggggcctcatgtgagcctggtgccctgtcaggctgcagtggcaacgctgtctggctggagcaggactggggcatctggagaattctccaggcttttccagggctccttccccggcctggctgcagtcaagtgccaaggtcctagtgctgggcctcaatgtgtgacctgggcaagtcattcacactctctaaggccagggccctgagtgttggggtcagattcagaatctaaggactctcctggttcaggccttgagtgacgaaggtgacagcccattgggagcactatagccagcttagggagccctcgtagccaggcctttgagggaggccatgtgccctgtgagcatccacaagggtctgtgggtttcacatggtgcctgtgcccccaccgccatgccaccactcttcagccacccttcaaccaagaaggccctgcctctgggaggtagtggactgtggggagaggctgatgcagttcccggcccttcccaaggaccagctcattccagggcctcaggagcccctggaacttcctactcctgggaggcagaggctcgtgggaaccacccgtgcttagagagggcacacacacaccctctttgagaatcttgtgcaagcagtgaccccaggaggcagcacacccgcagcctcacatgctacaaaagcttgtgagacaggcttccctgtgcctggtgaggacctggatcccagcaaaggtggtcatttaagcaactggacaaaagagctcacctgaagcagtatcaggaaggggcagaaaggagtggccccagagaggattagagagagagagagagatgtcctgcagggccgagggaggcctggctgctggagggggctggtcaggcctctggatggggcatctagaagccaggcaggactgggaagaggcgggggtcagtgactgggagtcagaagtgtagacagtctggggaaaagaggtgtgggggcacgcagcacaatggctcagcaagccctgcacccctttccccctgccctggccgcttcctccacctgtccccagcccctgctggcttgcaccctgtcctttgctgcctggggagctggcacgtgtgtctgcccgcctgtgttggtgtcaggccctcccatgtgctgggtccacgcatgtccaccctgcgcatgtgtgtgcactcctggggccttggccctcggcgcctcatgtgggaaaggccccccacatgccaccttgaattgcagggctgccccccacaggcccctgagtcatggctcagcccctcacctgcattcaagatccctcagggtctggtccagtctctatttcagtcctgtcccccacacacccaaattggtccactccactccacaaaccccacctgtgccatgcctcctcccctgcacctgagccctccctctcctggtcacctgcagtgcctcgctcccccttctctcctagtaaagcttcactcatctttgaagactcagccccaccccactaagaagccctcttgccttggaggcagtgtcagcctctacttgttgagccctcactactgcccacttcagggggtgcccccagcatctgccgcatctgcctcttctgttttattttcctttattcagtaaaccttcatgaccccagctcagtccaggcctaagcctggtgcaggggcaggggtaaagtagcccagcgctgtcccggaactcctgtgaacagggtggctgagctggcctgatcaccgtgggcccacagggaggagggctggctcggcccaggcagtggaggcctcagcagggcacgtgagccaggctttgtgtggcagtgcaccccccacccctacccatgggggaagctgctagggcaagctagagcaggggcctggagggtgaggactgggcatcttcccacgaggcctcagtgcggaggtcctagaacccccaaagggccatgggagtcttccaatgaagctacagcttcgggggttctaggatcctcccaagggccctgcagggagcaggtgctgagatggcctgcagagggcgccagtggagggcgtagctggggaaggaggagccaccaggactactttctggggagccctcctgcctgaggggcacctcataaatgacatccatgcctggaggctaggggcagtcccagccctggcagagcgcgtgcagctctgagacctctccctgtctaaaccctccctcctggtgggtccctgagtgtggggcggggacactcaccctctttcctccctgttcccaggttctctggactgctgcacggaagtcccaagaccacttcgttggcagcttctgctggtaaagggggtcaggaggggacccccaaacacactgatcctgggggggaggagaggtctcccacatggcacagatggggccactgaggccctcaagaggaagtgtgtgtcccccaacagcaagtgtggacagcagaaggaagaggcagggcccagcatggagaaaccccattctagtaggacttccaggggccagtgtccccagaaggggaggggtctatgtctcaccctgctcttagcgtccacagagaccctgacccccacccccgagcggaatgagggtgtctacacagccatcgcagtgcaggagatacagggaaacccggcctcaccagcccaggagtaccgggcgctctacgattatacagcgcaggtgaggcctctataccccaaacccacctgtgccacctcccctgcacctgagagctccctctcccatccagtgccttgcgtcctcatctctcctcatggtttcactcatcttcgagcatcctctcctcctcaggagggcacgtgtgcccgagtgtgtccacactagcaagggtacctgggagtgtgcttggatgtgagctctgagaacagcacccagggcttgcggggcctcagtgtgcatgtactgactggaagctggtgtgcagcaggcctgtgtctgcccgggcctgtacacagcacacacgtggagcacatgtacctatgccgtccacacaggctgggcgctgagtggtgcacacgtgcggggagctggcagagcctggagctgcctgcaggtcatagcttgagggccaggctctgtgcctttgggtcagggccctgtccttcgtggccatgggtgtggaaaactgtggcca

SEQ ID NO: 114 - DNA, 16851 bp, Homo sapiens
  source 1..16851: mol_type = genomic DNA
attatcagaagttgtgaggaccgaattgaatgtgaaaactctagccataagatgtgttcagaagagaacacccgaaggccgggcgcagtggctcacgcctgtaatcccagcactttgggaggacgagaagggcagatcacctgaggtcaggagttcgagaccagcctgaccaacatggagaaaccccgtctctactaaaaatacaaaaaattagccaggcgtggtggtgcatgcctgtaatcccagctactcgggaggctgaagcaggagaattgcttgaacccaggaggtggaggttgcggtgagctgagatcgtgccattgcactccagcctgggcaacaagagtgagactccatctcaaaaaaaaaaaaaaaaaaaaaaaagcagaagagaacacctgtgaagggaaggaagggaagggccagcttaaggacttagggatgtgctgagtccagggccagcttaagaacttagagatgtgctgagtccaggggaggaggcagctgtaggcgaccggtgggtgtggcaaggacttgctccgcccctactgccaggaggtggcagagagacctactggggaaattatttaccctacagatgaggacacgggggctcatttccttcataaacagccctttatcaataagataaagcccaacagcccaacagagaaaagaggggcaaggagaggatcctgcggttcacagagaaacacaagtaactaatatcatgaaaagattttggatctcactcaaaattaatgctaattaaaacatcaacaacgctgaacaatacatattcaccactggcaaaactttttaaagattgctaattttcagggctgaggagggtgttggggaaatagggttcttccagctgacgggatgtaaattggaacaacctttctagaggacaatttggcattagctgtcaaacagaattactatttttatttttattttattattttttttgagacggagtctcgctctgtcgcctaggctggagtgcagtggcgcgatctcagctcactgcaagctccacctcccgggttcacgccattctcctgcctcagcctcccgagtagctgggaattactgttattattttgagacaaggtctcactttgtcgcccaggttggagtccactggctctatctctgctcactgcaacctctgcctcctgggttcaagtgattctcccacctcagcctcctgcgtagctggaaccacaggggcccaccacaacgcctggctaatttttgtagtgtttgtagagacagagtttcaccatgttgcccaggctggtctccagctcttgggctcaagtgatccactcgcctcagcctcccaaagtgctgggattacaggtgtgagccactgcacccagcctcaaacagaattactaagatcctagaagaaaatatgataaaatatttctatattcttggagaagggaaaaacctaagcaagacacaaaatccagaagccctaaaggaaaaaatgaacagatttgacctcataaaaatgtaaaactgtagggctagagactatgacaaatataaaagacaaataatagacaatatgtgcaacatgcaaaatagcactaaaatgcaaacagccccttcatatcagaggataaaactttatattccaatatataaatggtcaatggataagaacaggcaacttgcaagagaagaaattcagatagcctggagttgagaaatgaccttgatgctccctggggatgagataaatgcaaattttaaaacagataatatctagagttggcaaagggaaagtagtgctccgtaaactgtgggcactatatgctgtagaatcttttgaagggccatttggaagaacctatcaacactgcaaatgtgcagataaacttctaggaatctgtcctttggaaatgccagctcaaccctacatggacatgaacgagtacaataggcaccccccttatcctcaggggatacgttgcaagacctccaggggatgcctgaaacagctaataggactgaacgctatgtagactatgtttgttcttatacatgcatacctatgataaagtttaatttataaattaggcacagtaagagattaacaactaataataaaatagaacaattataacaatatactgtggtaaaactgatgtgaatgcggtctctctctctctcaaaatgccttattgtactgcactcacctatttttagatggtggttgaccgcaggtaactgaaaccacagaaagcaaaactgcgatgggggggggctgcctgcatgctcctttcagacctgtttgtgagagagttttaactggagggcatctaaataatcagagagtgggaagagaaaggggtactcactttttatagttttgtattgtttgtgaatgttttctatttcatatgttttgtaattaaagccaaaaagggtaatgacaaaaaggaaaaaaaatgctatgtgtctgactttcgggaatttattagagggagtggaaattctaccacctcctattgctaaatctcattaaaatgcccttgaaatcaacccaaaccaactctcaggcacagccagaacaacggaggcagagcagagctcaggatcctgaatccacaccccccggccactcctggtgggaagagaagaagaggagagctcgcttcccaccatccccatcccacctggctggagaggctgatgtggggcgaggtttggccatcagtccacagaggggacttcatgtacacaattcattaacatttattgagcacctatgatgtgccaggcactgttctaggtcctgaggatatggtgatgaacaagatccctgctctcataggttacccagtgggtgccctaagcaggcaataaataaatatgtgagcaagatgacaagagaatagcagaaggcactaaagttttggagtaaagccatgaactctttttttttttttttttttttgagacagagtcttgctctgtcacccaggctggagtgcagtggtgcgatctcggctcaccacaacgtctgcctcccggattcaagcgattctcctgcctcagcctcccgagtggctgggattataggcacgtgccaccacacccagctaatttttctatttttagtagagatggggtttcaccgtgttggtcaggctggtctcgaactcctgacctcgtgatccaccagcctcagcctgccaaagtgttggaattacaggcgtgagccaccgcgcccggcccgaaagccatgaactcttttcccaattattttcttattgagaagcatctctcagcttgctgttgggttctgctgttagtaagcgtaaggatggaggaaggctggctgatgacattaagcagctaaaggcgtggactgtcgaggccaaatagcatcagctctctttggcttccccagcccatggaacagtcttcctattttgcgaatttcctaccttatgaactcacacctgcttatgatggaagccagaacctttccccatctctcttgaagattgggcacagcatacaacttaagacaccacccgttggctgctcctgcatgaggctaagtgacactgagaagcagatgactggagtcctttctgtcaggatgacagcagatcccagaggcagcagcagaaagaaccagtgcaggtaaatggcctttgagcctggttctctgatttcgctaagattttatgaggcacctcctatcctttaataggttcctctgtagcttaaaagcagctaaagagcagtctgttgcttgtaattaaggactcctaccagtacacgaagggagaaaagcaataatcaaataaattactttcagatagagatcagtgctaggaggaggtcagcacaaggtgatgtaagacagagtgacaggtggggtgagggctacacttgataaggggtcagtgaagcctctctgaggaggtgacgttaggctgagacccaaacaatgagaaggaactagccatagaaagatctgggcgaggagacttctagacacggggagcagaaaatgtaaaggatgagcttcagatgttgatggatgtagggagggttgatgtgtttggagtttagtgcaggtgaataaagaggaacataatgagattggaaagtaggtaggagtcagttcatgccaggccttgcagatcatggtaagacatttggattttattctgaggttagtgggaagccattagagagttttaaacaggacataatatagtacctggggtagccagcctccaaaacatcctccagtgatccttgcatccttgtatttacactcttgtgtagcccctctcacattgactagggctgacccaataggatgctgcaatgtgacggtatataactttcaaggataggtcataaaagacattgtgactctgccttggtctctcaaatgtctccctctggggaagccagccaccatgttgtgaagatactcaagcagccctatggagaggcccacacactggggaggcactgcggctttctgccgacagccttgtgaatgagacaccttgaaagaggatcctccagccccagccaagctttcaaatggttccaactctgacatgctgacaacttcatgagaggccctgagccagaaccacccaaactcctgacccattagtgtgttatgtaacaaatgtttgttgtttcatgccactaagttttggggcaatttgctacctctagccattgttcccagctggtgtgtagtctgactggcaggtgcccatgctttattagtggtttgatattttgactatcggccctgagtaggaggaatgacacagagaggagatagagttgtgagtgagaggaggccaaatcgtggtgtcagagcgagaagcagcaccctggggagggctgagtcacttgtgctgtctggaggaaggcggagcaaagatctgcagcccagctgactgtggtctcagcttttctagcctccaggctttctcccgggttcctaagtctgtatgtgctcactggaaatgccccatgacttggggtgacatgggtgagttttcttcctccttcctcccagagccacgccagacctgatgctggagggctgggctcttgtcctagttccccgtcctgggctgggcccagggcaccggccagtgggagaaactgccttctccgcctcctacatgcactggtggtcacacctcgccccacatcagcctctccagccaggtagggtgggaaccacaggaaacgagcccccttcttctcttcccaccaggagtggccggggggtgtggattcaggatcctgagctctgctctgcctccgttgttctggccgtgcctgagagttggtttgggttgatttcaagggcactttaatgagatttagcaataggaggtggtagaatttccactccctctaataacttcccaaaagccagacacatagcattttttttcctttttgtcattaccctttttggctttaattacaaaacatatgaaatagaaaacattcacaaacaatacaaaactataaaaagtgagtacccctttctcttcccactctctgattatttagataccctccagttaaaactctctcacaaacaggtctgaaaggagcatgcaagcagcccccccacattgcagttttgctttctgtggtttcagttacctgcggtcaaccaccatctaaaaataggtgagtgcagtacaataaggcattttgagagagacagagagagagagagagagagagaaaccacattcacatcagttttatcacagtatattgttagaattgttctatattattatcagttattattattatttttgagatggagtctcactctgtcgcccaggctggagtgcagtggtgcaatcttggctcactgcaacctccgcctcttgggttcaagcaattcttctgcctcagcctcccaagtactgggatcacaggcacccaccactgtgcctggctaatttttgcatttttagtagagacaggatttcaccatgttggccaggctggtctcaaactcctgacctcagatgatctgcctgtctcagcctcccaaagtgctggaattacaggcgtgagccactgcgcccagccttagttattattgttaatctcctgctacactaactccatggcctgaacagtccacccctttggctgcttaacatcgtcatctgccttcttccatccttgcactcacaaacaacagaacccaacagcaagtggagagatgtttttcaaaaaggaaatagttgtgaaaagagttcatggctttgctccaaaacttcagggctttctggcattctcttttcatcttgctcatatatttattcattgcctgcctagggcatctgctgggtaagctatgagagtggggatcttgttcatcaccatatcctcaggacctagaacagtgcctggcacatcataggtgctcaacaaatgttaaattaatgaattgtgccatgaagttccttcctatattgaatagagctgacctgtgtagccaatagggtattgcaaaaatgacagtgcatttcatgaagcctcagtttccatggctaagtgcctcttcctttggttattcccaatttcagattccagagaaggggaatatgattggctcatcttatctgtctgtaccaagccatgccatagattgccaggtggcctataaattggaagcttcagggagatgtgtctgcctaccttagtcaattagaagtcccatggccgctcagacactgtggttgacaagtctagtatgatagggtcacatcttatcggaggagtgattctaaaatctctacgtaagactttatcccatacagagttactcatgaaaatcccttaaattacccatacatttatttatttatttatttatttattttattttatttttttttttgagacagagtctcgccctgttgcccaggctggagtgatctcgcgatcactgcaatctctgcctcccggattcaagtgattttcctgcctcagcctcccgggtagttgggattacaggcatgcaccaccatgcctggctaatttttttttggtatttttagtaaagacggggattcagcatgttggccaggctggtcctgaactcctgacttcagaggatccgcccacctcagcctcccaaattgctgggattacaggcgtgagccaccgtgcctggccaaaaaatacacatctttagacatgaaagtcacagtcctcataatgagatgctcacagtgtaagaggcatttgtgagacccactgagagagtaacaggctcccatcgcatctatctctgcttattctgggcacacactctgagtagaatgataggtagactcgctggcactatttaaattgtcctctcccctccgctccattcctccttcctttcttctctttatttacacatacatgctacaagggtttaaacatccacttgctcttgttggatttacacatgaattgcatggaggtctgaatataagaggaagaaaattaatctgatcccagtgagaaagccctgagcacagatgtaaaagaagaaagcagcaaaattgtattgataatcctatttcctgaaatagatctctcatatgaaatgtaaggagattttagaaaacagctattacctattctgagggagattagacagggacagtgcagggggaactgggtgcttcatcatatcagattgtccctggaagcggaaataaataggcttacaggaaattggattattaagcagaagatcaacaagagaaacctatgtggcaagtgagggaaattaatggagagatgaaaagaaaacaagggaaaatgccaggcatttaggataaagtgtgaagatatagtatgagggaaaaacactttaagtttctggataaaataaatcaggtggaaggaaatcaataatcaaaaacttgttctctctctcactcacaccacacacacacacacacacacacacacacacaccccattgtaaaatccttaaggacaaagagcttgtctattttcttcactgctctctccccagaacttaaaacagtgcctacctagcatatagtaagcactcaataaatatttgtcaaataaatgaatgcaagactttaaaatgaactgagatgggtcatcttgtaccaattaaaacgagactactgaccctaagctatctcttggcgaaactcttaaacttggtacaaaaataaagacttctggccaggcgtggtggctcacacctgtaatcccagcactttgggaggccgaggcgtgtggatcacctgaggtcgggagttcaagaccagcctggccaacatagtgaaacccagtctctactaaaaatacaaaaattagctgggtgtggtggcgcatgcctgtaatctcacctactcgggaggctgaggcacaagaattacttgaatccgggagtgagaggttgaagggagccaagatggccactccagcctgggcaacaagagtgaaactccgtctcaaaaataaataaataaataaagacttctcccaaatttcatgcagaaaaaattcaaacttagatgatttccgaagatcttaataatcaggacaaccgtgaacttctcatgcaaccgtcaatgcctgagacaatggagtgaaagctaccagatccttaagagaaaagtgtcccccaggactcttaaagccaccagccctgatgttggccacgggaaaagacaatcaaggaaaatctccgaccttcggtgaaatgcagagactaagggacccctgtgctgcgtgtgatgcgattttgagagaaaaaaaaaaaaaaaggccaggtgtggtggctcacgcctgtaatcccagcactttgggaggcccagacaggaggatcccttgagctcaggagttagagaccattctgggcaacatggcaaaaccctgtctctacaaaacaaaacaaaacaatacaaaacaaaacaaacagaaaaatagccaggtgtggtggcacgtgcctgtggtcccagctaccctggaggcctaggcggggagatcgcttgagcctgggaggtcgaggcttcagcgaaccaagatcacgccactgcactccagcctgggccacagagcaagattgtcttaaaaataaaacaaaacaaaaactaacggagccctgaaaagggagcgcaattcatcaatccgctgacggtgatgggccccctggcccggtgcagcggacccttaggtcctggtgggggagtcggtcagtcaatgcatgggtgagcaaatgagtgaagcaacgcgagcacagcgctggcccggatctaacttggcggtgacagcccagccccgagctggacatggcaggcccctcggcctggccgttgcctgagaaccctaggatcacagcgttgggccggagtgggacagggccgggtagcgtcccccgacagagctgggtcagggccttgttgtggccgggggcaggcccggcagctgaaagcgtaagacccccggagcccggcacagcgctcctcaccaccgggaaaggcggctgggcctgaccgggctcccgcatccccccaccccggagcgtgcagccgccccaaacccccagcggcctccggcttccaggtgagcagcaccggaagggagcggcgccgcgtcctcaccgccgcggggggggctccccagccgcgtccccgccgcttcacgccctccgcgtggaaggacgggggcccggggacccctgcaaacggctgagaccccaaagcccggctcctctgcccggctgtccctccccggagctccggccgcacggccgcttccggcaccgaggacgccccgggctccagcgttcagcctgcgtttctggacacccgggatgcgcagggggttggacaggaccgccccaaacctgcgtcgtggggcttcgccctcctgagatcacccaggcagcctgtgcgcggccccaccacagcgcctgaggcggcaccgcctgagcgcgttcagaaagtaggcagtacttttatttttattcttattctgagacagggtctcgctttgtcgcccaggctggagtgcagtggagcgatctcggctcaccacagcctcgaacttccgggctgaagccatccttccgagtaggtgggactacgggcgcacgccaccacgcccggctaatttttaaactttttgtaaagatggggtctcactacgttgctcaggctggtcttgagctcctgagctcaagcgatcctcccgccttggcctcccaaagtgatgagattacaggcgtgagccactgtgcgcggctggtagtactttttgtaccttggggacaaaaataaaaacccaggcacttaagtggcactcctacagcagcagtgacttaataactggagatagaaaaataaaaaaaaataaaaaaaaatactggtgtctgaacaaagagacatacttagaaaattgtgttatactgactgacatgcctaattcccatcccttgtggggcgtggggggcggagcacttactcctcacccccgaaacccctcaaaatgataaaaataagtgagcaaaacagacccaaaacagcagccctagctcccatcattcccaagcagtttgctgactgactcacctggcatttcgtggatgcaaagaagagccccttccaccaggtgaagaagaaaagggggtctgggcactatggctcatgcctgttatcccagcactttcggaggctgaggtagacgaatcacttaaggtcaggagttcaagaccagcccggccaacatggtgaaaccccgtcttaactaaaaacacaaaaaaatttgccgggcatggtggcacctgaggcagaagaattgcttgaacctgggaggcggaggttgcagtgagccgagatggtgccactgcactccagactgggcaacagagtgagaccctgtctagaaaaaaaaaaaggagacgaggaaggagaagaaacacgtggttttaggggggtttatctgagggtggccaggcagctcctgggaatctgcgctgaggagcagccaggcctgggggcagggatgtccagggggagccaaagcaggcccagcttgccttcctttctgtctgcgcctctgttgctcggtggcatcttttttcgactgtgtccctgtttctgtctttccatcttgccatcacttgaatcctgtttgactctgtctccaactgtccctgcctcaggacagaaatctcttctccctgtttccccagctcacctacttttcccctctccccgctgtgcagagctgctccctcacctctgctgaaacacgtgggtctttccatgatccaaacaagtttggtgattacactaactgaccctgtctctggatgtccccatccagatccccagggcagactgagcaatgggctcagtctctggggcacttccccacggggcagctgccccctctgccctgtggttgtgtgagcacgtggggttggaatggggacacagtccactcttgggagtggcagtgagtgtgagagttctcagctaaagggcaaaacctggggacacacctcaaaaaaaaggcttctatttagggcagtgaaactactctgtatgatacatccatactctgtatggatgcatgtcattgtacatttgtccaaacccacagcatgttcaacagcagagtgaaccctaatgtacgctgtggactctgggcaatgatgatgtgtaggttcatggattgtaaaaaatggactgctctgaggggatgttaatcatcggggaggctggcagggagtacaccggaactctctgtaccttcctttttgctgtgaacataaacctggtctaaaaaaaattaagtcttaaaaaaaaattttagctgggtgcagtgactcatgcctgtaatcctagcactttgggaggctgaagggggtgggtcgcttgagcccaggagttgaagatcagcctgggcaacaaagtgagacccccatttcattaaaaaattagccaggcatggtggcacacactgtagtcccagctactcgggaggcttgagtccagaaggtcaaggctacagtgggctatgatcacaccactcacactccagcctgggcaacagggaagaccttgtcttaaaaaaaaaaaaaaaaaaaaaaaatcaaggaccaagagcagtggctcacacctttaatcccagcactttggaaggccgaggtggatggatcacctgagttcaggagtttgagacctacctgaccaacatagtgaaaccccgtctctactaaaaatacagaaattagccaagcatggcagtgtgtgcctgcaatcccagctacttgggtggctgaggcaggagaatcacttaaacccaggaggcggatggttgaagtgaactgagatcgcaccattgcactccagcctgagcaacaagagcgaaactccatctcaaaacaaaacaaaacaaaacaaaacaaaaaattaaatttttcttaaaggggaaaaagaaaataaaacgcttctatgttaaggaaaccccacaaaaagaggtgctcctggaaatcctgcagaaaagcctgaatgtaactctcctaatgccttgtgctcccttctgcagattttacaaatatatagaaatatatgtacattcctaaggcttaaagataaatttcacatgtgactgtgaaatgagatcgtaaaaagatgtttctgttctatatgattcagggtgaaaggctttctaaatgcagtatgttgcattagtatcttcatacagcctcttcctgacatcaaggttctatgcttatatatcatgcattaacattgctgaaaatctatgtaaaaacttggcccaggaagaacctaattaaaatatgcagtttccttgatttaatatggccaagattttgccaaaaaaattctacatgttttcagagatagctctgggaacagagctttttctgtcgctctttctcaagacaccccctttgaatctcagtgaaggaccaggaaggtacctcaccagccaagagagaccatctctgaaagacacagttgcttagatgtggggccagtgatgattggtagatttattcttctagattcttttttttttttttttgagacatgttctggctctgtctcccaggctggagtgcagtggcaagatcttggctcattgcaacctatgcctcctgggctcaagtgatcctcccacctcagcctcccaagtagctgggactacaggtgcatgccaccacacccggctaattttttttaaaacttttttgtagagacgtggtttcaccatattgcccaggctttctaaatgttgaataaacctcaaaagagaaatggcagcatttgcttctttgtagaaactaaatgtggcaaaattctcccatcctgaatcacaaattaattgttcaaatggctatttctcatccaaggtgttagacagttctctcatttccagggagtttcgtgaaaccatggtttgcctggcttctgttttttgttgttgttgttgttgtttgtgggtttgctttctaagagacggggtcctgctctgtcgtgcaggctggagtgcagggcacaatcatggctcactgcagccttgaactcctgggctcaagcgatcctcctgcctcagcctcttgagtagatgggaatataggcacatgccactgtgcctggctaactttttaacttttttgtagagatggggtgtcactgtgttgcccgggctggtcttgaactcctggcctcatgagatcctctgggcttggcctcccaaagtgctgggattacaggcatgagccaccagacctggcctgcgtctagtttcaaattgtgctctgagagtcccagggatgggctggagctgccctcctaccccacacagagcagctctgatttgatctgttttacttattttcctaatgtagttgttgtttgattagttatacattaaacatcagttatatagcaacagccccctaatccagccctgtagttgtcaaactcttgggtttttaaaaatatttacatttctaattctaaataataaagcttatatgtctattgattttttcaatttgaaccaccatctactgacttcaaacttcctactctgaaaaatggagactaagctctctgaccatacccctcaacacctatacacaaacacaccatttccccctgctgatcttccccagagagttacatcacaatgttcaaagaaatcaaaagtgtttgtttgtttatttgttgagacagagtcttgcactgtcgcccaggctggagtgcaaaggcgtgatctcagctcactgcaacctccacctcccaggttcaagtgattgtcctgcctcaccctcccgagcagctgggattacaggcatccgccaccgcacccagctaattttttgtatttttagtagagacggggtttcaccatcttggccaggatggtctcgaactcctgacctcgtgatccacccacctcagcctcccaaagtgctgggattacaggtgtgagccaccgcggccggccctcataagtgtttatatcatgatgactgtagaaggtactattcaccctgcccatgataggaagaatgcctaactccaagtgtgagatcgggcacagatttccagaagttaacagataaagtgagacttgaagaacacgcctagggtagcaaggagacggggagcttgggtggaaagacatttggggaattggaggcatgagggaaactgagaggcgctcaatgggaggggctggaggggtggggagcagggggagacgccaaggagttcagtgcagagcagtgtcagatcagatttgcattgaggaacatgcctgtgtggtgcctgatgaacatggacacaggggtgactggaggtacagctgggcctaccccagctgagcctcatgagtgagctaccagtgagttcggggtagtcctctggcaagaagtgtcacttgtcagaagtcagaggccacccagggacctggttggatggggatgccaaccatgagagtaaagaacagctcaggccgggagcagtggcttacgtctgtaatccatgcactttgggaggctgaagcgggtggatcacctgaggtcgggagttcaagaccagcctgaccaacatggagaaaccctgtctctactaaaaatacaaaattagcccggcgtggtggcgcatgcctgtaatcccagctactcaggaggctgagacaggagaatcgcttgaacctgggaggcataggctgtggtaaggtgagatagccccattgcactccagctctgggcaacaagagcaaaactctgtgtaaaaaaaaaaaagaacagcccagcttagaagggagaaagatgagttctcatctgggcacgtcgagtttcagatgcctgtgggagctgtggggctgaagcttaggagaaaaaggccaggaacaaggtggagaaatatatattttttaaattgtattaaaaaaatataattttttatggctgtaaaatttctgttaaaaaattggctttgtgtgggaaaaaaatcgtgctaagagcttgctttggaaggtgaaacgcccacttctggagggccggggtgtcagccgatctcaagattcagaggagggaagatgcttcagacaatagggaggactttggagttgcagcagtaaaatgaaaggtaaagtgggagaggagctgaggtggaggcaagaagcaagatggcagaggctgtgccagtcctggtaagacccctgcctagacagcccccaagacctctggcaaagtctaatgaccccacagtggggtgtgattaaatgttgtgggggaaccaaagacaaagttgagttttccttcagaacctggagtagacagagaggcagcacacaggaagtcagatcccaagaggagacgaggccagagtccctgggaatcacagcaaaaccccagggaggccttggaattccaagatccatggctcacctggatttccagtggcttgggagcccctaattgaactgtccaaaaagatgacggagtgaatgaagtcccacactggggtggagggagaagggaagagggcctacccccgctaaggcctgggtgtgagctgcctgggaagtgtgggtcacagacgtggggtaaagggagatttcaaggaagaagaggccccaaacgccaggtggtgctgggaagccaagtatgatggggagtccactgggtctagtgacaaggaagatggcagatgtcggactgcagatgggggaagagtgaacaggtgccgtggattgaatatgtgtatcccctccccagattcatctgttgaaatcctaacccccaaggtgatggtattaggaggtgagcctttagaaggtgattaggtcatgagctaagagcccccagcagtgagattactaccccatgaaaggaccccagagagttcactctgtctctctctccccatcacatgaggatacaaagaaaattcggccatctgcaacccagaagacatcccttgccagaactcaaccatgctggcaccacaatctcattccagactccagaatgtgagaaagtgcatttctgttgtttataagcctatgggagtctaaagcaacctgaatggactaaaataggtgatgagaaagtaaagcacagagtgcatatgaaactttctagacacttgaacatgacgctgtcctgggagccctttggttatattctcctccaaaagcccaaagaccctgtagtaccatcacacagctattttgttttgcatatttttctggaaaaaagga

SEQ ID NO: 115 - DNA, 109077 bp, Homo sapiens
  source 1..109077: mol_type = genomic DNA
tggatgccaaatagacatttgttgtgaccagagaaagactctagatgctatggaatattaaaacaaaaagaattaatttggatgggaaggttcattgaaggtctctgtgaaggactagcattgaggttgatgggtaggtaggaattagataggaagagagatggaaaggagtggtgcagactgaggagacagcgtgggcacagcttgaggaggagaggaacctggcaaggttgatcaatccacagatgagtgtgtccagagtgatgtgacaaggggctagagacatcagccttggaggcacagtagggtttggactgggttgtgagtacactgggaagccattggaggaatttaaaggttgggggtacctgatccaataaatatttttttttctatttttatttttttgaggcggagtctccctctttcgcccgggctggtgtgcagtggtgtgatctcatcccactcggctcaccacaacctccgcctccccagttcaagtgattgtcctgcctcagcctcccaggtagctgggattacaggtgcccgctagcacgccccattagtttttatattttttagtagagatgggggtttcaccacgttggccaggctggtctcaaactcccaaccttaagtgatccacccacctcggcctcccaaatttgctgggattgcaggcatgaggcaccacgcctggccctgatccaaaaaatattttaataagatctcttgggctattgggagaacacttgtttgggaggggaagcgtcaatggatgcctatagccttgcctggtacagagaaagtactcagtaactgtttattgatgaatgaatgaatgaatgaatgaatcagttaattaattaacaggagatatcagtaagtgatttgttcttaaaaagaaaccttgcagaaacttgaaggtgtttgtttgggatgactaagcaagggtagacagattgttgttactcataaatgtcaaaataagaattataaaatttagaataatattgttgtcatgctaagtgatatctggagttaagcgtcctctctgacctgcgactgctcgtgagacagttgcatttactcaggtaactgtggctctcagagtcattcttaaatgttttctttttctccccaatgtgtttgtgactttgtccatctggaagtcaagttcattttggccaattaacttcaaaggcctgacttctctatttttttttttttttttttgagatggtgtctcgctctgttgcccaggctggagtgcagtggcgcgatcttggttcactgtaagcttcatctcccaggttcacgccattctcctgcctcagcctcctgagtagctgggactgtaggcgcccaacaccatgccccggctaattttttatattttttagtagagacgggttagccaggatgttagtgttagccaggatggtctcaatctcctgaccctgtgatctgcccacctcggcctcccacagtgttgggatcacaggcgtgagccaccacgcccgaccggcctgacttctcttgtgaagatggctccgttagtgagcgctgtggactaagatccacaaacacagctgctatgcgggttccctttctgcatctttgtgagtttcagtgtcctaagctagccctcatataggcatagactccttgatattttactctgcataatcaggacaggaaaagatataggacctgtattaaagggacacaagattcagaatcacattaacttccaaatctcagtgccttaacacaatttaagtttctatcttcttggccgggtgtggtggtcacgcctgcaatcccagcactttgggagtccaaggtgggaagatcacttgaggccaggagtttgagaccagcctggtcaacatggtaaaaccccatctctaccaaaaataaaaaaaagtagctgggcatggtggtgcacgactgtagtcccagctactgggagaggctgaggcatgagaatagcttgaacctcagaggtagaggttgcagtgaaccaagattgagtcattgcactccagcctgggtgatagagtaagactctgcttaaaaaaaaaaaaaaaaaaaaaaaaaaaaagtttgtatcatgtgtagctctaaatcggtgtcctgatggatggacagttctactccataatgtgatacagggacccaggctccttccctaggtggctccacctttatggttgccaaagaaagagaggatcatatgtgctgagcctaaaatgataaagagcagcacctccattcccattccatctgccaaaagtgtcatctggtcacatctaactgcagaagaagctcagaaatacagtctctgtccttggaggagaaaagaaacctactgttcaatagctagctcagctctgctacaaaacgcctgctatagaaatgggagacaatcatgcattccttttctacaatttatggtatttcatgggtgaaccattaatacgtcaccgggtaacgcattattgaatatgttagtcattttcttttctcatcgtttcttgaaaaagaagttgtctaacagtcctaacttcccatctggcttcttaaaatctgttttacaagcaatgagatagttaaggattttcagctctgtggttgaattactccaaagaaagaaaactgcttttgaagttagaaactgaaacacacagcaacagaagcaaccagaaaccccatagggttttaaccttgttttgtcatatttctcaacaaactccttatttgtttggggattctgcttagctctgtgcagaggtatcttgctttctgtatcacttcaaaccttccttctacgtgagttagccttagggtatgaccacgaatgacaccttcaaatgggaaccttttgtgcctagagaaatcaaatcatctttcaagacttggctcaaggggtgtatcttctgtgaaggtcttacggactttcaccccgcttcgggggtgacagttcctttcttatgcccctaatttatcctgtgtggactatgatagctcccttgctacaataacatagttctttgcatttattttcttaaagtataacaccagttcattacagaaatttctaatttctgtaattagaaagtacagatgttttttaaaaaatcaagtaaatattatgtgtgagtccatgatgcagaatacttactgctgaaccacagggcctgtatggttaatcattgaatcagcgttgccaagcaaagagtgtgacacacattacttccatatcagtagaagggtggaaggatggctggatgggtggatggatgaatgactcacatagcttctcacggatgaacacacctatttactcggcttttacagtaagcccaggacagggtaaggatgagttggaaatgatatatattggttaacaatagccagagcagtactgagagttcccttgtttgcaaacagtacagttttaagttattcaggaaagctggttttctgagtttaaataactaaaatcaggttaggttgtactaggtaacatacaaactgtggatctccgtgttttaacacttgcatattgctctctcatctgagcgtgctgctagtctgttccacgaggtggctcaagacccaggctgcttccattttgtagatgtgccacctggctgactctgataaggaagtggagtcagagttcttgggttctccgcaatggtagtgacttccaatcacggtccaccagctagagctgatcacccagcctcacccaacagcaagagtattttgagccactcagaaggtgatgagaactagacatggatgaacataaccatgtcctatgcagtaccgggtaattgggaagactataataaaaatggtttagcatgtgagtactgggctcagactggttttgagcctctactgggaacaatttgtgcaatcttgggcaagtcgctcaatctctctaagcctcactccctcattgaaaattgaggataataatagttttaattaaataatgtgctaatcactgtgggcattgtgcaagttcagataaacattagttatctttaaatgtccatgaatacttaaaataattgtcattattacaatcttgttatcattggtagaagtggtagtaatgaggtagcacttgggactccacttcagaccacattgaagactggcggaaactgagaagaggcactgaaagcatgcccaacagcaacaatgacagtttactgtcaccatggcaacagcaggaagttaccacctctttccatggcaacacctggaagttaccacccctttccatggcaatactgggaagttaccacccctttttttttttttccattttactttaagttccgggatgcatgtgcagaacatgcaggtttgttacaaaggtatacatgtgttgtggtggtttgctgcacctatcaacctgttgtctaggtttaaagccccacatgcattaagtatttgtcctaatgctctacctccccttgccccctagcccccgacaggccccagtgtgtattgttcccttccctgtgtccatgtgttatcattgttcatctgccacttaagagtgagaagatgtggtgtttggttttctgttcctgtgatggtttgctgagaatgatggcttccagcttcacccatgtccctgcaaagaccattaactcattcttttttatggctgcataatattccctggtgcatatgtgccacattttctttatccagtctattattgatgggcatttgggttgactagcccttttctagaaatgtctgaataacctgccccttaatttgcatgcaattaaaagtgggtataaatgcaactgcaaaactgcttctgagctgctactctgcacacactgcctatgaggtagtcctcttctgctgcccctctgctgctgctgtgcactgccacttaagtaaaagttgctgtctaacaccactggtttgtcctagaattctttattgggcaaagccgataaccttcccatgctaatccccagtctgggggcttgcccgtcctgcatcggtaatacatttgcttagcatcctccaggggtctcaattagtgtcatacaaatgtacatgcctcaaaaggatatatcagaatactccattctcagctttctcaggtgcttccccgtcatactctgaaggaaaatcacactgagaatctcacccacagaaaaaggattcttcattattaaataccattcaagactgtgcactggtttttgatttttttttttaagaaaaaataaggggaggagtgtatccatcattttcttttttttctttatttttgtgaccgagtcttgctctgtcgacgaggctggagtgcagtgctgtgatcttggctccctgtaacctctgcctcctgggttcaagtgattctcccgcctcagcctcccaagtaggtgagattacaggcacacaccaccacacccagctaatttttgtatttcttgtagagacagggtttcaccatgttggccaggctgttctcgaattcctgacctcaagtgatccacccgcctcagccccccaaagtgctgggattacaggcaagagccactgtgcccggcacatcattttcaacatagctgcctcagtctgaaaacgataactcctcactctactattaaccccactgactccatctgggcagaaaggctgaggttaggttgtcagctgcgtcactgctgtggaaacatcgacagactcaataaacaccctgaaatttaacatgcttctgctatctgctgaacagctctgggcacaaataggtttcttttattatggacagaaaggccaagtgaaattttaatcagacagacaaggagggtatctgagaacactgaaatgccagccctgctggtatttccacaatattgaacttgtctttcggggaccttggtaggtatttcaattagctgtgagacacacagcctgtgtttttgcaaactctcctatttttaattaagatgctgttcactgggatattagaaggcacacgattcttcttgtaatatgcaaactatagaagagaaaattaagcagttgaaacatttggatgtagaaagtggattgtagtcatagctaaaatcatagcacttcgtgtactcatagctataatcatacctctgttcttacgtgatatttggggtatcttttcccctcccatcccattctctcgatttcttaactttcaattgcattattatgtatatttgctttaacgtatgatgagcctgttttcctgttttctttttaaaataacgaaatatttggtataaacaaaataatatctgtagcaactatggaccctgggaaggataataaaacaaaaatccgtgagtttactactcaacttaaaaattaaaatgctgatcagtactactgaattgacttgcttgcttcttggtgagtttattttttcatggagataatcaggcaccgttttgccagttaaggtgcctaaaagcaccataaatcactggaaattctagactaaaaagaggtctttctttctttaaagctttgtccatcttttagtcacacggaacacactgaaagaccttccgaaaaatgaaaaggcaactttagggtgtaaggggctgcagggccgcctctaacattcattcgttcattcattggtccctgtatttcaggattcctgcgttggttcctccattccttcattaaatgttgagtatgatcacagtcttctttcaactataattagtagaattaactgctattggctgaatgttcatgtccccctaaatttgtgtgttgaaattctaatcccaaggtgatagtattagaaaatgggatctttgggaggtgatggggccatagagcatagccctcatgaatgggattagtgccttcataaaaaggcttgagtctggtcacagtggctcatacccataaccccagcactttgggaggccgaggctggtggatcatgaggtcaacagatcgagaccatcctggccaacatggtgaaaccccgtctctactacaaatacaaaaattagatcagtgtggtggtgtgcacctgtagtcccagctactcgggaggctgaggcaggagaattgcttgatcctgggaggtggaggttgtggtgagctgagatcgtcccattgtactctagcctgggcgacgaaagtgagactctgtctcaaaaaaaaaaaaaaaaacgaaaaaaggtttgagagacccctcaccgctttaatcatgtgaagttagagttaagggtatctaccaggaggtggacactcaccagacactgaatctgccagcaccttgggcttagcctccagaattgggagaaataaacttgttttgtgcaagccacctgtttgtttgtttttaatttttagcacctttttttttcaattttcttgtgcatttgcttaagttccttgtacactctggatattagcctatggcattttgctagaagcctgaacagactaagacaatgattatgaaaagatttagttataaacattataataatggtcagttatcctgcccattatactcaggttcttttgagaattccttgcgaggtttgataaggacattagattttgtttacatgtttgtggttttagacagcaaacatgcattgaagaatgttagacaggaataaagttgaaatagcctcactcacactaaagagcccagagtgttaattgacatcctgttttccataatttttttcttttgtttgcttgtcaataaaaccctcatgcaacctgagtggaaggggagagtcattaatgcggtagatctggatgattttctgaacaacctaacctcacgctaatgaggcgagtattaccacaggccctttctcctacgagctgtccacccacagttgaagagctaattttactctcaaaactctcacgaatgcttttggttcctgccggctcttgagtagtaacagagtgctttagccctctgtggaaaatgatggaggcattgtcagggcacatgaaccctctaagaagtggatgtggtcccacctctacttaaacctggaccatgcagcttaagggttccattctcaagccagtgaacatcactgtcttcatgtgaatgttcttcaggtagaattttttagcataaaaaattccaacaggccgggcgcggtggctcacgcctgtaatcctagcactttgggaggtcgaggcgggtggatcacgaggtcaggagatcgagaccatcctggctaatacggtgaaaccccgtctctattaaaaaaaaaatacaaaaaattagccgggcgtggtggcgggcgcctgtagtcccagctacacgggaggctgagggaggagaatggcgtgaacccgggaggcggaacttgcagtgagcggagatcgcgccactgcactccagcctgggtgacagagcaagactgtctcagaaaaaaaaataaaaaataaataaataaataaataaataaataaataaattggaactgagtgttagctatttgagtagtctcagctgaataatacctctgacatggtatcattctgtggcatatatttttctgtaaggaaataaaaacaactttcttaattatttttttctgatcagagaaacaacacatacacatctttggaaagacaaatactttgtgcacatatagagaagaaatgttctccttatttaatccaactacttggagattattcactgtttgggcaactttgctgaccttgctctatatttatatacaaatatgaatgtgtgtgtttgtttagaaaaaccaaattgaatcatatatttttatcctgcccttttcagcttgatgaatatctgtatcaactttttaatggctctgcagtgttccattgtatagacatacttaatttatgtatccagtttcctgctgacagacatttagactgttttttttaaatctatttgctttttttttttttaattttacttcaagttctgggatacatgtgtagaatgtgcaggtttgttacataggtatacatgtgccatggtggtttgctgcacctgtcaacccgtcatctaggttttaagcccggcatgcattaggtatttgtcctaatgctctccctccatgttcccccaaccccctgacaggccccggtgtgtgatgttcccctccctgtgtccatgtgttctcattgttcaactccgacttatgagtgagaacatgcagtgtttggttttctgttcctgtgttagtttgctgagaacgatggtttccaggttcatccatgtccttgcaaaggatatgatctcattcttttttatggctgcctagtattccatggtgtgtatgtgccacgtgttctttatccttgatgggcatttgggttggttccaagatttactattgtaaataggttgtttcttattgttgttgttttcaaaacataacacattttaagcatatgattctctgagcaaagttttctattagagtggatgtctcttgggtttaaagaatgggtgaaaatctctttatttctgtgaaccttttgcaaagttggacagcagtatcaagttagccaaggaaggatgtcacacagagtggccatggtggtcttctggagcaaatagagaaaacacatattccagggaggaaaaaaaaaaattccttactttttgtatagcccaatcttattttcagttaataaagctttggccagacatggtggcttacacctgtaatcccagtactttgggaggctgaggcgggcagatcacgaggtcaggagatcgagaccatcctggctaacactgtgaaaccccgtctgtactaaaaataaaaaaaaattatctaggcatggtggcgggcacctgtagtcccagctactcaggacgttgaggcaggagaatggcatgaacccaggaggtggagcttgcagtgagccgacatcgcgccaccgcactccagcctgggtgacagagcgagactccatctcaaaataaataagtaaaattataaaaaagctttacaggtagttccttttcacatataaattaagttagtagatttaggaacgtatccttcactattctgttccatgccaaaagaaataacaaaaacaagatttgacccttaggttgaagttctcctgaactgactgttccctcaatatcttcatatcccctggattgtccttcagtatctaagaatatgggggggaaattaccagaattctccactgtctcatggaaatcacaaggcttgcttggatcgtaatgtgtacaattcactattaacaaaggatatggcattttctgtctgaaccttttcccaacaatccattttctttctctctctctttctctgtctctctctccccacccccaaatccctctctgtctctaagccaccatcacatcttccctgcatggcttttctctctctccatcattacccctacaggccagtccccttatagcttctggaggaatcttctttttttttttccttcatgttttaagttcaggggtacatgtgcaggatgtacagatttgttacataggtaaataggtaccatggcagtttgctgcacaggtcatcccatcacctaggtattaaatctggtgttcattaggtattctttctgatgctctctttccttcccctcagcagatccccacgcccattgttctctcccatgtgcccatgtgttctcatcattcacctactacttataagtaagaacatgtggtgtttggttttctgttcctgcgttagttatcttccaactccatctatgtctctgcagaagatatgaccttattcttttttatggctgcatagtattccatggtgtatatgtacgacttttttttttatccagtctttgtcattgatgggcatttaggttgagtccttgtctttgctatcgtgaatagtgctgcaattaacttacatgtgcacatacctttataaaagaatgatttctgttcctttgggtatatagccagtaattggattgttgggtcaaatggtatttctgcatctaggtctttgaggaattgttagaccatcttctgcaatggttgaactaatttacactgcctccaacagtgtaaaaatgttgctttttctccataaccttgccagcacctgttttttaatatttttattagtaaccattctgactggtgtgagatggtatctcattgtggttttgatttgaatttctctaatgatcagtgatactaagcttttttcctatgtttgttggccgcatgtatgtcttcttttgagaattgtctgtttatgtcctttgcccactttttcatggggttatgtttttcttgcacatttgcttgagttccttgtacactctggatattagacctttgtcagatggatagattgcgaacattgtctgccattctgtgggttgtctgttcactctggtagtttctttttctgcacagaagctctttagtttaattagatcccatttatcaattttcgcttttgcagcaattgcttttggcattttcgttatgaatccttgcccgtacctgtgtcctgaatggtattgcctaggttttttttttctagtgtttttagagttttgggttttacatttaactctttaatctttcttgagttaatttttgtgtattgtgtaaggaagaggtccagtttcaattttctgtgtatggccagacagttgtcccagcaccatttattaaatagagaatcctttccccattgcttgtttttgtcaggtttgtcaaagatcagatggatgggggtgtgcagtcttatttctgagttctgtgttctgttccgttggtcgttgtgtctgtttttgcaccagtgccatgctgttttggttattgtagccttgtaggtaatcttcttaaatcatacattttatcaggacactatcacttacgacccttcattggtttctcattctacaaagagaaaatttcagagatctcaccagaacgttccaggccttgcttctctgacacagacccatgtacctccttcctgacccccatacacaactcacactggtcttttatcagatcctcaaacaagtaaggctctttcatattttagagactttgtacctcttccttacccctcttgggataatctcagtcccacttgtgtatggctattccttctgattctttatatctcactttaaatgtcattatcttaaaaaggcaaatctcaacctgccatggacagcagatgcttcttccttaggtgttactgataaaataatgcatcaatgcatctctgtaaaatgaacctgtgcatctgcttcaggccatatttctgtccctcaacaagcacatcacagttgtaatctgtgtccattcatatttctgtaccactaaaatataggtatagtctttgtttttcattcgtatatcagacttgttgcctagcccagagctgcttacacggtggcccatccaataaatatttgttgaagactgaggacttgggaagggtgtgtgcatgttttcagtctgtgtgatagcttcacctcctattacgtgaattggcccgaagatccccaattccgtgtcatcaagaaacatggacacatcacagactcactcaacatggacacatcaagactcacttaacgcagggtggcttcccaacagcaagctgtattgctgaaaagcaggccttttccagtaagaacatggacaaggacaaacaagagactgcactgtgttctataagaagacacctgggtcataatgagggagagaaaaataagaccacagcaaatgaaacaaaatgtgtaacataccagacaggggaggaatcaagggagctgttcggggagctgctgcaatgcgagattggagctacaaatgtggaaacgcacgaagacctttgcccctatgaatcatgtattgggaaaacagttgagcatctacagacgtcaaataaccaataaaatttcatgaatggtaacgttcgccagtatccgggagaataaggctgagctctcaacatgatctgctaacaaaattaggtcatttgtctttgataggagatggccactttcttattttttatttattcatttgtaagcagctgctttaataagcctacaggatcttggatggcatgctcataagttctagtaaagcctggaagaaaattacaaagggaaagactgcctctaaattaccctaggaaacaaaaaaaaaaagaggtgatggctacagttttaccatgtctttgggggcaaagtgatttccttctttctgtgttcttgttggggaaaaggggaaggtgttaaatcccacagctgcaaaatagattcatttctgcctctcttgtaaagtgaagcatctttccttcccagagaactttatcttgcctcagtcaaccctgctcagagatggttcatccactcctgtcttgcggccattaaacatagcaactcaagccctcacttccagggacttaatattggtcatttaatactgcataacaacatttcatgatatacaacatgtatctctcatgcctttctaggctggctggggtttggctggcccagactgtgctcatttggacagctctgcttcatgctatgggtccagccagacctgtgtcctcacaactgcaagggggtcttcaatctgccctatgtgtgcacattctggggccgggtctaggggaagcagccgtctagactgcttggtgctctgtcatcatcttcacagcaatggggagccacagggggtgggctggaatccttaccactgtggcccacgttttattggccaaagcatgatacgcaactgatggcacagtcaaggtgtagggaagtgtggtccatggtcagtcgctgaaaagttgcatggcaaagggagtgaatacaagggacgtgaagaatggaagaattgctgccagtaattcagtcgaccacagcataactacaagaggctgatacggttatttgacagtgatcgtcaggattagagcacccatcaacctgtgaatgcttacacatttttattctgttttaaaacagtcacgtgtggcttagaaattaaataaaatctggtaattttactatgaaaaaaattattcccaccaagacttccttttggtggtggttgttgttgaaatggagtcttggtctgtcagtcaggctggagagtactggcacaatcttggctcactgcaacctctgtatcaagcaattatcctgcctcagcctcccaaatagctaagactataggcacctgccaccatgcccggctaatttttttatttttaatagagacacggggtcttaccatgttggccaggctggtctccaactcctgacctcaagtgatccacccaccttggcctcacaaagtgctgggatttgcaggtgtgagtcattgtgcccgatccaagactgtctaatgctgtgttaccccacaaggaggctgatcacagcctccttgtggggtgatacagcaagtggcgacaccatggtgagctcgggcccatgaccattcaaagggagtcacttcacagctgcagctgattgtgaccatgtgggaaggtgggcatagtatggccaggctttctcatttctccagagaagtttggcatctgcattttttatgagtgaaatttatagtttttgaatgttagtcactaatacaaagttttatgaaaatgctttgcatgccaaacaaacacttctgttgaccacacatggccagcaggcacccgattgccagcccaccttagactgaaggcactatttgctattttcgacattattggtcaaatctaaatagctagatggatatatagaaaaagaaaagaagagatagaaaaaaaggtgatagaaccaaagaaagaatgaaagagaagatgtatgtgtatgtgtgtagagagagatgatggaaggaaggaaaggagggagggaaaaaagcaacctaggtagatagctgggcagatggatggaatgagagataatagatggataatctttaacgttcagtaacatatgacaagtcacattgccaagtagaagaaactcagcaggcagcatttaaagagaaagtttcacactcatggaggagcaggccagtgattagtgtcagggataatgacccaaattcactgattgtatttcctcaggtgtcaaagaggaacagaaaacgatagtgttgcaaagaaaaagaccagagaatgtctcaccctgggtaattctaccttgcttcatgcacgcttaactagcaacttgcctgtcctgattccaaagcacgtttaggtagtcccaccattggccaggcttacgtgtccctgaacctgcagatttaggaaaaagtaaacagctgtcctcaagagtgcatgagacgctccacatttctcctttgtgatttatatataatcatccccagagagtgaaacaaaggaaccaagtaacttgctgaacactcttgaatgtagaggaaaaattatccacctatcagagagtgtgttgacagtagtgagcttttaatactgaggaagtctttccgtggcacctaaaagttagctcctgcaatattctgctcattggcaaaaatcgtgttcatttttaagagaaatagattatgacaaaagtagaaaaaatatagtcttatactttagatagaactgaaaggcctggctgggtgtggtggctcacacctgtaatactaacacttgggaggctgaggctggtagatcacttgaggccaggggttcgagaccagcctcgccaatatggcaaaaccctatctctactaaacaatacaaaaattagctgggtatggtggtgcatgcctgtagtcccagctactccacaggctgagacaggagaattgcttgaatgcaggaggcggaggtttcagtgagctgagattgtaccactgtactgcagcctgggcaagaaagcaagactccatctcaaaaaaacaaaacaaaataaaacaaaaaaaactgaaaagtccatctgccatgactgtctacatcgcctacatcccacatatccctaagacccagtacaaatgccatctcctccaagaagccaccttgatttctacccactgaaaatcctctctccctcttttctttgtccgttgtgccttatttttcttcctaccctgccacttaactctccctgatttataattatttgtgtgtgtatatctcccagttgactaggaagatgacttggattagaaagctggagactttgtctttgaatcttgcaatactgttgattttggtagatgaacaaaagtgacaagtgacatcttttttctcaaagaaatacaccatgtactcctttgtgcatagataccttcttaaccgagtcgattgacatggactcttaagtatttagcttcttggattctaaagtaaacttacaagttcctgcaccctagggttcctttccctttatcatttagtccttcattcagtgaattcagttgttcctcaaatgaagcagaaatgattcctcttttggggcgtaaagtgtagtgtgaagctttaaaaaataaaagtaaataaataattgcatacttacaaatattgacaggtacgatgaaagaataaactacgttgttctacaaaataaaattaaggtgagtgtagttgggagagaaccctacttaggtaggttggtcctggagggcttctctgaggaggtgatgttcaagctgaggggtaaaggatgacaaatgaggtttgagttgagagcttatcaggagactgattgcctaaggtacaataagagaagagatgggagaggaagttggaggaagaaacaaggccagatctgtacccacacagctaagattatatccctactggccttaacaaattaaagcacttcttcccatgccttccacagatgactcctaatgtcattcttttgcaatatttctaccttctttcattttaacttccgttacatatagctatgcagaaaaaaaatcaatttgttggctaaaataaagaatagtgacaataccaaatgctgtcaaagatcactcaaatattgctggtgggaatgtcaaatgacttaatcactttggaaaatcatctctcattttcttgtagaactaagcatgcacctcccatataattgagcaattgcacacttgggcatttatcccagtaaaatgaaaacacatccacaaaacaacctgtatgcaaatgttcactgcagctttatttgtaataatagctaaagactgtaaatagcccgtatgttttcagtgcatgaatggttacactgtgataatccacactgtggaatactatgtagcaataaaaaagaacaaattattgatgatagacacacaacaactaggatgaaactccagggtgagtttcactcccttgtggtgagtggaaaaaaagcccatttctaaatcattttgtccagtctcagcaatcatttttatgtatctaaaggttacatacaaaatgataccgtgtatgtagcattcttgagtttaaaattctagatatagagaatcaatgcgtggttgccggggtcaggagtgagaggtgtggagtgacagtagggtgtggtcatagaaggcgtctttttgtctgtggactattttttgtcctggctgtgatatttatagttttgtcagatgttacccctggagcaataagagtagaggtcatgggctctctgtatattacttattaaattacatgtgaatctacagttatctcaaaaagtttaatttttaaaattccttcatataacaacttagagtttgaaagatattcacaacatattttacatattaaatttttatttaaatatttgtgttctcctctgccaaattgtaagagctttcccctaagagatcttgtcttaattatctttacatgcctcctctcaagcctcctgttgtcagggaaagaacaaggctctagggtcgagaagacatgggtgagataacaatttcaatgccaggcaaaggactttggcaaattcagagcatgatttgataaagactggaactcacaggcagaaggactggcaggtggcacccggacccttaactccttcctctgggcatcaaggcgcagacatggatgatgccctgtgtgcttgcattctagaacagggacaccactatcctttagctgtattttttggggggttggagagtacggtgtattagtttccattgggttttttttttttttctttttttgagatggaggttcgtcgcccaggctggagtccagtggtgtgatctcggctcactgcaagctccatctcccgggttcatgccattctcctgactcagtctcttgagtagctgagactacaggcacctgccaccacgtaactaccacagatgtggtggcttaaaatgatataaatttattatctaacagttttggtgatctgatgtctgaaatcagtgtcactggcctgcaaccaaggttttgatagggctctgctttctctggagtctattcttctagcttgtagtggctacatgactgcagtctctgcctctgtgttcttgctgtcttccgttctgtgtgtgcctctgcgtctttcttttaaggatgcttgaggttgcgtgtagggccctctggataatccaggttgatcacccattttgtgagcatcagttcagtcacatcagcaaggaaactatttccttacaaagtttataagtttcagggatttttgacctgagatatctgagtggctattatctggcttattagggtaagtgtgagaacagtcttacaagtagggaacaattccttgtgtctcagaaattaactttggcgagatacatggtggcaactagctgtccaggaaaggtgcatgttggaaactagctgtccagatgagatgcatgctgggaactagctgtctgggagaggtacatgctgggaactagctgtccaggtaaggtgcttgcctaggtgaggtgcatgccaggaaatagctgtgccagcgaggcgtgggctgggaactagctgtctaggtgagatgcatgctgggaactagctgtctgggagaggtacatgctgggaactagctgtccaggtgagatgcatactggaaactgctttccaggtgaggtgcatgctgggaactgctgtccaggtgaggtgcatgctgggaactagctgtccacacaaggtgcatgctgggaactagctgtccatgcaaggaggatgctgggactgtgttgatgacatcaagagaccatgtgagcccagcaccctatggatggacaatctcactggcagaattggaacagctggtcccagctggcttattgccaggcaacccagagacagcctctggtgttacccttcacacagttctatccctccctccatatatactacctaatgattgtgcgaacttgggaaagctgcttaacttctctgagcctgagtttcctcctttgtaaaaggagactaatactggtgtttacccttagggcttttgtgagcattaatgatagtatgtataaggtttgtagtaagtgccatataaatgttggctgtaattattatattcttgtttttgatattgtttctatgaggatggtggtggtagtggtggtggcatacctctgtgcattgtagcataccctaagggttggctgcataacgttgaattttagttcgcagagttactgatagtgcctgcccccagccattgggcttcctggtttaaaaggcaaatcatcctgatggaggatggtgcctacagtgtggtgctcgaggacaatccctgtctgcttgggactctgacagtggtagatgctttcagaatttgggttatgagtgattgagggaggttagcaaacggattcctacctccttgtactgtatgaagcagtttgatgggattaatttgcatggcccatagtaaatgctctcagcctgtatggaggctaatttgtgaacctgtagcaatttatcaccctggttggattcgtttaccagtagacaatgtgattgggataatgcgcctcactgtgcgtggagaggagctgcactctgacctcacttgaagaaaccaccgaggggtaatttcctccccaacggatgactgacattacagtgtggtgacaaatgatgagtatggtaaatggttaatatagccagggccaggatctatatgatttatgcaaataattagctcttcctgggtagtagcctgcatgtctaggtaacttttattttttcagacagtcatctccgtaatgagctattagtctgcaggccagaaagaaagaaaggtagaaggaaggacagacctcaggcagttaagtctttgttccttccagaaatcctatttatttaaagctgagtgtgataatgttttcttttacaaaactccattgctctgtattgtaaaagcaactcaaaatatgagtgtctgacgtttattagtttcaataacggtttctggggtttagacagagcttgcattcatcttcactgagttccattaacacggagggacatataccattagcaccatttcctagttagagaatgtaaggaaagatggaggatcaatatgactgtattaggaaggagtctttgggtacaaattatggaacctatgaagaggaaagggcttaaggggttaattattaaaaagcttatctaaggaatattttatataaatataggatgatctgggaagctaaattgatggaaattcaatggcatgttacaccttgagggctgccagaaataggaagtttagcgaagttgggactttctctcaggttacctgttttgcctggccaacgacatcttctgaacctcacgcattacctccctgccaactaggagaggtgaatttttttttttttttttttttttttgagactgagtctcgctgttttgcccaggctggagtgcagtggcgctatctgggctcactgcaagctccgcctcctgggttcaagtcgttctcctgcgtcagcctcccgagtagctggaactacaggcgcctgccattgcgcccggctaattttttgtatttttagtagagacggggtttcaccatgttagccaggatggtctgcatctcctgacctcgtgatccgcctgcctcggcctcccaaagtgctgggattacaggcgtgagccaccgcgcccagccgaggtgaataatttttttattctggtttctatatgacagaggagaactttgatcaccgagattagaatcccttgttaatgcttggactaatctttggtggcaaaggagtcagtgccacctaaggacaatgtttcactgttgggaggtgggtgggaggagtaggtcctgagaggagagagtgatgatcccaacagaagagaaggatgctatgtagggagttgacagattccagcactatactgtaaattccgtgagtgtgtagctatacgtgttctggtgagcatgatatccccagtacccaatatagtacctggcaaaatgataagcatgcagtgaacatatgcatgaggaagggagggagggagagggggaaggagggcagtcagcattctagtatacaggtctgagatagccaagaaaaagcaagcaaaattttcagcaggtagtcacacaaaacagaaataagaagagatcttggccgggcgcagtggctcacgcctgtaatcccagcactttgggagggtgaggcgggcggatcatgaggtcaggagatcgagaccatcctggctaacacagtgaaaccccgtctctactaaaaatacagaaaaaattagctgggggcgatggcaggtgcctgtagtcccagctactggggaggctgaggcaggagaatggcgtgaacccgagaggtggagcttgcagtgagcctggatcgcaccacttcactccagcctgggcaacagagtgagactccatctcaaaaaaaaaaaaaaaagatcttttaactctggagagttatctcagcgatcgaaaccttgattgcacttcctagatttattggattcatttaattgcgcagcccttggaagttttatcctctacctttagaggatttgagtgataaatttccttcttcccttccttcctccttccctccctccttccctccctctttccctcccttcctttcttccctgctttcttccctccttgtctccctccttacctcccttctttccttctttctttactcatgcacatattcacttcatgggctctgtcatttgtacccaaagactcctgcctaatacaggcctattgatcctccatcttcccttatattctctaactagggaatggtgctcatggtatatgtctctctgggttaatggacctcagtgaagatgaaatgaagacccttcccttcccttccctttcttccctttccttcccttccctttaccttcccttccctttaccttccttgcttcctttccttcccttcttcaaatgtgtattgagaaccagatactgtgccagccacgagaaacatctgaatcatcaaggcagcctccatctgctcagatctttttagtaggtgttttattgttgagtatgatgatgtaggagttctattcccaattcatattgttttgaagccacgtctgaattctgagtaactaggatgatgagtagactatgtctccttggagtccctgtttgaggctaggatttaggtgagcaatcctgatcccactcaggagacagcaggaccacctgagccactgacctttaaacccaggatataaaggttatcattgccctctagaaatatcaaattggtaagaaaggaaaatgctccctcatgaatgttcatcaaagagtgtttcccatcaggtgatattctgtcccttcaggccaccgtggaattcattaaagatgagaagacagtgataaaccacctcttgtgcaggaatatttatatattcctgtattcttcaagatgttacaaattccatttaataagtaaagtggttatctcaatcacaaactaccatgaggcaataatgatgatccatttgtcaaaaaccgccactcaagcactaaggagatgtgtgtaacagttggcattttaagcattgcgattgtcaaaccactgattgacagatcccttaattgtcaattcagataataataattctgctgcaaaatgttagagacagagaaagggaaaagaaagaaagagaaagagaaggaaagaaaacgaacggagggacatgagaagaaagggagggacaaagagaaggaggacttgagataaatattagacatgctttggagtttttcaatggcttactgcaaatcgtgttcaaccccacatcattgctggctggttgtctttcttatttgttgtgaagtgattgcttcaaaaaccctgacacaaatctctgtagagtgattttttgtgtggtcaagaattttgtgattttaaaaagactttcaggttcctgctgatttgggactttggctctctctacgctgatatataaatcatattacacaatattgataactccccaatctctaaataaatcgcaaacttattaggaagaatcccaaagaagaagtcaacacctttactgaagaactatttaaaaagatgtatgggtagcatctaagtgctcacgttattcttagtgaatcagaggtctccatcctacgaagcatgggagaggtcaaatcccatgtacgccagctgaaagagttaagccatttttctatttacatggtttatttcacaagggtctgactcattgggcataaccagcacagttaaatttcaaaattactatttggtcctttttttattgactacaattcaaggctgcttcaagcctcccaaatttaatcgccgtagctctttgccaagaacattatgttttattttcagtgttaaactgtgtaagatgcccctaaggctacatggaaacttactctctgtgatagcagctaacggagtgtatcagttgttcatgatttcccattctcctgtaaattgggagaggcagggagagcagtggaatgcgaattttgttctgtcagcactttcttgccccagctttagcccaagcagtgcctgttttggtaattaattatagtgtgtttgtagctcttcatgctcagttaccatttagcaacctgtcaaatcctgagctaatgagcctatcccacagaagtcattgcatttactttattttatttttaagcatcaagacaatactggtttttcgtaggtcagatgaagttgagagggagattctaaaccagcatatggaaaaggcaaggcttttctcttctactcacaaatgttcatcccaagaatggccttgcttaaagtttttcattgatgtttctctaactagaaattggagttattaaatacagttattaaaatacagttattaacgtgactgtaatttaatatttgaaggaagaaatagctcactcataagtgtccttttcaaagtgttgttggtaaacgaaggttgaatggttttgagatttatctcaaatgatgaactacactttgtagggaatgtttcagaggtcttccctctctgtgttgagagactagattaggatatctagcttaggattttcatctaaaatacaggaaaaagcagagcagattcgtgatactttcctctccttgttggttttgtgttgttctttcttctttaattgtggacttgaaggagttccacaatctcgttatgggaaggacttaggcatagcactttggtttccgggcagaggtagaacatactccttgaagctgcttttgtatcacgcttgcttgttttacttagaatcgtacggttacagctcaattaaaatagcagagttttctgagaatgatttcattctctttatgtgagactcagacgatttcatttagtttatatgagacatatcactaatctctactaaaaaatagaaacaataattttatggaattacatatcagaatatgagtgttcagctcagcctctttatggaacagtgtataccaaaaacacatctttattcttagttgaaagttttagaaaacccagaaattagagcagtggcattcgcctctgctggttagaagtataatcttcaattcaacatgcaaaactcagactcgtagctatttctgaagctcagctataactacagtatcatgtggtcagtaagttctgcatttctaaaggaagatattattttcactgtcaatcaaaggtaggtaaaaacacatgtacacattttagcttagctgaccaggtcacagggatgtgtacctgtttatgtataagtgccaggactgaggctggaaggaggaattaagttatgctcccttaataccatcagtgttgtattgtcctaaaaaaagtgtatatatatatatatatacatatatatacgtatatatatatgtatatatatacgtatatatatgtatatatatgtatatatatatgtatatatatatatacaaaaattagttcctcaatccaataagaacatgattctgactctttataaaaatgactcctcttgaatattatttgttcccatctcattcgttgataatatctattatatttttataagaaagagtcaaaaattctatgcaaaattctctgttctcctcaaacagatgacgcttttgcccatacttggctctaatatcataattgattttacttgtcagctctctgttcatcagagaacttgataagcagaagaacagttgctcactcttgttcaagtctactgccctaatgcccatggacctgcaaatttcccaaatgtgagtggtttttatgctgcctgtggaaatctgaatttagatgagccacactttgtagaaaatgcttcagagatcttcctgccgcctctctgtgtcgataacctccatggaactgtgtttgtgagatactcaataatggaaccatttaattcaaattttttaatcgactacggtatcagcaaaatgagaaatgtctttcacccttgatctttgacaatagcagacatgttaatatgaagttactgctaaggctccaaaaggcattgatacaagtatattttttctgccattcttgtttctttatagaatcacacttttgagtattcagagcttgcttttcctttgagttagaggaatgcattggagagaagtgttattgatgagggctgattaagcaaattaatgaattgagacagctgaatagtaagtgagaagaatttgaggagtggaattggtttttgctcattgactgtaaagtgtaggagttaacaccacaagggtacctgatggaacgagctataataccgaggtaagtgaagagagagcatttggaattgtgtactatttttcctcttccaatgaatagctgtgcgctagctgttcactgctttcctggcatatgtttttcttgcttcattttctgagtcatctgcaatagcggaaatgaattcattcaacaatatatattgaatgcccgttatgttccagacacaatgttaggcacttaatggtacttgtggaaatacattatttaatgtctgatgactaaatgttctcagttctgatggagtcaagtgtttttggctgggggtggtaatatttgggaagcatcttggaaagcatttgttatttcaaactcttcaaatctgcaagtcttacaaaacactacacgttggctaagacgcgggggcagcgggcgctctaccgtgctgctgatggaagagtatattgatgcacctgctttggcgctcactttagtaacatcatgggacattcaagatgcatgtagttttgagatatttcatccctaaatgcacacatgaaggagacacatagaagattcattgtggcatccaagcaaaacattaggaagacaacaatcaaccagacattaattgtccaccaatagggaaatagaagataaattgtagcaaaagtcatgtctggtgtgtcatgttaaaataaataaattagatctctgtgtgccagtgtggataaatctgaaaaccataatgttgaacaacaacaaaaagtaatttgcagcaggagacatacagtatgacatcatttatgtacagtttttggacacagtaaaatgttttcaaaaatatataaatgtattcaaaaatagatattccaaaatatacatttatatgtatttatatatgaatgtgcccaaaaatatatattctcttggggtctatgcatatatggtaaaacgagatagagctatgtgggaatgatacacagtaagttcagcagtatgcccaccactgttagggagtaggggagcggttgtaatctgcgagagtgactgacaaggattccattatatttgttatattttatgttgcaagctgcggggtggacatacggcatttgctccagcatcttccgtattttttatatgtctcatgtattgcataagaaaaaagagtgcatctgaacagctacagttaccgctgtgtctgtgtgtatttgcatgctgagttttttgagcaccacactctaaccatagtctttgcaaaagggttttatacaaaaacaaggtccctttcgagtgcattgtcttggtaagattgttaagggcagatgagtaaagagatgcagtaccctcaatctacaagacaaaagatggaccagtcaagcagttccctaatgtctttgatcaatgtaaactgctaattgcaaggcctgactctcttttccaaaaggaatgattcccctcccaaccccctccccccccgactcaattacaagaataattgcttcaactctcaatgttcctttaactgggcacgttcagtgttagcatcttaggctctcatttcatatgaaagtactaagttgttccagtaaacagcctctacattgggtctttatgttgcaatattacagacttggcatgcaacctcctctatttttcactgtgtataatgaggtcaaattcgttttggaaggcccggaagtcttcaggatttacagctatttgaaaaccctattgataataagtatttggccaaagtgtttccacgttcatacactccccctctttcctagccagcgtcccttggtttttttttttttttttttttggttttttttttggtctagcttgcactttctccctgcccagaaatgtcgttaacattaacaagagctctctctggcactggcagggggtctgcaaacagaactggtttggaatatgcaatgggaggcttgaatcaaagaaaagctgtgatacagactgtggagtgtgtaagacaaactcgataagctccagtcaatactgtcaggaaaaatcacagcaaaactgatttcgatgagaagatgtcattgggctgtgagggatacttggaaaggatgcttcagcaacaataacaacaaaagagtttttcatttagattgtgaagggcttgctgtgtgtgtcatgtttagggacataaataagtactgacccttactctagagagttattgcacataagaaacccagagtcctaggccacctccagagattttaattctgtaggtctggagtggagactgtttgccttgtgaacaagctcacaggcgatgctgatcgtgcaggttcctggaagcacattttgaacaccaaggccccagagcaggttcaatgaaatggaggaagagagtcaaataaaaatcctttcattcggtgctatggggatgcaatggcagagttattagcaatattacagttacctaggaaaaggagcaaacagctctgccttgcccaggcaaccagcagaatggaggtgatacttaaccagcatcttgaagagtgaagagatttccaggaagaaaagagagttcatgttacaggcagaggaagtgacatgaatgaagtacaggacacaaatggaaaatgaaagtggttttgtatgaacagagctggaggtagaattggaatcatcacagatgctgtttaagaattgtctgtggctcacacctgtaatcccggcgctttgtaaggccgaggctggtggatcacctgaggtcaggagttgaagatcagcctggccaaaatggtgaaacctcgtctctactaaaaatacaaaaattagccagtcatggtggccggcacctgtaatcccagctactcaggaggttgaggcaggagaatcacttgaacccaggaggcagaggttgcagtgagctgagatcacggcactgcactccagcctgggcgacagagggagactctgtctaaaaaaaaaaaaaggaagacaggccgcagctgatttttgaaggaatttgcagagtccttctaaggtgtttggtacattattctatgatgtatggtggagaacagtggaaggatttttacagattattggtgggagagtggatgaagagaaattaataagcaggggatcaaaagtctaggtgaaaaaacaggagggcttgcctgaattactttttggaatagagaaggacatggcacaaaacattccaacctaaaggcaagaccctcaaggttggagacgaagtatcttctggatgcagactgggaaaagtgattagcagcaaatggtcaagatgaatgggtagagacaaaacgtggctcaccaggagggtggtgactcactaatcttcaagaatgtatggctaaagattcaaagctccttactaaaatttagaaaaggcccataatggaaggaactaagcaagttttgccttctgctacctctgaattcattatgttgcctgtacaagtagaacacatagcaggaactgtgttttaatactaattacaattattttctggttacatagataaatgtaaataacattaaagatgtgatctgttcctggacgccatttttatcttctttgtcagaaggagggagagagaatggcatcaaaataccaaggttctgtttttttttttccttaaaaaaaaaaaaagaaaaaaagaaatgaccggaagcacaaattggatgcctgcgctttttttttttttttttttttttttttaccaaaaccaaatacaaccttacagaggtaataaaccttgtgatacagtctcaggaggatgtgctatgaaaggagccaaatcaggtaaccagaaacaaataccaagttctttactggtattttgaatgtttattaaacagttaccaatccattgccatttgtttccttcacactttgtgctccctccttcttccttctcttgcaaaatcctcacaacttcttctgtctttatgttcctttttttttttttttgttgagattatgccttgcaaaacctctaattaacctgcctagcaaaagctgaaccttcttcagactacagggagagtagcagaaaaaataaaagtgacaaagaagaaagcgaaggagtctctttagcaggaagaaggaggggtcatttcagggaaattattttaataattcttgtcccattacataaataattcacttttttcttctatgtcactgtattcctagggttcttctcaaagcataactcttccacatttagacacgttcaaaaataagaaattagagaacacacttcattctttccttatcctatccagttatttcaagacaaacatttgaaaaacaataataatttcagactgcaataaaggaaggctatttgttttacttttgcaggcacagaaattttgtgaaatcaccaacaattcagaaaagaaatgacatcatcatgcccgaaaaagtataaatgacataatctcaaattaacacataaaaacgttaattaaaaatttagttttaaacccccctattctctccttcctcttttttttttttttttaatcatggcctaatacatcaaaacaggctggatgtgtcaacggcaggatatttgagaatcaaggatctgattcaaatgttttatttgttcttgatggaaaattccaaactggcttttaaagcctttcaataatgcatggaatcctgaagaaaaagttgcttcctagaagatgttgctctgttcaacctgtatttttaagtgtctttttcctctaatgtgggtttaaaaacaataaggagagacatatgctacttgggtattttgttgaggccatttccctttttttatctgaggtcatgtgaatggatactcatcaaaacaagaggggcgtttttggtttctctttttgctgataaatcgaaaacacaaaggtcaaaaataagccctgttcctcaatcccagtgccaatgttggagtgggtttttctttttcttttttttttttttttttttttttgagatcgaattttgctcttgtcacccaggctggagtgcagtggcgcgatcttggctcactgcaacctccgcctcctgggttcaagcaattctccacccttagcctcccaagtagctgggattacaggtgcccaccaccactcctgggtaatttttgtacttttagtagagatggggttttgccatgttggccaggctggtctcgaactcctgacctcaggtgatccacccgccttggcctcccacagtactgggattacagacgtgagccaccgtgcccgacctggagtgggttttttaagtacttataataattacttgaataatatgtgttcattgtagataacatgaaaaatgcagaaaaacacaaagaagaaaaatcatttctaattttaccagtgtttatcattagtgtgtgccatggggatatttcctttctagccccacacacccaggcaccttcttgttttttaacatttatttaacacatggttaatgacttgctactatgctgcaggaattgtatcaggtggtagaaatacaatttgtattaattgtagataatattttgtgatacattattttttaatttaataagatactatggactgagatgtattcttcatgacgtgtgatgacaacgtagtaatccctaattcctttagttaataagttcattttaccttctcattttgcctctcatttgctattttatcacctttcacaaataggtttatttgttgttattttttcctgctttatttgtaagcagtattagataacagttgcacacggagaattttcaggtacaattaacttctctcttttttgcgtgtaggcttatttcttcctgacaagtcttttgccttctaagtaacttagtgttgaaacattacatgaaaaagccacctcatttggttcttgcacagtaatgtctaaatcacataagaaatgcattgaaaaaaacaatcggggaaaaaagagggagtaatattggctagcacatctttgaatgcatctggaaagaaaagagtaaatcaggattgaaatagaagccaaaagatgatatttttatggaaaataattcccctctccttttctttccccagctctttttctatctaatatgcatttttctttatattataaaacagctttgctcaccttatctctggtagttctttattacttcagtgtcttctcatcattttttaaggttctggaaatgtaaactactttcctaccacttttcatttttgtggatagggtggctgatgggctttaagtttcaagctatgatgaaacaaggaaatagatcacttcttacagtgtaataatggaactctgttgatgggtctaataaagaagaaaaaaaatcaaaccttatccatcatctccatgacttctagtgtctttcccatctgcatcttcatgttaagcaaaaaatatataatgcaaaaagtgtgtttcacaaaggactttttttaaaaaaaaaaataaggttagggctttctttccttctattttttttttttttttttgagttggagtctcgctctgtcccccaggctggagtgcagtggtgcgatctcggctcactgcaagctccgcctccccggttcacgccattctcctgcctcagccttccgagtagctgggactacaggcgcctgccaccacgcctggctgatttttttgtatttttagtagagaaggggtttcaccgtgttagccaggatggtctcgatctcctgacctcgtgatctgcctgccttggcctcccaaactgctgggattacaggcaggagccaccgcgcccagctaaaggttagggttttctaaggttgtaacttttgcatgtgtattacttgccacacaaagcatcaagataaggaaaccagcccttatgggtccttagcttcatgacaatatctaaaggtcatactgttttaagcatacagaaaaccctctagtcagagtctgtgttagctgttctttaaaaaaaaaaaaaaaaacttccatgtcttgctattattatgagtttgtatttaaaaatttcattctaaccagcaagaacacttccagtgggaatttctgataaagcagtcaggttttagcttggagatgtactaagtgcagaagttttgtgagttttcttcttggtcttgcaaagaaaagcatgaagctatataagtctttctgtaggggaaaaaaaaatactttttttcttccttttttttcctttctgatgagcatggatggaggagagatccatccatattctggatcattattggctctgatgatggttttgtacaaggaataacctctcttggggtagtgattctttttaatgacctttataaaccagaatttttgttcatctgagaaactaatgaggattaagggaagaaagggggccgggtgtgggggctcactcatgtaattccagcactttggggggccgagacaggcggatcacttgaggtcaggagttcgagatcagcctggccaacatggcaaaacctcatctctactaaaaatacaaaaattagccaggcgtggtggtaccggcctgtaatcccagctacttgggaggctcaggcagcaggatcgcttgaacccgggaggcagaggttgcagtgagtgccgagattgcctgggtgacagagcacaagactctgtctcagaaggacaaaaagaaagggatccaacagatatttatcagttaatgtgtgaattacccatggcatcattacctttaggtttgctcagaacaagtcctgtttatcccttgatcctggtgtaattattgacatccccctttctgctgacaggtgtcccagtttcaacgatgtattatatagtcattccatactcttaaacaagagagtaatcaaatatagaagccaagcgtccagaactatggctcagacaaattggcagttgaattttgatttctgtacttgattttttctgagaagctgaaactactatacttcagttaacttatttgcgaaatataggtattatagtaatgtttttgccgtatgggtgttgagaaaattaatatgtgaaattttgatcaaagtacctgataaatagtaaatactcatttgaaattagcaaataattattcctatattttttttcattgaagtctttcagtgctacatgttacagcctccaagtcatttaatttatagaaacagaaatacttcgtggtctgcagcagtggacacaggaagtggcttataagaagatggacacagaaagtggtttgctgaagtaagaggatggtaaaacagagtggattcatctatgataagtgtctataaagggattatggatctagagaaatttctgtaagttttcttttgggttagtgttcaaattggtaaagttgccagggcgaggtaggaaagtcacattcaagccagtgtttcatatttattggtttatgatttttttttgagacagtctcactctgtcacccaggctggagtgcggtagtatgataacggctcactgcaacctctgcttcctgggttcaagcaattctcctgctttagcgtcctgagtagctgggattataggcacacaccaccacgcccagctaatttttgtatttttcctagagatagggtttcaccatgttggccaggctggtcagaacttctgatctcaggtgacccacttgctttggcctctgaaagtgctgagattataggcatgagccattgcacccggccagtatttcttaaagataggtaataaggttgcatctttttgctcctcgaaagatgggctttgccatatgacttactttgactaatgaaatatgcagggaggtgatgtgactttctcataggtggatgcttgaagtgacattttgtgagttaccacattttctagcccttgccttagagattttggatacatgaggtgagagaaaccgtctgtcagctcatgtccctgagtgactacaaaaaacaaaagttccagccaacctgtattgagcacatggtacgaatgagaaataaacttccattgctataagccactaacttcaggggctgtttattacagcagcattgtgttgcccatactggcttatgcatcttgcctcttgcttacctgtcatatcttctgctgctttgcacgctcatctcttccttcccccacttgccattatcagcaacacttgctgaccacctatatgtgcaaagtgcttggtgtcaatatgtttctcataagaaccttatcaagtaaatacttattatatcttgccactgccagatgaagaaatgggctcagagggtcactgttcacaaatcccatagttgtaggtagagaaagagtcaaacatgggtctttcaagctccaaattctgttattaaccactgtggtatctgtcttgtattaggaaggagttcccttactgtcttttgaggttttttttttttaatgtaaatgccctgagtttttcaacacatataaaagggttttatgaatcctttttgttcataaaaggagattaacattaatttctgtgcagagtaggatgaaatagagaaagaaagaacaggaaaaatataattggaatctgttttcaactctgacgtgttagaactaggatttttacccttctcaaaacaaattctaggacacacattcatgcagttggcaaagccatgtgactctagagaaccgtgttgactgattggaaatgggtaaaattctaaacagcatcagcttgatgtggaatttccaattacttaattctggttggttttgaagacacatgagctgactgcttcacgggaatcaggaatgaaggggaatctgttcagaacgtatatgtctccccgcagtaaaagcaattcaaagccataaattacttatatcatctcagcgtcttggggactgcttactaatcttaggacctataaaataagggatcaaaggtaacattttctacgttgatgctgtgagatctatgcatatctatctctcagctggccctacgagtttaaaaattgttaaactgacaatttactaatccttctttttggatgatgataataatgatgattttttgcataaggctcttggaccacctagttttcacaggatggtgatgaatgagtttagggtttggcccgaaaaccttatttcatctagaattttgcaggcagagccaagagagttagcagcctggggtggggcaatggagagagcattccctttggtcgcttgaaaaaatccgtgcctttttgtttgtcagcactactgaaattcagcactgctaggaaacagaaatctgatattccaagatgctcctattggattttcacatatctcatttgcatttggattgtttcagcaagtcttacctcacttctgatacctataaatatctaaggttttagttgacacacgtctggctagcttcacaacaaggatttaagagcttcatgatattatttgccatgaataattgctagtggaacatactggatcaccttgtataacttttgcaggctggttttaatttcaggtttgactgttacattgtagctttgcaaagcaataacaaatcataatgtagatgagcagaaacaaaacaaacgatgatgggaatattaccataaccataattttacagcacagtttaattatttggttcagtaatgttgaataattatttcaccaccaaaactcctccccaccccagcccctcaacaaactaaacaactgtttcactactagcaactaatttatgaggcaatttcagattcttatgacttcttgtcgctctgagatttacagtcactaataaaaggccctaactttgagagacttgaattaaaactcatttataaagagaataaaaaatcagactttttccatttctatccgtaagtgtccatattcctgtagacctggatgtaagtggatgaagcccactatccagtgaataacagatgctcattaaatattggaaagcaaatgaagtcataaatgcgtataaagtaggcagagtcttaggaatggacaagatgacttatctttcttcttacattctttaggatggaatttgatgaaggttcctttcttttgtttttgaataaaccaactgaagtttaattccatgtttcagaaaatcacccctgctttttttggagatggagtgttgctctgtcccccaggctggagtgcattggcatgatctcggctcactctaacctccccctcctgggttaaagtgattttcctgcatcaacttcctgagtagctgggattacaggcatgtgccatcacgcctggctaatttttgtatttttagtagacatagggtttcagtatgttggccaggctggtctcaaactcctgaggtcaaatgatctgctcacctcagcctcccaaattgctgggattacaggtgtgagccaccgtgcccggcctcaaaatcactcttgactctttcctctcccttatccctcatgcccagagatcaactccagtggtttatcccctcttaattactgactgaaactttttgcttctctccattctccttctattctcctggccaaagccactcttccctcctgcctggagtgctgtcaacacttctaaactggcctttcttcctccactcttgtccccattaatctattctccatataccagaaagagtgattttctgttacatgatcgccatcattcttgctgaaatttctactctaccttccgctgattttaggatcaagtctggaaatgttgtcagtggccctcaaagtgcagttgctgcttagcctatcgtgtcctaaatccgcatctgatggcactttgtcacaatccaggctctttgagagagggagagagtctgtgtgtgtgtgtgtgtgtgtgtgtgtgtgtgtgtgtgtgtgtgtgtgtgtttccctcggtagagtatggggatctctgaaaccctttgtatactcaatcctattgttcattatgattgtgtgtaggtatcgtttctggaaagcctctcagttacatacccttctttgtcttttcacagcataattgtaatggtacctgttatgttttaatatgatacgctttcttttccaccaaatggaaaactgtgagagcagtactacgtctgtcttagtcaccaacttgtgctcagcacctagcatggagaccagcacatagtagagatttaataattgttgtgtaaatgaataaaacacatctatccagttggataacttggggtagtttgcttctctgcagtctgtctccctctcttccttcctcccttctctctgtttctctctttttctctttctcgtagtaataatagctttactatgaccatagctctttttttaatcgatcaccttttaacactttaagaactatttctaaaaactcaacttaggaaacagctgaattagccccttgctttaggtttcaggcttccctgaattccctatgattttcttatttgaaagtctggttcctgtttatattggaaacattctttaaaaaaagataagaacgtttggaacggcaacaaaacacccaattaatgtgcaactactttgaatattcctgcagtggcaacggttaaagtagaatgattggacactgtcactgctagcaaaattataatccagggtaagctagatttagagttgtgtctcaaaacctgtgttttttgtccttcaggagttaaaagtgcaaaaaaataaaataactgagataagagttgaattgatgccttcgaacaaaatggttaaattctgtttgggtctttaaaagagttaacagaatataacaattcaaagactccatgttccataaaaattgtgctattaggaagaaagccatacttctcagtaacctccctgacacttgctctgttttacttccccggccgcagctggtcttgagtataatgccattgattttgagagatcttataaagataattagatatactgcagtgtgttctatattctcagcatttctgaggctatgcaaagccacccaaacttctgaaatatgtaccttgtatttcttacttgagaaacttttagtttctatgcattggaaaaaaaaaaaaaagctctatagcagactttcctcctgaagcgtgaagaaggaataaacgaggagtagagatttttgcctcctttttcatttatgtaaataaacgtatgaaatggatttttaatttatacattagttatcttggtcccaaagcataactcttttaacaccttgagcttccttatgttggagggggaaaaagagtgcaaaatcattagagacatgattatgctttaatttaggtctttgagttatgtaagcagaatgcaattaaagaagaagtgctcactatgactacctatttcaaataggctttcaatttttcagttttatgtgtatcttctgcaattgcataaaacttcctcaaggctatgacagtggattatggctgtgttcttgtaattattttcagcttaaaaaaaagaacaactttgctgcataaactattgagttaaacatattacacgtctagtttttactgggattgtgtaagattttacaccagccatgagattctctgcattcataggtttagaaggaaaatgtgagtatttatggcatcatgattgtcactgtcactatcatcctctcattgtcgtcatcaccatgaaaatcagatccacaagtgttatcttgcttaattattgcagcaactctgtgatctttattattgccattttccagataaggaaaccgagactttgaaacattaagtaacttgcataaagtcagacagctaggaagcatagtatctgaaataggaaaccattgctcactttggcagcacatatactaacattggaatgatacagagaagattagcgtgacccctgcacaacgatgacatgggaatttgtgaagcgtttcatatttttagtaaaagtagaaatacctgttgatccattatctaccaaaaggaaaagaagtcattatatgaaaaagacacttgcacatgcatgtttatagcagcacaattcacaatttcagaaatatggaaccagccgaaatgcccatcagtgaataagtggataaagaaactatggtgtgtgcatacacacacaaacacatgctactcagccataaaaaggaatgaaataggtcaggcaaagtggttcacacttgtaatcccagcacttcgggaggctgaggcaggtggataatctgaggtcaggagttttgagaccagcctggccaacatgatgaaactgcatctccactaaaaatacaaaattagccaggcatattggcaggtgcctgtagtcccagctacttaggaggctgaggcaggagaactgcttgaatccaggagatggaggttgcagttagtggaagatcatgccactgcactccaggctgggcgacagagcaagactccatctaaaaaaaaaaaaaaaaaaaaaaaaaaaaatgaaataatggcattcgcaacaacctggatggagtgagaggccgttattgtaagtgaagtaactcaggaatggaaaccaaacatctcatggcttatctcccacttacaatggttttccattcccgagttccttaacattgtgttaatatactaacatattctcgcttataagtgggagctaagctataaggacacaaaagcataaaaaatgacataatgtactcttgggacttgaggggaagggtgggaggtgggtgagggataaaagactacatactgattgggtgatgggtgcatcaaaatctcagaaatgacacccaatgaacttacccatgtaaggaacattacctgttcccacaaaactattgaaataataataaaagaaaaacattgttgaaaagataaaattagaaaccaagaagcttggcttcataacccatgttactaatcttaaaaatgattccaagttgggcagaaaatggggagaagttgtgagtgggagcaagtgtggtcaagaacagggcgaaaaaaatgtaaggactcaaaatgtaggttgtaatcttatcaattgactgtgttaccctaagttgcttataccatttaatcatataatgcctacagtgcttgtgcacataatcatcttctttgtattattatagtgctacggttgatgatgatgatattatcactattgtaattcaggaaatttcagtatctctgaagactcttcggttgtctaaacaatacaactcgttatggtgggggtgcgttttttagagaaacatttatattttaatctgtcctttatacacagctttgacctctcctgtccaatatgacctacttctctgaagctggtagtggtttttgaggtttcatttgcaatgtgtggcttcttcccaggactcacacaagattcgctgagagtcttcgaattttttgaatcacccttaagtgcagtatacatcaattcagtgctctggcaaagactatgaattatgtttatgtctgaagcaaggccgtggttaaggaaaatagtagatgtgttaagaccttgtttatttcagcagagaaggttagagttgatccacatctggataaaaataattttaacctaggagaagttatattttctttataccataagctccccttctctggtagcctaaatgaatcagcgccacatctgggcatggtggcccatgcctgtaacagcagcactttgggaggccatgacagcaggattatttgaggccaggagttcaagaccagtctggggaacatggtgaaacctcatctctacaaaaaaattagccagtcatggtggtccatgcgtggaatccaggctacttgaagggctgaggtgggaggatcacttgagccggggaggtggaggttgcagtgagctgcaattatgtcactgcacttcagcctgggcaacacagtggaacttgtctcaaaaaataataattccatttaaaaaaaataagcaggcatagtaacacacgtctatagtcctagcatctcggggggctgaggtaggagggtcacttgatccagaaggaaccccggagattgaggctgcagtgagccatgattgcaccattgcactccagcctgggcaacagagggtgaaggaccctctcaaaaaaaacaaagcaaagcaaaacaaaaagcatcagcaacacaatccatcttagattcctgacatccagtctttctattcttgggaattgtcctagaatcacccagttgcttcctggtcagcatattcaatggacaatgaatgacttgttgactattccaccatcaaagaaaaataatattaataccatccaacccctgaaatgagcctatgttctatgaagtaaattagctgaaacaaagtcactcttaaaaatgaagtgatatcaaaaatcaccaccttggtttttgtcactattttatcttcatcacatagcgctgtacctagcacacagtaggcatttaatatttgtttgcaaaaaattaagtcacttctataaaaattaatagtgtgagaaaccttggactttatgatgcaccatactagagtaaaagacttgtatctattttttttttctaagagtacatttctcacctagggttctatttcttaatcttggctggaaccaaagaagttgttatctgccgtctgatcaagagagaacccatagtccctgcattgtaatttgtgtgctttttcttatttatatttgcattacaagaaaacatgaaataactgtatctgctaaaactgaccgaaagatggatttcagatgtgagcaatggaagtgggattggcattcatcatagtgtaaatgcaaaagtgcttttagcccaccaagtactgggtacactattctgaccttttttcaagtttctcagtatttatggaagaataatttgtagaataatgaatatagttttccagtggagcaacaaatgcatactatatttctgctattgtttcttattaaatattcatatgtatattttgtgtttgcttcataactggccatttactggtgcttaacaagcataggcagtcccgctgaagagaaataacaccaaacaacagtaaacaaaaaagcagacgaatgaaaaaagatatcttatttctgcagccgttacatttaaaaagtgcatttaacatttttaatacagtccatatttcataaatcccacatgttgacatgtcctagagaaagatggatgggttgacttggaggtatgcttctatctagttttatgtgtgcatctggcagagctaatctttacttccctttagcagaacacaaaaatgtaattctctaataactgacataactgcatcattttccaatatggactgcattattaaatcacagagacaagcaaaaccagagtagtggggaagcttgacttctgcttgatatcagaccataaaatgcctacttactgtggccgaaaggaaaaagagcatcgactctcagtgcttggaattcggaacaacttctgaattcacagccccagagtcttgtgtgtgtgcaacaataaccgtgtctttgcatttgcatattgctttagagttcacaaagcatttttacggacaagcccatactgagaatcagagcaaggattgctattctctgtgtatagtgagaaaatagaggctcaaagaagtttccaatatagtaagaattatttctgtaggacttttaaattgtataaattgctttaacgcatgcagttacattttgcttgtgtaactaggagaataagtcatctaacagtcttcttcctatccccaaaatacccattcaaagagaatagggaaaggattgcttccagactaagaacttaggatcttgcgaatggtagttgcaaaacatacacagagtcttggattagcaaaaagtaggggataagggtttcagagagccgagtcattgtgcttaagcatataggaggaatttaaggatgttgttgcctctaagagggatggagctgaaagacacacaagggtaggacagatagaagagagaatggctgagatatatggtggcgtgtatgcaaggacttctaagagaagtgatagctaatgtttgtgttgctacaatgtaaatacttccacttccccaagcaatatattgtatggtcaccatgcaggctcatcaacaaagattccgtttcttccctgctgagcactgcttgaagttcttgtgatttgagtgaggccatgagagcagttctggctaatgaactataaatgaaagtgacaggtgctggaacattttattgctgatgcaagagtttctagaaatttcttatctctctgatatggtggctagaaatatttcagatgatggattttccttcatccaagattgctgagagtctttgagaagcaacaccaccctgtctcttaccaccaaatccatgatggacatgtgatatgagcaagaaataaacttttgttattcctggaccttttagattttggagtcatttgttgccacagcatcacatggcgcatcctgactgacacatgcagtgtcctcatgtgaacattttgtttgtgtgttgtcaaggaaagtcactgtggttcgtgttagcgtcagtttaattcaaaggtaactcaacagcaagaaacagaaagtaacagaaattcagcaagggcaagaaatggaaacctgatatatcccatgagagtttaaggaccctgacaatctgcagaaattttaaaaagtgctttgggcttttcacaaagtatagaaaggggttttggaaaaacctatttgaagttttaaggatcagagagaaattaacagctaatctttgatagttctcccagtaccatcttcaagttaaagaaaagggtaggattttttttcccctatgttaggggaggaaattaaaactgagataaataaaatgacttgtataaggtcatgcaaatgctaataagcaaagcccagattactaaaccatttgaccacacgtgtagtagtgtttcagcccactcttttaagaagttttcagaaagccaatgagctaatagcttgaatatattacagtttgaccttcatttcagcaggacagacaaatcattgacaaaacggctgcaagaatatcagcccttttaataagttgtccagtaatatgatatttttatgattattcaatgaattgatttttatggaattggctttcagtgaatttatttatcagccagttttctgaagggcagcccaacactatatgccataaattttctttgctataattaacttcagacactctgtctcctatctttcctaatttcatctctctctctgccctgtttatatttattggatgctctggtatgtaattattagaattttccctttactttaaaaactgttctttcatctttgtgtgtatcattgattgatgaccccatcatgaccttaattgcaatttacaaacttacttgctacaaagttaggttaatgagattattcactatacaggtagattcaacataagtttccattatcatttttaaagccagtatcatccactaaacatcaatatgtcatgcgatgttttaggagcttcaagtaaggtccagttgtgttatttcagttaactatgttgtacgtctctgtttaattgtaatattcttttctgtggaagtaaattctacctctggatcctacttaacagtgttcctggctgttactaacccttcctctgatttgacattggaatggaagcatttttgatgttctatttatgatgttaaatttacaaagaggtttgagacattttgaattatctcataaatgtgcaatcttgcctcacagttaaatctgatcatttcttttaaaatattatttaaattttcattgcatcatttcttctatctgttcagtggcatttctacttctttatttgttaatcttctgaaatagtcttaatctttcatacttgaagcgcctctgtttcctccatccatgcaagtaaattttcctccagattcaactcctttctccttagggatgttcctgagagtcccctgacctttcgagttacttcttgtcagtggctggtgttagatgcacagttctctaatcatgggatattccacctcaatctgtgtactcctttaaggtataaaagagcaaaattttccaccggggggtagcaacatgacaagaagggaaagagcagagttaaccttggggaaaaaaatgagacataaggttggctgggtagacgaggcagccagagagacagcctctgttgttcctgaccactgccttggtttttagtattatactttccacttcagtcactgcaacccaccgccctgttgcaggaatgaacatgtgacccaggtgcagccaatcagggtttgctcttcccctgtgttggtcattggtccaaggtggacaaatgatgcaaaagctgggccaggtagagagatttcctggaaccttgctagtcaggttagacagcttcagacacgtgaactcggagaaggccagaatctgtttttctttctggactgtctgaaatgtgaactggaagaggcagggtggggaaaaaatcaacccaaataaaattagcagtaaagaaatctagataaaaagagcactgagctgtatgatgttccagagtcagtttgacttcttggacgatgattattttatgattgtatttgattgcgttgtattaaaattattgttatatttttattacagtatttcttatattattgaaagaataaatcaatatataaatgtgttggaattgctggacagcaaactatatacattttatgtggttgacagaaataagctacttgaagctgttgagcttgagcagagtgacaaaaagatgtaaatgctacattaggagattcaatctaataacagtttttcaagatgaatacacagtgagagcctaggcagggctgaaaaatacgtggcccataccctccaccttcccctcctatgcctgtggcagacattgctaatcaatcatggcacttttacccactgagtctgagctggtcttaccatgcttctcagtgaagcgctccaggcagtgactatagatgatcagagctggcacacaaaatgaaacccatttgctctcccaagctcacaggcaaggagaatagccaggagtctgagcatgaattagatataaggttcccaagattggacctaggtggggagagagcaaaggaaggggtaaaacctatcgttgacaatattagtttgcttggactgccataacacagtgccacaggttgggtggctaaaacaacaaacagttactctcacagttctgcagactagaagtccagaatgaaggtgttggcaagattggttccttctgagggctgtgagcaaagggtctgctgcaggcctatccgtggcttgtagagggtcagctacatagagagcctgtgtatctttacatcatcttccgtctatgcatgtctgtgtccaaacatgcatactcctcttcctgtaaacactccagtcatactggcttacagcccactctgaggacctgactttaacttgattccctctgcaaatattccatcttcaaataaagtcacattcttagatgttggcagttaagacttcaacgtcttaacgttgaatttgcggggacaatttaacacatcacactgggtgcctaccatgagccaggcatgagcttatataccattatccactggagcctcaatgcaacctacatactgggtacttttattctccctattttacagagcaggaaactgaggctgaaaaatcttaagaactgtagtaaaagtttcacagctggagttgctgtatagcaggatttagatgtaggctcctgctggctaattgacatagtgtaaaaagaagggaacttggttatgggttagacataaaggagaaatttttttaaaaaaactaaaatcaccaaagactctagacttcatttctggaaaaatggtgatgtcagtcttcctgcttaatatttcagtggccccctattccctgcaggttaagatgtaaattatttagcaggaaagtcaaggctgctgatggtcttagatgcctcattaattctgtctctagcttctctcttcctggcccctttggtccagcaacactgggcaatttatttgcagtctccaccttagagagatggagagggagaaggcttggagagaacagaggatgatggggaggaacaacctgtgcactgggtctcatccttgttgtttgcaattctggctacttttagcagtgagcagtataattacagtttagtcacctaacctctctgattctctctcttcccagcctggccaacatgatgaaaccccatcttcactaaaaatacaaaattatctgggcatggtggtacgtgcttgtaatcccagctactccggagggtgaggcaggagaatcacctgaacttaggaggcagggaggttgcagtgagctgagatcgcaccactgcactgcagcctcggtggcagagttaaactctgaaaataaataaatataaataaataaataagatcatgtttgcagagtcctcagtgcagtgtctagcacttggcaggtacccattggctgtatggataacaaccattcagtttgggatatttggagtctgacataaccaacggcaaccaaagagacgagttccttaccaagccagaaacgcaagaccaggatgcaagtggcattcctggggggtatcaattctctgtttctttgccccttttcagaggctttatgttcacccccaggagtgaacaaccatcttcctgctctgttcctattttccattatacttaccaggagttatgaattgaatcaggatgtcttaggcggcttcccctcctgctttagcaatcaataaattgccatttctaaaggtgagattgtgaattgttaagtccaatctgcagatattctagataacccatatgtctcctgacattgctgtattcatagatggcttctcaaaccattattaatgatgtaattagtatgaatggctacagtatatatcaagcagatcattaaggcagaggtggggaggtagccatttatattaaagatacgtttaatgttctgaacctaagcaatagaaagaaagtacttagcttagaaatctcgctttgctacactatgggttttcttttttaaagttgtcctagaccttctttttgcttgcttaatgctactttttgttggagcccctgggaatttgaatgagttaataaggcagatctgtttgtaaaagagtataatcaagtaaatcacagcctttaaaatcacagatttcaaaatccaatcaacttaattaatgtgttggttcatagacattgtacaagattttatttgattgcactagccgctttctcttagacacccatctgcaagaatatttacttataacttgttgtgtaaagggatcttcctaaacggcacactgccatatgtaactgctcagcttacctttaagagaaaatattgaagtaacaccctcaagctgttctactctgtgttcagaacttttcaaagctagatttctatctttgtagtaagtattgaaaccttgcctcccacatccaggctgttcaaatatgagataaaatagtttctaagaatgatagagtccaaaagttttctacagttcttatagatgttgtgagctgaaaatacatgggttagtgaagaggtttttttttttcttttctctattattatctcttttttccccctaggaattaatgtcctttgtagtagccaaaatgttaaatgtttttaataaaagctgagacttaagttagaggggaacatctttaccccaggtacaaatgacgttgctacttgccacggtccaaagcgcagaggagatggggagattgtgaaaactggggagtcacacacaaggagggggtgttttttgttcttctgacaaactgatcctgttaagcatccactgcagagcggtggctgctgtgttatgcaagcacctgcgatgcgctgcagaagaagagaggcatctgatgctcgaccgagcagagctactgcagacagaagctgcttccgaggccccttctgctcacagggcatgcttcctggctcatgtgcagtcagccatgctgcagaggccagggacccagggagcgtggcaataagtatgtgtccagctttccaaactctgggtactgtgaagcaactgcagctctgagccttgcttaaccagggctggggacctggcagcttcttccaaagtcacttgacaacagttgctctgccctcagtcaatgcaagcaaccacttgtctacaaaaggagtgaggacagtaaagtctctgccttcaaggatcgtactgtattcttattattagtggctacaaactgttaagtacctaccatttgcaaggaactgtgttgatgacatgttacatgtacatcatctgttacattatcataagacctcaaatatgttttattacccccattttgaagagattaaaaaacaaaaaaaactaaattggccaggtgtggtggctcacacctgtaatcccagcactaggggaggctgaggtggtggatcacttgaggccaggggttccagaccagcttgggcaacatgacgaaaccccatctgtactaaaaatacaaaaattagctaggtgtgatggcacatacctgcagtcccagctacttgggaggctgaggcaggagaatctcttgaactcaggaggtggaggtggcagtcagcccagagtgctccactgcactccagcctgcatggcagagcaaggctctctttcaaacaaacaaacaaaacaaaaaaaccctgcaaatattaagtgttaaatcgtaaaactgagaccgcaacccagatctatcttattctaaagctttggttgttttcatttcaataattactgtcatgttttagaaaagcagcaaaacgtttatttaatatgaaatctcctgcagaaactgatacagagacagatcaaaccaggactgctctgactgaaacggaaggaggaaagtctcaagctctgactggaccgcctcctccttccctaattcccaggtagtaattcccaatgactgagccatcacttcagaaaactagaactgtggtttttcagatgtggtctccagtccagcagcgtcagcatcacctggaaacttgctacagacgcgtgttctctatcctcgctgcaggcaaactgagtcagaagctctagggtttgggtgtctctgatttaaacaagccttcggggggttgccgaagcatgctcatgagtcaaaaccaagaatttacaaaacccattttaataacagctgagttctatagtacctttcagtattcgtaacagtgattcctggagactttcttgacaaagtccaggatggtgcattaaatctacttctgcattttatttttttattttttttattttttttgaaatggagtcttgctctgtcatccaggctggagtgtaatggcacagtctcggctcactgccacctctgcctcctgagttcaagtgattatcctgccttagcctccctagtagctgggattacaggcccctgccaccacactcagctaatttttctatctttagtagagactgggtttcaccaggttggacaggctggtctcgaactcatgcctcaggtgattcacctgccttggcctcccaaaatgctgggattacgggcatgaatcactgcacccggccttagtcatgcaatttttattttagagaaattctagaaatggatactgtttactcaatgcagcattggagaatgaacgttgactttattaacccaataataaaataaaatgatttctcttgatttgtttgctgtcaagaatcacaaaccacatggacttgagaaaagtgaaagttattaacgagatttcatgcatcaaggatactgttgactgtccagtgaaagtattttttttttcttttttttttttttgagacggagtctcgctctgtcaccaggctggagtgcagtgacgtgatctcggctcactgcatcctccgcccccagggttcaagtgactctcctgcctcagcctcctgagtagctgggattacaggcgtgtgctaccacgcttagctaatttttgtatttttagtagagacgaggtctcaccatgttggccaggatagtctcgatctcttgacctcacgtgatctgcccacctcgacctcccaaagtgctgggattactggcgtgagtcactgcgcccggcccagtgaagcaccttacgtgtgtgtcaccattgagaagaaaggttaccaaataaattttgtcccgctattgattgcaaaggcattccaatttccaagatatgaaaatgtaggcccagcgcggtggctcacacctgtaatcccagcactttgagaggccaaggcaggtagatcacctgagttcaggagtttgagactagcctggtctacatggtgaaaccatgtctctactaaaaatagaaaaaaattagctgggcgtggtggtgctcacctgtaatcctagctgctcaggaggctgaggcacaagaatcgcttgaacccagcaggcagaggttgcactaaactgagatcgcaccaccgcactccagcgtgggcaagcaagtgagactctatctgaaaaaaacaaaaacaaaacaaaacaaaacaaaaaaaaaaccagaaaaaaaaagaatgaaaatgtgaagaaacgtttgctttagaatcagtgaaatatggcaaaaataaaagagatgcttccgaaattttgttgcattaggtcacttagccaatgaggtcaggtgtctgtggaagcaaaaccgtgtctttgtaatcaatttaaaataacacaaaatgaaaaaaaatgctcttgttcatgataattttttccactttctggtttgattatcttccatatactggtgagtctccatacttggttgtattgtccaagttggattttccctgcagcttcaaaatcatcatgtccctcaccaaactcatgaagttcctttacattgttattgttgactctgctgttcttcttgttattgttggtatactctttagcacttcttcctcctctatctctaattctagtacttggaaggagactatagagtagtgattacctgtattttgagaactgtgttatctgcgaagatgtttcaaagtgtggtggggttataaagggctttgatggtgggacaggatggcattgagtaaagtaagttgagaagttgacagttctccctggccttatgggttcattgtgatttcaagaagccgaaaggatatggttgtatcatctgtgggctccatgaaaactaatgatcattttctaaacttcgcatcatgttttctggctttttctatccctggaatcattaatcatgtatattaggtgatttccctatatctgtttatagacacaaaaacacatatacttttttttttcctttcgaattctgccatatcaccatagaggtcttcaggaagttagtaaccctagttttagaagggtttggttgtttttgctgtctttccatagtcatttttttttttttgaggcagagtctcactctgtcacccaggttggagtgccctggtgcaatcttggcttactgcaacctctgcctcccaggttcaagtgattctccagcctcagcctcctgagtagctgggtttacaggcactcgtcaccacacctggctaatttttatatttttagtagaggtggggtttgccatgttggccaggctggtctcgaactccagacttcaagtgatccacccgtcatggcctcccaaagtgctgggattataggtgtgagccaccacgcctgtcccatcctcatcatttttattactgcatcttattctgtttggggtttttgtttgggtgattgatttgaggtgtttgcttgtgtgtctgatttggggaagacgttcccaggtaattagtgtaaaatttttaataagcctcataagctttacaattatttccctggaggacaggttttatttaggatttaagaacagtaggcagtagttgtgacattttgaacattttatttctttacccaaaaaataactaacttttgtaaaaccaatgaaaagaaatgaaaagaaaatgaaggaccacaatgctttatgggtttgtgtttctgacagcttaagtcctgctcttgaaagtagttacacagttggcaatatacaatgaatcactgaagctgtttgaaaactttttcgtttttttgtgaaaatccaaacttggaggagaaagagcttactgatgtcaacacttagaaagcagtgttctctttatatagtcacttactgtcttgggtttcattttcggttcagggggaaattaaattcccttgcaattgcactctctgtctaccgagaaattttatctccacattgtttttacttgctgtttgtcctctgggtaaaatattgtgtccgtagggttagaagtgcattttagaggtcttttggttcatcaggctgttccttgcaggtcagtatttatactatttctgacccagatgtctcctgtattctaagatcctagtaaaaaagctgggggaagggagaccattgtaagtacacagcagccttactttgtgagctcatgccttagttaaaagattaaccgaagaattttatttcaccctattgtgttaccaaacattagatcttattgcttctaactatatttttatgtcctttattcatccctctttatcccctcctccccaaaaaagaattattttagcatctgaattcattctcctgccaagcagatagaaacctttaatcacttacttactgtaggtatgggcagacacagcttttctgtttcttaagcctgtccttccacttagattgcaaataagtcttcagggaattgcatgtgttctcaaatttgattgtattttttcccttatagacacgggttggttagagggatatcacagtggacaagaattccaaaaaacctggcttcaaatctccaatctattactgtaacattcagtagatcccattgttactgaaaatactgagttcattgtgagccacccctgtctttgagcctttccatgaaagtgagtcttctcccaccccattcttgcccccgttagccccatggcttgctttgaccagtgaactgtgagcataggtgatggatgtcactttcaagtggaaaatttacgagtatgcatgtgcctcattttgctctcttttccctctgcagtaaggccagtgatatcttacatatgacggctctgtcaacttggatttccagaaaaaggagaacgtggaacagataactttgagaaatgggcttttagcaagtgggaaaataggcatgtattttgagctgtgtgttgggttcttcgtgactgcagtgttactcaccctgtcttgaatgatgatggttagtatttgcaacatatacatgtcgaattcccgactagtttgtggaggaagggaagagtgccaatccatatccgtaagcccatcctcaatccaccagcttccaccatgtagtccagcacctaatggttgtttaataaattcttgaagagctatattgaaattggtttgtgtaatcttggaatagacccttcagtggtaaaaaccagcatttttccaaaggttgggtgagattttaggagttctataagtttcttttaggtggttcacagacacagcaggaaacaagattgaatcatagggtggagaaagttttcctttttgagttttcttttaacacattgtatagcattcaaaacaaaatttctcatagccacgtatttcagtggttacctgtgataactagaattccaggagaccaatgtgtttatatttgtacagttgcttaccatttatggttaataatagtagtgtcccacttatactagaagttgattttatagattttcttttaaagtaaaatgtgtttagcacaaagagtacaataaaggaaaataaataatataggtggtaaggtgaaaatgtgaaagcctaaaggtatggtatatgattgaagttgggagaaacactgctgtaagccttttggtaccctaaaatattgttatgaaaacctaaggagggtgggcatggtagctcatgcctgtaatcctggcactttgggaggccgaggcaggtggattgcttgaggtcaggagttcaagaccagcctggcctacaaggtgaaaccccgtctctactaaaaatacgaaaattagctgggcgtggtggtgggcacctgtagtcccagccacttggaaggctgaggctggaggatcacttaaacccagatggcagagatttcggtgaactgagatagcaccatggcactccagcctgggcaacagagcgagactccatctcaaaacaaacaaacaaaaccaaacccaaagaatgtttgaatgggttgtgaggatggtaaagtgatagatttaaggaatcattgctttggttatcgtttattgtgttggtgtttgtaacagtctttccttcctatctagggatttatctccatcttgtctgtccccagtttcctgggatttccgtatgaatagcatattccaagtggagaagaaggagagtgcctaaattcactgtcaccttctgatttaagcttttttaacctacgtacccactctctgttctgtgtgaaaagtaactggaaccatttgtgtaggtgaaaatagcacttagcagactcagtagaactctaaataaaagggatgaagtcaggggtatgaagtgagcatgaagtgagaaacttgaacagactcttgcttgcttgtgactgtaagtgttccctagaattcgtgtggagtcacctggttctttgtgtctcagacccttcaacactgtgaacgttttgaggacaggagttacgtctgattccccttcatgttccccgtcccttcacaattgtttgttgacaccaggcgttcttccaatatccatccattcattcattagtgactttcagttaaagcctactcatgtcttccattacaggtgccaatgcatccatttttattatcagtagtggctacaataatatttgtagcagctacaaattatagaatatgaatcatgaatcctgctagcactttataagaacaactgcttgaagcaacttagcaaggtggcagtattatctctaaagaggaaaatgaaacttagagtagttaatctacttgcccatcgatataagatacagacactaaatttgggtctacccagttctgaaaacccagaaacccgtttgccttttctacctaatagtaccttgttgatgaagacacatacacacacacactagagagagagagagagagaggagaggagaggggaagatatatcagctacataaacttcccagtcctgccttatttattagtctgtgatggttagttttttccagtgctccaggcatagcattcctcagcaccattgttccaaatcactgaagctggcagcattcctttccttgcttaatctctgcaagtttcaacaaattgttaatgtaatgttttccttgaacatacttaacatttacttttattcatctgaacgtggaacgcagcactccatgaaggtgcaatctgtcttcaatccaatgtctcatcaaattcctgctgcccaaaatagagcaaaggttgagccagcctaatgtagggttggcatatgataccattatagctacttagtggacagcaaggccagcactgcttttaaaacaatccctgctcattcttttcttccctttctttccagcaagtcggttttctgagaaggagctgtggctggttgtattaacatttgcattttgatcctgcttactgatgcactgcaaaaaagaatcttctgtgttgcctacttagaattttctgttgtagtcgtgtgaagttgccaggtggatgacatagatcccatttcttagtttcctttacagcacgttgactcttacccaagtccccaaaccccctggttggtgattgcagaccctctttgcaccccttcccttggcgattttatgcaaagttaatgccctttggccaagcagaacttccccagagctccttcaattcttcacatttttgacagtaacactttgtaacgaatgtattttagacaagactcttcgaccgtaaagtactggatctctctaaaaataactcatttgaaaagggggttattttaaggagactcagaaaatatcttaaaatatccaaagtctgagaccaggcatggtggctcacacctataattccagcactttaggaggccgaagtgggtggatcccttgaggtcagacgtttgagaccagcctggccaacacggtgaaaccctgattctactaaaaatacaaaaattagctgcgcatggtggcacacacctgtaatctctgctactcaggagcctgaggcagaaggatcacttgaacctgggaaatggaagttgcagtaaggcaagattgcaccactgtactccagcctgggcaacagagcagggctgtctcgaaacaaacaaacaaaaaagcctgagagtgaagtacagtgctatttgtaggggtttgttaggaagcagaagtatcagaaatgcatattctcaaagcctccctgtctccctctctctctctctctctctctctctctctctctctctctctctctctctctattctgcttcagggtgttctgtgcccccctcccctgtctgatttctgtctctgctcatttctcaccactcactctcagtctttgctcctcagctattcttgcgtgtgtggcgctggctcctgctctgcttttgccttgatctagttttacttttaattgcaaaaactacaattacttttcattgcaaacactgcagttacctttgcaccaaccgaatacatgatctttctcttcagaacttgtaaaagactgcccacctcacctgaccctcctagattccattcacaggagctcactgtctgcagaatgaattgccattgaaacagctctttcacctcattttgcaggcagtggagtgagtttacaggaaatggacaagctcacagggaagcagagactgtggagggaacacagcttctcccagaagaacaccgtgggaagtttggtttcttgtcttagattactgggagtcgggaaagaaagcccctagagatcaaactcatataggtcatctaaaaatacacgatcaagtcacaaaagcacaagataaaaagaaggctttctttatccctgtaccatgcctttacagaaactacctcattcatcaaaagatctttcttttaaacctgaactctagtagctgtgcgatagagaggtcccttgtcagtatcaacagctggggctctatgctgagctcagaaagtggagttctgaatcaaaccaagtccatgagccccaaagtaaatttagaccacaaagaatctcctctccagtttttatataaggagaaaaggagaacaaaagccctgttcctccaatagagcattggccagagaagcccagaactgtactttatcaatgtggaaactaaaatatcttttcagtgtaatttgtgatgaattttcatttgcatttatcatgaagaccaaaacacatgtatcatctggtgagaagtattctttcaaggtatctaaaacttataatcactaataaaaatatgcttaatacttcagggccaatggaatgaattgtatggggaatagtttaggttgtctgatagggtcagctgtcacacatagagggagcaagctgacctggagaatgaacatagagagaacatgataattaaccaagtgctatgatgtcttctaatatcccaaagacagtgctatgatgtcttctaatatcccaaagacagctctttatatgggttttcttcctttgcataatactggatcaatagatagatactggatcgattgatagatagacgaacagatacaaacatacatagattatggacagagatagaatgatctataattgctacctatctcttgtctgtctgtctgtcctttttattcaaagtaagcttcacttccatcacttctgcattttctgtcacagatggcattggtcattggtcatttcagcacagtttcataatatgtctctatttccaaggggtggtctgttgtgcgtttgaaatcccccagatagctctgtgttctgtgtgactttgacagtcagtctcatggatgggtgaaatgaagttttctcttttgttccattcagcccaagtggcagcacttctctaattctgtgagaatgccttcccgaatttgtgcctttattatcttttggttggactcctgggaatctgtctcatgtttctgttcacacctgctctccatcccaactagaggtactcccaaagtgtacccccaaaacaagaagtatttctgaaaacacttgccccatttggggttctcagtgcaatttcgtgacagttttaaactgacactttctctcactttataacagcaggctagagaaaaataagaaactgatagcctcgacctcactaaaacattcatgaattaaaattttgtaaaaaggttaccaacagattgtatcagtttagttcatttttttctattatcttaaaaagccattttccctgtgtttgtaattgtattttatcattttaggtagtagtccagaataagacatgttgggtttaattctctgccacagttctcaaatggatgtttcataagtagcatgtggctttctcagctaaaattaaatgtctcactgtctccaaatgttttctatctagaatttgcaacatacacccttccagaactaacagagactctgaaaattaccactaaacaacgtcagtctagttcatccttcttaccagcttcaaatgctggctgtagataaatacatctttaataaataatctaatgacttaaagaaataaagtctggtcctcttttccatagaagttcagttcagagaagcaccaaatcaaaaaagatgatctatattaacaaaatcctctagttttgtgatgttctaggaattaaagaacaagtccaaacctcagagaccaaatgtatatcccaaatgtatatccccagtggttcctgattcccagaatcccctggatagctctaaaaaatatataaaactggttccattcatgatgatttactaaatatggaatggaactaagcagataggagaactaactggtttaccctcttcgtctgcctcagccactagttgttagtaatatatgtgtgtgtgtgtgtgtgtgtgtgtgtgtgtatatatatatatatatatatatatatatatatatatatttattcccctattggataacaagctgtcgattcctctcatgacctctacaaggcagctgcacatgattgatgagaggaaggatctatgttcagaaaatttttttaaaggaggaagtggaggagaagaaaaaaatggagagtcatagatccttgacaatgccaatgttttgtggaaaggaggcaaaagtacctgatggaagaaataaaggaagagtaaaggatactcatgtgattgcacaaaagtggactacatctcaacagtgaggaatgagccctaagacaggttgaaatcccagctctgccacttcccgaatgtgagacttgagcaatttgtttaaacctcttgggatcagtgttaccatgtgtaaaatgaagatcatcatagtactcatcctcttatgtcatctttttgtaaaatgtttttttaattatggtgggtacatagtaggtatatatatatatttgtggggtaccaaagatgttttgatacaggcatgctgtgtgaaataatcaaatcatgaagaatgggatatccattgggttgggaggccgaggtgggcagatcatctgagcttaggagtttgggaccaacctggccaacatggtgaaaccccatctctattaaaactacaaatattagctggcattggtggtgggtgtctgtaatcccagctactcaggaggctgaggcaggagaatcacttgaacctggcaggcgaaggttgtagtgagcagagatcatgccactgcactgtgcagtttgagactgtctcaaaacaaaacataaaacagtttatcctttttggtactaacaatccaagtacactcttttagttatttttaaatataaaattactactgagtatagtaatcaaataatatgtatgtctttttctttctttttttctttaaactcatcaaccatccctactttcccctctttcagccctggtaactatccttctactgtctatgtacatgagttcaattgttttgacttttagatcccactaataagtgagaatatatgatgtctgtttttctgtgcctgggtaatttcagttaacataataatctccagttccatctttgtcattgcaaatgagaggatctcatcctctgctatgtaatctgcggacggtatttcaaacgcacttagaacagtgcttgggcatcatcaacgccatataagtgctgctgtggtcattgtgttagaaaagtgcccggtaaattatgctctatgaatgcgaggtctgtggattgctcccaagagcgtgaagacccacaaatgtacatgagaggtgggagcatttgagatcatagatgagtttataggatagaaagaagattgcaggtaatataaaaatcagtggaagagtggtgagaaatgattagggaatttaggtgacatttttaaaaaaaatgcatttggtgaaagaaagcaaagaaactctgccacaactcagaatgcagctgacaggccgtctaaggaaatgtcgtggctaacagcagcaggggacgcacctgtgcagagctccctgtgcccagacctgagctctccacaccttcctgaatgctggcagcacctgaggaagggagcaatggatggggctatttatatttggcacataagaaaaccattgctgacaaataacttgcccaagctgacacagcggctgtagagtagagatttaaacacaggttgttttccagaaccctacttcataacttctaagatagagtagaaaatatttgcattccccgtctttactaaaaatacaaaaattagcttgtaagcccagctactcaggaggctgaggagggagaatcgcttgaacccaggaggcagaggttgcagtgagccgaggtcgtgccattgcactccagccggggtgacagagcgagactccgtcacacacacacaaaaggaaacatttgcattgactggggcatgtcctgacacagattaaaacgtgatgtggcttcccactgtatttaagaaaatggtcaagtccagaagtccaggttgggtgcagtggctcacgcctgtaatcccaacactttgggagtccaaggcgggcggatcacttgaggtcaggagtttgaccagtctggccaacatggtgaaaccccatctctattaaaacaaaaaaaaattagctgggcttggtggcacgtgtctgtaatcacagccagttgggagcctgaggcaggacagttgcttgaacccgggaggcagaggttgcagtgtgctgagatcatgctgttacactccagccttggatgacagagcgagattccgtctcaaaaaataaaaaaaggctaagtccttaacatggattacagagccctgcagtttctgagcttatcatccatctgtcccttcataccctatatccccaattccctggagctctttctgtgtctcagacacgagctaccctctgtgtctcaccaggtcggatccctgtgttataggtaacttaaggtctgtaactctgctaaactacaggctccacatggacaagagaccaggtcaggtttttccttttcctcggtgtttatataatgcctgatacttggcagttatttcaaagaaatgaggtgaaccgagtaaattccacaccatattcaggaccaatctctattttgccaaatcatgcatcataattgaggtcgtagccaacggcattaagaatgcttacagtccattgtggagtttgcacccatggccgcccctttggcatcaagctctgactccagctgtgatcacctgccatcctcaagctgccatctgacccctgcccctccacgacctctcagagcatagcttccccttggatggaggggggtgaggagagcagtcagaggtgaaggctaaagaatgtggagggtattgagtgcaccccagcccctgacatttcagcttgttatgtggctgtggtagtaagcatttggaatcagctctatcaattatttaagtctcataattcagtccatagtaaagatttattgcaacaaactgaaaaacaaagtacagacgcaaaggaaacagaacatggattctgctgtgttacacggtacataaacttctcatgtccgtgggagtaacataaaaggaagtaggttatttttaaaatactggagtgtttctgaaagagataattcagctctgagtttctgtgtgtgtacatgtgtatatacgtgtgtatgtgtctataatatatgtgtgtatgtgtatgatacatgtgtatgtgtccatatatataatacgtgtatgcacatgcatctgtgtgtatgcatgtgcgtgtctgtataacgtgcatgtgtataatacatgtgtgtatgtgtgtgcatgtgtatgtgtaatatattacacacatgtacacgtgtataatacgtgtgtgcatctcgtatgtgtttgtgcatatgtgtatatgtgtgtatgtgtgtatatgtgtataatacattgtgtatgtgtatgatgtgtgtatgtgtgcatatatataatgcgtgtatgcatgcgcgtctctgtgtgtgtgtataatgtgtgtatgcatgtgtatgtataatacatgtattacacacatgtacacgtgtataatgtgtgtacatctgtgtatacgtgtttatgcatatgtgtatatgtgtgtatggacacacgtgtatgtaacatgtgtatgtgtgtgtataatatgtgtgtgagtgcatatgtgtgtatatgtgtgtgtatgtgtggatgcgtgtccatgtgtatgtttgcgtgcatgtgtgtataacgtgtgcatgtatgtgtgtataatacatatgtgtatgcatgtgtatgtttcagggtttccttgcattccattttctatttagcatcaggcattttcttcttccctaggcattaaggccctcttggctcaaaattttcatgaagcatggatacattacaatttttacatttttagttggttgtttacggccattggttggtctgtcaagagcaccgagtcatctgcttactataccatcttgagtggaaaggaatgagtttatatttagagacacctggatgtagattacaactccatctctcaccatctgtgagattttgagcacagctccagaatgctgtcagccttagttttctcatctttgaaatgggaagaataaacgtccatacctcctcaagcaagtgtcaattggaattatctctacagattttctcgcccatggaggcttcatgcatgatggtttcatcttgtgctgtccctcaacatttacatgaatgaagtacatcatacttacatatttgaagtatggacaccttttcattgcaagaggaaagcaaaagcaggcaggagcatttcgttagtaaataatagtagggccatgtccaggtgtgaagttaacaatgagagagatttttttgcccatgttctgaccataaccatttgaactatgtttagtcttaatagctgggtggccttggacaaggttaatttgcctttctgtgcttctgtttccttatttataacaggaggatgctcatagcatcaacttctagggttgtcgggaggattaaatgagttaatactcataaaatgcttagaacagttcctggcacatgaaacaaaggtttatttgagtttttctttagttattgctggtggtggtggtggtggtattgttcatgttcttatgctgagcctgtgtggtgaattggaatgtatctgtgaataattcacttgctatttaagcacgttcaaacatcccatcataatattcaaagtcaatatgtgtatttctctgtagttcatccacgaatatcctgttccaagttgccatcatctccccctggagctaccacaaaatcctttagggatccttctgtaacctctatccatgctcccatcaaggaaaaagattttgaaacatctaatcatgctaccactatctgctctcccacttaaaactgtttattgatttcccgttgctcttaggatgaaagcaaacacgattgcatggccttggatggtctggccctgcccttctctcaacactcatctgcttctccccttactcattatttcagagcctttttagtcttttccagttttagcaatgtgctgagtgtcacagcagatgctattccctctgcctggaattctacccttcttgacctcgtcccaccaacatcactattcattcttctggtctcagaatctgtattgctttctccatgatgccgttcctatctttcgtctaaactgggatcttctgtctacgtgtaagaccctctcctcttccttcacagcacacaatgccattcctaatattccacttaacatgttatggttgttgagtgtttgtctttgtgtgagctccatgaatgcagggagctacatatgtcttgtgaactgctagatccccagcattttgcacatggtaaatgctaatgaaaacatttgtagaaggtgtgaatgccatttaagatgttcccataacgttcattagaactagaaagacttcctgatatccctcccattcaccgacattatgtataccgggtgctgtgttcacagcttggccactggatacttctcagttgtgcctctcaccctgtattgtaaatttcctatcgacaggctttgtgtttcctgttagactgtctctttcatgtctcccatcctagtgtctaacataggtattcaataaatatatacagaaggaagataagaagaaagagaggaaagatcagacttcattccagtgaggacagaattgcttgttcatctcttctgtctaagcccatccctctccgtgggctcattttagcaacacggcaagtcaacagaagtttcaacctggaaatgtcccacctagcaaggccaggggtgcaaaatcaaagtgaacaggacgttcctactacctttggggaagacaataacacagagtccaagaggtcaaagggtgcctggcctatgtctgcccctacgactcttccttagcccatgactctcgacctggaatgacagcaagttcatgtctagttaagcaaatccagagaagatttttgtttatgtagtggaatgttcaactcctcaattatgctgtgagaggctgagggggaaaaatagacatttttgcaaaatctgtttctggtaaccttcaacaaactaaaacagttgagcatacagaattttctgttgtttctgcagagataatttgttacatggaagctcatttgcttatttgaagtaaatactgcttcagacccagtagagattaacactcatagatgagatggattgagaaggaagagacataatacttcactgttatatttactgtgttaaatataaagtgggaattgatgaaaaatgttctggagttccccatgtgagcctaagtgatgaactggggtttatttgccatctggcttttaagcagggattttttttcatgtcagaaaaatggcaccttcagaaatattgcgttacagacatctgtttatcagaactttgcctgaatgaattattcagaatgtgcttaaggttgcactttacctgacatatggaaatataaagttgcatacttgatgtcggcatatatttgtctacataaaatcaggtgtcttacttgaaaccaggagtgctggaacttggtaggtggtgcttttcgtacctgggatattcattgttctacctcatgtggttcttgatgtcttcattttttggaaatcattgtgtggaattacatgtaactcacagtttctgtattgaagccccgtttttgtttccactgtgttccttacaactgaaatggaaagctactcttacttgatatgggtttcatggcaaaactctgttagtaatttcaagttggtgaaacaagtgaatatctggagctatcaagaggaaagtcttccaggccatactcagaagacccaagaggaaaaggtggttttgccaggtgcaaaaccatgcttgtaatcctagcactttgagaggcagggtggggagaatcacttgagggcaggagttcaagaccagcctaaccaacatggtaatgccctgtcactactaaaaatacaaaaattggccaagtatggtggcacacacctgtaatcccagctattcaggaggctcagaaaggagaattgcttgaacccaggaggcagaggctgtagtgagctgagattgtgccactgcactccggtcagggtgacaagtcaagactccatgtagagaacaggaagaagtggtttccatacacatcaagttttaaaggaacccttcaactcatcatgtcatcagaaccaaataaagctttaacattatccatgattgtacactgttttccatctgttcatttatttatttatagattgtttcatcagacattgactaagctcctactttaggccaagtattgaagatgtagattctactctttacttgttcggggcttacaagggagcagagaagatggacataaacaaaatagttacacatcagtcaccatgattgatgtgtaacttcaaatgagatgactgctcctgtgaagtgaaacaaggttttgtgagcatctgttggagcaacctgactcaggacttcaagggaaacttcttggaggacgcgattctgaagccatcataagtgacttcacttgttgaagaaggggaggagcctttcagatggcaggacagccatatacaaagatctgggggctagagagctcatgcagcattgcacaagctatttagaggccattgtagctgccgccaggggagctcatatggccaggagggctgaccgttcctagagaggtcagcagcccttacagcctggagtaaggaaggcggtgcttataaagcaagaatgatgggaaaccattgcacagattctaacatagaggccagttctgcgctccaattaaaattgacgaaagatccgtgaagtctgccatcattgcttatctgtctttgaattctctagtgtctagtgttcagcaagtgctggtaaaataaatacatgatgtgggggaagcacttcaataggatgtgagctcggagtgagttccagaaaggtgccccgcaatcacttatcccagaaactggtggggaggtttcagtcaacctgtataaatgctcctggggactgtcctttggataagcaggtgttctctttacctaaaaagagatgcctttcagaaagtctttaagggcagcagagcaagcactgggagggactaataggacctcaaaagaaagaggtgagaggcagagggctgagggcctttcggagctgccgctgcttagccagaggagggaagcaattgcatccccaacaggcgggctgtaaagggaatgcacgtcattacttggaaagggtggtgaagctgggagcaaacagcttctagatcaagctgccagggaggatgtttagtaattaaaggaggctggcaccatttggaggtacaaatctgcaaatccaaggttcacatcccagggagtgaccacgtggtcacaaaacacagcctacaaatgcccccacctgaggtcatacagagataagctacccccatgggggctgtgcgggtacagcaagtcggatgctcttattcaccacccctatacctaatagtgcagttcgttctcagatcatttttaaaggagaaatgaaagctctgtgtctgtgtgtgtatgtaaacaccatcttaacacattgcatgcacttttgatgcacatgtgtgttctaaactgtcatttgcagggacttctgttgttgaacctgttctctgtgaggcacgagtggtaggcttatgaaacccatccatctttaggccaggtgggctggctcatgcctgtaatcccagcaccttggaaggcccaggtgggaggataagttgaggtcaggagtttgagaccagtctggccaacatggtgaatcctcctgtccactgaaagtacaaaaatgagctaggtgtggtggtgggtgcctgtaatcccagctactcgggaggccgaggcaggagaattgtttgaacccaggaggcagatgttgcagtgagctgagatcatgccattgcactccagcctgggtgacagagtgagactctctctaaaaaaaaaaaaaaaaaaaaaaaaaaaaagaagaagaagaaagaaaaattcatacatcttgtacctgaggactgtttggggaagcagctgctttttcccgtcagtttctccttggttttctctactcacagggaccctcgccttgcacctgctgggaaggccagttcacctgcccgggctacttgtgttacacaaagctggaggagaatgaagtcaaagtggctgattttgttagagaagaattgttttgttctgcgttgggtgaagtttctctctattacacttttctacaaattcccctgttcccaattccctcagacaacaaaactacaatttgctgggtaaacaaaagcagtggggatgaagcctccctggcagccagtctgtcagaggtgctgtgcttgttagcatggtaaaagagttagaggaatttttcaagttgtacaaaattgaattacttaataaacttcgtttaactttcttccctgggagtcagtgttgttaaaaaatccaaaaagactgttttgcagcattagcattttacagttggtcagggttttcaaatcctttattctttatccattttttttctcaataacacttgttccttagccctttcttcctagctaacagtctctgtaactgtttaaaaaaaaaattaaaaaaaagaatggctggcctcagtaggtcattcctgtaatcctagaactttgggaggcagaggcaggtggatcccctgaggttgggagttcgagactcccaggccaacaaggcaaaaccccacctctactaaaaatacaaaaattaactgagcatggtggcacactcctataatcccagctacttgggagtctgaggcaggagaatggcttgaacccgggaggcataggttgcagtgagccaagctgatgccactgcactctagcctaggggacagagttagactccatctcaaaaaaaaaaaaaagtgtagatgtttggttaccccttcaaatcatctagctagtaggttggactttgtgtttattccaattttccccgtttagcaacattgcccccaccatcaccaccaaaaggggaaaaaaagacagtgggttaatcatccctgttagaaagaatttctctccaatgcctgaggcaagtttgcatgccatggatggaaatggtattttcaagagacagactgagccggtcctgcctaggaaacctgctgccttggcacggtggtattagtggctgagggctgtatgtttattccctggccctctgctgatccctggaagcaaagtgagtgtccacaggctttctctgtagtgacattgacttccttctgcccttgtgtttccaaggtgagctttgttaggtgccaggctgcagggtccttctgcagcattctgaagaaatcctctgccttcctctggttgggcagaatgcccagtagaatcaggaacagtgagctcatctccacctgatactttgtcttcgatggaacgctttgctttatcattaaaaaaaaattataatgcctcacttagggctgcaaacagtgttgatgtattcaatagcgcattagagaaaacgtcgaagcagatttgtagaaggtgcccatcctatgggcaaccccaaaaagcaatttattacccccccccaaaatatacattgtcatgtggagcggaaggattaaatatttatgtctgttggctggggtaataaaattgtattcaattgtgtctcaggcactacctaatgattgttgaaaactcggtaataacaccgaaactcataaaaaatacaggataaacaatgctggaagaaaattatgggaaaatagcctctggcctgtggaaatgcgactttattttgaaataatttgaaataagagtgtatgcattaaaaaaaagtgagtttatataaccgcaatctaatctctagaaacttttctttatggttttgttctttgtcaagttaaaaacaaggggtacatcagtagtgtttccagtaaatcctgataggtttggatttccttgaggacaggaacagcgttttcttcatctctgaactcttgggacttaaaaagagcctagttcagagcagactgggtgctccataaatatttgcagaactattttttttttttttttgagacagagtcttgctctgttgctgaggctggagtacagtggtgaaatttcagctcactgcaacctctacctcctgggttcaagcaattctcctgcctcagcctcctgagtagctgagattacaggcacctgccaccccacctggttaattttttgtatttttagtagagatggggtttcaccatgttggccaggctggtcttgaactcctgaccttaagtgatcagcccacctcagcttcccaaagtgctaggattacaggcatgagccaccgcacccagcttgcagaactaaatttaaaacataataattgtttatgatctccatgtcatctccgtattccaaggattctcaaccagagtgatttttgttccccagtaggcatttcacaatatctgtagacatttctgtgttttacaacttggcaggggagtatgtcctcctggcatctgtagggcaggggccagggatgttgttaaatatcctacagtgcgcaggatggcccccgaagcaaagcgtttgtagtgctgacagtgagagtcatctttaccgatgtgcctccttcagtattcccagtgcccagagcttcactcagagaaacagtgtatcgagctgtccttgagagaatggcggtatccatgtattggttttctagggcttctttaagaaagaactaaagacttggtggtttcaataacaggaattgatcgtcttgtgttctgaaggctagaagtgtgagatcaagatgccagcaggggtggttccttctgaaaactgggagagagaatcggtcctatgcctctctcttagcttctgtttttgtttgtatgtttgtttgtttctgtttttgatggagtctcactctggttgcccaggctggattgcagtggcacgatcttggctcactgcagcctctgcctcctgggttcaagcaattctcctggctcagcctcctgagtagctgggattacaggcatgcaccaccatgcttggcttatttttttgcattttttagtagagatagggtttcaccattttggccaggctggtctcaaactcctgacctcaggtgaaccacccgcctcggcctcccaaagtgctgggattacaggcatgagcccccatgcccggccagcttctgtggttggctggcagtcatgggtgctccttgcttgtagatatgtcacctgaatctccacctgcatgtttacatagagttctccccgtgagcatggatgtctctgtgtctctattttcccttttagtgaggacatggtcatattggattagggcctatccaaatcatctttacttgatcttctgcagagaccccatttccaataaggtcacattcacagctactgggggttaggacatccacatgttttggagggaaacaattcagctcctaacaatctacttctctgcatccctacatccgtgcagttcagattattacctctgctcagcattgtgttgcctgagatctggcatttcatcttctctcctccagcctttcgggtgtcctctcctgcggctctgggcaggcctgcacccccagcctctgaccatggcttgggcctgtcttgttcatccaagttactctgcctttgcacccttctaaccccgatgtgtgtctgtctgcctgccttctctttcctcccaggaacctttgacttttccactgatacctctggcctctggtgtgacctcttctagactttctccccagcatgcccaatcctctaggaaggtatttccgggttatagctgacaactcacttatcaggttcacctcccaaactacttttcagagtgccaagcatgtcttatccatgtgcctggcacagtgctgaacccccgtgatttaggtggaaatggttaatgaatcctatcctatttcttccagaatatggccctctaattatccatgcagggtccagttgggatgacgagggcaggctccagggtcagaatgccttgtcctcaatccttgttcacctcattgactcactgtgcaatctgggaccaagtgcttactgtctctctgcccagttacctcattgataaatggaggtgaggttgtgccagcctcacaaggctattgtggggactaaattagtttatataataattttgaacaatgctaggcacatcctaagcattcatgactgcagctgctaggataatttggcataatctgtgcttccccccaacacgctctctctgggggctccgttcttctgcttctgaacatgcttagacttccatttctgtaggaggttcttattgttgctataactaaatgatcaccaatttaggtgtaatttaaaacaacacaaatgtattttcttgcagttctggaggtcagaagtccaaaatgggtcttgctggagtaaaatcaaacgtcaacagtgttgcatttcttctggaggttctttgggagaatgtagtttcctccctttgccggtttctagaggccacccagattacatggctcatggcccttttcatcttcaaagccagcattgtggccttcagactccagccctggcttccagcatcacatacctccttctctggtcttcctcttgtaaggaactttgtgattactttgggtccacctggataatcctggcaactcttccatttcaagatcctttattacatctgccaaggttcttttgccaggcaaggtgacgtattcacacctttcagagattacgatgcaggcatctttggcatgagacaagattctgtctatcacactctctaaaggcgttccacctgtgtgatggctttatctccagcaaacatgcattcatattcaggctcagctacctagaagcgagggacatgtaatctccccaagcctgttctctcttttacaaaatcagacaaagaaattatcaagtgaggatagagaagtcggaatcctatgtgcctaacacgtggtacatgcatgctaagtcgtggcagtcacaatgactgttgttggtttcactttttttggtgttattttctcccgagtgtggttcttcccttattacctgcagccatcggtcttctgttgatctaaagcaaggtgtgcagttgggggtgtctgctcggaccaccctcgtgtgactgaatttgcctgcatatcggttcctttgctaattctgttcgggcaggatttgcttttttttgcttagcaaacttcatgagccatttctgatttccaatattgctcctcaggcagatctctcttgaaaggtgttgtttgtttggtttgtttacctcttgttcattactcttacctctacaggctacaagtctcctaggaagggatattgtgcctgtacgtcccaccctggaccacggaaaaccttggtagcgtgcaaagagattgggcattctagcggggctttgatggaactctaggaagtagaaaaagcagactcaagcagaaaatgggaaaagagaaatcctaagaggagtctcatgagatgattacttcacatttgcagttcaggcattttctccatacttccagaatcgtgtagggagttgggcacagagaatctttttaggggcaaagaaagtgagtgtcttttccactccccgtctccacacccatcttcctatttcccttccacacacacaaagaggagagctttaactttatctcaggaattctgtccccaggttcaatgctggagtaaaatcaaggacttggctctgtgcctgagtgggtgattccccacttgtgttaatcactcaaacaacctacatgcttttccttgtagttctggaggtcagaagtccaaaacggcccctattggggtaaaatcaaagcctcagcagggctgcatttcttccggaggttttatgggagaaggcagtttcccatctttgtcagtttctagaggccacctggattacgaggctcgtggcccttctcagcttcaaagccagcagtgtgactctaaagcaacatcatttcctaaagtagcggagaggaggcctgggaagattacacagcaaaaccatcagatcctacgtctgagaatgagaaggttgtttccttttcagttgactggtatatctaagcttatatccagaagaatgcctccatttcatgctggtctttatacctttgccttccttgctaatctctgttagtaaagaggaaggagggtcaggtgcagaggctcacacctgtaatcccagcactttgggaggccgagacaggcggatcacttgaggtcaggagtttgagataagcctggtcaacgtggtgaaaccccgtctctaccaaaaatacaaaaattagccgagcgtggtggcaggcacctgtaatcccagctactcgggaggctgaggcaggacaatcgctggaacctgggaagtggaagttggagtgagccgataatcgcaccattgcactccaacctgggcaacaagagtaaaattgtgtctcaaaaaaaaaaaaaaaagcaaactgaagacttgaaccttgggtagtgcgttagtttcccaggactgctataacaaagttccacaaactaggaggcttcggcaacagaaatgttttgccttacacttgtggaggccagaagtccaagatcaaggtgtcaggagggttggtttcttctaagggctgggaggaggaatctgttccatgcccctccctgtggttgctggcaacgcatggtgctgcttgggttttaactctgtcagtgtgatctctgccttcacctgcatgtgttctccccataagcatgtctgtctccctgtccaaatttcccctttttatgatgacatcagtcatattgaactatgacccataatgacttaattttgttacctctgtaaagaccctgcttccaaatcacgtctcacagatcctaaggggttgggcttcaacatcttttggtgggaacaaagttcaatccatagcagacaggcaattctttttacctgctatttaataacacttttatttgtattgtgtttattttaccatgcatacctacagcaaataattttgtttccacttatagaagagatctattttttcttctttttcagtaaatgaatttactttttaaaaatctcagtaaagtgattttaagaaaagacgttaactatatcatagtacaggtggtcttcagatgtggccaaatatagaagacacagtgtaagatttgggcaatacttggttcaccaatcctttgaggcttgggagtagaaagaacaagaataaagatgttaagtagagtaagatgcattcttcaaagattcctttttgtggaccatttctttgagagagaagttttcttcctgtgaataaatatgctgttgctttttttagctctatcatttatacttactagtatttcagaactttacgtttgagttctattttcatgccataaagaatgaggtaaataatctgaaacttaaattcccacgtggagtaatttctctaatgtggagtttctcaaacttgagggtacgtcagaagcacctgctggcattgttaaaatgaaggttgctgtgctcagccccagattttctgactgaatagctctggggtggagctctgtaatttacacttctagcaagttcccaggtgatgtggatctcggagtggggacggtacattttgcgaaccacggggctactgaaatgaggtgtctgttctctgtgagtaaagatttttcaggatcctttccagccctgcggctcagatagatcagattgaagtattctgggtgggctaagataactaaactaaagaccttctgagatttaggtttaaattcttttctctttgtttcttttactttttctttcttgctttcttgctttcttttcttgtgtgtgtgtgttattactattttttttttttgcaaggtctcactgtgtcatccaggctggagtacagtggcatgatcatagctcactgtagcgccccaacctcctgggctcaagcaagcctactacctcagcctactgagtagctgggactataggcacatgccaccacacgtgcccgcctaatttttttttttaagacagactttgtcccactgtgttgcccaggctagactcaaactcctgagctcaagtgatcctcttgccttgacctcccaaagtgctgggattacaggcatgagccaccaagcccagcctagagctccttgtttttggtcctcaggggatcttgggcaatatctcacctcatctggctgttacccaacactgtgctttatattctacttcctatttctgctgggtgaggatgggcttctgatgggtggaaaagaacttggaaagggccccaggcaggaaaaccattatggaagcaacgtctgtccacccaccaggccgctgggaggctgaagaagacacgtttttttgttttgttttgtttttttgtttttcctgtgggttacttgaaaaacatttttttaaatgcaaaaacagggtatcggaaattattatctgtccacctatttaactgttataaagtagcacttttaattcatttccataattacagcctgtgtcatgctgttcaaaagattcaactggggataaggagaatggtcccattttaacccccttatgagcgtgttagctcaggccaagagcagctgctgtctcttccggcaagccacggcattgtttgagaacatctttcctctcatatcccccaccagaccctgagcatgttgccatcggccttcttcacacccccacaaccctcggccccatcatctgcagtgcccgatgcccagcactgagcccagtgcctggtgttcagggtgtcttttgaaggagaagttataagtcggtagcatccccaagcttttcccagagcaactcaagccctgaggccaccagattgtttgggcagcaagttggtctcctagaagcccttggtagacctggctccttgcctagctgggccaggctctgtcctcccctgcgtaccctcctagccaagcgtctgggcagccagcggttaagtccactgtgggaagctattgagtctgaaacacacagtgacagcaggcatgctaaactacttcccagccctgcatgtggcgtaattgtattttcagggagggccaatctattagcaaggtgccagtctcaactgtgtaacttttataaagcaaacactaaaggcctcttggggtgaaggatattataattatggatgatttatactccccacctcatgtatacattgcacttgatgagaatgttctacttgacgtagccagaaacattaagcaaaaaatagtgttgcattctgggttagaaacccatcttttgttttatgtctaatctatccagtgctaaaacatttggaatgatacctctgcatgctgctgtgaaggaaatacgaacataatgagtgcatttctgatttcagaccagatcatcatttccttctaaaatacctcactgagtttagcatatttattccttggtggaatgtttgctgtgtattgcagtacgaaagcaaaagaaaataatcattataattataatttccgggctaggagggaccttagtgatatatctagtccggggtgtctgggcttaaattacagggtcggctgataagtattctacttttcatgattcagaatctacaagttaaaagaggaagagagaagagaaaagacagtagtaaaggaggtacttttgcattaataagaacacagacctaggtgtctcacctccacctcctacctgagccacctttgataagtgagaatctctctggacatcagttttcagctccagaagaaaacaaaaataaaaaaaaaaacccaaaacagggatcaaggccaggagcagtggctcacgcctctaatcgcagcactttgggaggctgaggcaggaggattgcttgaggccacgagttcaagatcagcctggccaacatagcaagatcccatctgtaccaataagctgaaaattaacctggcatggtggtgtgcacctgtagtcccagctactttgaaggctgaagcaaggaggcagaaacaacaagatcgctgaagcccaggagttcaaggctgcactgagccaagatcgcaacattgtgttccaagctgggcaacagagcaagaccctctcaaaaacaaaacacagatggataggtttgagacagccctcactcacataacttttagagaagtaaatcggatagtgcctgcgtactattattattacagcactattgccaggcagcaagcaggcccagggtggtgtaagtcggctttgctcatccgtagatgaaggatgcagaacattcctcagttgactaatgtgtgaactgcacactgagaactggcctgcggtcctccagctaatcagtggcggagccatgctctccagactcggggtcaaggcactggggctgagctgctgctttccccaggctcccggagacccactcccttgttctcctagcagctggatgaagcctgtggtcctcagcatttctactaattccctccaagaagggcctgggattgtttccattctctgtgttgcggactagggagctaactgcggttcctttctgcagggaggaagcttgctctacagattagaaaggaaacacgcagcttcccaagcatgtcacttctgaactgtttaataaatccacgtagcccgttttcttatttccttgataacttttcaaaaattattccttaaacaaatgacttcctactatagcctaaatctaaaatctaaacaataactattttttctaagtcctcacccccacaccccccttttttttttttttttttgacacagtgtcttgctctgtcacccaggctggagtgcagtgccatgatctcaggtcactgcaacctctgcctctcgggttcaagtgatcctcctgcctcagccttcagagtagctgtgagtacaggtgcgcaccaccatgcctgactaaatttttctactttttgtagagacagggttttgccatgttgcccatgctgccctcaagcacctgtactcaggtgatctgcctgccctggcctcgcaaagtcctgtaattagaggtgtgagccgctatgcccagccttcattcctttttatagttgaataattctcctgaagtggacatgttccgtgaaagggccgtatttgcaaagtggtccccaaatgctgaagttgctgagaaaccaaagtacaaggcagaaaaatccagtttgacattaaaagctgttttactgggaaaacttaaagacagctgtcttgactggcaggaagacagagctccacactgctactccccagacccagggcttatataccttagggaaagggcataagcgctgtgtacaagacaactgaaggcaaccctccaggagaggcaagaatgatcaaagttgacacgttgttatgctaaggactggaaataaagtaggaatcaggaggcattcacggagctgggactgatcagaagtcaatatggcagattagcatccaagatggagtcactgttgtttccacaggataccatagtttgttcatccgttgatggacagttgggttgtttttacctttttgctattatggctaatgctgctttggacctctgtgcatggggtttggatgtaggttttcatttctcttgaatatatccctaggtgtggaattgctgggtaatgtggtctaatacacctttggttaacgaaataaatagcattttagttgtttttttttttttaattgtcattctacgaccatctccaggaccattagtggcacagataccacagtttaagaaatcccataaatcatcgtgacctacacacttgtaaggccttccatcttgcaacgctattggccgttctggcttgtgtttttctggatggtcatcacgaccttcccaggtcgtccttttacctctcattggccgcagttatgcccattcctacttaaaaactcttgcataagctcggattacttccagcttttttctaccacccacttaaacttttcccatctttgaaggctgagttcaaacttcgaagtttgaatttgtaccttgatcttgtttttttatttgtttgtttttgtttttttgtgtgtataagatggagtctctctctgttgcccaggctagagtgcagtgacataatctcggctcactgcaacctccaccttccaggttcaagcggttttcctgcctcagcctcccaagtaggtaggattacacatgcatgccatcacatcaggctaattttgtatttttagtagagatgggtttcaccatgttgttggacaggctagtcctgaactcatgatctgaggttatccacctgccttggcctcccagagtgctggggttacaggtgtgagccactgtacccagcctgcaaatgattttgtccacagagcagactgagtttctgttcttaatttgtatttaaaatagaaaatctcagtggccaccttggtccccgctctcactgcaaagagtctgtcccagctactgttagggactcatttgtaaccaaacactgaacagaggatgtcacagttagtgactaatcccatctggtgaaatcagtatatgggattgcacatgaaatgaagagtttctgaacttgagtgtagctctatatcttataaagaaatctacaagtgcttttgtccttgatgtgtttcatttggggaatacatccatttctgtctccgccttctttaaacctgaaaggaagagagttggtagaaacactctgtccaaaggaagatcaatgctaacaatgttcatttttctaagtgtctccttcttctgaaataaaagttaggaagctctgacaccggctcccttcctgccttctacaccgaagtgggagttaagatgttccagataccatttgctgttttgaaggagggtctgtgtgctgtgtgatgagtagactcttcccctttgcttcgatgggaacctcggcattccaagtggacatatttcatatcctcagggcttgttctcctcctctgtggatctcagtagcagaccttcagctgcctcttagagaacagggccctgggggagacatcatcctttgtcagaaatcctggaaaaataccaagaaactgacacaagtcgaaagagggacaatggagacctgggtattatccctttagggtgttcttactcaacctaagtctcagggtagcctacaggagagccacttacgaatttgttaaaaatgtacatttgtggccaggtacattagctcacgcctgtaatcccagcactttgggaggtcgaggcgggtggatcgcttgaggtcaggagttcgagaccagcctggacaacatggtgaaacccctgtctctactaaaaatgcagaaattagctgggtatgctagcctgtagtcccagctactagagaagctgaggcaggagaatcacttgaacctgggaggtggaggttgcagtgagctgagattgtaccattgcaatccagcctgggtgacagagcaagactccatctcaaaaaaaaaaaaaaaggaaacacacatttggggactccaccccaggcctaccgaatcagaccactgggcttggtgccattgtttatgaatttttaacaagctacccgggtgattctggggcccactaatatttttgaactgtagctataggaagacttcatacatgcagagtaaaaccatcttaaatccaatcaaattaattgttaattaaattaatgtctgcctgggccctaattcataactttcatgttgcaattccctcctgatatccagaggcatcatttaaagaataagtaaccagggacataaaaatgaattatttatcttacccaaatctcatacccttctcagtgaaaatgtggttgcttgtcactgagtgtcctacccaatgggcatatctctggtcgtttcagagaaagaaatcattctctgccttccgaatgcagacaacatgaagcggcagtctcacgttgatattatggttaattaatcttgggcataggagtatgcaggagcattgagcagaagcgcactcgttaataaacaagtattttcagtgcaacacattgcaggcttggcccttacctgatgtaacagatggaggagaaagtgggggtggggaggaaagtggctgtgatctagttacgcagggtcctatttcaaacaccatttctccatttaataacaacagctaatgatttttgtttgtttgtttttgaggcagagtgttgctcattcatccaggctggagtgcacaggtaggatctcagctcactgcaacctccgttcttgggtttaagccattctcctgtctcagcctactgagtagctgggattacaggcacctgccatcgtgcctggctagttttttgtattgtttttttggagatggggtttcaccatgttggccaggctggtcttgaactcctgacctcaggtgatccgcccgcctcagcttcccaaagtgctgggctgggattacaggtgtgagccatggcgcctggcccaagaggtaatgtttcttgaccaattcctatttatcctgtttacatgtattaatttctccaaattaattcctcacaacagcccagcagtttaggttctcttattagctccattttatagaccaaaaaataaaataaagctcccccaaactggaacatagagggtttttttttttaagtaaacttctcagcatcacacactaataaagagtagacctgggatttgaaccatgaaatcccaagagagatccagaacctactctcttagacatttctccacttcctatggcttgaaatttgttttaaaggaaaccctggtatcttcgaacaagtatctggaaattccgtcctttttgttgatggagagataaaaatccagattgaatccagatccataagacattgtcatcagcactgatatattgtatgttatagataaggagaaaaatttccaggaggctgagtgacctggctaagatcattctttttttttttttttttcattattattatttcaatagttctgggagaacaagtggtttttgttaaatggttaagttgctgagtggtgatttctgagattttggtgcacccatcacctgagcagtgtacactgtacccagtgtgtcatcttttatcctttaccccctcccacttttcccctctgagtccccaaagtccattacatcattcttgcccctttgcatcctcaaagcttagctctcccttataagacggaaaatatgatatttgtttttccgttcctgagttacttcacttagaataatggcatccaactccatccaagttgctgcataggccattattttgttccattttatggctgagtcatattctatggtgtaggtgtattttctttatccactcattggttgatgggcattgagtttggttccttatttttgcaattgcaaattgtgctgctataaacatgggtatgcacatgtgtttttttatatgacttctttcctttggtagatatccagtagtgggattgctggatcaaacggtagttctgctcttaatgaagttcactcctgatattgtcatgatacaatctctctcttctgcatgaaaccagagtcctttctactgtttctcttgcttcctcagcttataaatggcttgtttaagttgatacgaaaaagttagatgtgtcctagacattaagggagcaccgagtccacagaggctcttgtaattgccaagggctaccataacaaatgaccagctagtggcaggcttgaaacaacagaaatttattccattactgtttggggaattagaagtctgaaatcaagatgtggagatattagctccttctggaagctttgagggagaatacatttcatacctcttccctagtttcttttggttccaagcaatcattggcaccccttggcttgtggctgcatcactccagtctttacttcatctgcagtgggctttccctctgtctctgtgtgtgtcttctcctcctcttaggagaacatccaccctgaatccaggatgattccatcttgagatccttaacttagttacaccacctgcaaaagctttatttccaaatagggtcacattcactgatatcagggattaggacttggacataggtttttgcaggacactatctggctagtctgtaatgactatcagagaatggattctatagttactggataagtttgcccttgtttgactggaacacagtatctcaagtggttgtggtgaagcccacagactatggggctcagcaggtgttggtttgagctcctgcaccattcgttagctttgtgaccattgataagtttcctaaactcccccaggctgccatctcttcatttaggaaatggtgatattcatcttaactaaatgcatgagttttctattctgtgttacaaattacccacacacatttagcaatttaaaacagcacacatttgttttctcacaatgtctatgggttaaaattttgatacaatttagctgtgtcctttgttcatgctctcacatgactccagtgaacctgtcaggtgggttgtgttcacatttggaggctcaaatggggatggatatgcttcgaagatcacccaggttgttggcacaatttatttcctgtgaccgtaagtctgagattggtggattcttgctgactgttggccataaaccatgtttaccttccagaggctgcattcagctttctgaggtcacccatagttccttcctacatggcctttgccataggtcctctcataacatggcagcttgcttcttcaagcagtggagaaagaataatttatgtatatacataaattactgtatatatatatatatatatatttttttttttcttagggttgctttcaatcaatagacagtatggcaggcagaggtgatggaaagttataccgtgataatgttcatatatatgagcatatgtatgtgtgtgtgtatatatatgaagatgtatgttgtatatgcacacacacatgaacataatcaccatgtaactttccatcacttctgctgcattctgttggttggaagcaagtcccaggtctacccataatgaagaggaggagattatgcaagggtgagaacacaggaagtcagggatcattggcagtcaccttagcttctgcacaccactgaaatattgtatgaattagaatatacacagaactagcacaatgcctaacaccttgtggctatttaatgtatataactgctgttaccaactggcagctggtattactattcaggttaatcactgcccagattttagcatctacaactttcttcacacaggctgttccctgtgcaacttcaggagcaccttacacacaggggaggatgtgaaatggatcctggggggtaggtgcaattcagtggttcttgctacaatggagaggtctgaggcattggcatcgatctcagaaagacctgagcatcctacattgatataaactgtaacttattcagatattggaaagcactggttttcagttccgagtgtccggtggtaatggcaagtttcgcatgctgcagccccttgcaagcccactaaagaacatctgccacccggcacagcagtggctgctggtttttgctctctgcagtgagcacttccaggctgtcttgcctcttcctgaatttgtgggtggttgctaatcttttagctcattttctttgctgtgtttttccacatttaaaatcttttattttcctgcgtctgtgttttcatttccaggagacagttggcttttttcgtgtgtgtggaataaatgaacatgtgattcttttacttgctgactgttgaatgtgaaatgtgcagccacctgtaagccaggtgagggtggagtaaacttaggccatgttttgggcctcactgcatccaccactccaaaaactggaaagccttctgagattttaaacattttccagtaatttccttattgtatggtgactgtgagtaataaatcaggaggtcagcgttcatcacaggtgggattgtgtgatgatggtgtcacagagcacatcatagtgagcatttccatttctaggtgtaccttgggaagtcttaaacaagggggtctatatgtctgtatttccttttggccatttttgataatgaccaaccagaacatatccaaatcagatgatgtaaggtgcctttaatacacaaactacttataaatctataggcagtgtataagcaaaccatagacagtgcagtaccgtcggctgtttatacaagagctgttattacccctaagcccagaaggcaatgagagaaagtgatttgtagaattccaaaggagataggaaagcagctggtccagtgtgagtctgagaataaataccctggtccctgctcctggtcttcagttgcctgcctgagctctccatcagcccagccccacaggctgctagatgtggtatcctggccaggtgtggtggctcatgcctataatcccagaactttgggatgccaaggcgggaggatcatgtgaggtcaggagttcaagaccagcctggccaacatggtgaaaccccatctctactaacaatacacaaattagcaggcatggtggggaacacttgtaattccagctacttggaaggctgaggaaggagagttgctggaaaccgggaggtggaggaggcagtgagccaatatcacaacactgcactccagcctggatgatggagaaagactccatctcaaaaataaataaataaaaagatgtggtattctgttaatcatggctgaccattttccagggcagagagcagggtggaatgggatggagagtgaatcagcaggggagcatggaagatgcatcagatatacccacacaccctttactctttaccccttgactgccattttctagcctttaaagcagtagaaggccagcaaagtggtcaggaacacagatatcaaagcttaattaatagttagtctattttggagtccaataaaggatttgccaccttctagccatgaaacttcaggcaagtgactgaacctctttgagtgtattagtccatgctgcattgctataaagaaatacctgaaggtcagttgtggtggctgacacctgtaatcccagcactttggaggctgagtcaggcagatcacctgaagttaggagtttgagaccatcctggccaacatggtgaaaccctgtctctactaaaaatacaaacattagtcaggtatggtggtacgtacctgtagtcccagcttctcgggagactgaggcatgagagtcgcttgaacccggaggtggaggttgcagtgagctgagattgtaccactgcactccagcctgggtgacaggaagactctgtctcaaaaataataataataataataataatagcaataatgccacctgaaactgggtaatttataaagaaaagaggtttatttgactcacagttctgctggctgtgcagttatggctccagcatctgctctgcttctggtgaggcctcagggaggttccactcatcatgggaggcatgttgggcagggaagaggaacacgcaagagagaggggaggaggtgccagcctcctttaaacaaccagatctcgtgtgaactaacagagtgagtgctcactcatcactaaggggatggcaggcaccaagccattcttgaggaagccacccccataactcaaatatttccctccaggcccacctccaacattggggatcacatttcaacatgagatttagagaggacacatatccaaactgtatcaccgagcctccatttcttcacctgcaaaataatgaggtgcaagtacctacctcttgtccttactgtgataaaatatttctacctttattcttttttttttaattttattattattatactttaagttttagggtacatgtgcacaacgtgcaggtttgttacatatttatacatgtgccatgttggtgtgctgcacccattaacttgtcatttagcattaggtatatctcctaatgctatccctcccccctccccctccccctaccccacaacagtccctggtgtgtgatgttccccttcctgtgtccatgtgttctcattgttcaattcctacctatgagtgagaacatgcggtgtttggttttttgcccttgcgatagtttgctgagaatgatggtttccagtttcatccatgtccgtacaaaggacatgaactcatcattttttatggctgcataatattccatggtgtatatgtgccacattttcttaatccagtctatcgttgttggacatctaggttgttggttttttttttttttttttttttttttttttttttttttttttgagatggagttttgctctcttgcctagactggagtgcagtggtatgatctcagctcactgaagcctctgcctcccgggctcaagcaattgtcgtacctcagtctcccaagtagctgggattacaggtgcaaatcaccatgcccatttaacttttgtagagatagggtttcgtcctgttggccaggctggtcttgaactcctgacctcaggcgatctacctgccttggtctccgaacgtgccgggattataggagtgagccactgcacccagcctatcctttttaatgcgactaatggactccacatttatttatttatttatttatttattgtcctatccaccctattccactgtgaatgtaaatttccgggggggcagggattttgatctattttattcactgacatagctctagcattaagactagttggtggcatagaggaggcaatccataaatatttgggggcatcagtaaataagatagtggctacaaagggcttagggtagggcctggaatgcgttaacagcttgatatttgagcaagtatttggtagtaaatacatcaaagttgattttaaacacccaaacacagacaagcaaagaacgggaaatcccccaggtagggatgatatttagaaataggaataaaataagcctggcgaaattacctttggtgagttccttgcaaggttatgtgatttaaaaaaaaaatctgtaattacatttctctatgtaattttgttttatcatctatttatttatttacttttgcaattaatttattttagtaacctaaactcatcgttaagtctgtagtcctggaaaccatgtcaaccgtcagatctctgtctatgctcaaaaacctcaacttgctggctgggcttggtggctcgtgttagtcccagcactttgggaggccgaggtgggttgatcacttgaggtcaggagttcaagaccagcctggccaacatgatgaaaccctgtctctactaaaaatacaaaaaactagctgggcatggtggtgtgcatctgtaatctcagctaatccagaggctgaggcaggagactcccttgaacctgggagggggaggttgcagtgagctgagatcacaccactgcgctacagcctgggcaacagagcaagactccatctcaaagaaaaaacaaaaacaaaaacccttatttggcagtgactgggtacacagagttgtgcaacaggagacccgcctgcagaaagtacccactgggatcctcaccacacagcaggcctcagaatttcccctgcctcctgatcggtgttcagatgtagatagtaggttcagtgggttgattaagttaatgacatttgtagcggtgttataggctgcaggccagggagaggctttctggaaaattgcagggagaaatcctgcaggctctgcctttgaaagataatgctagttgcatgctggggctgtctcctccctttgtcttgaaggtgtagaagacacagctttgcgggctgagtaaacatatgtgcatggttaaggtaaaaatgctacttagctcttcttcccgttaattcgttcaagaactggtgaaagagagcacacttcttggagactgaacttttaaatgcttctgctgggtctcttgagttcttaaaattatcgttttgatctttctgtcccgtgcagatacaaaatacataaacatccacgtgactctttttatttttcacttagaacctgcgcattgtcctagcaggtactccctcagggcctgggttttgttgtcactgctggaatgcagttgctcctccttgccttactcaggcctctgccagcttctcagacagctttgtcaagcaattgctactcaaccagcgattactattaacccttcgttacctaaatccacccaccatttttcttttcctataccgatgggcctcaagcttgagtttgcattagcttcccccagagggtttgatcccctagagacttagagggtccccaccctcagaagttctgaattgttaggtctgggtggggctcagggatttcattttttaacgaaaccctaggtcctgctgaagctgccagttcccatctctactaaaaatagagaaatttgccaggtgtggtgacacacacctgtagtatcagctacttgggaggttgaggcacgagaatcgctggaacccgggaggcagaggttgcagtgagctgagatcgcaccgctccactccagcctgggcaacagagtgagacgctttctcacaaaaaaaaaaaaaaaaaaaaaaaaatccgaacgtctcgtgttaacaggctgatcattattttcaaaaatgtttcctctctttctttccacatggaagctccatgtgagcagatatttctttgttttgttttgttttgtttttcgtttttgcatcattcactgctgtgtcctgtgtgcctggaaaagtacctgacatttagcaggggcttaatagacatctgctgcatgttgaataatagtgaggatgtcagcatcacctgctgccctttgggggagcagattttagggcactgtagcaaggctgattataagtcagtgccctatgtaaggcctggaacctaaaatctccaatcattgtttttgttctgttgaattaagccaccaccctaaagagccagaagcctaacactgaaggaaatagaaaatgtggatctcacaacacatcatttcaagtgtgtacatatactaatagcatacgctaaacatcatctaaacactaaatataatgatataatggcattggtcataatcttgaaggtagttgcatctccgtaaagtttcccattgagctgctgttccgctgctgctggcttccacccccagcacccacccctctagatttataatttccccaacttgggttgaagccccagatgactgggagctgcttctttactttggttcccttcagtcccttcggcagatggcacaattcttagtgtgtgtgattggggttttcagcattggctgtgcattggcattgcatggggagtgttagaaaagattgatgtctgggtactgcccccgaagattctgatttaattggtctgaggatccctgggcatccagatttttaaaagcttacagccaaggttgtgaaccatcagatcagggacaaaggcgatctggaggaagacggggcggggaaagaaaagaggaaaagagaatcctgatttctggagccaacaaagggccctgtgggagcagaggttgttgtaggataatgaaggggtgagctggcagccaagagctcaggacatgcttgaggaaagaacgttcaactcagaaataagactgctttcatgcgttaattatgcacctcttgtcttctctaatcgttttatccagggtaaccttgttggcccaaggaaattataaattccttgggatcagcaatgtgtcttacagttaccctgtagctcccaaggtctctagcagccttgcattcatgtgggattcttcaaaagtagccctcaaattactgaagaactgtgaggtcagagtggtaagtaaaagattaaaatgtctgccaatcaatcacggttgcatatgtgtgtgtttcatcatttcacattgtttgatttctttccgctatgaaaagacatatgcacacagaaaaagaacagtaacacacacaaaaaaatcagccagttaaaaccaccaccaccaccatcatcaccacagaaacttagaaatggagcccagtagagcatcagttgtcagatatgggggcttcaagtccccaaagcagatgtcatctcatgtcattgggaagtaaagatgttcacggtgcaagcgtcattcacagacacgcatgcttgagttccaagggagcagatgtgagccagttaggaagacgccaggaaaacaccatgcttgccccactccccagtctagtgtttaattcacaggcccacattgcaactcttcaatactttattaaacacatctcttctcctggataccctactaccttcagagcaaacacattctactctttgaaggcaagtgtgttcttaactgcttggatcctaccctttatgacagagaagaagaagatattgctaagggttggattagaggtaggaaactggggaagctctggtaaatggaagaggggtttaccttgttttttcattcataatgtgaatataggcaaggttagaatcccggtgcacgtcaccattgtcaaaatgacatccacaagcagtattgatgcctccaccaggtaaacagcagttccctggtatatatcagaagcgtgcttttctgtattctaagcagtttttgacacagtgctttgctttattgcaagccacaatattttcagaaggcttaaaaatccagttatgactgtagctgtgagggaagaggtctgcatggggccggggaaatttaatttttagcttaaaaaaagtcccaccaaattcaatttttctcacctttagggattctcagagttatatccagcttgcataactagtgtgttagagaatgtgttactacggggttattttttttaacacatttattatttatgaaatgcagaggaaaatagaaatgatcgtttcagggaatatcctgtagctttttttattgtattcaaagaagttgctcatgctgttttaattcaaatattaaaagttaaatctcttttcatcctgacctacatttaaaaaacactgctttagcccttatggaggacagaaaatgtgtggaaggaaaacatccactatgcattccttaccccatagttcgtcaggaatcagaatgactggcaaacctgtccaggaagtaataggaaaaacagagcgagatctctctcttctctccacatccttgcttatcccctctctcccatagcaaaccagccctgctggttatgctggtttactcggcctgctcttgaatgttgagaagctccatgtgagcccctcaatctgtgctagggaaataaagagaagagagatattatcccatctttgataagggattaatattgagaatatattgagaactcctaaaactcaacaacagaaaagcaaacaagctgactcaaaaccgagcagaggatttgaatagacgtgtctccaaaagatatatacaaatggccaatatgcacataagaagatacctaacatcactaatctctagagaaatgcaaatcaaagtcacaatgagataccacctcacacccatcaggatggctatttttgttattgttgttattgttgagaaacagtctcactctgtcacccaggctggagcgcagtggtgtgatctcggctcactacaacctctgccttctgggttcaggtgattctcctgcctcagcctcccaagcagttgggattacaggtaccccccaccatgcctggctaattttggtacttttagtagagatggagttttaccatgttggccaggctggtcttgagctcctcaccttaggtgatccgcctgccttggcctcccaagttgctgggattacaggtgttagcccctgtgcctggcctaattccccgtttttaaaatgggtttaacatctttttatatgtttattggccacttgatcctccctcagagagctatacagttttctcactttattcagtctatgagcaaatgtcatcttgtaagagaatgttctggatcaatcttaactgtaatagcatgttcctatccaatacccctgccccctcaccatagccgagtcttctgtgtatttgtatgtatattcatatatatatatatagtatcccacccccctacacacatacatatgtacttatttcctatcttctcctttctggattgtaaattttttggatgtagaaatcaggttttgttggtttgtttttcattgctgtatgcctaacatttagaatagcagatattgaataaatacttattgatttatattataaaggttgtagttttaagaaaaattcagaacacattgacctttctttactagtaatgcgctgtgtagatatggcataatatttttaacctcttctctctactgatgggaattaaggggttgtttgctctttggtgctaccaaaaaaaaaaaatctatctatctgtctgtctgtctgtctatctatctatctatctatctatctatctatctatctatctctacacacacacacacacacacacatacatacacatatatacatacatatatgtgtatgtttatgtgtgcatgaaccactaaaggcataataaacgtctgctgccttggaccagcatctctgcagggtataatcccagaagtagaacctactacatcaatgagaacactcattttaaggctggggacatcttgccaatttgttcacccaagggctttgtcaattcacactcttgccaccctacaatggacaacatatcccaccccacaaccaccacaatgctttgtctttgccagcttctatccctatttgagagatgagaaaactaatgaaaggctcacagactcaaagtcagacagtttctagttggtgggtctaaccctccctgttgcttgtgcagatctctttgttgtgatctgtttcctgtggtctgccacaaactgggtaatttataaagaaaaataagtttactcagttatgattttggaggtcggaaagtccaagagcatggcactggtatctgacgagggcgtggtataaggcatcacatggcaagagcgcatgtgagagggaggaggcgaggagtaagcaagagaaccagggggctgaagtcatccttttaatcaggaatcaactcccaagataactaacccactccagtgaaaactaactgacacctgcagtagctaacctcctgcaacaatccattcttgagggcagagccttcatgacctgatcatcttggtttttgttgttgttgttttttgttgctgtttttgttttttcagatggcatcccatctgtcacccagcctggagtgcagtggcatgatcttggctcactgcaacctccacctcctgtgcttgagtgatttccctgcctcggcctcccaagtagctgggattacaggcatgcaccaccacacctggctaattttttttgaattttcagtagagacggggtttcaccctgttggccaagctggtctcaaactcctgacctcaggtgatccacctgcctcaggctccctaagtgctgggattacatgcatgagccaccatgcccagcccagatcatctcctaaaggtctcacctcacaataccattacattggcagttacatttcaaccttggaggaaacattaaaaccatagcccttcttgatggattacatccttaggaggatctgcttccaagtgtctcacctatatggtaggtgagttagtgctggctgtaggtcgtaggcctcacttcctcatcccacgggcctgtccacaggctgcccaaacatctagccccaggcatctttcatggagagttgcaccagattctgaagtgctcaaacacatgtctctactttcactaatctctttctgttaaatttgtttttgagttgtgtgaaataaatacaatgtaaaatttaccattttaactttttattgcacagtttggaggcattaaatatagtcacactgttgtgtaaccatggccactgtacatctctagaacattattcatcttgtaaaactgaaactctatatccattaaacattaactcccattatgtcttcccccagcccctggcaactactattctcctttctgtctttatgaacttgactgctctagtatctcatgtaagtggaatcattcagtatttgtctttttgttactggtttatttcacttagcataatatccttaaggttcatctgtgtcatcacatttgacaagatttcttccctgtctaaggatgaattacattccattgtatgtgtaaaccacatttctcttatccctccattcatctgtagacgcttgggttccttccacacttgagttactgtgaatgatgctatgaacgggagtgtacaatacctttcagagtccctgctttcagttgtcttgggtgtatagctgcaagtgaaattgatgaatcatagagtaatttatttatttattttttagtaaccgacatactcttttccgtagcactgcatcattttgcatttccgtcagcagtgcacaagggttccaatctgtccacatcattgccaacacttatattcaattttcagaaataatggccatcctggccaggtgcagtggctcatgcctgtaatcccggctctttgggaagccaaggcaggcagatcacctgaggtcaggagttccagaccagcctgaccagcatggtgaaatctcttctctactaaaaatgcaaaaattatccaggtgtggtggcaagcacctgtcatcccagctactccggaggctgaagcagaagaattacttgaacctgggagggagaggttgcagtgagtcaagatcgtatgactgcacactccagcctgggggacagcacgagactgcgtctcattaaaacaaaaacaaattggaagaatttaaaagggagtggggaagaagtatggtcagaacattttccaaactagtgttcattttctatatccaaaattttcatgcagtgtttacctctctttatcttaagaaatcaataattgggatttcattattttgttttgtcaaaacaaagttattgaacaacaaaataccagtgtttgagtgattaaaaaacaacaacatggtattgaaaaatcaaagtacttatcactaaagttaatgctcatcctctcagcccaccagccaggggtcagggaggggacacgattgcacactgggctagagctgctgtccgagaggccttgagggtaggcgtacgacagcagcatttcagaggtagttggcaatgctcctctgccacccatagtgagacagggaacttcctgggcttctggtacagagttttcctaacagtatgtgcatacctagctgcagttcctggtctagggattcttgctatagaactacagagcggtaacttgagtcactgtgaaagcagctcttcagtctggactgaagttgctgcgcttgggattttctttttcatgatgttttcctttatttcttttatcaatacagaatacgtatttatgtaataaatatgtgagtatttttttacatgcagagaatatgtcatgatcagtatttgaaagggagacctgcctttacatgtttattgcagcactacttaaaatagccaagacatggaatcaacctaactgtccatcagtgggctaatggacaaagaacatgtggtatatgtatgcagtggagtactatttggacataaaaagaaggaattttttaaaaagataacaaagtcatgtcatttgcagcagcacagatggaactggaggtcattgtgttgtgaaattactcaagcacagaaagacaagtaccatattctcactcatatgtgggagttaaaaaatatgatctcgagatttttttctttaaaggaaaaagctgtgaggccctttgcttagtttggaggatctcagagggaaaggggccacgctttgtgtatcacttgaatggtcaatttaagccaggtgcggtggctcctgcaggtaatcccagcactttggaaggccgaggctggcagatgacttgagctcaggagtttgagactagcctaggcaacatggtgaaaccctgtctctaccaaaaatagaaaaaaattagcttggcctggtggcatttgcctgtggttccagcaagtcgggaggctgagataggaggactgcttgagcccaggaggcaggggttgttgcagtgagacaagatcgttccactgcactccagcctgcgtgacagtgagacccccatctcggaaaaaaaaaagaaaaagaaaaaacagcttatttaacctattcgagtgaccttgagctatatgcctatctggcctaattttcccatcatcgaagtgagataataatacatagctcagagtgtatggtcagaattaggggaggcagcagaagtaatgtgtttagtgtggttcctggcatgtagcagatgttcagagtggtagtttcagacgatctctccaagtctttgatagtttcccttcataaagtagagcctcatctccctccccatgaatagaatagaatgtagcagacacaataccatgtgacttccaacagtagatcataaaaaggaaatctttttctctctcttcttgtcaattttcttttgcaataatgaatgattactgttgtcttaagccattacatttcagggtaatttgtctcatggcaatagataactcacactttcagtagtatttgcagccaagatctgttatccttgaatattcaaaaatctgtgacctatccccattgtgcatgtacacacaagcacacgctcccctacatactttgctgacatcttattcttaaatgtaatgtgccttattcaaagggtgattaggaggtttgagaatcagtgtggcagctaagcgagacatcttccttgttttaatcagaagaatggaaagtgctttgtagaggcgaggtggactgtcaagcacagagcatgcatgtctctaaggcatgccacagagtttatccggggccaggatacctgtggtctagatcctagaaaggagggatgctagcctgcacatcggttgctaatggaacccttgggtttgtgtgactggggaccaatctgtgccgatgtgtgaatatgtctgctttgcttacactcaggcagtgattgcatatctgggggctaatgagctaagtttggataatggcaagagggtttcttctcaatgcgcaagagtattttgcctgcgtcaggctgactgcgggcatttccttagatctgaggttcactttttgctccgggggttcagcttctgtacacttgatggatgctggtcttaatttggtgtgttgcagtcattgcgagttgtgcaaggatattaccttaaggatattcttttgaatattaaattagaataaattaagggatgctggatattaagcctaaatcagagatgagtaattgccttccgttttatgccgttaagtttgttggaaatgcaagatatttgttttaattaccaagttgttgaaccaactctcaatgagcataggcacaaacagaaacaaataaaaacttcttggtgagtttgtgaaatgtagataacacctaattggatgcattttgttagtgcctgtcctattatcattactttcttccttcatccaacattgagtaattgactcccgactatgtatccagaaacgtaaaatgctctggggaggatattaagggctacatttttttcattgcttaattgtttcctgtatatgccagcctaagcacttgacatccctataaaatattcacagaagcactataaggtaattatgactatgaccgctatttcacagatacaaaactaaggctgagagaggatagcattagattaatattaaaacaaaaactcatacagctagaggtagggtaattccatactgtattggtaattcaaagcagataaaattgttgcctcttgaaagcctgtgcccaaaacgctttaaagaggttctttccgaatgctcaaaaacagtgtattttaaaagctgctctctgaaatttttaagatccatcagccagagtgtgatgttccccttcctgtgtccatgtgatctcattgggactgttgtggggtggggggaggggggagggatagcattgggagatatacctaatgctagatgacgagttagtgggggtagcacaccagcattgcacatgtatacgtatgtaactaacctgcacaatgtgcacatgtaccctaaaacttaaagtatgataataaaaaaataaataaaaaaagatccatcagccagtaattttacctttaaaatgttatcaaaaatgatatttttttccaaatttttattctggaaaattcaactatgtctgtaagaaatcaaaatagtataatgaatccctgggtactcagatacccagattcaacaattgccaactcacgaccaacactgtttcctttttaccttcattcccacatcccccgaacaaccaccccacatgcacaatgtatcttttgaagtagatacttttctttgttggtattttaggaaagtcttattaatgtagactttttttttatagttttctatgtgttggccattcagatgtcaatgaaaagagtcaaactctgtaaaacggtgaagatatttattctgagtgacataggagtgacacagacatcaggagatcctgagaacacacacccatagtggtcaaggcacagcctagtttcacacattttagggagatgtgaggcattaatcaaatacatgtgagatttacattggttcggtctggaaaggtgggacaactggaagcaagggtatggtgcgatgggcttccacgttattggcaattggttaaaagagttattatcgatagaaaagaatgtctgggttaggataaggggttgtggagaccaaagttttatcgtgtggatgtagcctccaggtagcaggctgtggagagattagattgcaaatgtttcttttcagacttaaggtctgtgttgatgaaatgctggctggcttttcctgaattccaaaagggagatgggtatcatgaggcattcctatcatggtctgaatcagtttttcagctcaactttggaatgccctggctgagaggagaggtccatttagatgggtgggggtggggggtgggcttacaattttatttttggtttacgcaagtctgtagaaatgggagctaattgtgatatggatatccctcagtttctgcttgctttttagaagaaactgcaatcacataccttaaaaaaggaatctacatatagaaattttgaactattcaagttcattgtttaaaaacaaatttctggatttactttcctagtgtagaatataatctgtcattgtccagattagatcattgtcctataaatatcaggtaggttgcagatacaataatgctgcgcagatctttagcctttgtattttttggtatcgtcacaaggaaagtaaaaatagtaattgaaaccgaagcctattgttggcaagaaggttaagttagcacagcacatagagcattacctggaaaatagtaagggtcggaaaaatgtaactgttacactgttgctgttgttatttttgttgttcttgccatcacttttcttgtctgagaaatttctaagtctcatccataatattaataaggattaaataaggtaaatgcctaacattctagcattaccagacactgaattactgtattttttctcttcatttttttttcctctggctatgtgtggtggatttagttggactgtttataggaggacaatctaggttaaagggcagaaaattgtatttttggtagaattggggctttgccatgttggccaggctggtctcgaatcacttgagatcagaagtttgaaaccagtttggctgtcagggtgaaaccctgtctgtactaaaaatccaaaaattagctgggtgtggtgggttgtgcctgtaatcccagctactcggtaggctgaggcaggagaatcacttgaacctgagaggcagaggtagcagtgagccgagattgcaccactgcactccagcctgggtgacatagtgagagtccatctcaaaaaagaaagtaaaataaaaaatggagaatggagattttgcccaggaatgcactgtaactgttcttgtagtcactttccttagagatctgccttgacatgtgacgaactctggaatatcaatgctaccatggggtttgttcttttcctgtcattttactcttgaagaaacagtggcccagaaaaatttagcaacctgccaaggtcacaccactaactaatggcatagctggaattagaactcaggccaatgaagagaaaaataatttattaggttttgaaatttgatatataaaaaccataaaggtttccccacttctcaaatattgcagacatgagtgtaatatgagtcattattttgggccaattttgcttgaaataacaataaattacctagagtcacaaataatatataaattggtccaaagttttaggtagctttatatatgtgtatgtgtgtgtgtgtgtgtgtatatatatatatgtagctatatatagtagacatctgtttttatctgggttaatgaatgtgctctgctttgcacagaatttaaatagtttcagaatttttctttctttttttttttttcttttttttgagatggtgtcttgttctgtcatgcaggctggagttcagtgggagtgatttcagctcactgcaacctctccctcccaagttcacttgattctcatgcctcaaccacctgagtagctgcgattacagccgtgtgctaccatacccagctaatttttgtatctttggtagagttgaggcttcactatgttggccgggctggtctcagactcctggcctcaaatgatcagcctgccttggcctaccatagtgctgggattacagatgtcagccatcatgctggaccagaatttttcactaagagggtatcatatagctggtggaagatacatgtcaaggctctttgtaatttactgcatattattcaatttcactccataaatgcataatttaatcacaactctggtttaaatgatatagcaggaatgacatgggtggaatttaaagtttgtataatttatatcatccatagcactttgaaaaggcacaggtcagcctggcctacagggcaaaaccctgtctctactgaaaatacaaaaaatagtaatcccagttacttgggaggctgaggcaggagaatcacttgaacccaggaggcggaggttgcagtgagccaagatcacgctgctccactccagtctgggcaacagagtgagactccatctcaaaaataaaaataaataaataaataaataggtacaggtaggttacctctggctatcagaggggcttgggcatgagtccttgttgctgcccatataggaaggggctgctgtgagttgctctgaccaagctaggttttgggagatgcttaaaagcaaaagctcaaactacattgctcacttcccatccgacaattccaggaacttaacaattcaggagcagctaaagctcctttaatcttctctctgtccacacagcaaaaactgacgagtgagtgatgacaatgataatttaggtaaatattgatgaagggaagaataattctctatactttgaatgaaattcctctaaatctaattcatcctcttggagagaagcaaaaaattgggtattcaggggtcttatttgtacacttcttttcttttttgaggcggagtcttactctgtcacccaggctggagtggagcgacgcgatctcagctcactgcaagctccgcctcccgggttcacgccattctcctgcctcagcctcccgagtagctgggactacaggcgcccgccaccatgtcccgctagtgtgtgtgtgtgtgtgtgtgtgtgtgtgtgtgtgtgtgtgtgtgtgtagctgggagtacaggcgcctgccaccatgtccggctagtctgtgtgtgtgtgtgtgtgtgtgtgtgtgtgtgtgtgtgttagagatggggtttcactgctttagccaggatggtttcgatctcctgacctcgtgatccatccgtcttggcctctcaaagtgctgggattacaggcatgagccaccacacccggccccccttatcgtatacttctatatgtgtatggacgcctatgtgcgtgtacgtaagtgtggagggagaaatggaggtgggtagttaaacaggaaagagtcttagttggaatttcatttcaagtctactgggatatggaggcaagaatcctcaggaaatccatcagcagactctcattccatgcatacatatatatatattcccttccttccctcccattacctccctccctccatcccctcccattccctccctcccatttcctctctccctcccttccctccttccctccctccctccttccttccttccttccttccttccttccttccttccttccttccttccttccttctctatggcttccagcaagtagattagccgtgtggaaactcagttttctcatttggaatattaggaaatccctaatttaaaataaacaccaaagtcctctaacatactgtaaaagtgccgtaaacttttgatctattctttcttcccagtaaggggaccctgctggtgggtttcctgaaggttctcacacctgtccaccaagagacttgaaattccaacagggaatctcctctacctactaaattatgcccctcctctgcccttcatacctgttgaatattataagaatgggtttatctataaagcaggtcagtcatagtaatagagctgatggttaggaaaggtggatagacagagagagattggatttggcttctgagaatgtggtaactataccaagcaagaggtagaaggcaggtgaactcatactcaccctattggaggacctaacaaataagaatgagctgcttttttttccccctaactctttcccatctggagtgcagtaagtgcaatcataactcactgtagcttcaaatgcctgtgctcaagcagtcctcccgcttcagtctcccaagtagctgggaaaggatgggcacaatggctcacacctgtaatcccagcactttaccaggcggaggtgggcagataatttgaaattaggagtttgagagcagcctggccaaaatggtgaaaccccatctttactaaaaataataataataataaaaattagccacgtgcagtggtgcacacctgtaatcccagctacttgggaggctgaggcaggagaattgcttgaacttgggagatggaggttgcagtgagccaagatggcaccactgtgctccaacctgggtgacagtgaaccaggatcccaccactgcacttcagcctgactgaccgagtgagactccatctcacaaacaaaaaacaagttgctgagaccactggcacacaccaccacgctcagctaattttttgatttttttttgtgacattttgttgcccaggctgatctcgaacccttgggttcaaaccaccctctccgtcagcctcccaaaatgctgggattacagttttgagccattgtgcccagccaggatgagctttaagaatgttgacaacatctccatctcctgggagatgaagcttcctagtgagactatcagttagagcattttcctgtggaagcatcaagaagacaagagtagactaaggcaagtgattgggtgatcaagacagagtggacttttcagtgcaggagacggtgctaggcagagttgagtggacagcgagaaggataagatggtgtctgacttggatgtgaacttgacactggggcatctctttggacaagtgaccatttagagactctcttgagagacagactc

SEQ ID NO: 116 - DNA, 3462 bp, Homo sapiens
  source 1..3462: mol_type = genomic DNA
acctttatctttctgaaaacgattgctttgttccttcatttaatatttccccacaagtgcttcgcagagcacatagtcgttgtgaaggctctatgtggcactctgagagaaggaatccttcactgctatcactgagatgaaagaaaaagagtaggacctttccctgctacgtttctgtagatttctggttctaaaagaacaaacttaaaggtaaagctcttgtgtgtgcaaaaaagtagaactccagttttgacaaagtagttaacttagacctgttagaaagtaaacttgttgggcatggtggttcacacctgtaatcccagcactttgtgaggccaaggcaggaggattgcttgagcccaggagtttgagaccagcctgggccacgtattaagaccctgtctctacaaaaaattagcaggtgtggtcatgcacacctgtagtcccacctacctgggaggctgaggtaggagaatcacttaggcctgggagatcaaggctgcagtgagccatgatcatgccactggactacagcctgggcaacagagcaagactctgtctccctcctccctccaaaaaaaagaaaagaaaaagaaatgaaaaaaaattatccttggtagggccgggcacggtggctcatgcctgtcagctcagcactttgggaatctgaagcgggcggatcacgaggtcaggagtttgacaccagcctggccaacatggtgaaaccccatctctactaaaatacaaaaattagctgggtatggtggtgcatgcctgtaatcccagctattggggaggctgaggcaggagaagggcttgaacccaggtggtggaggttgcagtgagcctattgccccattgcactccagcctgggggacagagcaaaattctgtctcataaagaaaaaaaaattgtcattgtttgaactatacatctttacctcacctggcaatgtatattaagcattattatttctatattgcaggtggcgaaaccaagccacaaatacaaaaacaaagaaggcttgaaggtctgcgactgagtagaacttaggtgtatgtatgcctctttccactgaaggaaaaataaccatgatcattcccttatattttgctaagctgggtatgtgtccggtgctctcagacctgttacctatggtactctttaatcaaataaaaccttaagttcaaacatatacaccgaaataaggcagaactactctgaaacagaagatttatggagtctctttcaccagcaacttaataacatagagatcacaatgtttcccatatacatgattttttttgttgttgttattgtttttttttgagatagagtcttgctttgtcgccaatgctgggtacagtggtgcagtctcagctcaccgcaacctccacctcctgggttcaagcgattcttctgcttcagcctcccgagtagctgggattacgggggtgtgtcaccacacctggctaatgtgttgtatctttagtagagatggggttttgccatgttggccagcgtggtctgaaactgctgacttgaagtgatccactcatctcggcctcccaaagcgctgggattatgggcatgagccacagtgcccagcctcacacgcacacgatatttacacatacatacatataaatatacatattttatatacataatgggtgttggtgcatttcataggcttgtctttgaatatcaagatttcaaactggtttgcaactgatagaaccgagaaaaataactcttggatacctgacttgaatctctctttgcccattggcggccaaagccagttgttgacgtaaagttttttttggttgttgttgctaattgcatctctttcctgacagaggagtaacctcttatttacaaaagtgtttacagttttacatacccgataggtcttacgcacatgtcaagacaaggtattgagccaggcgcatatacccctaatatggcaagagagagaacttctctgtcaacaaggcggtaataaagtgtaacagacaacacttaaggtgtcagtcacctttgcaggcgtattggaagttacaggttagatctagtggttttgatttattttgatgtcaaaaagttactcacatatttatgtaaaaagagagtggcaaatcaacggggtgttgattttgaaggtgctatgtaataaatcagggtagcgattctggtcatctcgccaattttgacagtgagacttgcttatttatggcgttttaaggtctgaggagttgatttatagttacaataacggtcttccatccattagtagttccggcatgcatagatgtgtccctcgtttgcatttaatgattggcatttttaaaattacacgactataaattgtcaagcaggaacaaaactcagtttaaaacgtaattttgttgaaacatttgttttaataaaaagggggtagttgggataaaatacatgccaactgtcctcacctgttgtccaccccaatgctatattaattatgatcctatatcctcctcattatgtagatggagaaactgaggcaaaaagaggcatgatttttctagggcagttctccaatatcaggtcattgcatttaggggctctcttaagtgcaggtgcccaagtctagccataggtgaggagatgagccccagagaacatgccctccagaggatcttaaatcatcacctgacttgagcacccagtttgaaggcaggtagaagggttcgaacctcatttctgtggattagcaactttataaccttgggcaagttgccttttttctatcaattcatgtgtcctcaaataaagaaaggtaattatcctaaacttattaggctattttaggcatcaaatttaatatgaaggctgggtgtggtggctcgtgcccataatctgagtactttgggagactgaggcaggaggattgcttgagcccgggagttcaagacaagcctgggcaacactgggaaaccccatctctacaaaaaaaaaaaaacacacaaaaaattagctgggcatggtggattatgcctgtagtcccagctacttgggaggttgaggcaggaggatcagttgagcctgggactgagatgtttcagtgaactgagatggcaccactgtactccagcctgcgcaacagagtgagaccttgtctgggaagaaaaaaagaaaaaaagaaatttaatctagaactccctagcgtacgattaagtaagttatcaataatttttttctctttcacctttaagccttccccacatatgcacacacacacacacacacacacacgtgcacatacacacactcaaaacccctgtgttctggacttactgattaattttatgagaacgttgttctgtgttccactggttagaagtacttaaaatgatcacattcaggcaagatatgaatctcacggaattaaattagctcattgcttgcttttttcaaag

SEQ ID NO: 117 - DNA, 6120 bp, Homo sapiens
  source 1..6120: mol_type = genomic DNA
attgctcattgtggtcacagaagtaacctacccaatagaagcacaccaacttgaagcatgcttccatgatcactgagggaggaaaatgattggcaagtctcgtattggtccttgaagcgctccctataaacacttgtcactgccaagcgtgtatcactggccaaagcaagtcacattgtgatatgattagactttgtgtccccacccaaatctcatcttgaattgtaatccccataatccccatgtgtctagggagagaactggtgggaggtgaatggatcataggggcagtttctcccatgctgttctcatgatactgagtgagttctcacaagagctgatggttttataaggggctcctcccccttcactcctcactcttctctctcccgtagccatgtgagaaggtccaagcttgcttccccttcgccttctgtcataattgtaagtttcctgaggcctccccaaccatgcggaactgtgagtcatttaaatctctttcctctagaaattacccagtctcgggtagtatcaagatagcagtgtgagaaccgactaatacgcatggccatgcctaacttcaaagcggctgggcaagtatcatattgctgtgtacttgggaggaggggagaatcagaatatttgatctggcgaccaccacacaactgaacttctctatttctgtgttcttcttgttaaccatctagtttctgtttcctcttgtgacacatatattaattaatttttcaatacccaaacacaagcctctaatatttatctttgtttagttacttcctaataaactaagatatctctacatcctgatcctaaaattcaaaggctccacgtataccatggtgactagttaattccaatatattgcatagttgaaaattgccaagagagtagattttaagtgttctcactacgaaaaaatgcatatgttaaatagcttgatttagccatttcactatgtatacatgtaggaaaacatcatgttgtacactacagatgtatacaatttttacttgtcaattataaacaacaacaacaaaactgcaaagtctccttagacccacccaatcacatgttgtctgctcatttaatgagtaaatgctatataggttcattctggacctgggtaaaatgatttacggactgggaccaagtgggaggaccctatttcaattcattaggtaaggtcttccaggtcaatatttgaccattgattggcacatctggggtatagttatttaactgccttctagtttacctcaatatgacccctcagtggagggaaaatggagcacaatgactagaagaatgttgagagatgaggaaagagagaatgggatggaaagaacataaaataggaaagcattgacattgtcacttcttggctatttcttcctgtaaaattttgcctggagtgccctacaatggggtccccatcctctgccctgataacatcttagtggatcactcctctctcccttttcattctgcaggacttgcccattggggctctttcagacctgactggtcattgggtatctgtggccatgataatcactctcttcctggacgtgaccctcctctcgttaaccaggatgcctgtgttcttaaggttggccgtttccaaggacagagagcttgcatcccatttctaggggactggggatccaaggactccattcttgacattgtcttgtcagccttgaagtgccgaaacccagcatccctgtctgaggtcatcctgtctctcttccaaacatgaggacttcttaaattttttaaaaaaagtttttacttgtataaattgagaaggcacaagtgcaattttgttacatggatatgttatttagtggtagaatctgtgcttttggtatgtccatcacccagatagggtaccctgtactcattaagtgatttcttatccttcactcccccacccaacccttccaagaaggatgactattactcaacagtcattcagtagccattggagaatgactattattccatactctgtgtctatgtgtattatatagttcccatttataactaagaatatgcattatttgactttctctttctgagttttttttttttaagataatggctttgggttccatcctgttgctgcaaaagacatgatttcagactgggcatggtggctcatgcctgtcatattagcacactgggaggctgacgaaggaagatcacttgagcccaggagtttgaaaccagcctgagcaacttggtgagactccggctctataaaaattaaattagccaggcatcgtgttgtgtacctgtggtcccagtttcttgagaggctgaggcaggaggatctcttgagcccaggagttcaaggctgcagtgagctatgatcacacaactgccccccagcctgggtgacagagtgagaccctgttttagtcaggacttcaagaccagccttgccaacatggtgaagccccatctctgcaaaaatacaaaaattagctgggcatgatggcgggtgcctgtagtcccagctactcaggaggccgaggtggaagaatcacttgaacccgggaggtggaggttgcagtgagccgagattgccccactgcactccagcctgggcgacagagtgagactgtttcaaaaaaaataaataataaataaataaataaaaataaaatcaaaggtcttactcttttttatggctgagtagtattctattgtgtgtatgtatatatagatatacatacatataccacacacatacgtgtatatatgtatatatatggtggtatgtgtgtctatatacacacaatgatatgtatattaatatatatgtatatataaatatatatacattttctttatccagtcatccattgattgatgcttaagttgattccatatctttgctattgtactgtgataaacgtatgagtgcaggcatcttttatataataatttcttctttggatagctgcccaaaattcaggtaaaagatctcagtctacaaggcagctcccaagcttcaaaaaattgtcctgccagatttttaaaagcaagttttctcaaaagcttcgatgtatacattggtcgatttatttatccattaaagtatttattgaatacttcttactgcgtatggtggtggtggtgctgaggtgtctcacagtgaacacaacaggcgtagcctctgctattaccaaaattattgtctggtaaagaatgcagatggctaaccaggcaggtgcctgtacggtgagatatgtgctgtgatggctgtaagcgcatggtgtgagcgtagagttgggtgcttaattgaaggcatcaggaaggcttccaggactaaatgatatcaaagtcccaccttaaggatgacaggtttaactaagtaaaggaggatgtggaaagaagggggagagtgctccaggcagaggaaatagtatatacaaaagcacaagaggattgaagaaccaaaatcactttggcatggctggaatgaagggcatgtttgtgtattttcagggtaggggatgtgtttagggacaagctcagagaaaaggaagtaaggaaccctgtcataaagggctcatctgtcctatgaaagagtgtgtacattttattctgagagtacagagccttttcttttttctaagcattacatgattagatttgtcttttagaaaccactctggctgccgttaaaaatgaatttcacagtgacaaggctggaggaaggatcttgggttaggaggcggtggtagtaatctaggcaggacttgaggacgcctgagtggtggtgaggaaggagagaggtggatggaagattcaagagatatttagggggtgttattgagagaacttagtgattgatttggcgtgggaggaatgagaaagtcagggatggctccctggtttctggcttgggtactaggtgcgctggtggtgcttttgacagagatagaaccatgggaggaggaacatgttttgagggaaggctgtctcccttttagacacctagttggtgtccaaatggcacagaccagttggcgtgtggatatcttggggcttagggcgtggatctgggctcagggtggagatctgagccttagctgcacatcagtagtcattgcagtcatggagtgtgctggggttttgccaagagctcatgtagattcaggcgagaagagaggaggggcccaggctgggaatactggctttggaaatactcttgaaatatatagaaatgaaagaatgtatagggctgtttccacagacgtttattttttatttttatttttttgagatggtgtttcactcttgttgcccaggctggagtgcaatggcatgatctcagctcactgcaacctccacctcccaggttcaagcaattctcctgcctcagcctactgagtagctgggattatagatgcccacgaccatgcccggctaatttttttgtatttttagtagagacacggtttcaccatgttggccaggctggtctcgaactcctgacctcaggtgatccacccaccttggcctcccaaagtgctgggattacaggcatgagccaccgcgcccggcccacagacatttactgagcaagagcttgtgcaaggcactctggtatgcatgcagtcggggaccctctgatgaatggaactcaggccttgtataaggaagtgacctccatcagagggtggagacgctgtcagtgaacatccatcacagacaagtgactgagctaggagctggggtaaggtagaaagaggaggacagtgggcgatatgagctgggaaatgcacctctgttgggggactggggagggcttcctggaggaggtgattttggtatctagtggttttgttttgttttgtttgttttttttgttttgagatggggccttgctcttgttgcccaggctggagtgcaatggcatgatctcggctcactgcaacctccgcctcccaggttcaagcgattctcctgcctcagcctcccaagtagctaggattacaggcgcccacaaccatacctggctaatttttgtatttttagtagagacggggttttgccatgttggccaggctgttcccgacctcctgacctcgtgatccgcccgcctcggcatcccaaagtgttgggattacaggcgtgagccactgcgccaggcctgtatccagtgtttaaggagatgttttgtcagataaagctggagttttgtaatggagttttggagatggggaagggcagactggcttaagagggtgctgcataagagatggctcagaggagagaaagtgtacgatgttttcaggacaaattagtccttcaccatggcaggaatctaggcggccgaaggacatttgtgggaaattgtagcagaaaatacgaggaggactttgatgccaggccacagagtttgcagtcctttttggagactcaggggagttattgaacaattagaaactaaaggctgatgtgacctccacaggatactggctaaacgcatgaactcttgaaccagatggacctggatttaagtctggattctgccatttccttgctgtgtggtcttaggcagattattaacctctctgagcctcagttttctcatctgtcaaataggagtgaaatacctcatagagggttgtgaagagtgaagtaaactaatgtggagaaggcattctgcagtgtctggaattcagcgacccctcagtacatgttaacacactaatactttctacgtaatcatacctgtaacaacacagagacgatggtattatctttacagcttgttcgcttctgtatcctgagcatctaggacagtgcctggcatgtaatggatgctggagaaatatttcttgggcaagaaatgaattgcaccagtttctttttgtaagggatctatttttttcttgtctggaaaaatactttgataaaaccttagggaaaagatgaaattccctttcttctggagcctagatttcaaagaggagaggttgagtgctctgcaaagtagaaggagaagattttgggcagtgaggaggagagaattgatgagatggtggggcacagcgtactatgaaatgtgactcttcccccggg

SEQ ID NO: 118 - DNA, 10654 bp, Homo sapiens
  source 1..10654: mol_type = genomic DNA
aatcaagtgtcagagaccagagatatgaggtctcatatatatatatttgctcagggcagggggctggttttgggtgataattaggggctagactgaacagaattagtgtttggaagtgagtggtggtggtggtgagggaggagagaagggtgagtcccagggtaagggatgcaggcacatcctgagaaatgaggcagaagaatgagaacttggcttggggcatgttctgttcatctgaatggtggtgctgaggagacaggtggacagagaggtgtggggttcagggaggagcacaggactgagagggaccagcaggaatagaattcctgaagtcccttggattgacaagatgcttcagtgagagagagtccacagggtagagatcagcacctaggacagagcctcgagaacttcctctaggatagggaagggctggagaacaggaggaggagccaaggagaggaggaaggggccaagagggcaggatcaggactgaggcaggccgacttctgcgcagttgaagaactctaatgtcagagctgtccttaggaggcagagaacccctcgtcctggaagagtgcagggagctgcttggtgaccatcctttggggatgtcatggaaaagatatttgcatcaatctggggtgagattaggtgtctggattggttcaggttcttttgtcatttgtaagcacacaaaagaactctagttatctaaaggaaaaaaaaaactggaaatattatgggttggcacacgagtggtgccaggcctcagagagtacagggcccagggtggctctggggatctgggtggcaggagcgaatggatgaccttcacagggtgacaccatcgggaggaatcagctccagctgttttctgtccttgtcccaagaatcaaatcccagggagaacagtgtgattccccaatgttgtgaggttcagtcatgtgcaaggggaaagccgggcacctcgattgacagccccaccaggactgcataccgtggagaaaggatggcttcccaaagaaaaacaacattccagctaccagagaaaagggagtggacgctgggcaggcaaagccaacagacactttttgtagtctccatggtcctgtgtatgattcagtgatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaag

SEQ ID NO: 119 - DNA, 14280 bp, Homo sapiens
  source 1..14280: mol_type = genomic DNA
gatttttgcagtattcacttagcaagtcattcctcgttgcagaattgttgctagtgtttttcctggctggggattaagctttttccatttgcctattttagagtgagttgggggcctgggattgacacgcatttgtctctgggcttcaaggtagcccagagattatgccacctcaggaggcacaatttggtggctgtcactccttgtcatgtcaacaaagggtgtggcttgtggctctgtggcctctgctttaccagcaaggggaggatgctggtagtagcaaagggtctaaatcgctgttgcatcagcgaggtggatgtgcctatcctaaaggcacctactgagaagatgcccaagtaacagacactcatgggcacagtagacctgtcaaacctcatagttcctggctgactctctttgggtgacctgagtcacacgcccacgcctgaacacccactgaaactcctaggtgcattacgtcttctgcaatatctaaaggaattaagggaaggatgaaactctgtatctcaactttcctgaattcaccagtatggactgatggaattgagtgctagtaacaccaagctcctaaataataataataaaggcttacttataggaacgtacgaagcacaagagaaataagggcccccacggcccacccttcaacttctcacatttggtttgttagtcaggactcctttggtcacaagagacaaaaaaaacaattcaagttggtttaggaaaagaggcatttattggcttgtacagaggagttgagagttctttaggtctggctggatttaggtgctccagcatggtcatggggcatctcttggctcagcttttctctgtgttggcttcattctcaaaaaaacttttccttggtgatggtaaagatggcagatgcagcactttgggagcctgaggcaagaagaccacttgaggccaggagttcgaaaccagcctggtcaacctagtgagaccccatctctacaaaagaaaaaaaaattcaggtgtaatggtgtgcacctgtagtagctactagggatgttaagtgggagttgcatgaatccaggtgctcaaggttgcagtgagccataatcgcaccattgcactccaccttgggtgacagagtgagattctgtctcaaaaaaacccacaaaaaccgcccccccaaaaacggatggcagatgcaaatttattccctaccagtttaacaactctgctggaaaataaaccctctttcctaataattccagcaaaagtcctgaagctgattctctttgggtgtcctgagtcacacgcccatgcctgaatccccactgtggcccaggtcccatgtccacccttagagccagaggatgagggcagccttagctggcccacacaatcagtgagccagtgaagagcgattcctcacaggagaagcatggaggatgggtgctgtcaggcagaaacaagacatgccaccacacttggttttggggttaggcctgcttctggtctgagcaatctgctgctggatatggctggtgagtgaagagatattgatgtgtcatccccttagaccatggcattgtgtcctgctctctgcatctttgggggcctgatcaaaagcgggaagtcatggggtcaaggacagtctccacgtgccacccaaacaggaaggatgtccccagcaggtgttctgctcagggtctggctctcccagggttgttactgcagagggaagggtaggggcagctttcttctggtggatttatttacttctcaggcctgttcttttcctcatgttggctcaactgttttatcttgcttagttaaataaatttggtaacattataaaggaaaacagtcttttccggcagttgctgaccactgcaaaattactgctctttcttttgtttttcctttttagtgctgggctgtgaataagcaaatgaagtttgctatctcttcctcccctcttccaggaagaaataatcaccatcagaactttaagagtttcccataagactgggcaaattagaggaaggacctctatacggtggaacagatgcaattgtgcaaacagaatggggttattctctacatatggagatggaacagaccctcccagatgtgttagtgtggggaaaagcaggtggtggaggtgcgttcagagtagcagtgttcagctctcccaagcacattcaaatcacccaggagcttttaaaacgtactgatgcctgcccaccaccctctcctcacagccccattaaatcagaatctctgggagtgggacttgagcacttttcattttaaaagctccctggtgactcctggggagccaggactgagaactagtgctgtagaattgtatatgggcaaaacagcagggatctagataaaaaaagaaaactgaagtagggaatatctcagtccgtacctacagatagcctcacacatgtggtcgcgcatacagagaacgtctctagaaggatacacaggagactggaaagaacggttctctccagtgatgaagtacagtggtgattctcaactgtatactcgtttgtaatgttggaattttgaagccacaagcataaatgctcactgtgtactgaaagctggccagacagggctgtaagatgacccctgaactctagcttgtctgtgttggggccggctgcccacagattcacacaaaccatctccctgcccgtggtctctgcttgccctcctctactcagctgcaatgagtggtttccgagtgtgggagagaccagaagagctcattcattcattcattcgctcacatttttagtaagaattaggtataagccaggcacgtggtaggcacgtgaatctgatctcaccttcacaaccgtatgtgaaattggtggtcttatctccattctaagattggggatattttaacacagaaattcatacaaccaagctgtaaatatttgaggccgaatgaccagctaagagagcttataaactggcagcacttagatgtgtttggatggcctgtacagaactttttaaaaaaatcctatttcacgactctggaccagtgaacccagggccactgttggctagagctgagtgtcccttggaagggcatatgcccctcagttcagcgcagtccccccatatcccttcccttctgtgtcacaccagccttgcatcactcagtcacaggcctagcctctgcaggcatttgcgtttgtcacccctgtgttaaggtaggtaggatgagtgaactgtcgtctgtcctgcagggatgctgagctgaagtgtcctgtggaatgtgccatttctattccaatctggccctctgtctgctggctggaaaaccaagctcctttgctttaagtttcatttgtggactgcatgggatgggctgtgggtattgatttgtttgtggaaaagatgtgcacaatagggaatgtgtaaaatacatcatggaaatggatggttaatgccgcctggctggagtgtggggcagtggagtgacaagagatgagagtcaagttagatggtggggtatactgtgggtagatgccgggctaagcattttgaactttaacctttaggctactgctgtccaataagactttctatggtgctggaaatttcttatatctgtactatccaatgttgtctccagacgcatgtggcatcaagcacttgaaaagtagctggcatgaatgaagatttttattggcattttagattttatttaattaatttacttttacatagctccatgtggctggtagctaccacactgggcgctgcagatttaggcaatagcagtggatgtgttggagcagggaaataatatcaaagctgaatcttcagaaggtgatttttccaggagtgtacaggccgcatggggtgagcagaagtaggtagggataatattgacacttcttagcatctattaggcacttcttgtgtccacacactgtgctaagataactcacttattcctcataacaactctatgaggaaagtactatcattgtccctattttatagactagaaaatgagacacagcaaagacaatgggcatattcaaggtcacacagctaatcaacagtggcacacggtgtagaatccaggcagctcagctgtagagcttgtaccatgaatccttccatcctggaaggaaataaatgaaccttcattgagaatataccttctgctgtcccctggtgctgggcattcacacgtaaaatctcatttagatttttgttaacactcatgtgccattcggtggatttagatcctttgtgtttatggaaacttgggctcatagggatgagatatcaaggcaactgcaatctctgtggacaccagttaaggctttattgtaaaattccatgcctgtgggggaaatcacaggctgtgggagtcggggggaatgtacaggaagatatggcataaaaggtgttgcgaaggaagaatcagtgggatttagcaactgactgaatggcgggggtgaggaaagcgggggaggctttctcctggaacagtgagatgaatgacaaacacacatgtaactgcactgtgtgagttgagagtgtgggctctagaggaagacaaactggtttcaaatacaagtgttaacacggactagctgaacaaccttgggcaaattacttctctccgagcatcagtgtccctgttaatataacgaggaccgaaggcaggaggatcacttgaggtcaggagtttgagaccagcctgggcaacatagtgagatcccgtctctagaaaaaacttaaaaaattagccaggcatggtgatgcatgcctgtagtcccatctactcaggaggctgaggccagaggatcacttgagcccaggagtttgcggctacagtgagctgtgattgcaccattgcactccagcctgggtgacagagcaagactttgtctctataaaagatataatgagaatcatagcaccttcctcacaggactgtgatgaggctcaggttaagcacggatatgaaagccctttgcaaactcaatagcatgaccctgtgagtcactcttcttagtgctggtgagaccagccattgggcagaaatggtgaccagaactttctgtctttgatcatggaaacagttcgggaaattgcctgggggaaccccacttcatcttaggtacttggtagagtttaatgcggataagtctgtgggtcagctttgacctaggaggaaagagtggttctcccagcagctgtagagcaaaatctgcatgccagtggctccaacttaaatgcccttttccaccaaacagtttgcatgtgttgtcttatttgagctgcacaacaaccttatatacataggtactgtgataaaataaggctcagagaggtggagacactgagctaatgtccttcagcttataggtagtaaaatgagtgttcaaacgaaggtcctcctgcttccagaaacttagcctgtaattcctgtaggtgatgggcttctcatttcttctcctaccacagatatctgcaactagcgctagaatttctatcccagattgacatggatttaagggtaaaggttgcttcctaagaatgtcagttttccactatagaccccagtaagaattgtgtacaagaggggaatcgactccaaacagaatatatatatatatatgatttaatttagtcctctttggaatgcaatgagtaaattttagtggttagagtaaaccactaaaatttgggagttaggggtgaagtgcagtgtgaagcagagttgagatctcagtgcttttcctggggcagaaacatccgagagggcccctgtcacccaagcttttggctacagtctactccttccatctgggattaaccaggcgtttcttatccttgctgatctagtgtttcttattgctgctgtaacaaattaccacaaatttcctggcctaaaatggcacacatttattatcttatacttctagatgtcaacattctgaacagcaggtcttccggggctgaaatcgaggtgtcagcagggctgccttccttctggaggctctaggggacaatctgtttcttaccttttctagaggccacccacattccttggcttgcgttcccttccagaaatggcacaattccaacctctgcttccatcatcacgtctcatcctctgactccgagtctcttccctccctcctataaggacccctgtgatcacactgggctcatccagataatctagtataaccccctttctcaagatccttaatttaatcacatctgcaaaatcaattttgtcatgtaagtaatatattcacaggtcccaggattaggacacggatatctggtggtggtgtcagggggtcgggggtaggggatgggaacattattctgcctacagagctggcaggtggcctttcttctttcctttcttttcctttcctttccttcccttcccttccctttcctttccctttcccttcccttttttccctttcttttctccttcccttccttttttccctttctcttccccttccccttcccttccccttcccttccccttccctttcccttccccttcccttccccttcccttccccttcccttccctttcccttccccttcccttccccttcccttccccttcccttccccttcccttccccttcccttccccttccccttcccttcccttcccttccccttccccttcccctccccttccccttcccttccccttcccctccccttccccttcccttccccttccccttcccttcccttccccttcccttccctttcccttccccttcactttcccttccccttcccttccctttcccttccttttcccttccacttcccctttcccttccacttccctttcccttcaccttccccttccctttcccttccccttctctttcccttccctttcccttccctttccttttcccttcccttccctttcccttccccttcccttccctttcccttccctttcccttccccttccctttcccttccctttccctttcccttcctcttcccttccccttcccttccccttcccttcgccttcccttccccttcccttccccttcccttccccttcccttcccttccctttcccttctccttcccttccccttcccttccctttcccttccctttcccttccccttccctttccctttcccttccctttcccttccccttccctttcccttgcctttcccttccccttcgcttctgcttcccttccccttctcttctcttttcttttttttctggagtcagggtctcattctgttgcccaggctggagtgcagtggtgctaacacagctcactacagccttgatttcccagcctcccgggttcaaccaattccccccacctcagcttcccaagtagctgggaccacaggtgcccaccaccaagcctggctaattttaaaaattttttagagatggagtcttgccatgttgcccaggatggtcttgaactcctgggctcaagcaatcctcctgcctcgacctcccaaagtgctaggattataggtgtgagccactgcactcagctgcaggtggcctttctgatcttgcctgtaataagggagggtgggaggtggatagagccggagacatctttttcattctctgctggagctgagtagcaatttccccttttaaacaggccatgtgtgcagtcccctacctggccgtcagacattttcattgctcacctggcccctaggcatttgagtttcagaccccattttgtagttctagtaaagccttgctatagactggggtcagagggctgcaggctttcaacctttgtagagcaaggggttattgaataaattatgaagcatctggagattctgggctcttaactgggtacctgtttgaaagtagggtctagtacatttttttcagtagctcagtaaatgttgcctcttcttaaaaaaaaaaaaaacagaaaacaaaaactggtcttactctgaatttgccaaatagaaatgagggggcgtttatttgtgtcacaaaaggatttgatttctttaaataggcagccctactattttcttcaaagtgttttagttaatgggaaatttgatttgcacaacttttcagaaacacactgtgtaaaggaattacctgcaccagaagctcatgaggtttttcaaagtctgttctcagcttctctgcacatcatgctggggttcacttggcctattgattctgcctcagtggggatggactattcatttctgtgggtaattggaagcctacctaaagtgaccttgtcaatggttggattgacaaatatccaggctggtgggatgtcaggcgatcatccaggagctacatctaccatgaagttggttatgttttctcctttttctatgactgatgatattcattttttggttcattcattcaccaaacatttatttactgaatatcaattatgtaccaggaattgtggtagacactaggagactagagatgagctatctttatccccttctgtctccaaaggggataaagatgaataagataataattgatttttttttttgagacagagtctcgctctgtctcttaggctggagtgcagtggcgtgatctcggctcactgcagcctctgcctccctggttccagtgattctcctgcctcagtctcctgggtagctgggattaccggggcctgccaccacactttgctaatttttgtattttttgtagagaataactgatattttagatgtttggaagaaaggttgtagaataaagcacctacttgaaaatgggggaaactactttcctaaatatttctgggtcaaagaataaattaaaaccatactaatagaccacttagaaacttgatacaatgatgggactaaatataaaacataggatgcagccaaaactgtacttaaaagagggtttttagccataacatctttaaatgtttaatgaagaggaatgggaataaattaattgagcagtcaattcaagaagctttaaaaagaacagtggataatattagctgacatttgtagaatagtcatgatatggttggcatggttctgggcatggaataactcatttagttctgacaacaccactgtgatatgggtcctattgttgctgtcattttccagagaggaaactgaagtacaggaagatgaggtagtgtacctagtcttagagtttgcaaatgatagacacaggatatacacctgatcatcagactccagaattcacattcccaaccaataagtaatacaaatacaagtaagcaatacaatcacagacacacagaacaaaaaaagttaaagtagcaattaataaagtaggctaaaaccaggtagagttgataaatataatcataatctgcttctttaacatgatagaaagataaaaatagacaagaaagaacacaaacttctggaaaaaaaataacgagagactacctaacaatgcaatatgaagaaagaaacaaagaaagagaaaaggtgtaatatcatcccagataagatgctacaatttaaacacgttgagaagaacactgtggataatttccaaggaaaatataaattccaaaagtttgtttgagtagaggtgaaaaactttcctgtgtggttgaagtgtagagagggagagggaggtgaagctggggaaagctcagggatggggcgagactatgctgtcatccctttactttcatgttgaataaaagggaaagttaaacatggaactacgacagggggaaaagagagaataataaaaatattatttggggtaatacggttttctatctggaaaactcaaaggaagcaactaaaactccacaaaagctatttgagtttttttaaaaaatgctttaaaataaatatgctaacaatctattgctttcctattgtttttgtttgtttgtttgttttgtgttttgagatggagtctcgctctgttgcccaggctggagtgcagtggcatgatattggctcacttcaacctccgcctcctgggttcaagcaatctactgcctcagccttccaagtacctgggactactacaggcacctaccaccacgcccagctaattttttttgtatttttaatagagacggggtttcaccatgttggccaggctggtctcgaacttctggcctcaagtgatctgcctgcctcagtctcccaaagtgctaggattacaggcatgaaccactgcgcacagctatttgctttcctatttttaaacaatgaccagttgggaaacaaaatgaagacatgtcaaatttacaatagcataaaaaagaatcccttagatgatgctaaagggaaaatgtgtaggacttatatggagaaaataagagttcaacaaggggacaatcatttcctgatggaaagactcattgttgtcaaggcatcaattatcttgaatttaatttctaaatttaacacaatttcaatcaaagtcccaatcattttttggaggctgagggttgactgaatacaatcccaataaaaattccattggtatttttaaaatcttgataaactgattctaaagtttacttggaagaataaatatgcagtgatagccaagaaaatgttgaaaataaggataatgagggtggacttgccctgccaagatataacatattacagagctactataattaaagcccatattgctatactagaagacagatcagtggcacagaatagaaggcccaaagacagaccccagtatatataattattaaacatataataaagttggcatttgaaatcagtggggaagggatgaattattcaataaaggatgctgggacaattggttacctctttggaaaaaaatggcaaattggattcccatttcacatcagattccaagaaattagacatggatcaaagagtttaaagtggaaatgatgccatataaaagtacaaaaaaactccaaagagtaatatttatatgaccttggagcatgaagaaggctgtttgaggtgtacttggactgtctttctttgtccagttttcccttttagtggtttaaaaggaatacatagtagtttttatatttttatttatttatgtatttatttttgaaacagggtctcattaggtcacccaggctggagtgcagtggtgcagtcatggctcactgcagccccaacttcctgggctcaagcgatcctcccacctcagcctccggagtagctggactgcaggcatgcaccaccatgtctggctaatcttttattttttgtagagatggggtctcactatgttgcccaggttggtcttaaactcctgggctcaagtgatcctcctgccttggtgtcccaaagtgctgggattacagatgtgagccaccacacccggtttctattcttatttttaatacttaattgttaacacgtatatttaaacttataatgtcctatatgcaatttctcaatatcaataatcttttgaggaatataagactcagcacattttcatcttgtaaccctcctgcaactcccatttcttatgacttgggttttctctacttctctatctcttcctctgttgaaaacttttcatattatggaaaaaattaaacatatataaaagtaacattagtataatgcatccttgtgtatgcatcacccagttcaataatgacccatcatgatcaatttctttttcatctgtaatcctcccctttctctccccaccttggcatactgaattattttaaattattttatccataaagatgttaatgtatcctcaaagataaggattctataagcaaagaaaaacaagaccattatcacaccaaatatttttcattccctaatatcagtaacaataattcccttatgtcatcagaaagtgagtatatccatttccctgattgccttacagttttttaaactgttggtttttttccacttagaatccaaacaaggtccacatgttaaatttagttgatatgggttgataggtgcagcaaaccaccatggcacatgtatacctgtgtaacaaacctgaatgttctgcacgtgtatcccagaatttaaagtaaaattaaaaaaatttagttgatatgtttcttaaattcctttgaaaatatacgtttctcgtcctattttctccccacttgcagtcctctcttgtagtctatttgttgaagataccatattctttgccttgtagttttctacattctgggtatttggttggggtgggggggggtgtgtttgctgatcgcatccctgtggtgtcatttaatatgttcctctgtcacttgtattttctgtaaatctgtatttgcatcaagagacttgaaccaatcatatttgattatttgacaagtgtacttcataggtagtgaagtgagctttcctctgtaggcaagtggtatctttttgtgaccttagcaaccatagatgaatgtcacctagactcattgtgtcactagggatggccttgaggtttcctgttctattttcatttactaagcatgcactttagaaaggctctgagctgctccctgaagcatggcacccgtcctccagaaacccgcagtctagaggttgtaaaagaagatttgaacaccaagactgtaaaagatgatttgaacaacaacaacaacaacaaagcagttttattttgtatacattctttcattgtacctcccccagagggatataacctccaaataggggagccataccatagatgcattaaattcacaccaattcaaatgtgtgtatatatgtatttgcttgcagactactaaagtgacaatgtaaacgttgctgcctatttttcccactcttctattagattgacgttgcttttggtgagatggggcatgagtccaccatcctgtcccctctgtttccacatgaccctcatcgtatgaacacctctcttaagtgtgattctaggatttaaagatacatatttcttatgcattatgcacctaaacacaagccaactacttcatctggcacctgatccaagaaacaacattctgttccaaaatcaatagaagacaaggcactttaagggatcttcaagggagtgtaattttgagcatatggaatctttctaaccctagctaactttagaagtttaactcctatgcaagatgaagcatctatgttcccaagagtttgacttcagcaaaggacaagctgcagaagctgacattattgtttattttggcataaaggctttacttgttggtgaagttcaagtttaatgatctcttcctccctttctctctcttcctcctctccgctttccttcttcccttcctcccaccctgattttctcttttgcagtttgctgctttgtggtgcacaagcggtgccatgaatttgtcacattctcctgccctggcgctgacaagggtccagcctccgatgtaagtaatgggcatcgattgcttttctctgtccacagtcaatgctgccttgtgattaaatgtgagtgagcattcttagacgagtaagtgtggacgatctcactctaaggcatgtggtggtccctatagcttttgagacagttttccttttagtggaaaacaaaattttggagggagtgtggctggataggaagtcagctagtttgtctactatgattttgctaatgtcttcactttgagagctggagcacggagggtgagaggcaggggcctacttggtagtgtggctgcaaaaaggtagtttcggtggtactttgcagtgcacgttatggcactttgttagggtgttctttcttttgttattgttattattatttttattatttttcagatggagtcttgctctatcgcccaggctggagtgcagtggagcaatctcagctcactgcaagctccgcctcctgggttcatgccattctcctgcctcagcctcccgaggagctgggactacaggcacctgccactatgcctggctaattttttgttttgtatttttggtagagacggggtttcaccgtgttagacaggatggtctcgatctcctgacctcgtgatccgccgcctcggcctcccaaagtgctgggattacaggtgtgagtcactgtgcccggcctattattattattatttaagagtgttgcccaggctggtctcaaattcctgggctcaagcaatcctcctgccttggcctcccaaagtgttgggattccaggcgtgagccagtgcaccctgcttgttagggtgttcctaatatcagggcccaggaatgaggagga

SEQ ID NO: 120 - DNA, 5917 bp, Homo sapiens
  source 1..5917: mol_type = genomic DNA
tgttcctgtgtatccacacactatctgtccataaacattattttttatttgaggggcttcccatacatattgctctacaacttgctgcttttcccttaacatgatgtcctgaacatcactccctactgaacatatagagcatctgtcttgcatggatgtgcctagtttagttttccagttgtaaaccaaaaagcaccagatactggtctcaatcaatttacaagtttattttgccaaagttaagaatgtgtgcacctgggagacaggtctgtacctttctccaaagatgattttgagggcttcaatatttaaaggggaaaggtcagatattggggaaagaggaattttttttttttttttagacagggcctcactgtgttgcccaggctggagtgcagtggtgcaatctcagctcactgcaacctctgcctcccgggttcaagcgattctccttcctcagcctcccaagctgctgggactacaggtgcgcgccaccacgctcagctaatttttgtatttttagtagacggggtttcaccatattggccaggctggtcttcaactcccgacctcatgatccacccgcctcggcctcaccaaagggctgggactacaggtgcgagccaccgtgcctggcctgaaagaggaaatttttaaaaggcatgggtaggtaagaggcaaatggctgcattcttctgagtctttgataagcctttcacatgttagagggggatagaggactagtcacttatgcattcatctagctcagtgaatatgcatttttacataagaaaaaataaacatagggcagaggaagcaatgagatatgcatttgtctcaggtgagctgagagatgactttcagtgctgtcaaagcccagcacctgtgaagataagctataaatttacattgtcactgaaattccacacaactgttttagggtacagatttgggggcacacaaggaatttcctagtgggcaagttgtgagggccaggccatatctagcttttttatctttgtagttatcttgtttaagaataaaatgggaggtaggtttccctgatgcagttctcagcttgacttttccctttgacttagtgactttggggtcctgagatttattttcctttcacatagtaacctagagagagacactcagagtatttccaattgtcatctatgacaatcaatgctgccattcacaactttcccaaaaggtccgcagatcccctccccattacggagttggaaagtttcttcccaaaggatccacgtgatgaaaccagcgcaaacctttccaactgcaaatcgaatggcagctgcttccgcttgggcaaagcgtgatttttttttttcctccatcagtggatttttctccagaggaaagcggaagctcctggtgccgtccagaaggtgttaaaaaaaaaaaaaaaaaaaaacccaaacgagaaaacaaacaaaaaagctacacattaacctattaacctggatcccggagtcccagaaaacgggcctctgtctttaaggcgcttcggtcctctgggagttgtagtttcgtgggtcctggagcggcccccttcccatctcccttctggattgcagccccgctgcccttcaggaaagcgctgccccggccacccacgctggcctatgcggtggctccgaccgtgttttttgccggacgggggctcggccttgggggggcgcggaggtgaaactacacttcccggagtgcaccgcgagggtcgcgcagcctcgcgttaaagagcccgctccgccgagcgccgggcgacggcaggtacgtcagtccgcgagggtcgccgcagcgccccttgcgccccttgcgccccttgcgccccctcagctttccggtgcaccctccctgactgggagcaccgagtcgacccgcgggccgcccgggtcctgacagggaagagtccccgggagctctgcggtgccccgggagcccacaggtgtttctacgctcccgcgtccatttggcctgggtcttccaaggggagccccgcgacccggctggtgcggccggacctgctggcagctgggaccgggagggatgcgggcctcagaggatcctcaccctgaggcaggtggggccctggatgccggcgctgctctgattttactttgaggccgcttctcctctctcagtttacccggccagggctcagtattatgcacaaatctcaatgatgtgctcttgggtaatttacaaaacgattttactcccaagtaacttctttcggtctgttatttagaaggcagcaagtcagagtcctccgtgagcctttttttcctctttaaagttctaaaatgtgcagtccctgacccacctgtcttcaaaaggttcatatgaagagttcttagtactttattctatctctggctccccaaccctatcccagtcttggacagcgtggggctgaggacactaaaaaatatttcaacttgatctcagcagatgaggctgtattgaaagtgggtagaggctgggcgccaaggctcatgcctgtaatcccagctacttgggaggctgaggcgagggaatcgcttgaactcaggagatggaggttgcagtgagccaagatcacgccactgcactccaccctgggcgacagagcgagactacgtctcaaaaacaaaacaaaacaaaccaacaacaacaacaacaaaagaaccttagggccttagggcacactttctcaggacctcttgagattgtgtaactccagcaaactattaattaaaaaaaaaaaaaaggccgggcgaggtggctcacgcctgtaatcccagcactgtgggaggcggaagcaggtagatcacctatggtcaggagtttgagaccagcgtggccaacatggcaaaaccccctctctactaataatacaaaaattagctgggcgtggtggtgcacgtctgtaatcccagctacttgggaggctgaggcaggagaatcactttaacctgggaggcggagattgcagtgagccgagatcgcgccattgcactccagcctgacgacagagggagactgtctcaaaaaaaaaaaaagccaggcatggtggcttacacctgtaatcccaacacttaggaaggccaaggcgggaggattacttgagtccgggagttgtaggtcagcctgggcaacaaagggaggccccatctcaacaaaaaataaaaaactagcaggactcatgcatagtcccagctacttgggaggctgggatgggaggatcgctggagcccgggagtttgaggctgcagtgagctgtgatcacatcactgcgttccgccctctggtgacagagccggaccctgtttctcaaaaacaaaacaaaacaaaacaaaagcctagcctgcctgtgctattaaagcaatggcaaaagccaaaattacttttgcaccaacctaatagctatgtttctgctttttaaactacagttttcttgtctagagcttcagtgagataagaaccaattcttaggactgttgggtgggtcatatgaagtgacactgatgtgcctttgccatagtgcctgaaaaagcactccatatgtattagctacttgtatcattttaccttttttgttaatctctcaggggatgtccctcagccttgcttgattcccgaggccttccctgatttttttcttcttcaggacagtctttaactcagagaatgtttgagagcttccagtccttcctccttcagggacaggttaaactctcctgcttccttgcctggctggaaggattatcattcattgagccactggtgtgtgccacatactttacattgtatttcatgctgaaaacagtcctgggaggttgatgtctttggccttaaatttcagattaggaaactgaggcttagagaggttaagtaactgctgggcatggtggctcacgcctgtaatcccagcactttgggaggccgaggcaggcggatcccaaggtcaggagtttgagaccagcctggccagcatggtgaaaccccgtctctactaaaaatacaaaaaattatccaggcatggtggtgcgcgcctgtagtcccagttactcgggaggctgaggcaggagaatggcttgaacctgggaggcggaggttgcagtgagccaagattgcgccactgcactccagcctgggtgacagagcgagactccatcttaaaaaaaaaaatagattaagtaacttgctcaggatcctacaggaagcaggaagaggtagagatggggacagagccttttgggactgatacgcaacccaggactgttcctctgcccctgtcattagtaagggatactctccccactctggccatgacctgtcacctgcccatgtctctctatcactatgctgagatgaagactgggctcagaacttctgggccattggactctctggggcatttcttttttttcttgagacagagtcgctctgttgcccaggctagagtgcagtggcgtgatcttggctcactgcagcctccgtctcctgggttcaagtgattctcctgcctcagcctcctgagtagctgggactacaagcgcgcatcactacacccggctaatttttgtacttttaaaagagatggggttttggcatgttggccaggctggccttgaactcctgaactcaagtgatctgcccactttggcctcccgaagtgctgggattccggatgtgagctaccacatctggccatttcaagggtttctttctttctttctttctttcttttttcctcagacagggtctggctttgttacccagggtggaatgtattggtgccagtttactgcaacctctgcccccagggctgaaacaatgcttccgcctcagcctcctgagtagctgtgactataggcacattcactgtgcctggctaatttttgtatgtgtgtggttttttgtttttttttttttggtagagatggggtttgccatgttgctcaggctggtctcaaactcctgggctcaagccatccgcctgtcttggcctcccaaagtgctggaattacaggtgtgaaccactgcacctggcctcttgctgtctttcagtgcctttgcttgggaccagatatcattatcactatcacctgaataaggatccaaaagacccaggtgtgttgcaactttgactatagcgtctcctggcctctgtgaagtggagataataggagataataatacttatcttgcagggtctaagggtgttgtcaagataaaaaaaaaaaatcacagcaccttaactgtggtccagagtgctcagtcctagtggctattattaattttttttctttctttctttcttttttttttttttgagacaaagtctcactctgtcacccaggctggagtgcagtggaacaatctctgctcactgcaaccaccgcttcccaggttcaagcgattctcctgcctcagcctcctgagtagctgggattacaggcacccgccaccatgcctggctaatttttgaatttttggtagagatggggtttcaccatgctggccaggctggtctcaaactcctgacctcaggtgatccacccgcctcggcctcccaaagtgctgagattataggcgtgagccaccatgcccggcctattaattttaattttattttttttgagacggaatctcactctgtcgcccaggctggagtgcagtggcgtgatcttggctcactgcaacctccacctcccaggttcagcctcccgagtaactgggattacaggtgcctgccaccatgcctggctaatttttgtatttttagtagagacagggtttaccatgttggcgaggctggtctcgaactcctgacctcaggtaatcttcctgccttggccttccaaagtgctgggattacaggcataagccaccatgcctggca
